United States Patent 6,812,339 (POLYMORPHISMS IN KNOWN GENES ASSOCIATED WITH HUMAN DISEASE, METHODS OF DETECTION AND USES THEREOF) - sequence listing, part 104

SEQ ID NO: 158340 - DNA, 601 bp, Human
aggtttacaaactatgactccttaaaaaaccactttagccctgtattaatatgctttaaagcaccaaaaattttgtgagaagaaaattcagcggcatatccccaggtatcaatttatacttttgtttggttccgaagtaggtatttgatgctgaaatacaatctgaagaagtagagcatgcctgtaatcccagcacttatgggaggctgaagcgggtggatcatgaagtcaggagatcaagaccagtctggccaacatggtgaaaccccgcctctactaaaaatacaaaaaaaaaaaaaaattagccaggcatagtggtgtgtgcctgtagtcccagctactcgggaggctgaggcaggagaatcacttgaacccaggaggcggaggttgcagtgagccgagatcagctactgtactccagcctcggcgacagagcaagactccatctcaacacaaaaaagaccgggtgcggtggctcacacctgtaatcctagcactttgggaggccaatgcaggcagatgacgaggtcaggagtttgagaccagcctgaccaacatggtgaaaccccatctctactaaaaaaaaaaaaaaaagccaggt

SEQ ID NO: 158341 - DNA, 601 bp, Human
ccatatcatatacacaagtgaaaagtttttaaaggtttacaaactatgactccttaaaaaaccactttagccctgtattaatatgctttaaagcaccaaaaattttgtgagaagaaaattcagcggcatatccccaggtatcaatttatacttttgtttggttccgaagtaggtatttgatgctgaaatacaatctgaagaagtagagcatgcctgtaatcccagcacttatgggaggctgaagcgggtggatcatgaagtcaggagatcaagaccagtctggccaacatggtgaaacccygcctctactaaaaatacaaaaaaaaaaaaaaattagccaggcatagtggtgtgtgcctgtagtcccagctactcgggaggctgaggcaggagaatcacttgaacccaggaggcggaggttgcagtgagccgagatcagctactgtactccagcctcggcgacagagcaagactccatctcaacacaaaaaagaccgggtgcggtggctcacacctgtaatcctagcactttgggaggccaatgcaggcagatgacgaggtcaggagtttgagaccagcctgaccaacatggtgaaacccc

SEQ ID NO: 158342 - DNA, 601 bp, Human
tatttctaactgctgtcccttcttttcccctgggaattttgaaaagcatcactatggatttatgtcaccatgtcctgagttttcacatatggcagaaatcattcatcagagtattttttcccagttagctcagggctgctaggagctgacactatcagctgggcttggttaagcacttgcaataaagccaattctatgtcttctctatcacagcagtaccaaggggagcccagggggtagcacctccataaacttcatctgtgccagagtccaacttaaacatttcatccaacttataatyatatcctccctgtgcaagcaaatctcctccccttctttccaaccacattgcctcctgaaatccctcttaccctgcagtctttttttttgaagtttcatattctttaattttgaaatatcgaaaatggattcaaatggactaacattatcaaataatcactcacatctaaccatatgatttccatatagtttgatacaatgataaaaagaaaacaaaaattacaatgaaatagagttgactttaaagaatatttaactactcattcatttattgactactgcaaatttttcactctctagg

SEQ ID NO: 158343 - DNA, 601 bp, Human
aatctacatgttcactatagaattaagaatagaaatatatggtaacagaggctggcgtgtttgtgaatagaaaaaagaaaggcaatatataaaaatactaatatagctattttaggtagtttgataatgtatagttttaatttttcttacttttctatattttacaaaaattaccattttttcttaatgaactcttcatctgaaacttaaggtgatggtttcagaaaccttctgtcaacacacaaacctctgcaaaactctagcagtttctccatcagaaagagaagggaagaagcatccrggcacatgaatatcatttctatccttatcctgctgaagaagactttctcttctggcttatgagtagctggattagcttctaatgctaatttaatctcatatttctcattcctcaaaggagtaagaggctgagacacatacctcaccttaacaagcaacaaacagtgggtcagcagaagtgaatctcttagtgacaaacaccacacacaaaaggaagagcattcaagtccatacctgaaccacagggtggcctccagttggagctttgacagcccctcggctgccttctgtctcatagtgg

SEQ ID NO: 158344 - DNA, 601 bp, Human
cctgccctaatggggcctaaaaccaatcctcaaataaaatacagagaagacagtttaaaagctaagccccatcaagttagatacaccttgtgctttccacagatccacctgatgaagcacgaaaggaagttcagaatgtctaccacatccagtatatatcatcacgatgtcagaatgcagtcgacaactactagacaggcaacacaacaggaaaatgggactcatggtcaagaaccaaaactcaatgaatagaaacagattccaagatggctatggtgtctgatttaaaaaaaaaaaaaaagcaattgtcaggacttacaagttcttaatattatcatagatgtccttaatcagaggtacacacccaaagcacctgtggagatttggggagtttgctgtttttcatttgtttgtttgtttacctgggctttactcatgttatatagtttctaatttagtttcagaatgcccaacaatctgaatttttaagaaccaccctagaggttctgatgcacactatagattaagaaccaagttttatcatattaataggatacttctactttaaggcaaataccaaaaaaagttatattaatttaaa

SEQ ID NO: 158345 - DNA, 601 bp, Human
gagacctccccaccaagcatccaaaatggccatgccttcagaacaggcacatgcctcagaggaagggctactccaggcctgccctaatggggcctaaaaccaatcctcaaataaaatacagagaagacagtttaaaagctaagccccatcaagttagatacaccttgtgctttccacagatccacctgatgaagcacgaaaggaagttcagaatgtctaccacatccagtatatatcatcacgatgtcagaatgcagtcgacaactactagacaggcaacacaacaggaaaatgggactcrtggtcaagaaccaaaactcaatgaatagaaacagattccaagatggctatggtgtctgatttaaaaaaaaaaaaaaagcaattgtcaggacttacaagttcttaatattatcatagatgtccttaatcagaggtacacacccaaagcacctgtggagatttggggagtttgctgtttttcatttgtttgtttgtttacctgggctttactcatgttatatagtttctaatttagtttcagaatgcccaacaatctgaatttttaagaaccaccctagaggttctgatgcacactatagat

SEQ ID NO: 158346 - DNA, 601 bp, Human
gaggtttaccagagaggggctgctatggggtggagagaacagagagactaagcgtgcagcggagctggcatatgggaattccagcccaccagattaaagagacctccccaccaagcatccaaaatggccatgccttcagaacaggcacatgcctcagaggaagggctactccaggcctgccctaatggggcctaaaaccaatcctcaaataaaatacagagaagacagtttaaaagctaagccccatcaagttagatacaccttgtgctttccacagatccacctgatgaagcacgaaagraagttcagaatgtctaccacatccagtatatatcatcacgatgtcagaatgcagtcgacaactactagacaggcaacacaacaggaaaatgggactcatggtcaagaaccaaaactcaatgaatagaaacagattccaagatggctatggtgtctgatttaaaaaaaaaaaaaaagcaattgtcaggacttacaagttcttaatattatcatagatgtccttaatcagaggtacacacccaaagcacctgtggagatttggggagtttgctgtttttcatttgtttgtttgtttacctgg

SEQ ID NO: 158347 - DNA, 601 bp, Human
gctgggggaaaccctcaactctttggccaagggctgggctgtgtaagcacagggagagatggtgcgaggtttaccagagaggggctgctatggggtggagagaacagagagactaagcgtgcagcggagctggcatatgggaattccagcccaccagattaaagagacctccccaccaagcatccaaaatggccatgccttcagaacaggcacatgcctcagaggaagggctactccaggcctgccctaatggggcctaaaaccaatcctcaaataaaatacagagaagacagtttaaaakctaagccccatcaagttagatacaccttgtgctttccacagatccacctgatgaagcacgaaaggaagttcagaatgtctaccacatccagtatatatcatcacgatgtcagaatgcagtcgacaactactagacaggcaacacaacaggaaaatgggactcatggtcaagaaccaaaactcaatgaatagaaacagattccaagatggctatggtgtctgatttaaaaaaaaaaaaaaagcaattgtcaggacttacaagttcttaatattatcatagatgtccttaatcagaggtaca

SEQ ID NO: 158348 - DNA, 601 bp, Human
accttcatttcagctctctgcctggggacagctcccctgccacgtgcaggaagtagcatctgagcagagcacagtggtcccgctgtgctgaggattcctgaaataatcctggattcctggcaccgctcagagtgccaggctgtggaaactgctggaatcggtggcatcagagaggaggaagctgctgggggaaaccctcaactctttggccaagggctgggctgtgtaagcacagggagagatggtgcgaggtttaccagagaggggctgctatggggtggagagaacagagagactaagmgtgcagcggagctggcatatgggaattccagcccaccagattaaagagacctccccaccaagcatccaaaatggccatgccttcagaacaggcacatgcctcagaggaagggctactccaggcctgccctaatggggcctaaaaccaatcctcaaataaaatacagagaagacagtttaaaagctaagccccatcaagttagatacaccttgtgctttccacagatccacctgatgaagcacgaaaggaagttcagaatgtctaccacatccagtatatatcatcacgatgtcagaatgc

SEQ ID NO: 158349 - DNA, 601 bp, Human
ctccagcctgtgtgacagagtgatagactctgtcaaaaaatacatatatatattacataaggcaattgctctcaggattggacggcaggaatcagaagactgcggtccccaagggagaggaagtgcacaggtgagcccaccttcatttcagctctctgcctggggacagctcccctgccacgtgcaggaagtagcatctgagcagagcacagtggtcccgctgtgctgaggattcctgaaataatcctggattcctggcaccgctcagagtgccaggctgtggaaactgctggaatcggtrgcatcagagaggaggaagctgctgggggaaaccctcaactctttggccaagggctgggctgtgtaagcacagggagagatggtgcgaggtttaccagagaggggctgctatggggtggagagaacagagagactaagcgtgcagcggagctggcatatgggaattccagcccaccagattaaagagacctccccaccaagcatccaaaatggccatgccttcagaacaggcacatgcctcagaggaagggctactccaggcctgccctaatggggcctaaaaccaatcctcaaataaaat

SEQ ID NO: 158350 - DNA, 601 bp, Human
tgacctgttacctgcatcataaggctcttttgaggattaaataagttaacacatatgcagcacttggaacaggatctcacaggcagcaaatgttttctaaatgtttattattactatcatcttgccaaaatgtaagctcatgatggtgagaatttccagctgttttgttcatatcataacccagaatcaagcaccatgcctggtacatagtaggtgctcaataaacatcttttgaataatcagtgaatgaagatgccacaaagccagaaatggatacagattctctctccttaagacttamaattgtttggccaatgcatttaatgagcagattcattctccaagtatttgttgagtgcctgctatgtttgtggcagcaaactgtgcttgatggtgatatacaatgaagaataagaaggaagttgtggtctcttttaaacaaagctcatggtctaagagagagagacattgacaaaataattatgcaaatgttagaattacaagtagtggcaggtagcatgaaggaaaggtgcatggagctgtggacacataaaacagagcacttggccaggcacggtggctcacgcctataatcccagca

SEQ ID NO: 158351 - DNA, 601 bp, Human
ccaggccacagcctactggaccaatgggcggcaccctcccaagacagggccaatcagcatctccctgagaatcaggatttagctcccatgaggtgatgacaaggctcatactggaacagcatgcaaaactagggggaatggagtggcccgcaggaggcgtgggcatttccccttcaggctttttctgcacaagtgagaaggcaggaagagctggtctgcaaagagacgtggatgatcagatctactgtgctgcaaatagagcttgcggtatccaaatcccagctccaccatttaatagccrtaaccttgaacaagtccttgacagctacttgacctgttacctgcatcataaggctcttttgaggattaaataagttaacacatatgcagcacttggaacaggatctcacaggcagcaaatgttttctaaatgtttattattactatcatcttgccaaaatgtaagctcatgatggtgagaatttccagctgttttgttcatatcataacccagaatcaagcaccatgcctggtacatagtaggtgctcaataaacatcttttgaataatcagtgaatgaagatgccacaaagccagaaat

SEQ ID NO: 158352 - DNA, 601 bp, Human
atacaacctcaagcacaaacacagactatctctggcgggatgtccagagaaccaatggcactggggcttaggaagacgaggtggccacctaggtatgagggaagaccttgccctgtacacagcttgtattaatacctttcaaattgtgcaccatgtgaatgcatttccccaaaatcaatttatgaaagaaactagagcagtttgcacttggcactgtgctaagtggtgttttacacacgttctcattgactcctgtaaaaatcctaaaagacaagtaacattctctccaatttgcttcttsggcaaattgaagccccagaaggtcaaattatccttgctcacagtcatgccactagtatggtgagaacaactcaggctggagggcaagggtcaggtaggtcccatgaccatctcaatgtaccaccatttgcactgggagctcatcctcctggaggaggcgggcatcggagggcccaggctcaggccactaggctccccaggttctactctcagatgcttctgggcccagctgccctgggtcaggccactcacaggaggacatgcttgggggtgtcaacagcagcccacagcgaggctgcac

SEQ ID NO: 158353 - DNA, 601 bp, Human
cttgatcatttattaggaaggtaaaatgtgctgagcagtatgccaaatccttcatacattataattctgataatgacggcaacaaagaccacgaatacaacctcaagcacaaacacagactatctctggcgggatgtccagagaaccaatggcactggggcttaggaagacgaggtggccacctaggtatgagggaagaccttgccctgtacacagcttgtattaatacctttcaaattgtgcaccatgtgaatgcatttccccaaaatcaatttatgaaagaaactagagcagtttgcasttggcactgtgctaagtggtgttttacacacgttctcattgactcctgtaaaaatcctaaaagacaagtaacattctctccaatttgcttcttcggcaaattgaagccccagaaggtcaaattatccttgctcacagtcatgccactagtatggtgagaacaactcaggctggagggcaagggtcaggtaggtcccatgaccatctcaatgtaccaccatttgcactgggagctcatcctcctggaggaggcgggcatcggagggcccaggctcaggccactaggctccccaggttctac

SEQ ID NO: 158354 - DNA, 601 bp, Human
ggaataatgtgtctcaaactcgaatgtgcacacagattaagttgcagcagggcctgagattctgcattcttcatgagctcccagaggatatccaggccaccaatccatggaccaaactgagcaggcagcatctaacacaatgcctggtatgtggtagaagcccaatgtttgttgaataaatacaagataagaggaaaaccactcataatcccactcaacacttttattgctgcattttgaccatggcaccatgcccttgctaaactatctactaatcaggttttatctttactgtttggggtttgttttgagacaggatctcactctgttgcccaggctggagtgtggtagcatgatcacagctcactgcagcctccatctccaggttcaaggaatccttctactgtaacctcccaactagccaagactacaggcatgttccactgcgcccagctaattttttgtttttgtgttttttttggtagagacaagggtctggtaatgttgcccaagcttgtctcgaactcctggcctcaagtgatctttgtgcctcagcctcccaaagtactaggattacaggcatgagccaccatgcctggcc

SEQ ID NO: 158355 - DNA, 601 bp, Human
tttggctggcatagtttgacgactctttttctggaataatgtgtctcaaactcgaatgtgcacacagattaagttgcagcagggcctgagattctgcattcttcatgagctcccagaggatatccaggccaccaatccatggaccaaactgagcaggcagcatctaacacaatgcctggtatgtggtagaagcccaatgtttgttgaataaatacaagataagaggaaaaccactcataatcccactcaacacttttattgctgcattttgaccatggcaccatgcccttgctaaactatytactaatcaggttttatctttactgtttggggtttgttttgagacaggatctcactctgttgcccaggctggagtgtggtagcatgatcacagctcactgcagcctccatctccaggttcaaggaatccttctactgtaacctcccaactagccaagactacaggcatgttccactgcgcccagctaattttttgtttttgtgttttttttggtagagacaagggtctggtaatgttgcccaagcttgtctcgaactcctggcctcaagtgatctttgtgcctcagcctcccaaagtact

SEQ ID NO: 158356 - DNA, 601 bp, Human
gcttggccccaggtgacagaggggaggaggtaagaaatggttgagcaccctaccccgagcccagctcccacacagatgcacagaactgtgaggaaggccaacaggccaactggatgcccataaaagatcacaaggcaaagagaagcagatgagaaagagaaagagattcaaaatctaaaacgcggccgggcacggtggctcatgcctataatcccagcattttcggaagccaaggtgggtggatcacttgaggccaggagttcaagatcagcctgaccaacatgatgaaacccgtctctaycaaaaatacaaaaattagccaggcgtggtggctaataccagctgctttggaggctgaggcaggagaatcgcttgaatccggaggcagatgttgcagtgagccgagatcgcaccactgcactccagcctggatgacagagcaagactccatcttaaaaaaaaaaaaagaaagaaagaaagaaagaaaaagaaatctaaaacacttctgcttcctacctgtaaaagctttacctcaggcaagtcacatttctctggggctcagttttttcatttgtaagatagtagaacccaattcatgggg

SEQ ID NO: 158357 - DNA, 601 bp, Human
atcacattgagagcagcttggtccctgtccaatcctctcatcagtggcaacctcagcaccatgtccccagagagctgctccccactgtgatgggcatcaaacgcttagcaaagagccagcccggaacgtgacacccttgaccatcagcctgctcagaaccaaccaagtctcagatccgagactggttggggctgcggaaagctggccacacctctgagccctcacctctgcaaaggggaaaataacagatgcccatcccatgccccatgagctgtggcaaagattagacgatataatgggkacagtgcctggcaaagagtgggtgctcagtgagcgtcaacagttaccatcatcgccaccatcgtcacccatttcagaccttcctccaagccatctcaggcagctcggtcaccgttactttgcttggttatgagtcctcttttgaatgtggacatgaggaaggacaggaccccagtgctcccctccttctccacgcggagtgggcaccaggcactgaatttccatgggtttgctcagagaggctaagtcagctgcctaaggtgtccggcacagggcgggtgccactggaaatcaaaagcaa

SEQ ID NO: 158358 - DNA, 601 bp, Human
gtccaacagtttagactgggggctagggagtcggcagacacaagctcaagtcccaactgctgaactcgctggctgtggaccttgggcaggtcactctgactctttgacacatgtgtcacatagaaaaaagcacttgtacatttcatagagttgccaggacccaatgaattggtataagcacagctcttagaaccagtggcgacacatagtaagcgctcagtaaacgttggccttcatcttgttgtaattcttgtcgttttctcatggggctgttatgggcatagaatggggattggcgacstcacattgcaactgagtgatgtgaaattgacaacatgctagagaaatgattttgatcttctaggcacctcccatttacagagggaatgtcccagactgacacagtgaatctacgataaaagaaagcctctcattacttgagcacctttccaccccgactatgagtctcactcaccggggccctggattcagatagcagctccatctgaggcccctcgaatgcagcagacactggttcaacgtcaccgcagggaaaccccactgggcctattccctgagaggcggggcatgctgagagaca

SEQ ID NO: 158359 - DNA, 601 bp, Human
gtggatacacggatgcctatgacctcaggcacataggtcagaacaacatgtaacagagttcctggaactttaaaaatcagctctcacaaggccacgaaaacgggctccaggacactcctgggcacccataggtctctgtgtgcatctgtttaggtgcataactactcagattgcagtctgcccatctcttactctcttctcccattgattttcacatctgctcgttgagaacagccccacccccaccaacacacacatacacatacacacacacacacacacacacacacacacacacacacacaccccttgccccagccctactccctgtgaaagcttatgaggaccctgctatggtctggcctgcacacacatacccccagccccgcgcccccggagtgccatgaacaccccttgttcactggcccgggctccccttagatctggagaaagccgcatccctgcacatcccagaaatgcgcaaatcctacaaaccaaatcacctcggccccaaggctcctagagccttctcgccccagcaggagggagagcctcatctttaaatcccatcacacacatcttcctgtctagacgaggtccc

SEQ ID NO: 158360 - DNA, 601 bp, Human
atgtggatacacggatgcctatgacctcaggcacataggtcagaacaacatgtaacagagttcctggaactttaaaaatcagctctcacaaggccacgaaaacgggctccaggacactcctgggcacccataggtctctgtgtgcatctgtttaggtgcataactactcagattgcagtctgcccatctcttactctcttctcccattgattttcacatctgctcgttgagaacagccccacccccaccaacacacacatacacatacacacacacacacacacacacacacacacacacacacacaccccttgccccagccctactccctgtgaaagcttatgaggaccctgctatggtctggcctgcacacacatacccccagccccgcgcccccggagtgccatgaacaccccttgttcactggcccgggctccccttagatctggagaaagccgcatccctgcacatcccagaaatgcgcaaatcctacaaaccaaatcacctcggccccaaggctcctagagccttctcgccccagcaggagggagagcctcatctttaaatcccatcacacacatcttcctgtctagacgaggtc

SEQ ID NO: 158361 - DNA, 601 bp, Human
cgatactgtatatggagctgggaggagaagtgcagcggcaccattacgtgctacctccgccatgtggatacacggatgcctatgacctcaggcacataggtcagaacaacatgtaacagagttcctggaactttaaaaatcagctctcacaaggccacgaaaacgggctccaggacactcctgggcacccataggtctctgtgtgcatctgtttaggtgcataactactcagattgcagtctgcccatctcttactctcttctcccattgattttcacatctgctcgttgagaacagcccyacccccaccaacacacacatacacatacacacacacacacacacacacacacacacacacacacacaccccttgccccagccctactccctgtgaaagcttatgaggaccctgctatggtctggcctgcacacacatacccccagccccgcgcccccggagtgccatgaacaccccttgttcactggcccgggctccccttagatctggagaaagccgcatccctgcacatcccagaaatgcgcaaatcctacaaaccaaatcacctcggccccaaggctcctagagccttctcgcccca

SEQ ID NO: 158362 - DNA, 601 bp, Human
gtaacacaacattaatcaacatgctcctttcccagggaaccatggtttgcagagcacaggactggcattcaaagtacagcagaggaggtgctgaagcactgggtttggggagccccaagatgggaagccaccatctccaaagccagtagatcatcaagggatgattaagaaaaccacccaggtcagtgcccagacacaagaggtgctcagcaaacctctgcaaaaggacccaaggaggtctgctaaggactctttaccaggagagaaaaagtaccactgcctgcccacaagctaggagaaygtcctgtattcagagagaggactagaaaaggaaaatcatctcctggctccagggcacaaatttttaacctttttttgcaccaatgaccccttctgcagcttggtgaagccatggccctatctctgagtgattcttccacatgcataaaatggacaaggttaaaaaaaaaaaagaagagggaaatcaaccaatgtataaaaatgtaatgtattttcccaaaactaaaaagtggcattcgttcaggtagcccgtctgtctgtcttccttgctctgggtttgcatgcgctgtgcctgtgaggt

SEQ ID NO: 158363 - DNA, 601 bp, Human
gtagggtgtttgtcagcatcactggactctacccagtaggtagcagcagccacccttttcccaactgtgatgcacaaaaaagtctctggacattgctaaatgtcccctgggacacgaaatcactcctattgagaaacattcttaaattaagctaacatttatgaggaggggaaacagaaaatctgcactgaaaccctatcccttgtccatcagaaagtgttgttcaacgggaccttcaagaaacaccccagatcctcccacttttcacgttctcatcaacctccctgggtcccagcactgycatctctcacctggacccctgcatccagcctctcgctaatttctgccttgtcccttgtccctatcctgaatagaatctccacaagcagccagagggatcttttaaaagcaaatgagatcctatcacttccctacttaaaatccccccatggcttcccagtgcataaagaattacattcaagctgggcgcagtggctcatgcctgtaatcccagcactttgggaggccaaggcaggcggatcacttgaggtcaggagttcaagaccagactggccaacatggcgaaacccccgtctctact

SEQ ID NO: 158364 - DNA, 601 bp, Human
tggattctttgaggccaggagctcaagaccagcctggccaacatggtgaaaccccgtctctactacaaatacaaaaatgacccgagcgtggtggcgtgcacctgtagtcccagctactcaggagactgagacatgagaatcgcttgaacccgggaggcagaggttgcagtaagccaagatcgtgccactgcactccagcctgggtgacagagcgagacactgcctcaaaaaaaaaaaagaagaagaaaatccaaactgcccattgcagccgacaaaactgcatgatcagacccccgcccayatcaccagcttcatctccccaactccagtccagccacaggggcctccttgctgctcctggaacaagccacgtttctgccacagggcctttgcatatgctatgcccttggcctagaacattcttcccctgggtcttcccacagctggttcctcctgatccttcaggtctcagcctaaatgcagggccctccctgggtagcctggcagaaagagagctcctctagcatcattccaccatgtcttcctgtttatttccttcctgactgtgctaagtgttactttatgtgtttgcttattgcct

SEQ ID NO: 158365 - DNA, 601 bp, Human
catttagaataagatccaggccaaggagggtggattctttgaggccaggagctcaagaccagcctggccaacatggtgaaaccccgtctctactacaaatacaaaaatgacccgagcgtggtggcgtgcacctgtagtcccagctactcaggagactgagacatgagaatcgcttgaacccgggaggcagaggttgcagtaagccaagatcgtgccactgcactccagcctgggtgacagagcgagacactgcctcaaaaaaaaaaaagaagaagaaaatccaaactgcccattgcagccracaaaactgcatgatcagacccccgcccatatcaccagcttcatctccccaactccagtccagccacaggggcctccttgctgctcctggaacaagccacgtttctgccacagggcctttgcatatgctatgcccttggcctagaacattcttcccctgggtcttcccacagctggttcctcctgatccttcaggtctcagcctaaatgcagggccctccctgggtagcctggcagaaagagagctcctctagcatcattccaccatgtcttcctgtttatttccttcctgactgtgcta

SEQ ID NO: 158366 - DNA, 601 bp, Human
aaggttgtctttcagtgctaacatgtcatgatcttcaggtacatttagaataagatccaggccaaggagggtggattctttgaggccaggagctcaagaccagcctggccaacatggtgaaaccccgtctctactacaaatacaaaaatgacccgagcgtggtggcgtgcacctgtagtcccagctactcaggagactgagacatgagaatcgcttgaacccgggaggcagaggttgcagtaagccaagatcgtgccactgcactccagcctgggtgacagagcgagacactgcctcaaamaaaaaaaagaagaagaaaatccaaactgcccattgcagccgacaaaactgcatgatcagacccccgcccatatcaccagcttcatctccccaactccagtccagccacaggggcctccttgctgctcctggaacaagccacgtttctgccacagggcctttgcatatgctatgcccttggcctagaacattcttcccctgggtcttcccacagctggttcctcctgatccttcaggtctcagcctaaatgcagggccctccctgggtagcctggcagaaagagagctcctctagcatcat

SEQ ID NO: 158367 - DNA, 601 bp, Human
gttatttgctctttgctgcctccccactagaatgtcagtcccgtgggggcagcaccccatctttcctgttcatggtgcagcctcaatgcctagagcaccacacaggtgtccaacgagcgagcaaggctagaaggaagagtctgtgacatcatgggaggggccggagcagctgcagtctctccagacctacgcctctcccatgacaaagagctgttatacgcccacaccggcttctctccagcttgggcaattctcctcccggcccacagcgaccattgtgtcacagagccttgtcctgctyggtgtgggcacgactcagctggttggacaactggtacctgggctgccctgttccgaacagaggtgacagcatctccaggtatgatgaagaaggagccctgcgcctgctttctgacccagctgggatcccactggctggatgtgtcttcagtcctgcaggaggccactgtgatcagccgccctgctgatagtggcacattttgaaattacacagggaaccataaaaagaattagacattctggacaggcttgaaaaccaaacaagtcaggctctctcagtgttctaaattaagaatcaagt

SEQ ID NO: 158368 - DNA, 601 bp, Human
tccctccacacaccctgccttaagttgcatcatccacctgacgcttccctccacctgaccccacatgtgatagttatttgctctttgctgcctccccactagaatgtcagtcccgtgggggcagcaccccatctttcctgttcatggtgcagcctcaatgcctagagcaccacacaggtgtccaacgagcgagcaaggctagaaggaagagtctgtgacatcatgggaggggccggagcagctgcagtctctccagacctacgcctctcccatgacaaagagctgttatacgcccacaccrgcttctctccagcttgggcaattctcctcccggcccacagcgaccattgtgtcacagagccttgtcctgctcggtgtgggcacgactcagctggttggacaactggtacctgggctgccctgttccgaacagaggtgacagcatctccaggtatgatgaagaaggagccctgcgcctgctttctgacccagctgggatcccactggctggatgtgtcttcagtcctgcaggaggccactgtgatcagccgccctgctgatagtggcacattttgaaattacacagggaaccataaaaaga

SEQ ID NO: 158369 - DNA, 601 bp, Human
ttggaacctgtcctcaggtgacctctcatcagagaagccttcccagacagccgcaccccaatgtgacaccccacgcccttcccactgtccctccacacaccctgccttaagttgcatcatccacctgacgcttccctccacctgaccccacatgtgatagttatttgctctttgctgcctccccactagaatgtcagtcccgtgggggcagcaccccatctttcctgttcatggtgcagcctcaatgcctagagcaccacacaggtgtccaacgagcgagcaaggctagaaggaagagtcygtgacatcatgggaggggccggagcagctgcagtctctccagacctacgcctctcccatgacaaagagctgttatacgcccacaccggcttctctccagcttgggcaattctcctcccggcccacagcgaccattgtgtcacagagccttgtcctgctcggtgtgggcacgactcagctggttggacaactggtacctgggctgccctgttccgaacagaggtgacagcatctccaggtatgatgaagaaggagccctgcgcctgctttctgacccagctgggatcccactggctggatg

SEQ ID NO: 158370 - DNA, 601 bp, Human
agggacccaagaagccaactgcaggcttgggggcatcgttctattaataatccactctgtccccttgtcagctcagctacttgaaaaaccggatctgaggaatgacgtgtgatttagacatcccgccacagttagctatataaatgacgccatccaacctcatcacaaggaaaactttgcaccctccataggtgaagacctttctacacagtgtattgggatcgcttgcaaacatagctaatgtaatctccataacaatgctcagagaagagcagtgttatcccatttttagatgagaacrgtgaggctcaaccaggttaactaacttgctcactatcctacaggtcataagtgatcaggtggcaacagcctccactggccctgtttgtttcttctgttgtatggctgattcctgattcagaaaaaggcaaaatccccccacccccagccccccaagtctggcctatgcattttaagacaggcaaatccaccccaccagctcagcaataagaacccagagacacacaaacatggcctccacgtgtcaaagaccctcagcgtcaaagagaaggttattcagactcacccctgcctgccacca

SEQ ID NO: 158371 - DNA, 601 bp, Human
tggaccagccggatcacactccaggcacagcagacacattctgcaatacaggagctccacgtcactggcctcccgagcaaaggaaacgccacttcctgcagccaaggtgagagcgaaagttttctgcttcttgtaatttcccaggcagctgaaaaggttccaggaagaagcagtgcttctagtgcacaccgtgaagggctgaatgcacgggaggggagtgtctgtggcgtctgcgggggtgggggcccaggctgcagcttggtgcgacttccatccaccaaccttcccatcaaagggaccyaagaagccaactgcaggcttgggggcatcgttctattaataatccactctgtccccttgtcagctcagctacttgaaaaaccggatctgaggaatgacgtgtgatttagacatcccgccacagttagctatataaatgacgccatccaacctcatcacaaggaaaactttgcaccctccataggtgaagacctttctacacagtgtattgggatcgcttgcaaacatagctaatgtaatctccataacaatgctcagagaagagcagtgttatcccatttttagatgagaacggtgaggc

SEQ ID NO: 158372 - DNA, 601 bp, Human
cgcctccccgggtaacaccagaaagcagtgtggtatagctgaaagcacaaagtttttcactttgggtcagacatatctgaatttcgatgccagctctgcttcttgatggctgtgtgactgtgagcaatcgctccacccctgagtttccatatgctcagataaaaaggagacatcaccccccaccctgcaggcctcttctgaaaggcgaaataaggtgacctttgttgggcaccaaagcacagcacacggtaggtacccatgaaacgagaactttccttgtcatcggaggatgacgcaaatygaaacagggaggtgatattacagaactgaatggaagggtgaagaatgaatgtgaacaaagtgagaaccaacgtgaaggcctcccatatgggaaagcccaggcactaattgcagtcttctcagtgggctggctcaacagttgccggcttggagtgtcagaggaaagaggggccaggtgaagaaacctcaccatctttcatgaaaggaatacttcccgtccaccctccatcctcccctcctacaaaaggtacagaatgtgcccagaatcccaactgctcagctgcctcattctggaagagcc

SEQ ID NO: 158373 - DNA, 601 bp, Human
ggctccgaacccacccgcttccctgccaccctctctctgtcctcagcgcttggtggattccactctgctctctgattactacaggtcagaaagggcaggtcctcaaaggcaaaataagcaagtgctaaggtgcaacatcaagaatgtgcttcctggggccaggcgcggtggctcgtgcctgtaatcccagcactttgggaggctgaggtgggcagatcacttgacgtcaggagttcaagaccagcccgggcaacatggtgaaaccccgtctctgtgaaaaatacaaaaattagccaggtayggtggcacgtgcctgtaatcccagctactcaggagaccaaggcaggagaatcacttgaacccgggggttggaggtggcagtgagccgatattgcaccactgcactcccgcctgggtcacaaagcaagactctgtctcaaaaaaaatagaatgtgcttcctgccgcacaggagagagagtggggcaggaaggagggagaaaagaaggggcacagagggagatggagggagagaaacaaacagcaacctaaacaaacaaaaacggtagttccttgagagaaaaacctctttaggaaagccaa

SEQ ID NO: 158374 - DNA, 601 bp, Human
ccagtcaacacagtgagcatagggcagagccaggctccaaactccagcctctcaggctccgaacccacccgcttccctgccaccctctctctgtcctcagcgcttggtggattccactctgctctctgattactacaggtcagaaagggcaggtcctcaaaggcaaaataagcaagtgctaaggtgcaacatcaagaatgtgcttcctggggccaggcgcggtggctcgtgcctgtaatcccagcactttgggaggctgaggtgggcagatcacttgacgtcaggagttcaagaccagccygggcaacatggtgaaaccccgtctctgtgaaaaatacaaaaattagccaggtatggtggcacgtgcctgtaatcccagctactcaggagaccaaggcaggagaatcacttgaacccgggggttggaggtggcagtgagccgatattgcaccactgcactcccgcctgggtcacaaagcaagactctgtctcaaaaaaaatagaatgtgcttcctgccgcacaggagagagagtggggcaggaaggagggagaaaagaaggggcacagagggagatggagggagagaaacaaacagcaacc

SEQ ID NO: 158375 - DNA, 601 bp, Human
gcccttacgttgccctcatgttgtttttgggctccaagggtatctccaggactttggtgttgcccactatcttctcatagctggtggtggtgacagttttccccgtgattcggtgcacctggtagaaggcgtgcggcttaaggatccgctcatcagctgtcccaatgaagatctgaagtcccagaggcttgttttccatgtagccatggagctggtgggggagaaaacaaaatcattaaggtgcggggtgtggtggctctaatccaataaacaaaaaaagaccagagagctcatgggcagyagagagactatgggatttctgcagcatctggaagaatggagaactggaaacaaccttgatgtccagccagagggtaacgcttggataaattacagggatcccctctaatgctgaatattaagcagccactagaaagaatacagtaagtcagaactgcatttatggagaaacagccagaaactgtgcttaattgatgactgagggtggaaggagtgttgcatagtagtgaggataactgaaattaactgcaaataaactgaaaggacaaacatagagctcttgatagtgattgcctgagaa

SEQ ID NO: 158376 - DNA, 601 bp, Human
aattcctgatctcaagtgatccacccgcctcagccttccaaagcgctaggattacaggcgcgagccaccacgcccggcctacatattatgcttttaaaatggaaacatttaaaacagaaatcacaacgggtcgatggatcacagactgagaactgccatcaacagctgcttccatcagttctgtagagtcccctctcccaaatccctgccacctgccccctgctcgcttctccatgaagacccgccgccctcagctcccagcccttacgttgccctcatgttgtttttgggctccaagggkatctccaggactttggtgttgcccactatcttctcatagctggtggtggtgacagttttccccgtgattcggtgcacctggtagaaggcgtgcggcttaaggatccgctcatcagctgtcccaatgaagatctgaagtcccagaggcttgttttccatgtagccatggagctggtgggggagaaaacaaaatcattaaggtgcggggtgtggtggctctaatccaataaacaaaaaaagaccagagagctcatgggcagtagagagactatgggatttctgcagcatctggaagaatgga

SEQ ID NO: 158377 - DNA, 601 bp, Human
ttctccctgctgcctccatgagcccactgagcataatggccctgctctagactgagcttctccagcacaggctctgtgtcttgtgccctcggtgcctggtggtgtttggcacatgatggaggtaccgagtcaatggctgttcattgaccgactgaatgaccagcatgtccagctgccacactgggcacgctgccctgggctctctctcaaggcttctgtgtcctcaccctcagctctggtgagctctgttctgtctctctctccctcagcagttgtagctgctggcccatgtgcccaggcyctcctaacacctgttttccctgactcagattccctaaagtatgggtcctctggctacatgacattcacctgccagggtgactgacatttaaaaagggggcctgaggaaagaacagtgctcactgaaggaaaggaaacactcacggtggcgtccaggcaagagtgactggccaaggagccttccaggaagcccgcagggagcagttccgtttcacaggcggggctgcgggccacgcccactccagcgactccccaaggcagggggagtacagagttccaggcgccaccccgctgggaataa

SEQ ID NO: 158378 - DNA, 601 bp, Human
agacgtgaaggaggcaggggtgggggtaggagggcttgtacagcacctcagtgcttccagcttctgacggggagtagctgagcattttccctgggctgggggcatcagtagtgggggccaggcctcaccctcctcagaaggtaggtgggctctccacagcctgtctccctcactgacacatgcacactcactggattctcaccggcacttttgtgatagctgtcatcatcattcacacctatttcttttcttttctttttcttctcttttttttgagacagggtctcgctctgtctcccargctgaagtgcagtggcaccatcacacctcactgcagcctcaacctcctgggctcaagcgatcctcccgcctcagcctcctgagtagctgggactacgggagtgcaccaccacacacacttcccctaactttttttattttttggagagacggggtctagttttgttgtccaggctagtctcaaactcctggactcaaatgatcctcccgcctcagcctcacaaagtgctgggattacaggcgtgagccaacctcctgggccactcacacctatttcttagaagggtaagttgaggctgac

SEQ ID NO: 158379 - DNA, 601 bp, Human
cgccaatcatgggccccagctccagtaagacgtgaaggaggcaggggtgggggtaggagggcttgtacagcacctcagtgcttccagcttctgacggggagtagctgagcattttccctgggctgggggcatcagtagtgggggccaggcctcaccctcctcagaaggtaggtgggctctccacagcctgtctccctcactgacacatgcacactcactggattctcaccggcacttttgtgatagctgtcatcatcattcacacctatttcttttcttttctttttcttctcttttttttgagacagggtctcgctctgtctcccaggctgaagtgcagtggcaccatcacacctcactgcagcctcaacctcctgggctcaagcgatcctcccgcctcagcctcctgagtagctgggactacgggagtgcaccaccacacacacttcccctaactttttttattttttggagagacggggtctagttttgttgtccaggctagtctcaaactcctggactcaaatgatcctcccgcctcagcctcacaaagtgctgggattacaggcgtgagccaacctcctgggccactcacacctat

SEQ ID NO: 158380 - DNA, 601 bp, Human
tgagacagagtctcactctgtcacccaggctggagtgcaatggcgagatctcggctcactgcaagctccacctcccgggtttatgccattctcctgcctcagccttctgcgtagctgggactacaggcgcccgccaccatgcccagctaattttttgtatttttagtagaaatggggttttgccatgttggccaggctggtctcgaactcctggcctcatgatccacccacctttgcctcccaaagtgctgggattacaggcgtgagccactgcaccccgccaatcaaagagctttgctaytgccataggattcacatcagggtacagtgggtccccagcccaagggcagagggagcccagagcatttaataaaaagactgcaaaggggaggcgccaatcatgggccccagctccagtaagacgtgaaggaggcaggggtgggggtaggagggcttgtacagcacctcagtgcttccagcttctgacggggagtagctgagcattttccctgggctgggggcatcagtagtgggggccaggcctcaccctcctcagaaggtaggtgggctctccacagcctgtctccctcactgacacatg

SEQ ID NO: 158381 - DNA, 601 bp, Human
catgttcgcaatcaaggagcctttttttttttttttttttttttgagacagagtctcactctgtcacccaggctggagtgcaatggcgagatctcggctcactgcaagctccacctcccgggtttatgccattctcctgcctcagccttctgcgtagctgggactacaggcgcccgccaccatgcccagctaattttttgtatttttagtagaaatggggttttgccatgttggccaggctggtctcgaactcctggcctcatgatccacccacctttgcctcccaaagtgctgggattayaggcgtgagccactgcaccccgccaatcaaagagctttgctactgccataggattcacatcagggtacagtgggtccccagcccaagggcagagggagcccagagcatttaataaaaagactgcaaaggggaggcgccaatcatgggccccagctccagtaagacgtgaaggaggcaggggtgggggtaggagggcttgtacagcacctcagtgcttccagcttctgacggggagtagctgagcattttccctgggctgggggcatcagtagtgggggccaggcctcaccctcctcagaa

SEQ ID NO: 158382 - DNA, 601 bp, Human
cctcccttgatgggctgttacagaagaactgcaaggatccaatgggtgtctgcaacaagtgctctagaagtgggccctgctgttctctccataactcccaacatgttcgcaatcaaggagcctttttttttttttttttttttttgagacagagtctcactctgtcacccaggctggagtgcaatggcgagatctcggctcactgcaagctccacctcccgggtttatgccattctcctgcctcagccttctgcgtagctgggactacaggcgcccgccaccatgcccagctaattttttrtatttttagtagaaatggggttttgccatgttggccaggctggtctcgaactcctggcctcatgatccacccacctttgcctcccaaagtgctgggattacaggcgtgagccactgcaccccgccaatcaaagagctttgctactgccataggattcacatcagggtacagtgggtccccagcccaagggcagagggagcccagagcatttaataaaaagactgcaaaggggaggcgccaatcatgggccccagctccagtaagacgtgaaggaggcaggggtgggggtaggagggcttg

SEQ ID NO: 158383 - DNA, 601 bp, Human
gactcaggacacgggacacccacataagcagctgatgttccatcctccaggtgtggacactgaggtcccaatagggaaaatgatctgccagcttgaatcagatgggaggactgagcaaggccaaaaaatggggataataatatgagcccctcccttgatgggctgttacagaagaactgcaaggatccaatgggtgtctgcaacaagtgctctagaagtgggccctgctgttctctccataactcccaacatgttcgcaatcaaggagcctttttttttttttttttttttttgagacagmgtctcactctgtcacccaggctggagtgcaatggcgagatctcggctcactgcaagctccacctcccgggtttatgccattctcctgcctcagccttctgcgtagctgggactacaggcgcccgccaccatgcccagctaattttttgtatttttagtagaaatggggttttgccatgttggccaggctggtctcgaactcctggcctcatgatccacccacctttgcctcccaaagtgctgggattacaggcgtgagccactgcaccccgccaatcaaagagctttgctactgccatag

SEQ ID NO: 158384 - DNA, 601 bp, Human
ctgtagtcccagctacttgggaggctgaggcaggaggatcgcatgaacccaggaggcagaggttgcagggacccaaaatcttgccactgcactccagcttgggcgacagagtgagattctggcaaaaaagaaaaagtcactgaaggcacctggtacccaggactacttcaaggacagctattgttatgattattgtaacaggcatgtgatcagcactggcctccaggatgcagaatgcctgagtgcctggtgccacctgtgaacataggctgataagggccacccctgcaacccccctttscacttcttccagtgcccagcaggtgctaagtcaaaccaggtgggggtatgggaggcacacccgacagggcaaacttgacttgggcatcccctgacgatgaccctgcatggcaggcacacttgaatgggtgttcagagttctgagcgaaggaatccaagagtggccaacctggagatccagtcgttatctatgaggaacatctgagccccaccccattcccacgggacactgaccatacaggggtatagggaccgaggccctttgttttgggttaaatgaaggttactaggtggagatggt

SEQ ID NO: 158385 - DNA, 601 bp, Human
gcatgcctgtaattccagctacttgggaggctgaggcagaagaatcacttgaacctgggaggcgaaggttgcagtgagccgaggtcgtgccattgcactccagcctgggcaacaagagcgaaactctgtctaaaaaaagaaaaaaagaaagaaactgctgtcccagcctgtacctgttcacttgccagtctacagcttcaaggctctcagattttgtgtagccctggcaagtccctccactccctaagcttcagtttcttcatctgtaaatggggatgaagacccatgccttgtcaagtcrtccagaggattccgtgagataaaagttactagccgggcacagtggctcacacctgtaatcccagcgctttgggaagccaaggtgggaggatcacctgagatcaggagttcgagaccagctggctaacgtggtgaaaccctgtctctactaaaaatacaaaaattagccgggcgtggtggtggacgcctgtaatcccagctactccggaggctgaggcagaagaatggcttgaactcgggaggtggaggttgtagtgagccaggatcacaccactgcactccagcctgggcaacagagtga

SEQ ID NO: 158386 - DNA, 601 bp, Human
aatcccggcactttgggaggctgaggtgggcggatcacctgaagtcgggagttcgagaccagcctggccaacaaggagaaaccccgtctctactaaaaatacaaaaaattagccgggcatggtggtgcatgcctgtaattccagctacttgggaggctgaggcagaagaatcacttgaacctgggaggcgaaggttgcagtgagccgaggtcgtgccattgcactccagcctgggcaacaagagcgaaactctgtctaaaaaaagaaaaaaagaaagaaactgctgtcccagcctgtacckgttcacttgccagtctacagcttcaaggctctcagattttgtgtagccctggcaagtccctccactccctaagcttcagtttcttcatctgtaaatggggatgaagacccatgccttgtcaagtcgtccagaggattccgtgagataaaagttactagccgggcacagtggctcacacctgtaatcccagcgctttgggaagccaaggtgggaggatcacctgagatcaggagttcgagaccagctggctaacgtggtgaaaccctgtctctactaaaaatacaaaaattagccgggcgt

SEQ ID NO: 158387 - DNA, 601 bp, Human
cagagggctgacataaacattaaatgagtcactgtatgcaaagcaggacagcgcctcgtgcagagtagacattcaaatatgagacagaaaaggcacattgctgatttagccccaattcccctctgcatcagagagggacagtttagaaactgctgtcccttggccgggtgcggtggctcatgcctgtaatcccggcactttgggaggctgaggtgggcggatcacctgaagtcgggagttcgagaccagcctggccaacaaggagaaaccccgtctctactaaaaatacaaaaaattagcygggcatggtggtgcatgcctgtaattccagctacttgggaggctgaggcagaagaatcacttgaacctgggaggcgaaggttgcagtgagccgaggtcgtgccattgcactccagcctgggcaacaagagcgaaactctgtctaaaaaaagaaaaaaagaaagaaactgctgtcccagcctgtacctgttcacttgccagtctacagcttcaaggctctcagattttgtgtagccctggcaagtccctccactccctaagcttcagtttcttcatctgtaaatggggatgaagacccatg

SEQ ID NO: 158388 - DNA, 601 bp, Human
cttgccagctgtgtgactttggcaagttccctcccctctctgagtctcagtttcctcataataagtgaagttaataataggacaggaccttcctcagagggctgacataaacattaaatgagtcactgtatgcaaagcaggacagcgcctcgtgcagagtagacattcaaatatgagacagaaaaggcacattgctgatttagccccaattcccctctgcatcagagagggacagtttagaaactgctgtcccttggccgggtgcggtggctcatgcctgtaatcccggcactttgggagrctgaggtgggcggatcacctgaagtcgggagttcgagaccagcctggccaacaaggagaaaccccgtctctactaaaaatacaaaaaattagccgggcatggtggtgcatgcctgtaattccagctacttgggaggctgaggcagaagaatcacttgaacctgggaggcgaaggttgcagtgagccgaggtcgtgccattgcactccagcctgggcaacaagagcgaaactctgtctaaaaaaagaaaaaaagaaagaaactgctgtcccagcctgtacctgttcacttgccagtctaca

SEQ ID NO: 158389 - DNA, 601 bp, Human
agccaggcatggtggcgcacacctgtaatcccaactacttgggagactgaggcagaagaatcacttgaacccgggaggcagaggttgtagtgagccgagattgcaccactgcactccagcctgggcgacagagtgagactctgtctcaaaagtcaaagtaggaccattaccaaccatgatgatgatgctgaccaatggcagctattgctgcagcacctgctctgagccaggcctgcacttggtgtttgagaggtgggtatgggtataattctcattttagagaggggaaactgaggcaccrtgaagttaaatgactcattcaagctcctctagctggaaagtgggaaatcaggactcagacccagagagcctgaccccagctggtgtccaagttcaaattccttgctgttctagctccctggtcactaggagtgcagaggttatcccccacaactgctcaggggcctgagaacattaagggctgagggcaagcctacccccaacaccttgggtaaatacagattccaacctcactctgcgcccacagcctgctcctctccacctccccagccagaccatggtcctactaccttgccccgcc

SEQ ID NO: 158390 - DNA, 601 bp, Human
gggtgacagaggaagactccagctcaaaaaaaaaaaaaaaaaaaaagtcactgaaggcacctggtacccaggactacttcaaggacagccattgttatggccaacatggtgaaaccctgtctctactaaaaacacaaaaattagccaggcatggtggcgcacacctgtaatcccaactacttgggagactgaggcagaagaatcacttgaacccgggaggcagaggttgtagtgagccgagattgcaccactgcactccagcctgggcgacagagtgagactctgtctcaaaagtcaaagyaggaccattaccaaccatgatgatgatgctgaccaatggcagctattgctgcagcacctgctctgagccaggcctgcacttggtgtttgagaggtgggtatgggtataattctcattttagagaggggaaactgaggcaccgtgaagttaaatgactcattcaagctcctctagctggaaagtgggaaatcaggactcagacccagagagcctgaccccagctggtgtccaagttcaaattccttgctgttctagctccctggtcactaggagtgcagaggttatcccccacaactgctc

SEQ ID NO: 158391 - DNA, 601 bp, Human
cttaaactcgttttaaaggcaacaagactgaggctcagagagtgggaggaccttgagttagaaagtctaatgcataccacagccaggaagctatttgactctaaacccggaggtctagcagcacgctccctgcatgccacatagcaaggtgctgggtcactgatgctaacatctaaacaggggccaggtgcggtggctcactcttgaaatcccagcactttgggaggctgaggtgggtggatcacttgaggccaggagtttgagacctcctcttcacagaggtggaagggaggaccagcgrgggcaagtgtatcccaagtcccagctacttgggaggctgaggcaggaggatcgcatgaacccaggaggcagaggttgcagtgagccaaaatcgtgccactgcactccagcttgggtgacagaggaagactccagctcaaaaaaaaaaaaaaaaaaaaagtcactgaaggcacctggtacccaggactacttcaaggacagccattgttatggccaacatggtgaaaccctgtctctactaaaaacacaaaaattagccaggcatggtggcgcacacctgtaatcccaactacttgggaga

SEQ ID NO: 158392 - DNA, 601 bp, Human
agcacacttaaactcgttttaaaggcaacaagactgaggctcagagagtgggaggaccttgagttagaaagtctaatgcataccacagccaggaagctatttgactctaaacccggaggtctagcagcacgctccctgcatgccacatagcaaggtgctgggtcactgatgctaacatctaaacaggggccaggtgcggtggctcactcttgaaatcccagcactttgggaggctgaggtgggtggatcacttgaggccaggagtttgagacctcctcttcacagaggtggaagggaggaycagcgggggcaagtgtatcccaagtcccagctacttgggaggctgaggcaggaggatcgcatgaacccaggaggcagaggttgcagtgagccaaaatcgtgccactgcactccagcttgggtgacagaggaagactccagctcaaaaaaaaaaaaaaaaaaaaagtcactgaaggcacctggtacccaggactacttcaaggacagccattgttatggccaacatggtgaaaccctgtctctactaaaaacacaaaaattagccaggcatggtggcgcacacctgtaatcccaactactt

SEQ ID NO: 158393 - DNA, 601 bp, Human
cagaaggcaagatgtgtcttccacctggggaaattcctgtggagccacagcatagggactcagcacacttaaactcgttttaaaggcaacaagactgaggctcagagagtgggaggaccttgagttagaaagtctaatgcataccacagccaggaagctatttgactctaaacccggaggtctagcagcacgctccctgcatgccacatagcaaggtgctgggtcactgatgctaacatctaaacaggggccaggtgcggtggctcactcttgaaatcccagcactttgggaggctgaggygggtggatcacttgaggccaggagtttgagacctcctcttcacagaggtggaagggaggaccagcgggggcaagtgtatcccaagtcccagctacttgggaggctgaggcaggaggatcgcatgaacccaggaggcagaggttgcagtgagccaaaatcgtgccactgcactccagcttgggtgacagaggaagactccagctcaaaaaaaaaaaaaaaaaaaaagtcactgaaggcacctggtacccaggactacttcaaggacagccattgttatggccaacatggtgaaaccctgtc

SEQ ID NO: 158394 - DNA, 601 bp, Human
ctaggctccgccagctccgaggtacacagtggaagggactgagcagtccccacagtgtctcctgctgacggggcctgacagctctgctgctgagaggtttcacagaaggcaagatgtgtcttccacctggggaaattcctgtggagccacagcatagggactcagcacacttaaactcgttttaaaggcaacaagactgaggctcagagagtgggaggaccttgagttagaaagtctaatgcataccacagccaggaagctatttgactctaaacccggaggtctagcagcacgctccctkcatgccacatagcaaggtgctgggtcactgatgctaacatctaaacaggggccaggtgcggtggctcactcttgaaatcccagcactttgggaggctgaggtgggtggatcacttgaggccaggagtttgagacctcctcttcacagaggtggaagggaggaccagcgggggcaagtgtatcccaagtcccagctacttgggaggctgaggcaggaggatcgcatgaacccaggaggcagaggttgcagtgagccaaaatcgtgccactgcactccagcttgggtgacagaggaagactc

SEQ ID NO: 158395 - DNA, 601 bp, Human
ccctccctagccctgcttttggtgatgagctgggcagtgccagggtcagtgacttatgccactatggcctctcaactgacttttagtgtgaggccaggagacagagcagccctgggctgagaaactgtttcagctccacttcctccaggaagccctctatgctcagcctcatctaggctccgccagctccgaggtacacagtggaagggactgagcagtccccacagtgtctcctgctgacggggcctgacagctctgctgctgagaggtttcacagaaggcaagatgtgtcttccacctsgggaaattcctgtggagccacagcatagggactcagcacacttaaactcgttttaaaggcaacaagactgaggctcagagagtgggaggaccttgagttagaaagtctaatgcataccacagccaggaagctatttgactctaaacccggaggtctagcagcacgctccctgcatgccacatagcaaggtgctgggtcactgatgctaacatctaaacaggggccaggtgcggtggctcactcttgaaatcccagcactttgggaggctgaggtgggtggatcacttgaggccaggagtt

SEQ ID NO: 158396 - DNA, 601 bp, Human
ctagcctcagacatcaataatacagaaataataataatgataaagcagctacctactgttttcagaccctttatctcatttaatccctaggcaatgtacatatcggcccatgttacagatggggaaatggacttgccaggctaagcccggagaagttcagtggcctgtccagagttacacaaaattgatggtggtagagctagggtggaactcaagtccctctgcctcagcccaagccctgcccacaggccacaccccctccctggcactcatgtcgagacagtgcctggcctcctgacckctccagaggggaatctcacgccccttcccactgcctttgctctctgcaaggctgactcacagccagcccagcatttgtctgaacagcaggaaatcctcccagcgctgatgtgaacaggaagcatcctcagttaccaacaaatatttactaagccccactatgtgccaggcaccgtggaggccctcgggaaatgcactaagtccctgctctcaagagatgcgtgccagagaggtccagggcggtgggttcacttacccaaggtcactcagtgtgtcggtggcagagctaccatgaggaccc

SEQ ID NO: 158397 - DNA, 601 bp, Human
gttttccacccaagtgtgttaaatcggagagtcccctttaaaaaaacctttcccggctgctgtgtggaggacaggatggcaggaagccagaacagaagaccagctactgcgggagggaagatctgattgggatttgaataacatgcgggaagtactcaaggcagcgtcagagacagtgggtgctcagcggggcagaagccagacagtgccggggtgcagaagctaggggttcagggagctgggcaggaggcaggagcgcctctgggaagggggaaagcagagccagctgcccaccatgacyagtagcactcatcccttctcacggctgcctgagaagaggcccagacgcgtttcaggtgtggagcagaggcaggaagccacctccacaggtggctcaagctcaggcaggcctcctactgaattttctagaaaactgcaacacaccatgggaagtctgtcagcctattccagatgacaatgacaatggggtggcgaccccgctctcctgtctcctttcagggaaaagggtcagcagtggcctcaaacttttgagtatctactatgtgctagaccatctatatgcattatcttatttcatcct

SEQ ID NO: 158398 - DNA, 601 bp, Human
aagggttttccacccaagtgtgttaaatcggagagtcccctttaaaaaaacctttcccggctgctgtgtggaggacaggatggcaggaagccagaacagaagaccagctactgcgggagggaagatctgattgggatttgaataacatgcgggaagtactcaaggcagcgtcagagacagtgggtgctcagcggggcagaagccagacagtgccggggtgcagaagctaggggttcagggagctgggcaggaggcaggagcgcctctgggaagggggaaagcagagccagctgcccaccakgaccagtagcactcatcccttctcacggctgcctgagaagaggcccagacgcgtttcaggtgtggagcagaggcaggaagccacctccacaggtggctcaagctcaggcaggcctcctactgaattttctagaaaactgcaacacaccatgggaagtctgtcagcctattccagatgacaatgacaatggggtggcgaccccgctctcctgtctcctttcagggaaaagggtcagcagtggcctcaaacttttgagtatctactatgtgctagaccatctatatgcattatcttatttca

SEQ ID NO: 158399 - DNA, 601 bp, Human
actgtgataagaagcagaccaagtgctatgagataaagaaaaatcacactggggtgggggcaatttagaaagtgtgttgggaaaagatcacttaaagggggagttctccagggagaagaaagaaggagagggagaatggctccaggcaggggagctgcgtgtgcttagtgtctgaatcaggaagcaggcggggagttggccagagtgcagagtgaggttagtggtgagaaatgaggccagggcaaagtggagagggggcagggagattgcagaggccgaagcaaagggttttccacccaartgtgttaaatcggagagtcccctttaaaaaaacctttcccggctgctgtgtggaggacaggatggcaggaagccagaacagaagaccagctactgcgggagggaagatctgattgggatttgaataacatgcgggaagtactcaaggcagcgtcagagacagtgggtgctcagcggggcagaagccagacagtgccggggtgcagaagctaggggttcagggagctgggcaggaggcaggagcgcctctgggaagggggaaagcagagccagctgcccaccatgaccagtagcactcatc

SEQ ID NO: 158400 - DNA, 601 bp, Human
ccatctgcctggggccctgagtgatccaaggagccgaaacctcactggaggccctggagggacaagcagtatgaggtcaacctgggtctctgcagacccctcagacctgggggctgtttgttaccacagcagcacaaggtagcctctcctgcctcagaatgagcaaacacacctttctgaactcagccttgcaaactgtgataagaagcagaccaagtgctatgagataaagaaaaatcacactggggtgggggcaatttagaaagtgtgttgggaaaagatcacttaaagggggagttckccagggagaagaaagaaggagagggagaatggctccaggcaggggagctgcgtgtgcttagtgtctgaatcaggaagcaggcggggagttggccagagtgcagagtgaggttagtggtgagaaatgaggccagggcaaagtggagagggggcagggagattgcagaggccgaagcaaagggttttccacccaagtgtgttaaatcggagagtcccctttaaaaaaacctttcccggctgctgtgtggaggacaggatggcaggaagccagaacagaagaccagctactgcgggagggaag

SEQ ID NO: 158401 - DNA, 601 bp, Human
agagaatggcaggctttttcaaaggggcatgtcttgggcaagtttaaacacccatggggatgattgaggctgagtgaaaggagttgcatgaggttactgggaaggtaggaggaagtcagaaagtcagaaggtcaaaccaggcctggccttggagcccctgagaacaggaggatcaggcagtgaatgggggcggtagtcacgtccgcttgtgggtgggactggtggggggaggtctgcatggctacttctggctaaagtatttattcatttatttatttgttgttgttgtttttttttttttgagatggagtctggctctgttgcccaggctggagtgcagtggcaagatctcagctcattgcagcctctgcctcccaggttcaagggattctcgtgcctcagcctcccaagtagctgggattacaggcgcccaccaccatgcccggctaatttttgtacttttagtagagacagggtttcaccatgttggccaggctggttttgaactcctgacctcaggtgatccacccacctaggcctcccaaagtgttatgattacaggcgtgagctgccttaccctgcctggcaaaagtatttaaat

SEQ ID NO: 158402 - DNA, 601 bp, Human
gtatgcagaaggccaggccgtcagatgtcaaggagaagcgagcaacggttcacagggttagcatagtgggctgaatggtggcccccacaaagctgtctacatgctaatcctaatccccagaacctgtaaatattaccttatatgggtcgggcgtggtggttcatgcctgtaatcccaacactttgggaggctgaggtgggtggatcacttgaggttaggagttcaacaccagcctggccaacatggtgaaatcccctctctattaaaaatacaaaaatcagccaggcatggtggcatgcayctgtagtcccagctactcaggagactgaggtaggagaatcatttgaacctgggaggcggaggttgcagtgagccgagattgagccactagcactccagcctgggcaacagagcaatactccctctcaaaaaaaaaatattaacttatggcgggtggatcacctgaggtcaggagttcgagaccagcctggccaacatggtgaaaccccatgtctactaaaaatacaaaagttagctgggcatggtggcaggtacctataatcccagctactcaggaggctgaggcaggagaattgcttga

SEQ ID NO: 158403 - DNA, 601 bp, Human
ctcaaaaataaaaaataagaataaaataaaagtcaacgaaggcctgcgcgcctgctggatgctagattgtagagttaaacaggagggtccaagtcctgttcctggggcttgtacaggccccagagtgggagaggcattaagcaaatgtcacatgggaaaatgtacagtcacaaaccaagacgactccttgggaagtacgaacacagtcctatgacagagggtaacaaacaagagaagtgaatacatctagagggccaacaatgagcctgagcgaaaagctagaggatagcgaggaacccayaacacaaggcaggggtgcggagggaggcaggaagaaaattccaggcagaaggaacagcatgtgcaaggccctatggcaggagaaaacggggtatatgaaatggattaaatagaggttcagagaagggagggttcatggtactggagaggctgcaggataggaccacccaggcagggctgtgcgggccacgaggagtcaggctttatctggaaagcacacagaggccattgcagggttggcagctggttagagaaagaggatggctcctccaaggccagttagaggctactgcagccattt

SEQ ID NO: 158404 - DNA, 601 bp, Human
gaacggccaaccagctgtgtgacctcaggcaagggacctcaactctctgagcctctgttttctatccttaaccctcacagggctatggagagggcccagccagagagccggagtcacactgtatagagcatcatgcggttagagctggaatctcggctcctccactcactccctgcttgaccctgagaaagtcacttcacttcctgtgcctcggcatcctcatctgttaagtggggagaatggcagtccttccttctaggcttcatgagggttaactgcattagtaggcagggagttcttrgcacatagcaaatgctaaatagttgtcaactaaaagtcaatgaaggctgggcatgggggctcacccctgtaatccagccactttgggaggccgaggtgggtggatcacctgaggccaggagtttgagaccagcctggccaacatggtgaaaccccatctctactaaaaatgcaaaaaattagccaggcgtggtggcgcacacctgtaatcccagctacttgggaggctgagacaggagaatcacctgaacctgggaggcagaggctgcagtgagccgagattacgccactgcactccagc

SEQ ID NO: 158405 - DNA, 601 bp, Human; identical to SEQ ID NO: 17640

SEQ ID NO: 158406 - DNA, 601 bp, Human; identical to SEQ ID NO: 17641

SEQ ID NO: 158407 - DNA, 601 bp, Human; identical to SEQ ID NO: 17642

SEQ ID NO: 158408 - DNA, 601 bp, Human
ggggcagatgtgcccaggtgtgccagtgggggcaggtgtgcctgggtccaggagcagatctttggcactcaactttggggtgggaggagaatgatacaaaatggtaggttggtcctacaggccagcacaggtgttgccaagtgaagcccatgtgcccaggcacagtgatcacaggcattctgggtgaagggaggcctgcaagggccaatttccagcaaaagtcgatcccggctattcctcccaggcccttccagtcctcactgcctcacagtggctctgcttggcgcttggcacagtgacrtgatggtgagctcccccttggtgcccagctccagcgattcagcccagcacggccccttcgtgaaccccttgggcctaggttcagagagacggcaagggatgttgtatccctggagatggtggttggagacataaccgcatttctcggtgtctttgggactttcctagggaaatgaaattggcacttagggaaaatggagctctcagggaagttttgctaactacgaagccaactcagcactgtgtgtgttgtgtgtgcgttcgtgtgtgatagtgagtttccatgtaggttgtatgggtg

SEQ ID NO: 158409 - DNA, 601 bp, Human
tgtgtgcaatgtatgtggactgtgtgcatgtgtggactgtgtgtatgtgtgtgcatgtgtgtggagcgtgtgtgtgcttatgtgtggactctgtgttcatgtgtgtgtactgtatgtgtacacatgtgtgtatatatgtgtgtgtgtgcgtgtgtctgtgtggtgtgtggactgtgtggtgtgtgtgaactgtggtgtgtgtgtgcgtgactgtgtggtgtgtgtgcgcgtgtgtgtgactgcttggtgtgtgtggactgtggtgtgtgtggtgtgtgtgtgcttgtgtgtggtgtgtgttcgtgtgtgtggactgtgtggtgtgtgtggactgtggtgtgtaaggtgtgtgtgtgcttgtgtgtggtgtgtgcgtgtgtgtggactgtgtggtgcgtgtgtgtgcttgtgtgtggactgtgtggtgcgtgtgtgtggactgtgtggtgcgtgtgtgtgcttgtgcgtagcgtgtgtgcgtgtgtgtggactgtgtggcacacacgcttgcattttcccgggggctgacccattgcatttgtcatcttcttcaaaggggtctatctttgctgaaagatttgctgacaaataaagggggttc

SEQ ID NO: 158410 - DNA, 601 bp, Human
gggatgggagatgtgtccagaccctcctaggaggccacatgagtgtgactgttctcggcccaagtctttctcgttcctcagagaatttgcggggcccctgggcacacaagctgagatccacccagccctggtcccttggcaagaactgagggacaggacctggttctggggaaaatgcaggggaatgtttctcccttccacagcccccttgcgagttaggaggccggctcccaccccagaaggtggccaggttttcatgccttcctagagaaagctggggctcgtggcctccaccacaggragacgcagaccctcagaaacaagtctgtgaagtcacaaccagccccagtttacagatgtgaaactgaagctccaaaaagtcaggaggtcactgagtggggaggtgatggagtgggaacagcccccagatctggctgaggccgaagccctggagagatccccgcaaggctcccttagatgcctgacattctgttcttcctgaagcctcactcccttctctcctggcgcagacacgtccccatcagaaggcaccaacctcaacgcgcccaacagcctgggtgtcagcgccctgtgtgccatc

SEQ ID NO: 158411 - DNA, 601 bp, Human
tgggagatgtgtccagaccctcctaggaggccacatgagtgtgactgttctcggcccaagtctttctcgttcctcagagaatttgcggggcccctgggcacacaagctgagatccacccagccctggtcccttggcaagaactgagggacaggacctggttctggggaaaatgcaggggaatgtttctcccttccacagcccccttgcgagttaggaggccggctcccaccccagaaggtggccaggttttcatgccttcctagagaaagctggggctcgtggcctccaccacagggagaygcagaccctcagaaacaagtctgtgaagtcacaaccagccccagtttacagatgtgaaactgaagctccaaaaagtcaggaggtcactgagtggggaggtgatggagtgggaacagcccccagatctggctgaggccgaagccctggagagatccccgcaaggctcccttagatgcctgacattctgttcttcctgaagcctcactcccttctctcctggcgcagacacgtccccatcagaaggcaccaacctcaacgcgcccaacagcctgggtgtcagcgccctgtgtgccatctgcg

SEQ ID NO: 158412 - DNA, 601 bp, Human
tgactgttctcggcccaagtctttctcgttcctcagagaatttgcggggcccctgggcacacaagctgagatccacccagccctggtcccttggcaagaactgagggacaggacctggttctggggaaaatgcaggggaatgtttctcccttccacagcccccttgcgagttaggaggccggctcccaccccagaaggtggccaggttttcatgccttcctagagaaagctggggctcgtggcctccaccacagggagacgcagaccctcagaaacaagtctgtgaagtcacaaccagccscagtttacagatgtgaaactgaagctccaaaaagtcaggaggtcactgagtggggaggtgatggagtgggaacagcccccagatctggctgaggccgaagccctggagagatccccgcaaggctcccttagatgcctgacattctgttcttcctgaagcctcactcccttctctcctggcgcagacacgtccccatcagaaggcaccaacctcaacgcgcccaacagcctgggtgtcagcgccctgtgtgccatctgcggggaccgggccacgggcaaacactacggtgcctcgagctgt

SEQ ID NO: 158413 - DNA, 601 bp, Human
cccttccacagcccccttgcgagttaggaggccggctcccaccccagaaggtggccaggttttcatgccttcctagagaaagctggggctcgtggcctccaccacagggagacgcagaccctcagaaacaagtctgtgaagtcacaaccagccccagtttacagatgtgaaactgaagctccaaaaagtcaggaggtcactgagtggggaggtgatggagtgggaacagcccccagatctggctgaggccgaagccctggagagatccccgcaaggctcccttagatgcctgacattctgytcttcctgaagcctcactcccttctctcctggcgcagacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcaggtgaggagcctcaatttcttcagctgggaaatgggcacacttgggctcatggccccaaggtctgtcttctccctgagtgggtaggtcc

SEQ ID NO: 158414 - DNA, 601 bp, Human
tgtactcctgcaggtgaggagcctcaatttcttcagctgggaaatgggcacacttgggctcatggccccaaggtctgtcttctccctgagtgggtaggtcccagagacagctgcccttcagggccttcaaggctcttctggttttgtaaaagactttgtgaatccaagaagagcatctattctaggaaccacatttactgatcatcaagctactggctgccgtttattgagctcttatcatatgccaggcacaatactaagtctttgtgtgtatttacccatccccttgagcccattgttstttttcccattccatggggcctctcctgaagcctcagtagatgagcccgtcttccagtctggtgctgtttttgggacaaataggagattgaccccaggccgttccacctaccccaggggcttccaccaaccccaaagtcttcccaaggccttggagagccctctttcgaaagcatctcctgttctgggtaatgacaataataaaatcatagcagctgtcaattgcgagcacttgtcatgtacaaagactgtgccccatcggcgcatgacttcatttcacctgtcaacacccctgtgagat

SEQ ID NO: 158415 - DNA, 601 bp, Human
tcaacacccctgtgagatggttactgttgttattcccattttatagaggaggaagctgtggcttggagggctaggcatttgcccaaggtcaaccagcttgaatcactggcagagccagggttaacattcagggccccacccatcaccacggtgtggcactgcctctacttcctatccccctccagagagaggcttatgtgaaccgagtattaactctgagccataaccaggagcctgctatgggttctgagcttttataggatgtggtggaaatagcagggctctggtactccagaggtcraggttcccaactcagctctaacaccaaccagcagagcgacccaggaccacatgttgcctctctgagcctcagttttcccatgtttagcaggacaggactgggctcttagagagttcatagcacctttccagctcctggtgggttcaagagagaactcccgggatgaagagatgagagcactgaggttggggggtcaactggatagccagggccctagttctgtcctaagaggaggaagttgtgtcttctccatccaaccatccaaagccctccccagatttagccggcagtgcgtggtgg

SEQ ID NO: 158416 - DNA, 601 bp, Human
attttatagaggaggaagctgtggcttggagggctaggcatttgcccaaggtcaaccagcttgaatcactggcagagccagggttaacattcagggccccacccatcaccacggtgtggcactgcctctacttcctatccccctccagagagaggcttatgtgaaccgagtattaactctgagccataaccaggagcctgctatgggttctgagcttttataggatgtggtggaaatagcagggctctggtactccagaggtcaaggttcccaactcagctctaacaccaaccagcagagygacccaggaccacatgttgcctctctgagcctcagttttcccatgtttagcaggacaggactgggctcttagagagttcatagcacctttccagctcctggtgggttcaagagagaactcccgggatgaagagatgagagcactgaggttggggggtcaactggatagccagggccctagttctgtcctaagaggaggaagttgtgtcttctccatccaaccatccaaagccctccccagatttagccggcagtgcgtggtggacaaagacaagaggaaccagtgccgctactgcaggct

SEQ ID NO: 158417 - DNA, 601 bp, Human
tgctttaaagtaacttgaggccaggcgcagtgaatcaggcctgtaatcccagcactttgggaggccgaggcaggcaaatcatttgaggtcaagagttcgagaccatcctgaccaacatggtaaaaccccgtctctactaaaaatacaaaaaaattagctgggcgtggtggtgcatgcctgtagtcctagctactcggaaggctgaggcaggagaattgcttgaacccaagaggaggcggttgcagtgagctgagatcatgccactgcactccagactgggcaagacagcgagactctctcwaaaaaaataaaaaagtaacgagttcattttcgaatctcttcatttcctgctcctctaaactcaacctttcccagctctgcgactagtcccagaccttcccttctagcccacagttgtgccgtaccagccaaaccttggtctagtcctgctagttcggtacaaacacccctcacccccatcaccccagcacaccccagaagcaggaacgtaggacccagcttgctccagggcccactgagaaggaggggaggggaggctttggtagactctctttcccctgtatctgctcctggccccctg

SEQ ID NO: 158418 - DNA, 601 bp, Human
gctttaaagtaacttgaggccaggcgcagtgaatcaggcctgtaatcccagcactttgggaggccgaggcaggcaaatcatttgaggtcaagagttcgagaccatcctgaccaacatggtaaaaccccgtctctactaaaaatacaaaaaaattagctgggcgtggtggtgcatgcctgtagtcctagctactcggaaggctgaggcaggagaattgcttgaacccaagaggaggcggttgcagtgagctgagatcatgccactgcactccagactgggcaagacagcgagactctctcamaaaaaataaaaaagtaacgagttcattttcgaatctcttcatttcctgctcctctaaactcaacctttcccagctctgcgactagtcccagaccttcccttctagcccacagttgtgccgtaccagccaaaccttggtctagtcctgctagttcggtacaaacacccctcacccccatcaccccagcacaccccagaagcaggaacgtaggacccagcttgctccagggcccactgagaaggaggggaggggaggctttggtagactctctttcccctgtatctgctcctggccccctgt

SEQ ID NO: 158419 - DNA, 601 bp, Human
atggggggcagggccagggtgggagtcatgttgtgttagacagggtggctggagagggtgtctgaaaggcgacatttgtgcagaggcaggagtgaaatgaagatgctgctgcgctgtgcaggaaagggaaccccaggcagtgaccacagcagcctacaagcgtgcggatgcgtccaggtggggaggcgggttttcgcggacagagtgtgtagggggaagccggtaaaaggtgcgatccgagaggagaggaagggccctggggacttgtgaggttggaaggcactggttttgagcagcaggsgacatgacttgaacggatccctctgtctctgagaggaacacagactgcaggcgcaaggcagaagcagagcccaggaggaggctgatctaatccaggagagacagcgggcctgggagcagggagggagcagcaggtctgtttgtcaggatcacgacagcactggggtgtgaggggaagccaaggaaggtggccaggcttgatgccagtccctgagacgagaaagagtgcagggagccggctggcagggaaatgcctacgggtagggaaactgagccccagagagaggctgcgattgccacc

SEQ ID NO: 158420 - DNA, 601 bp, Human
tgctgcgctgtgcaggaaagggaaccccaggcagtgaccacagcagcctacaagcgtgcggatgcgtccaggtggggaggcgggttttcgcggacagagtgtgtagggggaagccggtaaaaggtgcgatccgagaggagaggaagggccctggggacttgtgaggttggaaggcactggttttgagcagcaggcgacatgacttgaacggatccctctgtctctgagaggaacacagactgcaggcgcaaggcagaagcagagcccaggaggaggctgatctaatccaggagagacagcrggcctgggagcagggagggagcagcaggtctgtttgtcaggatcacgacagcactggggtgtgaggggaagccaaggaaggtggccaggcttgatgccagtccctgagacgagaaagagtgcagggagccggctggcagggaaatgcctacgggtagggaaactgagccccagagagaggctgcgattgccaccggcacacagagtggcaggttccagacaggaagccgggtctggtgcagcttcaacctccctcctttctgaatcagccaagcctcattccacagtgaggcctcttgga

SEQ ID NO: 158421 - DNA, 601 bp, Human
ggcagaagcagagcccaggaggaggctgatctaatccaggagagacagcgggcctgggagcagggagggagcagcaggtctgtttgtcaggatcacgacagcactggggtgtgaggggaagccaaggaaggtggccaggcttgatgccagtccctgagacgagaaagagtgcagggagccggctggcagggaaatgcctacgggtagggaaactgagccccagagagaggctgcgattgccaccggcacacagagtggcaggttccagacaggaagccgggtctggtgcagcttcaacctycctcctttctgaatcagccaagcctcattccacagtgaggcctcttggactccaagggctatcccatccactgtcgggatggtggaaggatcatcttctatctcaggccaggactgacccagatgggagcaggcagtggagcctggggccccggtgggcgtaggctccagatccctcagtgcctggaacagagcagcagtgggagggagggagacagcgcctggccttgctgatgctgaggttagtctggagtacatgcagctcctgctgatggacaaaaccatcaaggcagttggagcc

SEQ ID NO: 158422 - DNA, 601 bp, Human
tgatgccagtccctgagacgagaaagagtgcagggagccggctggcagggaaatgcctacgggtagggaaactgagccccagagagaggctgcgattgccaccggcacacagagtggcaggttccagacaggaagccgggtctggtgcagcttcaacctccctcctttctgaatcagccaagcctcattccacagtgaggcctcttggactccaagggctatcccatccactgtcgggatggtggaaggatcatcttctatctcaggccaggactgacccagatgggagcaggcagtggarcctggggccccggtgggcgtaggctccagatccctcagtgcctggaacagagcagcagtgggagggagggagacagcgcctggccttgctgatgctgaggttagtctggagtacatgcagctcctgctgatggacaaaaccatcaaggcagttggagcccccagatcctcttgttcaggaatccccaggccatctccttgtcacccagagtaatttgttttgcttgctttactcactttcatttggaaagaaagggacccttttgtagaccagagcttgaacatctttaagctagtcaga

SEQ ID NO: 158423 - DNA, 601 bp, Human
aggttagtctggagtacatgcagctcctgctgatggacaaaaccatcaaggcagttggagcccccagatcctcttgttcaggaatccccaggccatctccttgtcacccagagtaatttgttttgcttgctttactcactttcatttggaaagaaagggacccttttgtagaccagagcttgaacatctttaagctagtcagatcccctcctcaatgctcaagaccaattttaaacccatagccgagtcttcactgtcttgcgcgcccctgctgatgggtggatcactcttatagcctctscattgtgttgggggcagttgtgatatgtggaaagttcttccaccagctgagttagaggccatctcccctcattccacatgctgatgtgggcctgttctctggacaccccccacctcctgctcccactcctcatcagtcacagacacccccaccccctactccatccctgttctccctcctcacctctctgtgcctcctcacagccgtccagaatgagcgggaccggatcagcactcgaaggtcaagctatgaggacagcagcctgccctccatcaatgcgctcctgcaggcggaggtcct

SEQ ID NO: 158424 - DNA, 601 bp, Human
caccccctactccatccctgttctccctcctcacctctctgtgcctcctcacagccgtccagaatgagcgggaccggatcagcactcgaaggtcaagctatgaggacagcagcctgccctccatcaatgcgctcctgcaggcggaggtcctgtcccgacaggtaccggggtgatcctgccacccacccagggatcccccacactacagaggagctcacctcctccacctccattctccccagccaggccctggagcagctgacgggaggggcctcagatattacagaagggacactgagtscggtttcacatggcccagtttgcagcaagggcaggaatcgaacctggcgccctggggcactttctaattcatcctactgcctgcatcccacaggccaagcagagtcttcaccttcactgagggcctgcgatcagctcagctccgagagaacagagcagtggctcagtggagagaggtggcaaagtggggcccagcccttcccttgctgagtgaccttgggcaagtcacagcacctctctgagccatggttgcctcattgtcagaaaaggatgatgattttttgccctgcttctcctctaa

SEQ ID NO: 158425 - DNA, 601 bp, Human
catcctactgcctgcatcccacaggccaagcagagtcttcaccttcactgagggcctgcgatcagctcagctccgagagaacagagcagtggctcagtggagagaggtggcaaagtggggcccagcccttcccttgctgagtgaccttgggcaagtcacagcacctctctgagccatggttgcctcattgtcagaaaaggatgatgattttttgccctgcttctcctctaaggctgacagactccttggggctctaaagctgacagaggagggggcagggggcaggtaacaggtgaaggcmcagagggagcccttctccctcatccctgcctcctccctccctccgtttttaccctgagcttccttcagagctggagggcacccactatccagccccctccccacatctgattccagggagggggctctgtgcaggggacagagagtgcgggagggcccggacatctccagcattttcttccctgtatctctcgaagatcacctcccccgtctccgggatcaacggcgacattcgggcgaagaagattgccagcatcgcagatgtgtgtgagtccatgaaggagcagctgctggttctcgt

SEQ ID NO: 158426 - DNA, 601 bp, Human
gagaggtggcaaagtggggcccagcccttcccttgctgagtgaccttgggcaagtcacagcacctctctgagccatggttgcctcattgtcagaaaaggatgatgattttttgccctgcttctcctctaaggctgacagactccttggggctctaaagctgacagaggagggggcagggggcaggtaacaggtgaaggcacagagggagcccttctccctcatccctgcctcctccctccctccgtttttaccctgagcttccttcagagctggagggcacccactatccagccccctccscacatctgattccagggagggggctctgtgcaggggacagagagtgcgggagggcccggacatctccagcattttcttccctgtatctctcgaagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtgaggatgggcgtggatggtgggcagtagtgggcagtgggcggggcag

SEQ ID NO: 158427 - DNA, 601 bp, Human
cttgggcaagtcacagcacctctctgagccatggttgcctcattgtcagaaaaggatgatgattttttgccctgcttctcctctaaggctgacagactccttggggctctaaagctgacagaggagggggcagggggcaggtaacaggtgaaggcacagagggagcccttctccctcatccctgcctcctccctccctccgtttttaccctgagcttccttcagagctggagggcacccactatccagccccctccccacatctgattccagggagggggctctgtgcaggggacagagartgcgggagggcccggacatctccagcattttcttccctgtatctctcgaagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtgaggatgggcgtggatggtgggcagtagtgggcagtgggcggggcagccagggggctgctggcccacctgggatatagccgtggactggct

SEQ ID NO: 158428 - DNA, 601 bp, Human
ggaagaaagggttgaaggaaggtggcgtgtgtctgaggacagatgaatttcggagatgccacctatgaagctcctgcccagagcacccctgggcctccaaagagatgttacccatctggggaagaggagctgggctgggccacctcctcagcttcggagacagactctggtgcattcgcttacccgtttcgcacctttgcataagacactgacaatgcatgtgagtctgtgaaagcttctgagaagtctcgtccaggcagttgtttgactttgcagaggccgaggcttctcaaactccttyggcaagattctcctggaacacctattaatactgcacattgggacactgtgaaaacgctggtttggcttgtccccagcctcatacaggggctggacccggggccctcttccatggttcctccttccattagcagagtcgacagggcaaggatcttggacaatccgcccctaccctctcccctgttccttgtgctctggccccagtcccctctgctggagtctctacattaatgtttaatccctcctgttccttcccaggggcttagcagggcaacaagatacccccaacctgagcaattgt

SEQ ID NO: 158429 - DNA, 601 bp, Human
ttaggatttgataactgaaagaatgaacaatcaaattaatgaacaaacaaaggcattttaaccttctagtttggcttgctatggaacctccaaactccctaacccaaccttgaagatgagaagatgagatccttgaggctaccagcctggtgctgttttgtttcaagccatcctttggtcctcaggcaagcactaaagcagatggctctcagtgggctggctatgtccttctgtgagcttgctgggcccctacctatgactccagtcttagaagtcttgccttgtaccccctgcagagaakggtttcatcaagctgattctctgccaggggccagtgctcatacatttgctctgagaaggaccagccctgagacctaacatccacatccaagttcttgtaatgccctctcagaatcctggagtcctgcaatgtcgatccctggagggatctgccagaccaatgatttcccaaacagaattgcacttcagagtcaactatggagctttttaaacacagatccctgggcccaccctaaacatacaaaatcaggatcagaatctcagggcctaagaatctgtattttcaggccgggcgcagtgg

SEQ ID NO: 158430 - DNA, 601 bp, Human
ttccttctctctttcaggtggccctgctcagagcccatgctggcgagcacctgctgctcggagccaccaagagatccatggtgttcaaggacgtgctgctcctaggtgaggcggctgcctgccctggccagggctccagggagggtatgcctagcatggcactcacccaggcaaggagattcacatggtggcatgcaagggtgagggagactagtcaggagtggccctgtcctcaggcttgcattggagggctccaggactcagttttcaactgggtaccccactcagatgcaaggaaatrtggatgcaagtcaccaaattcccagcattgaagtcagagcacgatcagggttatccctggaattacctgtgcatccttttttcttttgacagagtcttgctctgtcactcaggctggagtgcaatgatgtgatctcggctcacttcagcctccacccgccacgttcaagcaattctcctgcctcaccctccagagttgctgggaccacaggcgtgcaccaccacacccagctaatttttgtatttttagtagagacagggtttcaccatgttgaccaggctggtctcaaactcctggcct

SEQ ID NO: 158431 - DNA, 601 bp, Human
cacccaggcaaggagattcacatggtggcatgcaagggtgagggagactagtcaggagtggccctgtcctcaggcttgcattggagggctccaggactcagttttcaactgggtaccccactcagatgcaaggaaatgtggatgcaagtcaccaaattcccagcattgaagtcagagcacgatcagggttatccctggaattacctgtgcatccttttttcttttgacagagtcttgctctgtcactcaggctggagtgcaatgatgtgatctcggctcacttcagcctccacccgccacrttcaagcaattctcctgcctcaccctccagagttgctgggaccacaggcgtgcaccaccacacccagctaatttttgtatttttagtagagacagggtttcaccatgttgaccaggctggtctcaaactcctggcctcaaataatccacccgcctcagtctcccaaagtgctgggattacaggtgtgagccaccgcgcctggcctacctgtgcattctgatgttctttctggagtaggagcaagaggtggttaagaatggcacaaagccccagcccgcgtcacctgtgccttcatggcat

SEQ ID NO: 158432 - DNA, 601 bp, Human
gcaggagaattgcttgaacctgggaggcggaggttgcagtgagccaagatcccgccactgcattccagcctgggtgactccatctcaaaaaaacaaaaacaaagggaggatatgacttgacagggcaccctgactccaaaggcctgggctttcccttcttttacttcttccctccatccttctttctctttacttcccatcttcctcttttctttcatatttgcttcttttcctcaaaaaaatttatcaaaataatatctagaaccggatgtggtggctcacatctgtaatcccagcactwtgggaggcagaggcaggaggatcacttcaggccaggagttcgaggccagcctggccaacataacaagacctcgtctctatagaaactaaaaaaaattagccagggatagtggtgagcacctgcagtcccagctactcgggaggccaaggtgagcacctgcagtcccagctactcaggaggccaaggtgggaggatctcttgagcccaggaggtggaggctgctgtgagatgtgattgcaccactgcactccagtctgggtgacaaagcaagacctcatctaaaaaataataataaataaa

SEQ ID NO: 158433 - DNA, 601 bp, Human
tcacgctgcaaatagattacctctagtaataatagtaatgaaaaggctgggtgtggtggctcacgcctgtaatcccagcactttgggagactgaggcaggcagattacttgacgtcaggagttcaagaccagcctggccaacatggtgaaaccccgtctctactaaaaatacaaaaatcagttgtgtgtggtggtccgtgcctgtaatcccagctactcaggaggctgaggcaggagaatcgcttgaacctgggaggcgggggttgcagtgagccaagatcatgccattgcactccagcckgggcaacaagagcaaaacttcatctcaaaaaaatacatatatgtgtatatatatataatatatattatatatatataatatatagtgatatatatagtatatagtgatatattacgtataatatatattatatatagtgatatatattttatatatatatagtgatatatattatatatagagagagtgatgaagtggaagatgagccccatgtattgaatgctccctaaagagctgtttttaaacactttatgtggattgtcttacttaccaacatggtacctgtgaagtaggaattat

SEQ ID NO: 158434 - DNA, 601 bp, Human
caggagttcaagaccagcctggccaacatggtgaaaccccgtctctactaaaaatacaaaaatcagttgtgtgtggtggtccgtgcctgtaatcccagctactcaggaggctgaggcaggagaatcgcttgaacctgggaggcgggggttgcagtgagccaagatcatgccattgcactccagccggggcaacaagagcaaaacttcatctcaaaaaaatacatatatgtgtatatatatataatatatattatatatatataatatatagtgatatatatagtatatagtgatatattaygtataatatatattatatatagtgatatatattttatatatatatagtgatatatattatatatagagagagtgatgaagtggaagatgagccccatgtattgaatgctccctaaagagctgtttttaaacactttatgtggattgtcttacttaccaacatggtacctgtgaagtaggaattattattatctccattttacagataaggaaactgaggcatgattaacttgctcaaggtcacacaaccggaaaatggcagagcttggatttgaactgcagaccacctgtcaatcccaat

SEQ ID NO: 158435 - DNA, 601 bp, Human
tatagtatatagtgatatattacgtataatatatattatatatagtgatatatattttatatatatatagtgatatatattatatatagagagagtgatgaagtggaagatgagccccatgtattgaatgctccctaaagagctgtttttaaacactttatgtggattgtcttacttaccaacatggtacctgtgaagtaggaattattattatctccattttacagataaggaaactgaggcatgattaacttgctcaaggtcacacaaccggaaaatggcagagcttggatttgaactkcagaccacctgtcaatcccaatttctctctctcaagcccacattcttacctaccacctgctatcccacacttaccagagggtgagatttctagttctagttccctccacagcctggcccagcctgtatcctctgtagtgctcaacacgaggctggactggcagaattgttctgcaaaatgggaaggatcactgatgctgagtcagaggcagcagcctccagcaatttgaaggggcgggggacctagttcaaggcctggcatgcaggaggtgctcaataaacatgtgtggcctgaatgaac

SEQ ID NO: 158436 - DNA, 601 bp, Human
tttacagataaggaaactgaggcatgattaacttgctcaaggtcacacaaccggaaaatggcagagcttggatttgaactgcagaccacctgtcaatcccaatttctctctctcaagcccacattcttacctaccacctgctatcccacacttaccagagggtgagatttctagttctagttccctccacagcctggcccagcctgtatcctctgtagtgctcaacacgaggctggactggcagaattgttctgcaaaatgggaaggatcactgatgctgagtcagaggcagcagcctccmgcaatttgaaggggcgggggacctagttcaaggcctggcatgcaggaggtgctcaataaacatgtgtggcctgaatgaactaatgaataagcatgattcagtggagacagcccactagaaatgtgggtgaatgttctttctgccacttcctttgtccatgaaagaggaaataaatgcattacctccatgaaggttgagattaaatattgtatgaccgcttaagttcctttccaggctaaggatctagaatttattcactgatttttttttcattcattcatccagccatctaacaaaaaa

SEQ ID NO: 158437 - DNA, 601 bp, Human
agtgctcaacacgaggctggactggcagaattgttctgcaaaatgggaaggatcactgatgctgagtcagaggcagcagcctccagcaatttgaaggggcgggggacctagttcaaggcctggcatgcaggaggtgctcaataaacatgtgtggcctgaatgaactaatgaataagcatgattcagtggagacagcccactagaaatgtgggtgaatgttctttctgccacttcctttgtccatgaaagaggaaataaatgcattacctccatgaaggttgagattaaatattgtatgacygcttaagttcctttccaggctaaggatctagaatttattcactgatttttttttcattcattcatccagccatctaacaaaaaatatacatatagttatcaataaatatatatttatatataaatatatattttttaaaatatatatatatatagtctgtcacccaggctggagtgcagtggcaccgtcttggctcactgcgacctccacctcccagtttcaagcgattctcccacctcacctcctgagtcgctgggattacaggcatgtgtcaccacgccaggtgaatttttgtattat

SEQ ID NO: 158438 - DNA, 601 bp, Human
ctggactggcagaattgttctgcaaaatgggaaggatcactgatgctgagtcagaggcagcagcctccagcaatttgaaggggcgggggacctagttcaaggcctggcatgcaggaggtgctcaataaacatgtgtggcctgaatgaactaatgaataagcatgattcagtggagacagcccactagaaatgtgggtgaatgttctttctgccacttcctttgtccatgaaagaggaaataaatgcattacctccatgaaggttgagattaaatattgtatgaccgcttaagttcctttcyaggctaaggatctagaatttattcactgatttttttttcattcattcatccagccatctaacaaaaaatatacatatagttatcaataaatatatatttatatataaatatatattttttaaaatatatatatatatagtctgtcacccaggctggagtgcagtggcaccgtcttggctcactgcgacctccacctcccagtttcaagcgattctcccacctcacctcctgagtcgctgggattacaggcatgtgtcaccacgccaggtgaatttttgtattatcagtagagatggggtt

SEQ ID NO: 158439 - DNA, 601 bp, Human
aactgaaaaggaatcctctttagataggggaggccacaggagacctctctgaagtggtgactcttgtgctaagaccctaacggctgaaaggaaatggaaggcttaaaagacaagagaggaatattccaagaagaagaaactacttcaagggctgcggataggagagagtgttgtgtttgagaaagaagggcaaggttgtgagatggaggacgtgtaggaggtgaagatggagattgggcagaaaccaaatcataaacatatggctttgtcagccttttcagaaatttggattttattctcwttgcaactattgtaaggagagtgaaaaccagactaagtatttttattctttgagacaaagtctccctcaatcatccaggctggagtgcagtggcacaatcttggctgactgcaacctccacctcccgagttcaagcaattctcctgccacagcctcctgagtagttgggattacaggcgcccgccaccacgccctgctcatttttttatatttttagtaaagacagggtttcaccctattggccaagatggtctcaaactcctgacctcaagtgatcacccacctcagtctcccaaagtg

SEQ ID NO: 158440 - DNA, 601 bp, Human
ggacaaagtctacatttttgctttgagtagcagaaatgacgatggagtaatttactgaaatgaggaggacagaataaacaacaagacactgggtctgggggtggtagtgaggggtgacctcagagatccattgtggaccctcttttcttttttcctttttttttttttttttgagacgagatctctctctgccacccaggctggagtgcagtggcgcaatcatagttcactgtagcctcaaccttccaggctcaagagatcctcctaccccagcctttcaagtagctgggactacaggtgygtgccaccacacccagctaattcttcattcttattttttatagagacaaggtctcactatgttgcccaggctggtcttgaactcctagccttaagcaatccttccgacttggcctctcaaagtgctgggattacaggtgtgagccaccatgcccagcctcattgtggactttcattaagcatgagatgactattacaaatccaagttatcaaggaggctgttgaatgtatgagtctgttgctcaagcacaagattaaaggcagctctgtggaatcagggggaagatggagccatggaggg

SEQ ID NO: 158441 - DNA, 601 bp, Human
gatggagtaatttactgaaatgaggaggacagaataaacaacaagacactgggtctgggggtggtagtgaggggtgacctcagagatccattgtggaccctcttttcttttttcctttttttttttttttttgagacgagatctctctctgccacccaggctggagtgcagtggcgcaatcatagttcactgtagcctcaaccttccaggctcaagagatcctcctaccccagcctttcaagtagctgggactacaggtgtgtgccaccacacccagctaattcttcattcttattttttrtagagacaaggtctcactatgttgcccaggctggtcttgaactcctagccttaagcaatccttccgacttggcctctcaaagtgctgggattacaggtgtgagccaccatgcccagcctcattgtggactttcattaagcatgagatgactattacaaatccaagttatcaaggaggctgttgaatgtatgagtctgttgctcaagcacaagattaaaggcagctctgtggaatcagggggaagatggagccatggagggaagggaagaagactggccagaggggtaggagaaaaccagg

SEQ ID NO: 158442 - DNA, 601 bp, Human
tggagtaatttactgaaatgaggaggacagaataaacaacaagacactgggtctgggggtggtagtgaggggtgacctcagagatccattgtggaccctcttttcttttttcctttttttttttttttttgagacgagatctctctctgccacccaggctggagtgcagtggcgcaatcatagttcactgtagcctcaaccttccaggctcaagagatcctcctaccccagcctttcaagtagctgggactacaggtgtgtgccaccacacccagctaattcttcattcttattttttatrgagacaaggtctcactatgttgcccaggctggtcttgaactcctagccttaagcaatccttccgacttggcctctcaaagtgctgggattacaggtgtgagccaccatgcccagcctcattgtggactttcattaagcatgagatgactattacaaatccaagttatcaaggaggctgttgaatgtatgagtctgttgctcaagcacaagattaaaggcagctctgtggaatcagggggaagatggagccatggagggaagggaagaagactggccagaggggtaggagaaaaccagggc

SEQ ID NO: 158443 - DNA, 601 bp, Human
attacaggtgtgagccaccatgcccagcctcattgtggactttcattaagcatgagatgactattacaaatccaagttatcaaggaggctgttgaatgtatgagtctgttgctcaagcacaagattaaaggcagctctgtggaatcagggggaagatggagccatggagggaagggaagaagactggccagaggggtaggagaaaaccagggcaattccagaatccaagagaagagcgtgtttgaaggacagagtgtttaatggtgttaaactctacagagaaacagaaagaagcggggargaaaggagaggtgaagagaggaggggaagagagaggaaagggtccattggattgacagctggaggctcttggcaattgtgttgaaagcagcatcagagagctgggagagtggaaaccagattggagagtgctccaaagagagtgagtgggaaggtggagatagagtagataaccctttgaaatggtttgactatgaaggggagtatgaaggagttaggatgactgcaagggagtgattagaatgataggtcatggagtctgggctgcactcaaaaagaaataaagatagaggccgggcac

SEQ ID NO: 158444 - DNA, 601 bp, Human
tgttatgtgatagctcatttcattctcactttgaccctgtgaacatggggttattatgaatcaggtgtcattgagatcaggatcaggagcctgtggtctgttgccaaataattaagagctctctgggctcagttgtctcatctgtagaatgggctaataatagtatccatcctataggattgctgtgaggattaaattatgtgaaacatgggaagtgctatacaacagtacctggcacgtgataattgttaattatcaacaattgttatttatcactgaaatagatgtactgtagagatckcttgcaagcgttgaaattccatcatcgtcatattactcaccataggctattattaaaccatatcccatgtggtatttttactccctgacatatgtttgaagcggttactgtgttccagacaatctgctaggccctcaaagaaagaagaaaaatacctctgaaattgtaatgctcatagacagaagaagtggttgttcctaaaagttgtgttacagacaaattactatgagaaatccaaggaaggagaatcaggagaggcttctaaagagaggaaatatatgagctgggatttgggcttat

SEQ ID NO: 158445 - DNA, 601 bp, Human
ttccagacaatctgctaggccctcaaagaaagaagaaaaatacctctgaaattgtaatgctcatagacagaagaagtggttgttcctaaaagttgtgttacagacaaattactatgagaaatccaaggaaggagaatcaggagaggcttctaaagagaggaaatatatgagctgggatttgggcttatggacatggaacaggtttggggtggaaaaacatctctgacagaagcaacaacgtgagcagaagcatagagatagaaaaacacaggggacacatagatgctataagtaggtcagytggctgcagcagagatgtgggggatgaggctgaaaggtgaggcgggaccaaatggttgaaggacttgcactccaaggagctttgagagccattgattacatccattatgttactatgtgaccaatacactactcattagaacatttacgtgatctcagagcttccttatatgcaccttgttcctttcaactcacttttgttctcttggttttttggggtcctcttaacaccctcatgaagtctatagatgggaatggtacaccctagtttactaacccaggaataggtacccaacaggca

SEQ ID NO: 158446 - DNA, 601 bp, Human
accatcctctgaaacctccaaagtataaacttgtcattgggcaaagctcttcaaaggataagattatcaatgggatgaagtgatccactgagataagatgatattttactgacattgttctcagggaaagttttccattgaacaaagatggccaattgggtcaaatttgctctccaaacctgccatgagagtgaggccaattagtttctattactcatctcctaaatatccaagaaatggtattttttgagccagctggtccggggtttcatcaactgctgctccttctcccaggaaagamtatccctgtcacccatcccattgccgctggggacagccaggcctgggccttggtttgggagaagcagtccaagtctgcatatcaaataaatgatggaggagatgggtggtaggaccttccagacctcataaaacttaggctttatgatctgggactcacagaaggttgagcaataaaagaccttagggattatctggtttaattaattctctcattttatagaggaagaaattaagtcaaggtggggcagggtgggaggggagaactttcccgggcctcttcatttactcccacaaaggc

SEQ ID NO: 158447 - DNA, 601 bp, Human
gaggccaattagtttctattactcatctcctaaatatccaagaaatggtattttttgagccagctggtccggggtttcatcaactgctgctccttctcccaggaaagaatatccctgtcacccatcccattgccgctggggacagccaggcctgggccttggtttgggagaagcagtccaagtctgcatatcaaataaatgatggaggagatgggtggtaggaccttccagacctcataaaacttaggctttatgatctgggactcacagaaggttgagcaataaaagaccttagggattmtctggtttaattaattctctcattttatagaggaagaaattaagtcaaggtggggcagggtgggaggggagaactttcccgggcctcttcatttactcccacaaaggctggaattttgagcagcccctgtctgtctgtttgtccttccagccacccctgagaccccacagccctcaccgccaggtggctcagggtctgagccctataagctcctgccgggagccgtcgccacaatcgtcaagcccctctctgccatcccccagccgaccatcaccaagcaggaagttatctagcaagccg

SEQ ID NO: 158448 - DNA, 601 bp, Human
aattagtttctattactcatctcctaaatatccaagaaatggtattttttgagccagctggtccggggtttcatcaactgctgctccttctcccaggaaagaatatccctgtcacccatcccattgccgctggggacagccaggcctgggccttggtttgggagaagcagtccaagtctgcatatcaaataaatgatggaggagatgggtggtaggaccttccagacctcataaaacttaggctttatgatctgggactcacagaaggttgagcaataaaagaccttagggattatctggyttaattaattctctcattttatagaggaagaaattaagtcaaggtggggcagggtgggaggggagaactttcccgggcctcttcatttactcccacaaaggctggaattttgagcagcccctgtctgtctgtttgtccttccagccacccctgagaccccacagccctcaccgccaggtggctcagggtctgagccctataagctcctgccgggagccgtcgccacaatcgtcaagcccctctctgccatcccccagccgaccatcaccaagcaggaagttatctagcaagccgctgggg

SEQ ID NO: 158449 - DNA, 601 bp, Human
tgctgctccttctcccaggaaagaatatccctgtcacccatcccattgccgctggggacagccaggcctgggccttggtttgggagaagcagtccaagtctgcatatcaaataaatgatggaggagatgggtggtaggaccttccagacctcataaaacttaggctttatgatctgggactcacagaaggttgagcaataaaagaccttagggattatctggtttaattaattctctcattttatagaggaagaaattaagtcaaggtggggcagggtgggaggggagaactttcccgggsctcttcatttactcccacaaaggctggaattttgagcagcccctgtctgtctgtttgtccttccagccacccctgagaccccacagccctcaccgccaggtggctcagggtctgagccctataagctcctgccgggagccgtcgccacaatcgtcaagcccctctctgccatcccccagccgaccatcaccaagcaggaagttatctagcaagccgctggggcttgggggctccactggctccccccagccccctaagagagcacctggtgatcacgtggtcacggcaaaggaagacgtg

SEQ ID NO: 158450 - DNA, 601 bp, Human; identical to SEQ ID NO: 28977

SEQ ID NO: 158451 - DNA, 601 bp, Human; identical to SEQ ID NO: 28978

SEQ ID NO: 158452 - DNA, 601 bp, Human; identical to SEQ ID NO: 28979

SEQ ID NO: 158453 - DNA, 601 bp, Human; identical to SEQ ID NO: 28980

SEQ ID NO: 158454 - DNA, 601 bp, Human; identical to SEQ ID NO: 28981

SEQ ID NO: 158455 - DNA, 601 bp, Human; identical to SEQ ID NO: 28982

SEQ ID NO: 158456 - DNA, 601 bp, Human; identical to SEQ ID NO: 28983

SEQ ID NO: 158457 - DNA, 601 bp, Human; identical to SEQ ID NO: 28984

SEQ ID NO: 158458 - DNA, 601 bp, Human; identical to SEQ ID NO: 28985

SEQ ID NO: 158459 - DNA, 601 bp, Human; identical to SEQ ID NO: 28986

SEQ ID NO: 158460 - DNA, 601 bp, Human; identical to SEQ ID NO: 28987

SEQ ID NO: 158461 - DNA, 601 bp, Human; identical to SEQ ID NO: 28988

SEQ ID NO: 158462 - DNA, 601 bp, Human; identical to SEQ ID NO: 28989

SEQ ID NO: 158463 - DNA, 601 bp, Human; identical to SEQ ID NO: 28990

SEQ ID NO: 158464 - DNA, 601 bp, Human; identical to SEQ ID NO: 28991

SEQ ID NO: 158465 - DNA, 601 bp, Human; identical to SEQ ID NO: 28992

SEQ ID NO: 158466 - DNA, 601 bp, Human
gccagctgaagatgagtggggtaaaaccccagatgccatgaaagctgccatggccctggagaaaaagctgaaccaggcccttttggatcttcatgccctggattctgcccacatggacccccatctctgtgacttcctggagactcacttcctagatgaggaagtgaagctcatcaagaagatgggtgaccacctgacgaacctccacaggctgggaggcccagaggctgggctgggcgagtatctcttcgaaaggctcactctcaagcacgtctaagagccttatgagcccagcgacttytgaagggccccttgcaaagtaatagggcttctgcctaagcctctccctccagccaataggcagctttcttaactaccctaacaagccttggaccaaatggaaataaggctttctgatgcaaaaaaaaaaaaaaaaaaaaaaaaaaaaagaataagaggtgatattacacccatgaaacaagaataagatgctattttgagacaagaaacaaaaaataagctttaaaataaacacacacacatacacacacatacacacaacagcagaaatgaaaaattcaatggatggcttgagaaaaat

SEQ ID NO: 158467 - DNA, 601 bp, Human
tgaaccaggcccttttggatcttcatgccctggattctgcccacatggacccccatctctgtgacttcctggagactcacttcctagatgaggaagtgaagctcatcaagaagatgggtgaccacctgacgaacctccacaggctgggaggcccagaggctgggctgggcgagtatctcttcgaaaggctcactctcaagcacgtctaagagccttatgagcccagcgacttctgaagggccccttgcaaagtaatagggcttctgcctaagcctctccctccagccaataggcagctttyttaactaccctaacaagccttggaccaaatggaaataaggctttctgatgcaaaaaaaaaaaaaaaaaaaaaaaaaaaaagaataagaggtgatattacacccatgaaacaagaataagatgctattttgagacaagaaacaaaaaataagctttaaaataaacacacacacatacacacacatacacacaacagcagaaatgaaaaattcaatggatggcttgagaaaaatgtctagaatatctcacagaaaatagatctgaaagacaaaacaatgaaaaacaggaaagaaaagatgag

SEQ ID NO: 158468 - DNA, 601 bp, Human
cttcctagatgaggaagtgaagctcatcaagaagatgggtgaccacctgacgaacctccacaggctgggaggcccagaggctgggctgggcgagtatctcttcgaaaggctcactctcaagcacgtctaagagccttatgagcccagcgacttctgaagggccccttgcaaagtaatagggcttctgcctaagcctctccctccagccaataggcagctttcttaactaccctaacaagccttggaccaaatggaaataaggctttctgatgcaaaaaaaaaaaaaaaaaaaaaaaaaaaaagaataagaggtgatattacacccatgaaacaagaataagatgctattttgagacaagaaacaaaaaataagctttaaaataaacacacacacatacacacacatacacacaacagcagaaatgaaaaattcaatggatggcttgagaaaaatgtctagaatatctcacagaaaatagatctgaaagacaaaacaatgaaaaacaggaaagaaaagatgaggaatgtagggggaatagtccaaaaggtttaacatctgaataacaagcatttcagaaaaggagggaaggaaatcatcaat

SEQ ID NO: 158469 - DNA, 601 bp, Human
cagtctttctgtatctgagttttcctctagataggaaggaagaaaacgtgccatacctgcaaggaaacctcacattttgtattcgcttctaagatgtcacactctctctgcccgtctagagagattctgttgtctgattctgtatctgtttggctttttaaagccaggcgactacagagaggcaggaatacatgtatgatgctatttagtgcctgcataatttcccttattattgttattgtcatgtaagtatgatgagataaaagtgagtcccatatatatataagatatatcccttttyttaacatgtccatatataatgtgtgtgtatgtgtgctcatgtatgtacaagtttaatataatatgttcctctattttgtatttccatctctagggacaggtaatttctaatttcacactcaaaggaattatttttttttaacctgtgaaagcctcagcagtcctgagaacatgtgctcctcattttttagttatgaatggaaaccgcagtattttgacttctgtactccaggaaaattattagagtacaaaataaccacaaaagttcctttggagtagtaaaaaaaaaaatgttttagcc

SEQ ID NO: 158470 - DNA, 601 bp, Human
tatcccttttcttaacatgtccatatataatgtgtgtgtatgtgtgctcatgtatgtacaagtttaatataatatgttcctctattttgtatttccatctctagggacaggtaatttctaatttcacactcaaaggaattatttttttttaacctgtgaaagcctcagcagtcctgagaacatgtgctcctcattttttagttatgaatggaaaccgcagtattttgacttctgtactccaggaaaattattagagtacaaaataaccacaaaagttcctttggagtagtaaaaaaaaaaatgttttagccaatttaggaggattgaattttaagtagtagatatttgactgtttcccttttgtagggaagattgtaggattaatctttcaaactaccctgaatctcaaacaaatgatctctgaagatctgaagtgtgtgtgtgtgcatgtgtgtgtgtgtgttgaagtcgagtcacctaccggtattgagatattgagactattgagaagtaagtatactagcaccaaattaaactacaggttttcttcagctgttttaatgatttagaaaattgtccatatctgagattgagactccta

SEQ ID NO: 158471 - DNA, 601 bp, Human
atgaatggaaaccgcagtattttgacttctgtactccaggaaaattattagagtacaaaataaccacaaaagttcctttggagtagtaaaaaaaaaaatgttttagccaatttaggaggattgaattttaagtagtagatatttgactgtttcccttttgtagggaagattgtaggattaatctttcaaactaccctgaatctcaaacaaatgatctctgaagatctgaagtgtgtgtgtgtgcatgtgtgtgtgtgtgttgaagtcgagtcacctaccggtattgagatattgagactaytgagaagtaagtatactagcaccaaattaaactacaggttttcttcagctgttttaatgatttagaaaattgtccatatctgagattgagactcctacctagaattgagatactgccatccatgaatatgaagcttttattggcagcaattactagatccaaaaggtagaaacaaaatgaaagccagtcgtaattaattttattgtaagctatatacattcagaatttgctaaaattcttgtcattctcacaaattgtcaataaatgttctcaatttcattaaagaaaatcaaatgaata

SEQ ID NO: 158472 - DNA, 601 bp, Human
ctgccatgttctttacatggttgcaaacagtgtggagaaagagaaacacaatgttgatacggatgcataaacgagcttgttcaggcaaaggccttgcgggtgaaaaatgaggtaattaattatggaagacatccataaccatgtttttgtcaaggaagtaagttttgggaggatatatttttggaaacagagatacggagagagagccacagatctttacctatttggggtaggcagagaaggaccaaggagggcattcttgttttattagacttagtttggtttaaacttttttttttttgagacggagtctggccctgtcacccaggctggagtacagtggcacgatcatggctcactgcaacctccgcctcctgggttcaagcaattctcctgcctcagcctcccaggtagctggcgcgtgccaccacgcctggctaattttttgtagttttagtagagacagggttttgtcatgttagccaggttggtctcgatctcctgaccttgtgatccaccagccttggcctcccaaagtgctgggattacaagcatgagccaccgcacccagccctagcttaaacttttaattgaaataaaa

SEQ ID NO: 158473 - DNA, 601 bp, Human
tacagtggcacgatcatggctcactgcaacctccgcctcctgggttcaagcaattctcctgcctcagcctcccaggtagctggcgcgtgccaccacgcctggctaattttttgtagttttagtagagacagggttttgtcatgttagccaggttggtctcgatctcctgaccttgtgatccaccagccttggcctcccaaagtgctgggattacaagcatgagccaccgcacccagccctagcttaaacttttaattgaaataaaatatatagaaaatggaacagatcatgagtatacagmttaatacgcacacctgtgtaaccagcactgagattaaaaaatgggacatttctggttccccagaagtcccctccttgtctgtggtctagatttgatttataccggatctaaaatagcatttgtttccaaatatatttaagacattgccaggggaaaaacaacaactaatgtggggtgattttgtcagttggggtcacacagctttcaaaaaccaactcaagtcattttccattctttttctccttcaaagctgtcaattccatgccagtggataacaggaaccacaatgaaggaatggta

SEQ ID NO: 158474 - DNA, 601 bp, Human
ctaatgtggggtgattttgtcagttggggtcacacagctttcaaaaaccaactcaagtcattttccattctttttctccttcaaagctgtcaattccatgccagtggataacaggaaccacaatgaaggaatggtaagttgcaatgtcaatcttagaatctagacttgtgtctagactctagattctcccagtccctattataccaaaccaaacacacgcatgacataatcttacaaagccaggttttcattgctgacagaatgtgagcaagggatgcccctcctgcactgagctcctatstcctgtcaggatggtttagcacccctgaggatagctgtgccattggttcagaaatgggtgtttatttcccttctccagataatcccaactcagtgccttcttgcattattctgtgtagaagtttggaagatttcattctgttcctgtaaatctgtatctccgccctaagaatactgcatcagcccaggtcacgtaatcaagtcttccttgacagcagctctgggttgagtagtctgtcatccagtgataccagcttctccaacctgctttcgggtttccccccaggtgactcgctgcatc

SEQ ID NO: 158475 - DNA, 601 bp, Human
tcgctgcatcattgaggtcctctcaaatgccttgtcgaagtccagcgctccacccatcacccctgagtgccgccaagtcctgaagacgagtaagtgtcccacacggcaggcagatcttggtcactgcagtgatccttgttcctactccctccacatcaccttctactttatctacaaatgacctgggggcataatgcactaggaagagtattgattgactaggccagtatctgggagacagaagatatgactcctagttcctgctttaccacttcgcagctgtgtgactataggaaagacmgtttgcctctcttttcctcaaagtaaaatgaaggagttgaactcagtgatagtctttcagatgtctatccgttcttaaattccttagttccatactttggatttttagaaccggacttcctttgggtggagggggtttgggaaatgctggtttgtgattagatgaggaggggggttatggaagtgttggacaatgacagagggagatttaaaaatcattcttctctttgccttttgctcttctgacagtgagaatcaggaagctgagaagcaagaaacttagaaaggtgacttaaaattc

SEQ ID NO: 158476 - DNA, 601 bp, Human
cgctgcatcattgaggtcctctcaaatgccttgtcgaagtccagcgctccacccatcacccctgagtgccgccaagtcctgaagacgagtaagtgtcccacacggcaggcagatcttggtcactgcagtgatccttgttcctactccctccacatcaccttctactttatctacaaatgacctgggggcataatgcactaggaagagtattgattgactaggccagtatctgggagacagaagatatgactcctagttcctgctttaccacttcgcagctgtgtgactataggaaagacastttgcctctcttttcctcaaagtaaaatgaaggagttgaactcagtgatagtctttcagatgtctatccgttcttaaattccttagttccatactttggatttttagaaccggacttcctttgggtggagggggtttgggaaatgctggtttgtgattagatgaggaggggggttatggaagtgttggacaatgacagagggagatttaaaaatcattcttctctttgccttttgctcttctgacagtgagaatcaggaagctgagaagcaagaaacttagaaaggtgacttaaaattct

SEQ ID NO: 158477 - DNA, 601 bp, Human
acattatgaggtcaattttacaaaactatgcagtctctgttatgcatgaagccacactgattcaaacaaatccagaaaacactgccctcttcaacactgtcctctgcttttaaacttttagtcaggctgggaacagtagattttatcttattttttcacctttaaaaatctttcaggtgggcatagtggctcacacctgtaatcccagcactttgggaggccgaggcaggtggatcacctgaggtcagcagtttgagaccagcctggccaacatggtgaaaccctgtctctactaaaaatmcaaaaaaaaaaaaaaaaaattagccaggcatggtggcaggcacctgtaatcccactactcaggaggccgagacaggagaattgcttgaacttgggaggcagagactgcagtgagccaagattgcaccattgaactccagcctgggcaacaagagtaagactccatctaaaaaaaaaaaaaaaaaaaaaaactctcattgccaccagcctggccaatatggtgaaaccccatctctactaaaaatacaacaactagttgggtgtggtggcgggcgcctgtaatcccagctacttgggaggc

SEQ ID NO: 158478 - DNA, 601 bp, Human
agccgggcgtggtgacacacgcctgtagtcccagctactcaggaggctgaggcaggagaatcgcttgagcccaggaggtggaggttgcagtaagccgagattgccccacggcattccagcctcagtgacagagcgagtctctgtctaaaaaaaaaaaaaaaaaaaaaaaaaaaaaaaaaaaaagagcaacctgaattaattcaatctttgggggcttcaggtaacaatggtagctgtgggggcctgagcctttagggaccctagaaacagtggatggaagctttcctaccactcccagccyacatacctctttctgagtttctttccaacttcttttttccagcagttacaggaagtgagtaagagcagagtgggtcactaggcagagagtaaaggctgctccttttggcaaacccatcttggtatctccctttccctttctttgtttactagaccaatgcaaaagtgaggggcctgtcccatcagctcactaaagaaccacagttgcttaggaaaagttgcctatgcctgcctgccaagatcttagcccttagattatggcatagtaactctagcctctgctccagccctgattatgccc

SEQ ID NO: 158479 - DNA, 601 bp, Human
atacccagagagtgacagaatgctgagatggcgaaggtttaagagctcttctgtggttgagccttaaacaccaggcagagctagacagacaaataacacaaaagagtaaggcaggacaggaagtgactcacagactggagggcacatgccttttctgagagggagcaggtaattctcagctctaaacccgttatggagaaatacagactatgttgtcaaatcttgggatttttcaaaagaagttaaaattttgatttttaaaagacatctcctggtattttcatatcgcctctgaattcaratgtactaaaactgctgtttaggtcaaacagaatttacctctgatgcaccagtttgcaacttttatcctattctagttctctctctcttgttggcatgtcgtaaactgatcagaagactggtggagcttttgcccaactggttggatgaatgcctttatacagcctctgttccaccccacgcccatctccactcccactcctacttgcatgtctcagagtcagcatatactcactgagcaaatgagtatttggggagtaggacagaatcattgttttatggatttgagagacctcaggga

SEQ ID NO: 158480 - DNA, 601 bp, Human
ctctctcttgttggcatgtcgtaaactgatcagaagactggtggagcttttgcccaactggttggatgaatgcctttatacagcctctgttccaccccacgcccatctccactcccactcctacttgcatgtctcagagtcagcatatactcactgagcaaatgagtatttggggagtaggacagaatcattgttttatggatttgagagacctcagggaagacgtagtctaatttcttcacaggtacaagaatctctttgactagggttgatctggtcatccttacagcatgacagatgcatttccctgttttcgcttgaaagtaagtgtgagcttcacagcttgattttacagcttgacagtgagtgtgtgctgctatcacagcctcttccaggcccacctgcggggcttaaagctaaatttagtaggaagagctaagcctcaggcacatgctgctcaggcagtacatatttaattgggaaaaaataaaaatacttctgttcctgacacttaagactcacaaaccagtaggcagtaggaaagggaccacagtgactcggcccctggaggctgagatcttgtctgatcagctctatttca

SEQ ID NO: 158481 - DNA, 601 bp, Human
tgcctctaaattctaatatttcataaatctatatctcgatttcagtttgatcattggtagtaccaatgagagaagctggctgggcattatgaagacataaaaatatagacagtttattaccagatttaaacacagtcaaggagctttcatagcatttactttcaaaaggaatctgagtatattcttcattaacttaaataattatccaagcaattttcagtgtcatcaggatttgtagtgattactgaggctggtgcttgtggaaccacaagcaattctgaaattatacctactcttcatyttcattataggtagaaaagacgtcaaagacaaagagacaactgaaaatgaaaacacaaagtttgaagtaagattgttaagagacccagctgatgcctcggaagcccacgagtcctccagcaggggagaggcaggagccccaggggaggaggacatccaaggcccaacaaaggcagacacagagaaatgggcagagggaggcgggcacagccgagagcgagcggatgagccccagtggagcctctatccctccgacagccaagtctctgaagaagtgaagacacgccattctgagaagagc

SEQ ID NO: 158482 - DNA, 601 bp, Human
gggagaataggtgatagagaagtttacttgcttgcctatttagtttgctatctttattatttcatgccctactgccatcagaaatttgtatctgggagaggtaacactactggagctgaacctacccaaacaatgttttttttcctaatattgattatgtaggttggtgcttctcaaagttgaatgtacattaggatcatgagggattcctagcccccagagttcctcatttagtaggtcccaagtgagaccccaatatctgcatttctgacaagttcctggctgatgccactggtcaggkgaccacactttgagagttactgaggtaggttgactaatgcagcttctaacatgcctaaaattcccctttgcactcatgctccatcaaactacagcaaaagaaattggttcgggacctcatgcctccacttttctgtattttccagaaaaaagaactcgaaaacttggctgcaatggatttggaactacagaagatagctgagaaattcagccaaaggggctgactgtcattggagcggtgggcactgttaagaagcagccatcacatgatctgtttttcaccacttcactgaaagacacc

SEQ ID NO: 158483 - DNA, 601 bp, Human
cagaaatttgtatctgggagaggtaacactactggagctgaacctacccaaacaatgttttttttcctaatattgattatgtaggttggtgcttctcaaagttgaatgtacattaggatcatgagggattcctagcccccagagttcctcatttagtaggtcccaagtgagaccccaatatctgcatttctgacaagttcctggctgatgccactggtcaggggaccacactttgagagttactgaggtaggttgactaatgcagcttctaacatgcctaaaattcccctttgcactcatrctccatcaaactacagcaaaagaaattggttcgggacctcatgcctccacttttctgtattttccagaaaaaagaactcgaaaacttggctgcaatggatttggaactacagaagatagctgagaaattcagccaaaggggctgactgtcattggagcggtgggcactgttaagaagcagccatcacatgatctgtttttcaccacttcactgaaagacaccatttatatacccaagggcagaaagtagaacttactattcattaaatgtttgacacaattggaattgtctttaatttct

SEQ ID NO: 158484 - DNA, 601 bp, Human; identical to SEQ ID NO: 18233

SEQ ID NO: 158485 - DNA, 601 bp, Human; identical to SEQ ID NO: 18234

SEQ ID NO: 158486 - DNA, 601 bp, Human; identical to SEQ ID NO: 18235

SEQ ID NO: 158487 - DNA, 601 bp, Human; identical to SEQ ID NO: 18236

SEQ ID NO: 158488 - DNA, 601 bp, Human; identical to SEQ ID NO: 18237

SEQ ID NO: 158489 - DNA, 601 bp, Human; identical to SEQ ID NO: 18238

SEQ ID NO: 158490 - DNA, 601 bp, Human; identical to SEQ ID NO: 18239

SEQ ID NO: 158491 - DNA, 601 bp, Human; identical to SEQ ID NO: 18240

SEQ ID NO: 158492 - DNA, 601 bp, Human; identical to SEQ ID NO: 18241

SEQ ID NO: 158493 - DNA, 601 bp, Human; identical to SEQ ID NO: 18242

SEQ ID NO: 158494 - DNA, 601 bp, Human; identical to SEQ ID NO: 18243

SEQ ID NO: 158495 - DNA, 601 bp, Human; identical to SEQ ID NO: 18244

SEQ ID NO: 158496 - DNA, 601 bp, Human; identical to SEQ ID NO: 18245

SEQ ID NO: 158497 - DNA, 601 bp, Human; identical to SEQ ID NO: 18246

SEQ ID NO: 158498 - DNA, 601 bp, Human; identical to SEQ ID NO: 18247

SEQ ID NO: 158499 - DNA, 601 bp, Human; identical to SEQ ID NO: 18248

SEQ ID NO: 158500 - DNA, 601 bp, Human; identical to SEQ ID NO: 18249

SEQ ID NO: 158501 - DNA, 601 bp, Human; identical to SEQ ID NO: 18250

SEQ ID NO: 158502 - DNA, 601 bp, Human; identical to SEQ ID NO: 18251

SEQ ID NO: 158503 - DNA, 601 bp, Human; identical to SEQ ID NO: 18252

SEQ ID NO: 158504 - DNA, 601 bp, Human; identical to SEQ ID NO: 18253

SEQ ID NO: 158505 - DNA, 601 bp, Human; identical to SEQ ID NO: 18254

SEQ ID NO: 158506 - DNA, 601 bp, Human; identical to SEQ ID NO: 18255

SEQ ID NO: 158507 - DNA, 601 bp, Human; identical to SEQ ID NO: 18256

SEQ ID NO: 158508 - DNA, 601 bp, Human; identical to SEQ ID NO: 18257

SEQ ID NO: 158509 - DNA, 601 bp, Human; identical to SEQ ID NO: 18258

SEQ ID NO: 158510 - DNA, 601 bp, Human; identical to SEQ ID NO: 18259

SEQ ID NO: 158511 - DNA, 601 bp, Human; identical to SEQ ID NO: 18260

SEQ ID NO: 158512 - DNA, 601 bp, Human; identical to SEQ ID NO: 18261

SEQ ID NO: 158513 - DNA, 601 bp, Human; identical to SEQ ID NO: 18262

SEQ ID NO: 158514 - DNA, 601 bp, Human; identical to SEQ ID NO: 18263

SEQ ID NO: 158515 - DNA, 601 bp, Human; identical to SEQ ID NO: 18264

SEQ ID NO: 158516 - DNA, 601 bp, Human; identical to SEQ ID NO: 18265

SEQ ID NO: 158517 - DNA, 601 bp, Human; identical to SEQ ID NO: 18266

SEQ ID NO: 158518 - DNA, 601 bp, Human; identical to SEQ ID NO: 18267

SEQ ID NO: 158519 - DNA, 601 bp, Human; identical to SEQ ID NO: 18268

SEQ ID NO: 158520 - DNA, 601 bp, Human; identical to SEQ ID NO: 18269

SEQ ID NO: 158521 - DNA, 601 bp, Human
atggattttggtgttctattgaagagggaatatggtttggaagagtgtctccccctcctctgagttcaatttactagttgagatttgcaagcctgaaatgcttgaagcagctcaggcacgatagcagtgcaagctttaaaatctaggtgtagctgttaatcctttacagaggcacataagtctccaggagtagctcggctagctgtgagcaagatgtatgcttttcatgtactgcgtactcatgggctgagggattattgattttctttcacagttgtaaaaacagcaattggtgatcatmccacacgtacagtacacaccaagttgctttcctatctgtgaagaatctccttgtattctttaatatttaacattgaactttccaacttgctgttttccataaggctcttttcacatagcaattactcaagacagaaaatagccacttactatcttttataaatgaaagaaggttctaagaaacttcttacattcagccatcatagtgaaatttttcattgctggcttgcacgcacatatattgcttgttgtggtgacagagcaaacgttcctatttggatttctcatagtatcaagtcgt

SEQ ID NO: 158522 - DNA, 601 bp, Human
cagacctaattcagtgaacaaaattttttgagaagatacatttaactactttttcaagctttgtagtataaatgcatttcttccaatataagattttcctattataagttgcaaagaatggatcctctgcaaaacccacttgataagggctctactcatttatttttctttcctgctaccccaaactcactgcatacatcaggcatagcttccagggtgagctttgttagtttttctgagtagacttagccatttactatgctagtcacatacttcacttgcctaagcaatggattttggygttctattgaagagggaatatggtttggaagagtgtctccccctcctctgagttcaatttactagttgagatttgcaagcctgaaatgcttgaagcagctcaggcacgatagcagtgcaagctttaaaatctaggtgtagctgttaatcctttacagaggcacataagtctccaggagtagctcggctagctgtgagcaagatgtatgcttttcatgtactgcgtactcatgggctgagggattattgattttctttcacagttgtaaaaacagcaattggtgatcataccacacgtaca

SEQ ID NO: 158523 - DNA, 601 bp, Human
actgttctaattttcttttagcatactgagtttgaaaaaaaaattgtatttgaaatagaagggacactattatttcaatctccttgtagtgaccattaggaaagcacatcaaaaccaggtggggcatttctctctaggttcatacatgaatattgccagtttttaataagtgtatttttcatttccaaaagaagacttttggcttgactaaagagatcattgaatttaatgttgactgctttgcccattatcaaatatgcacgaagattttttgagagtttagaggaggtgagtaatattygaattggttatgcagggtcatccactctgatactttgtatatatgtagggaacatttgagtatcctggaaatatgtgaccctcaaagtaaggactaaagtagtagcaatttgcttctcccacagttgctatctaacatccaacaagtatagcatctgttccataattcagatactctgctgaacgagtatgttaaataaggccacaatttgtgtttctggttctctccaaaaattcagtttcttttagtttgctaactacataccaacatggtcataggctatattaacggaagaaaagt

SEQ ID NO: 158524 - DNA, 601 bp, Human
aagtcattcatgatgctaaggcctgtatagtaataggtttttcaggcagttaccccctacctttattcccatccaggattatccaagtataaactttgtacagtagctacatcctgaggtatgattacctgctgtgaaatagctatttccagcttttgcttcttgctgatttttcagaatgtctggtgcagtcacgttatacaagaacaggtattctcttttaagaagtaaaggaaactaaattcttcatttaaagaaaaggaggcatactaaatttcctttatatttctcttccttaaartatactgggactgagcatctcctgtgaaagtaaaaggttttaatgaactattaataatgaactttaacatactagagaaatttcctagacatttaatttcaatgtcttaaaataacacatctttcatcatagtggttagtcagaagggataggttgacctctttgtttttagacttctcattttcttatacaaataaagtaggagccaaagttgagattgtcatcaaacagataatttctattatctgattgtgtcactttgaattaaacaccatggctttcaaattcaagccagtcttt

SEQ ID NO: 158525 - DNA, 601 bp, Human; identical to SEQ ID NO: 23256

SEQ ID NO: 158526 - DNA, 601 bp, Human; identical to SEQ ID NO: 23257

SEQ ID NO: 158527 - DNA, 601 bp, Human; identical to SEQ ID NO: 23258

SEQ ID NO: 158528 - DNA, 601 bp, Human; identical to SEQ ID NO: 23259

SEQ ID NO: 158529 - DNA, 601 bp, Human; identical to SEQ ID NO: 23260

SEQ ID NO: 158530 - DNA, 601 bp, Human; identical to SEQ ID NO: 23261

SEQ ID NO: 158531 - DNA, 601 bp, Human; identical to SEQ ID NO: 23262

SEQ ID NO: 158532 - DNA, 601 bp, Human; identical to SEQ ID NO: 23263

SEQ ID NO: 158533 - DNA, 601 bp, Human; identical to SEQ ID NO: 23264

SEQ ID NO: 158534 - DNA, 601 bp, Human; identical to SEQ ID NO: 23265

SEQ ID NO: 158535 - DNA, 601 bp, Human; identical to SEQ ID NO: 23266

SEQ ID NO: 158536 - DNA, 601 bp, Human; identical to SEQ ID NO: 23267

SEQ ID NO: 158537 - DNA, 601 bp, Human; identical to SEQ ID NO: 23268

SEQ ID NO: 158538 - DNA, 601 bp, Human; identical to SEQ ID NO: 23269

SEQ ID NO: 158539 - DNA, 601 bp, Human; identical to SEQ ID NO: 23270

SEQ ID NO: 158540 - DNA, 601 bp, Human; identical to SEQ ID NO: 23271

SEQ ID NO: 158541 - DNA, 601 bp, Human; identical to SEQ ID NO: 23272

SEQ ID NO: 158542 - DNA, 601 bp, Human; identical to SEQ ID NO: 23273

SEQ ID NO: 158543 - DNA, 601 bp, Human; identical to SEQ ID NO: 23274

SEQ ID NO: 158544 - DNA, 601 bp, Human; identical to SEQ ID NO: 23275

SEQ ID NO: 158545 - DNA, 601 bp, Human; identical to SEQ ID NO: 23276

SEQ ID NO: 158546 - DNA, 601 bp, Human; identical to SEQ ID NO: 23277

SEQ ID NO: 158547 - DNA, 601 bp, Human; identical to SEQ ID NO: 23278

SEQ ID NO: 158548 - DNA, 601 bp, Human; identical to SEQ ID NO: 23279

SEQ ID NO: 158549 - DNA, 601 bp, Human
gttaatttcactaaaaaaaaatctatacaaactctaaagtgttactcagatacaagataccatcattattacataggtagaaaacctatcatggaagctcttaagagagaaaaggtagaaaatagtatgtaaaggacatttacaaatcaaaaaagtaacaaaggttgagtagaaacttagtagggcattctaatggaattatgttacattggatgcactggaaatatatatatatatatagctttatatgatgctttagtaagtgaaaaaaatgacttttgccacagttagggaatatcarggttttataacttaggacttaaaagtttggagttttctcctcccaacttaaaaggtaatcaatttggagaaaaggtaattcagaggcagaaaaagatgaactctaaatgttgttaaatgacttcatttatttcttcattcattgggtattttgagcattttataccaaatgctttaaactgtttgtcggatagttccaacatctctgtcatgtcctccttggcttgtgttttctttccccatggaagttgacattttcgtggttcttcatatactgtgtaattttggattgtaatttgaa

SEQ ID NO: 158550 - DNA, 601 bp, Human
tatatatatatatagctttatatgatgctttagtaagtgaaaaaaatgacttttgccacagttagggaatatcaaggttttataacttaggacttaaaagtttggagttttctcctcccaacttaaaaggtaatcaatttggagaaaaggtaattcagaggcagaaaaagatgaactctaaatgttgttaaatgacttcatttatttcttcattcattgggtattttgagcattttataccaaatgctttaaactgtttgtcggatagttccaacatctctgtcatgtcctccttggcttstgttttctttccccatggaagttgacattttcgtggttcttcatatactgtgtaattttggattgtaatttgaacattttgaacaaatatttagttagactggatcttatttaaattttggagtatattgatactattgttttagcaagcaatcaccctggtgagatgaagacaatctgtgggatctggttccaatgtcagttccattctgaaagcctttgtagtgctattcagacatgtgcatcaaccaggggtgaaattgggaactgtgcaatgctctactcattagttcaggtctta

SEQ ID NO: 158551 - DNA, 601 bp, Human
tttccccatggaagttgacattttcgtggttcttcatatactgtgtaattttggattgtaatttgaacattttgaacaaatatttagttagactggatcttatttaaattttggagtatattgatactattgttttagcaagcaatcaccctggtgagatgaagacaatctgtgggatctggttccaatgtcagttccattctgaaagcctttgtagtgctattcagacatgtgcatcaaccaggggtgaaattgggaactgtgcaatgctctactcattagttcaggtcttagcatcttyagtgtgccaattagaaccatatctaggcatgcataagttgaggggcaggtgaatccaggagtttataaataatgttcatgggtctctttctaaagtttcttcctcttcaccatctgacccgtactttcaggttcccaggggcttctcctttccatcctccagctagaaatgcgggcctccttttattctgatgaaccatatacttctgcaattatagctgcatctttaagctcatgtggcagacggacagtgagaaagaagaaaaaaaaagcaagaggtttggccccactctcatggagc

SEQ ID NO: 158552 - DNA, 601 bp, Human
tgttcatgggtctctttctaaagtttcttcctcttcaccatctgacccgtactttcaggttcccaggggcttctcctttccatcctccagctagaaatgcgggcctccttttattctgatgaaccatatacttctgcaattatagctgcatctttaagctcatgtggcagacggacagtgagaaagaagaaaaaaaaagcaagaggtttggccccactctcatggagctacagctcaactgaatggaaaggattgactttagatttcttttctttttttgaggtggagtctcactctgtcscccaggctagagtgcagtggcgcgatctcggctcactgcaagccccgcctcctgggttcacgccattctgcctcagcctcctgagtagctgggactacaggcgcccgccaccaggcccggctacttttttgtatttttagtagagacggggtttcaccgtgttagccaggatagtctcgatctcctgactttgtgatccgcccgcctccgcctcccaaagtgctgggattacaggcgtgagccaccgcgcccggccgaggattaacctttctcaaggttttggctattgcatgttgctgt

SEQ ID NO: 158553 - DNA, 601 bp, Human
tctgatgaaccatatacttctgcaattatagctgcatctttaagctcatgtggcagacggacagtgagaaagaagaaaaaaaaagcaagaggtttggccccactctcatggagctacagctcaactgaatggaaaggattgactttagatttcttttctttttttgaggtggagtctcactctgtcgcccaggctagagtgcagtggcgcgatctcggctcactgcaagccccgcctcctgggttcacgccattctgcctcagcctcctgagtagctgggactacaggcgcccgccaccasgcccggctacttttttgtatttttagtagagacggggtttcaccgtgttagccaggatagtctcgatctcctgactttgtgatccgcccgcctccgcctcccaaagtgctgggattacaggcgtgagccaccgcgcccggccgaggattaacctttctcaaggttttggctattgcatgttgctgtagtttcccctaccatcatcagattgcctgaggtttgaggcacatgagaatgtagacaagagggggagaaaaaataaacgtggtattttcacactctatttgagataggagtttg

SEQ ID NO: 158554 - DNA, 601 bp, Human
ggccccactctcatggagctacagctcaactgaatggaaaggattgactttagatttcttttctttttttgaggtggagtctcactctgtcgcccaggctagagtgcagtggcgcgatctcggctcactgcaagccccgcctcctgggttcacgccattctgcctcagcctcctgagtagctgggactacaggcgcccgccaccaggcccggctacttttttgtatttttagtagagacggggtttcaccgtgttagccaggatagtctcgatctcctgactttgtgatccgcccgcctcsgcctcccaaagtgctgggattacaggcgtgagccaccgcgcccggccgaggattaacctttctcaaggttttggctattgcatgttgctgtagtttcccctaccatcatcagattgcctgaggtttgaggcacatgagaatgtagacaagagggggagaaaaaataaacgtggtattttcacactctatttgagataggagtttgcttttctgttcctcagaccatacctctagtgcttctcctggagccctctctttatgctgacagaggctcaattccatgtttctggctgtattaag

SEQ ID NO: 158555 - DNA, 601 bp, Human
gaggtggagtctcactctgtcgcccaggctagagtgcagtggcgcgatctcggctcactgcaagccccgcctcctgggttcacgccattctgcctcagcctcctgagtagctgggactacaggcgcccgccaccaggcccggctacttttttgtatttttagtagagacggggtttcaccgtgttagccaggatagtctcgatctcctgactttgtgatccgcccgcctccgcctcccaaagtgctgggattacaggcgtgagccaccgcgcccggccgaggattaacctttctcaaggtkttggctattgcatgttgctgtagtttcccctaccatcatcagattgcctgaggtttgaggcacatgagaatgtagacaagagggggagaaaaaataaacgtggtattttcacactctatttgagataggagtttgcttttctgttcctcagaccatacctctagtgcttctcctggagccctctctttatgctgacagaggctcaattccatgtttctggctgtattaagttcggggcagtgatactagaggagggaaatttaaattcaccactggtttgatggctctttaaatttggat

SEQ ID NO: 158556 - DNA, 601 bp, Human
tctcacccagtcaggaggcatgggatcaaggacccgcttatgtagagaatctgacattcccttagcagagctggtgtgctgtgctgggggaatcccactcatcgggttcatctggtctcttcagagccagcaggcagaaaagataagtctgctgaacctgaaactgcctctcccctcaggttctctgactcagcgagatgagagttctgtctgtaagcccctgaccagagctgctggaattcttgcagggatgacctgcctggtgaggagggatggctcagggtcccacctaaagaggcastctggccacaacctgccacagccagtttgctgcactgtgggaaatctggcccagtccaaacctctcaggctcctttgcactgtcaggggcaaaccgccaactaatggtggtcacccctccccccaggaacttagtcattccaggcacactccagactactctgctggcagcagggatctcaagccagtgggtcttagcttgcagggatccatgggagtagaacctactgattgagactgctgggctctcctccttggcttcagccccctttccatgggactggatggttctcgtgcctca

SEQ ID NO: 158557 - DNA, 601 bp, Human
tgggaaatctggcccagtccaaacctctcaggctcctttgcactgtcaggggcaaaccgccaactaatggtggtcacccctccccccaggaacttagtcattccaggcacactccagactactctgctggcagcagggatctcaagccagtgggtcttagcttgcagggatccatgggagtagaacctactgattgagactgctgggctctcctccttggcttcagccccctttccatgggactggatggttctcgtgcctcactggagttccaggcaccactggagtatgtaaaaactcytgcagctcagtgcctgcctaaacagccaccaatgggagtggctgtcattggtttgcccaggtttgtgcttgagacccagggccctggtggtgtaggctcatgagggaatcttctgatctgcagattgcaaaaatctgtgggagaagcatagtacacctggtgggtaggacagaccctcgccacttcccttacctcagggaggcaagtctccccaccctgtgcagctcctgggtgaaatgacaccccacctgctttcttcctgcttcctgtgggttgcaccagctgcccaatgagatgaac

SEQ ID NO: 158558 - DNA, 601 bp, Human
tttgcactgtcaggggcaaaccgccaactaatggtggtcacccctccccccaggaacttagtcattccaggcacactccagactactctgctggcagcagggatctcaagccagtgggtcttagcttgcagggatccatgggagtagaacctactgattgagactgctgggctctcctccttggcttcagccccctttccatgggactggatggttctcgtgcctcactggagttccaggcaccactggagtatgtaaaaactcctgcagctcagtgcctgcctaaacagccaccaatggsagtggctgtcattggtttgcccaggtttgtgcttgagacccagggccctggtggtgtaggctcatgagggaatcttctgatctgcagattgcaaaaatctgtgggagaagcatagtacacctggtgggtaggacagaccctcgccacttcccttacctcagggaggcaagtctccccaccctgtgcagctcctgggtgaaatgacaccccacctgctttcttcctgcttcctgtgggttgcaccagctgcccaatgagatgaacttggtacctcagatggagatgcagaattcacctgcc

SEQ ID NO: 158559 - DNA, 601 bp, Human
aaaagactgtcttttcttaattgtattgctttgcttgtttatgaaagatcagttgactatatttatctgggtctatttctttttagtctgctactctgctttctatcctttttcattaatttatttgtctattccttttttttttttttttttaagagacggagtctcactctcttgcccaggccggagtgcagtggcgcaatctcggctcactgcaagctccgcctcctgggttcacccaccattctcctgcctcagcctcctgagtagctgggactacagacacctgccaccacgcccrgctaatttttgtatttttagtagagacggggtttcaccgtgttagccaggatggtatagatctcctgacctcatgatccacctgccttggcctcccaaagtgctaggattacaggcgtgagccaccgcgcccagccttatttgtctgttctttaacaaataccacactgtcttgattactgtagttttagagtaaatcatgaagtcaggtagtatcagttgtttaactttgctcatctccttcaataatgtgtttgcttttctgggtcttttgcctatctatataaactttagaatcagt

SEQ ID NO: 158560 - DNA, 601 bp, Human
ttttttttttttttttttattttgttgtttttgagacagagtctcgctctgtcacccagactggagtgcagtaatgcaatctcatctcatttcaaccactgcttcccgagttcaagcaatcctcccacctcagtctcctgagtagctgggaataccggcaaataccaccacacttggctcatttttgtctttttgtagagacagattttaccacattgctcaggttggtcttgaactcctgagatcaaataatccagccttttgggcctcccaaagtgctgagattacagtcatgagccamtataccctgctggatctgtgcatttccaatagagtgttgttgaaatctccaactatgataatgaattcatcgatttctccttgcagttctgttaatttttgcctcacgtagttaaatactctcttgttaggtgcgtgcacatttaggtttgttatgcggaaacataacatagtttcttggaaagctaattcttataccattatgcaatgcttttcttcattcctgataaatttccttgctttgaggtttgttctgtttgaaatttgtatagcttctcctgctttcttttgtttgtgccag

SEQ ID NO: 158561 - DNA, 601 bp, Human
ttttttttttttttttattttgttgtttttgagacagagtctcgctctgtcacccagactggagtgcagtaatgcaatctcatctcatttcaaccactgcttcccgagttcaagcaatcctcccacctcagtctcctgagtagctgggaataccggcaaataccaccacacttggctcatttttgtctttttgtagagacagattttaccacattgctcaggttggtcttgaactcctgagatcaaataatccagccttttgggcctcccaaagtgctgagattacagtcatgagccaatrtaccctgctggatctgtgcatttccaatagagtgttgttgaaatctccaactatgataatgaattcatcgatttctccttgcagttctgttaatttttgcctcacgtagttaaatactctcttgttaggtgcgtgcacatttaggtttgttatgcggaaacataacatagtttcttggaaagctaattcttataccattatgcaatgcttttcttcattcctgataaatttccttgctttgaggtttgttctgtttgaaatttgtatagcttctcctgctttcttttgtttgtgccagta

SEQ ID NO: 158562 - DNA, 601 bp, Human
gcacatttaggtttgttatgcggaaacataacatagtttcttggaaagctaattcttataccattatgcaatgcttttcttcattcctgataaatttccttgctttgaggtttgttctgtttgaaatttgtatagcttctcctgctttcttttgtttgtgccagtatgatataatacatatatatattcatgatccatttacttttaatttgtgtgtctttatatttaaagtgcatttcctgcagacatcatatagtttaatctctgatttttaattggtgcatttagatcattgatattaatgattattaatataggtggattaaatatctaccatatttctttctgttttctatttgttgcctttgttctttgtttctatttttgtttttcattctcttcttttcagagactgagtctcattctgttcattaggctagagtgtggtggtataatcatagctccctgtacccttgaaatcctaggctcaagtgattctcctacctgagccctgagtacctggtattacgggcatgtgccacaaagcctggctaatttttatttaatttttgtagcgacagagtctttgctacgttgccca

SEQ ID NO: 158563 - DNA, 601 bp, Human
aaagatgtatacataagcacacataattaaatatattgctactattgttattttgaacaaactgccatttgttagatcaattaagaataagaaaaatagttttattttaccttcacttattttttatattgttcctttttcatataatttaggtttctaacctgtataattctctttccttttaaaataattgcatttaacttttttgttttttgatataagacaagtctactggcaacaagttatctcaatgtttctccaaaatagtggttgtttctcattcactttgaagaattttttyggctaaagaattctaagttgataaggttttttctcttaatactttaaatatttgtttccactgtcttcttgcttgcatggtttttgagaagaatgtaaatgtcatttttatctttgtttctctacatgtagaatttattttcctctggattctcttatgatttcttaaatctttgataaagggggtacaggggcatatgtgaactctatatttttaattcagtatttctgtcaacttaaactgataaaaactaaaatctattgattaagacaaatatcttgggaaacatcaatgtaaagc

SEQ ID NO: 158564 - DNA, 601 bp, Human
tgagaagaatgtaaatgtcatttttatctttgtttctctacatgtagaatttattttcctctggattctcttatgatttcttaaatctttgataaagggggtacaggggcatatgtgaactctatatttttaattcagtatttctgtcaacttaaactgataaaaactaaaatctattgattaagacaaatatcttgggaaacatcaatgtaaagcttgctgatctctctagtgttggggggaatgttggagaaaaatatgcctatttagctaaggacaaacctagataaattaactagargtgtgaattgtatgcaagagattgtgtcagaacagggttccaataatgaacttcataagaggttttagataacctaagacattttgaaatataacacaactacaggaaattatacaatacaaatatgtagcttgattaattattataagataaacacctttgttgactcctgatatggcctagctgtgtctttacccaaatctcatcttgaattgtagttctcataatccccacttgtcatgggagggacccagtgggagataactgaatcatggagttggttaccctcgtgctgttctt

SEQ ID NO: 158565 - DNA, 601 bp, Human
tacaggaaattatacaatacaaatatgtagcttgattaattattataagataaacacctttgttgactcctgatatggcctagctgtgtctttacccaaatctcatcttgaattgtagttctcataatccccacttgtcatgggagggacccagtgggagataactgaatcatggagttggttaccctcgtgctgttcttgtgatagcgagtgagttttcatgatatctgatggttttataaggggcttttacccctttgttaggcacttctgtctcctgctgccatgtgaagaagaacaygtttgcttcctcttccaccattattgtaagtttcctgaggcctccccagccatgtagaattgtgagtcagttaaacttctttcctttttaaattatccagtcttgggcagttcttcatagcagtgaggatggactaatacaactgctaacattgtctaagaaagatccttgttatgtggctcagaggccctccatgtattcttaactattcactctcctatccttccaagaataacactaatttgacctctacaataatcactttatcactccagttttgccttttttcctccaaaacaa

SEQ ID NO: 158566 - DNA, 601 bp, Human
tgttgactcctgatatggcctagctgtgtctttacccaaatctcatcttgaattgtagttctcataatccccacttgtcatgggagggacccagtgggagataactgaatcatggagttggttaccctcgtgctgttcttgtgatagcgagtgagttttcatgatatctgatggttttataaggggcttttacccctttgttaggcacttctgtctcctgctgccatgtgaagaagaacacgtttgcttcctcttccaccattattgtaagtttcctgaggcctccccagccatgtagaaytgtgagtcagttaaacttctttcctttttaaattatccagtcttgggcagttcttcatagcagtgaggatggactaatacaactgctaacattgtctaagaaagatccttgttatgtggctcagaggccctccatgtattcttaactattcactctcctatccttccaagaataacactaatttgacctctacaataatcactttatcactccagttttgccttttttcctccaaaacaatgccttttaagtctattttaatcgatagatttcctcttaatatcatttaaaaatatttct

SEQ ID NO: 158567 - DNA, 601 bp, Human
agataactgaatcatggagttggttaccctcgtgctgttcttgtgatagcgagtgagttttcatgatatctgatggttttataaggggcttttacccctttgttaggcacttctgtctcctgctgccatgtgaagaagaacacgtttgcttcctcttccaccattattgtaagtttcctgaggcctccccagccatgtagaattgtgagtcagttaaacttctttcctttttaaattatccagtcttgggcagttcttcatagcagtgaggatggactaatacaactgctaacattgtctragaaagatccttgttatgtggctcagaggccctccatgtattcttaactattcactctcctatccttccaagaataacactaatttgacctctacaataatcactttatcactccagttttgccttttttcctccaaaacaatgccttttaagtctattttaatcgatagatttcctcttaatatcatttaaaaatatttctttacatttttagacaggaatcagaataatttgctatgttgaatttccagttacttggattttgttgatttcattcctgtggtttagttgacatgaatc

SEQ ID NO: 158568 - DNA, 601 bp, Human
cttttaagtctattttaatcgatagatttcctcttaatatcatttaaaaatatttctttacatttttagacaggaatcagaataatttgctatgttgaatttccagttacttggattttgttgatttcattcctgtggtttagttgacatgaatctctccaattgaaagggtaacttgaatatggtagctggaaagttaaaatcaattcttttaactttggaaaatgattaaattctggagatagaatagtaagttcataagatgacaggtcatttgcatcctctagtgaaaagcgaaggrattaaataaaaataacattttgatgcttaatgtttctggcagtattatgtctgtatttaattgttaaaatgtttttcaataattttttccaggttgtctgcattcaaaagagcattctattaaagctaccttaatttggcgcttatttttcttaatcatgtttctgacaatcatagtgtgtggaatggttgctgctttaagcggtaagtgaactgtaatctttattcatctagagagaattatacttgtaaaaagaagaggaagaatctgaataattttgttattctttacagcttttaa

SEQ ID NO: 158569 - DNA, 601 bp, Human
tagcactttggaaatgatttcttgtgtggagccaatagctggagccatcttctaatctggtcattttctttctttctttttttaaatgtgttattatgtattactttatatcatttttatgttttatttaacatttagattgttagttaactattcaagtgtggtatttccccatttaaatcgagttatttagattggctttagttataaaaattcctaatagagctttgtagttatagctctggtccctaactttttttttaaattatactttaagttctgggataaatgtgcagaaccygcaggttcgttacataggtatacacgtgccatggtggtttgatgcacctatcaacccatcatctatattaggtatttctcctaatgctatccctcccgttgccccccaaccctcaacacgcctcagtgtgtgatgttccgctccctgcatccatgtgttctcattgttcagctcccacatatgagtgagaacctgcagtatttggttttctgttcctgtgttagtttgatgagaatgatggtttccagtttcatttgtctccctgcaaagaatatgaactcattcttctttatggctgta

SEQ ID NO: 158570 - DNA, 601 bp, Human
gttgtctcccagtcaggaggcatgggggtcagggacccacttgaaaaggcagtctttccctcagaagagctcgagcactgtgctgggagatccactgctcttttcagagctggctggcaggaatgtttaagtctcctgaagccgtgaccacagccaccctttcccccaggtgctctgtcccagggagataagagttttatctataagcccctgactggggctgctgcctttctttcagagatgccctgcccagagaggaggaatctagagaggcagtccggctgcagtggctttgctgcastggctttgctgcactgtggtgggctccgcccagtccgaacttcccccagggctttgtttacactgtgaggggaaaatcacctactcaagcctcagtaatggcggatgcacctcccctcaccaagcttgagcatctggggtccacttcagactgctgtgctggcagcaagaatttccagccagtgggtcttagcttgctgggctctgtggggattggacccactgagcaagaccacttggctccctggcttcagccccctttccagcagagtgaatgattctgtctcagtgggttccaggc

SEQ ID NO: 158571 - DNA, 601 bp, Human
ttatttatttttattttattttcagcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactggtaagaaaatagttctggccagaatcaaagattcagccctacaaggatatgttttcctgtgaaattatctaagaggtaggtttagacatcwgcttttacattgattttttttttttttttgcataacgaaagagtaacctagcatgtattatattttacagtgaaccatctaaaattaccttaatattcgtggcaggaacaggcccagagggcaagcaagccagagccttctttgacttgtgagccagaattgtgcaaataaggattagaaaagtattggtagaaacccagttttaagtttgtatgaagttagcaacattgtttcaaaataaatcaaacaaggccaagagcagtggcacatgcctgtaatcccagcactttgggaggccaa

SEQ ID NO: 158572 - DNA, 601 bp, Human
agagtaacctagcatgtattatattttacagtgaaccatctaaaattaccttaatattcgtggcaggaacaggcccagagggcaagcaagccagagccttctttgacttgtgagccagaattgtgcaaataaggattagaaaagtattggtagaaacccagttttaagtttgtatgaagttagcaacattgtttcaaaataaatcaaacaaggccaagagcagtggcacatgcctgtaatcccagcactttgggaggccaaggcgggtgtatcacttgaggtcaggagtttgagatcagcytggccaacatggtgaaaccccatctcaactaaaaaatacaaaaattagctgggcatggtggcatacgcctgtagttccagctactcaggaggctgaggcagcagaattgcttgaacctgggaggtggaggcctacagttagctgaaatcatgctactgtactccagcctaacagagtgagactctatctcaaaaaaataataaaataaaaacaataagtcaagcaagaatgatgtcatagagattggtagactaaaaagctacagaaatctgttcctccactgagaaaactattgaactg

SEQ ID NO: 158573 - DNA, 601 bp, Human
aggccaagagcagtggcacatgcctgtaatcccagcactttgggaggccaaggcgggtgtatcacttgaggtcaggagtttgagatcagcttggccaacatggtgaaaccccatctcaactaaaaaatacaaaaattagctgggcatggtggcatacgcctgtagttccagctactcaggaggctgaggcagcagaattgcttgaacctgggaggtggaggcctacagttagctgaaatcatgctactgtactccagcctaacagagtgagactctatctcaaaaaaataataaaataaaracaataagtcaagcaagaatgatgtcatagagattggtagactaaaaagctacagaaatctgttcctccactgagaaaactattgaactgtcaaaaactgtctgaagtaactattttggaattctcgagtctagttaaacactggaagcatcaagggaagagtttgataaagaggatgataaattttggttaatgttggtgaatttcagcctttccactcaataataactattttccataccccattattgcagggatccatgggaactgctgcccatgttcttgtaatgaattcctgca

SEQ ID NO: 158574 - DNA, 601 bp, Human
ggggcagacacagaagtgggctatcattacatcagtcctcatcagctgaagtggcttcccaaggatttaaataaatagtatgtgtttttcctccctttaggaagcagtcatttaagacaatttttattagataactggctgacagcagagataacagaacagagatttcaatgaccatgcacaacagagaataaaaatagttgggaaaaaatcatgaccaaatgactctgagccacaacaaccaagatttgacaatccctgaagagcaaaataattaagttaccagagttaccacaacatrgtactcataatgtccagttctcaaaaaaaaattacaaaacatgcaaagaaaagtatggttcattcacaggaagaaaaagtaatctgacagaaactatccctgaagaggctcagatattaaaaatatgagtcaaaaatgttaaatcagctgtcttaagtataaccaatgagttaaaggaaactagacaaaaagctaaaggaaaccgaaaacataataaatgaacaaaattagaatatcaatataaaggtagaaattgtaaaaaagaaccaagcaaaaattccagagctgaaaagtacaatg

SEQ ID NO: 158575 - DNA, 601 bp, Human
cagacacagaagtgggctatcattacatcagtcctcatcagctgaagtggcttcccaaggatttaaataaatagtatgtgtttttcctccctttaggaagcagtcatttaagacaatttttattagataactggctgacagcagagataacagaacagagatttcaatgaccatgcacaacagagaataaaaatagttgggaaaaaatcatgaccaaatgactctgagccacaacaaccaagatttgacaatccctgaagagcaaaataattaagttaccagagttaccacaacatggtaytcataatgtccagttctcaaaaaaaaattacaaaacatgcaaagaaaagtatggttcattcacaggaagaaaaagtaatctgacagaaactatccctgaagaggctcagatattaaaaatatgagtcaaaaatgttaaatcagctgtcttaagtataaccaatgagttaaaggaaactagacaaaaagctaaaggaaaccgaaaacataataaatgaacaaaattagaatatcaatataaaggtagaaattgtaaaaaagaaccaagcaaaaattccagagctgaaaagtacaatgactg

SEQ ID NO: 158576 - DNA, 601 bp, Human
tcatttacataagaccctgaataaaattaatagctgattttctctgagaaaccatggagatcagaaggtagtggaatggcatatttaaatgtctgaaagaaaaaataaaactgccaaccatgaattctatgtatagcaaagttgtccttcaagaatgaaggaaaaagtaacacattttcagataaccaataattaagggattttattaccagtagacatgtgctacagaaaatgctaaaggaaaccttttaggctgaactgaaagtacactagacagcaattcagagcctccaaaataaasaatattcataaaagtaacaatagaggtaaatataaaacccagaattactacatgtgtcatatagtttataacttctcctatttatagctttctatatttatatttatctataacttcataggcaaatgaataaaaattataaatatgatagtggtcatataatgtataaagatgcaatctgtgacagtcttatgaagcagggatgaagacatataggatcaaaatgtttgcatagttattgaagctatgttgatattatgaaattatattgttacaagtttaagatgctaattataattc

SEQ ID NO: 158577 - DNA, 601 bp, Human
agaaacaaagacatataagatatagagaaaacaaatgattaaatggcaaaagtaaatcttgttttagtaatcacattaaatagaaaaggatgaagccatcctattaaagggctgagactgacaagttggctaaaaactaaaataaattaaaaagaaaaacaagactcatctacatgctgtctataagagacttgccttagatataaggacacaaagaagttgaaagtaaaaggactgaaaaagatattccatacaaacagtagtaaccaagatagtgccgagtggctatatttttgtcaarcaaaataaactaaagtaaaatttacaagagaaaaagaagggcattatgcattgacaaaaattttgacatagccaaataattatctgttataaaatatatgtacttaataatacagcctcaaaatatatgaagcaataattgctataatttaagggagaaaagaacagttctatgaaaagttagagaatgaaatattccactttcaacatgagattaaacaactagacataagatcaataaggaaatagaaaatttgaacaacactataaaccaattatccctaacaggcatatacagaag

SEQ ID NO: 158578 - DNA, 601 bp, Human
attagaaaataccttgagacaaatgaagtaaaaatacaaatagcacgtttatggtatacactgaacatagttctaagagggaaatttatagctgtgagcagttaactaaaaaagaagaaagatctcaaatccatagcctaactgtacactgtaaggaactaaaaaaagtaaaacaaaaatagaagtcatctttatgatttgaaagagtaaaagatttacctaataagtccctaaatttactaataataaagaaaattgtttatatatttaattgcgttaaaattcagaacttgtaatcatraaaaggacagtacacattgacaaggaaacacagcaaaggaaaccagcctatgctgctgctgttgtgaggataatttggtacacttacattagtttggtgtcttttctttctctctctttctttctttctttctctttctttcgttcgttcgttcattcgtttctttttgagacagaatctcactctattgcccaggctggagtgcagtggcgtgatcttggctcactacaacttttgtctcccaggttcaaatgattctcatgcctcagcctcccaaatagctgggattataggtgcatg

SEQ ID NO: 158579 - DNA, 601 bp, Human; identical to SEQ ID NO: 24637

SEQ ID NO: 158580 - DNA, 601 bp, Human; identical to SEQ ID NO: 24638

SEQ ID NO: 158581 - DNA, 601 bp, Human; identical to SEQ ID NO: 24639

SEQ ID NO: 158582 - DNA, 601 bp, Human; identical to SEQ ID NO: 24640

SEQ ID NO: 158583 - DNA, 601 bp, Human; identical to SEQ ID NO: 24637

SEQ ID NO: 158584 - DNA, 601 bp, Human; identical to SEQ ID NO: 24638

SEQ ID NO: 158585 - DNA, 601 bp, Human; identical to SEQ ID NO: 24639

SEQ ID NO: 158586 - DNA, 601 bp, Human; identical to SEQ ID NO: 24640

SEQ ID NO: 158587 - DNA, 601 bp, Human; identical to SEQ ID NO: 24637

SEQ ID NO: 158588 - DNA, 601 bp, Human; identical to SEQ ID NO: 24638

SEQ ID NO: 158589 - DNA, 601 bp, Human; identical to SEQ ID NO: 24639

SEQ ID NO: 158590 - DNA, 601 bp, Human; identical to SEQ ID NO: 24640

SEQ ID NO: 158591 - DNA, 601 bp, Human; identical to SEQ ID NO: 24637

SEQ ID NO: 158592 - DNA, 601 bp, Human; identical to SEQ ID NO: 24638

SEQ ID NO: 158593 - DNA, 601 bp, Human; identical to SEQ ID NO: 24639

SEQ ID NO: 158594 - DNA, 601 bp, Human; identical to SEQ ID NO: 24640

SEQ ID NO: 158595 - DNA, 601 bp, Human; identical to SEQ ID NO: 21161

SEQ ID NO: 158596 - DNA, 601 bp, Human; identical to SEQ ID NO: 21162

SEQ ID NO: 158597 - DNA, 601 bp, Human; identical to SEQ ID NO: 21163

SEQ ID NO: 158598 - DNA, 601 bp, Human; identical to SEQ ID NO: 21164

SEQ ID NO: 158599 - DNA, 601 bp, Human
aaggaaatcaccactgttctgtaaagagcaactccacataaccctgcaggaaagtcaagtggctaagaacccctggcatctcccctggggctattggtcacgctataagagggaactctagaggaaatagaaatttcttcctctgttatcttgagacttctgtggagccgcaatctcaaaactcttagccaataggacagaggtatcactgtgtccaaataaccactgcccaaagcaaggtccttcctaaatttggtgttgggcatcagtatgtctgacaagtaaaacagcagcttgtcaytgtaacgccggcaggttttgctagcctagcataaccaacaagcttcatagtctgtgtttctctcgtgagagaggggtgtgtgtatgggtgtgtgagttcactcataaagactcaattgaaattaacaagtcaagagacagagtgactgcaaaagaagtagtgaccgccaaagtaacacaaagaggaagcctgtaaaacctgcacttccaccattccattcaacactgtaattaagctacgtaaacccaaggatgtgttccgctcaccttgttaagccgttcaagcatttcttttagcagg

SEQ ID NO: 158600 - DNA, 601 bp, Human
agcatacctgggcatggcagggaagagtctgcggttttgtcagcaattttgatgagttgtaggcatggaaggggcggggaagggcagcccatgtgccctaatcaagcagcctttccactaaatagtctccatgggtcgttctgctctgacattggagctcaaaaacgatcagaaaagggccatgcttaaagctatgtgccatccctggttctgtacaaccctggtggtccagaatcattctgctttttggtggtgggattctcccagcaaaagcagaaaatccaatcagttagttagaatsatgatgaagaatcccaagaaggaaatcaccactgttctgtaaagagcaactccacataaccctgcaggaaagtcaagtggctaagaacccctggcatctcccctggggctattggtcacgctataagagggaactctagaggaaatagaaatttcttcctctgttatcttgagacttctgtggagccgcaatctcaaaactcttagccaataggacagaggtatcactgtgtccaaataaccactgcccaaagcaaggtccttcctaaatttggtgttgggcatcagtatgtctgacaag

SEQ ID NO: 158601 - DNA, 601 bp, Human
acgcttgtgtttttattatgctgtggatgttgtcagctgaattttcaaaagcttcaccagcagaatcatctagatttttctgaattgagattatgggtcaatagtctaattttacaaaacattccaactctgataattgcctatgtcctagatctagaccagtggtcctcaaagtgtggtccctggatcacaacacctgggaacggatcagaaatgcaaatactccagcagatgccagacctactggcttagaatttctggggctggggcccaggagtctgggttttaacgtgcccccccmccccgcccacctttcaccccaggtaacactgatgcacactgaagttttagaaccactaatctagactatttacagccatgtttttagaaaggagctggagaaataactagaatttggagcattattgaaaatcagcccttttttaactcaaatggtggggattaaaaaggaaaaaaaacagccttgctgacctattcacagggatcccagaaactccatttaaaacccaactgctaaagaatgggtatttaagttcattaagagttctagttagctggaatttaattaaaaaacactttt

SEQ ID NO: 158602 - DNA, 601 bp, Human
ccctggggtcactggtcctcaaacttttgttaagccacatgtgccatcctttgaacaaagcagtccatggaagccactgtactgaagcaaagccaaggggccacaggcatctcccatgctcagctgccctcttccctcagagacccttcaagcaactcgatgcaacatgagggctctgccaaatgcaccttgaagtccagagcctccctccatgtatgcagggctgaggccagactgatgcagtgcatcattgaactcgtgaatggaagttagtggaagataacaggcctggaacctaccwtgggcttctctctcctagccaagagctgagtgctaagccctgactccatccttcgaggtgcctgtcattcttccccacctccctcctaggattgtgtcaaaaccaccagcactgggtcccatcagttaaatctttataactgctcatagtgatagtaaaaggccagtcaatatgtattcttaaaatagggattaagcagatgtttctgcaagcacactgtcctgctttgaagataatcacccgataagctgaccccaaaacccccaaaggtgagtagggcccactggaatgtacagctgc

SEQ ID NO: 158603 - DNA, 601 bp, Human
gcagttccaggaatctaagtagcaggagtcaaggacctgtcctcagagtgacccagctctgaatcagttcatccctgcatccctccctcaggagagctgtgattggccagcatgggtcacatgaccaccatcttgcctgacagctggaccacacgatgtgaaggaaaatcacagtgttcccggacgcatcccactcccttcaaaggcagtggttccctgtggagtgattctcagccccggggatgggaccacaccctcagagaggcttggctaaatctgggccagaggtgcaggagtattkggtggatgttgttctatcttccctctgcccctcttaagactgctgaggatggggtggggcacagaattctcaatcactcttaacaaaatgcatccaagattgagccacaaagctgaatgactggaaacagggcttcaaggaccctttgtgttattatttataaggaatcaaacattacaaattttagaaatagaaggaaccctggggtcactggtcctcaaacttttgttaagccacatgtgccatcctttgaacaaagcagtccatggaagccactgtactgaagcaaagccaaggggc

SEQ ID NO: 158604 - DNA, 601 bp, Human
aatttttactgacttattagtgacttgctaataaacataatgagtcttagcaatgggctctcattaatcaaggggaacacgtggtctgactaaaatatgtaagagacactctccatactcgcatgaacagagttatgacagtcacgatatgtggactggccatgagatgtagggacactccccacccttgtgctactagggtttcggtctggcaaggccttgagactgcactcttaagaaaggcacttggggccgggtgtggtggctcacacctgtagtcccagcactttgggaggctgargcaggtggatcacctgaggtcaggagttcgagaccagcctgaccaacatggagaactccatctctactaaaagtacaaaattagctgggcatggtggcacatgcctgtaatcccagctactcaggaggctgaggcaggagaatcacttgaacctgggaggcagaggttgcagtgagccaagatcatgccattgcactccagtctgggcaaaaagagcaaaactccatctcaaaaaaaattaattaattaattcaataaaaataaaaggcacttggttccttaattgctcttgtgaaagac

SEQ ID NO: 158605 - DNA, 601 bp, Human
cttgcagaaattgggcttccagctgaaggcgtaggttatgcagcaaggcttcatcagcttcctgcaatgagagccacatatccctggccacaggcaccatggagcataggggtaaagctggccgggtatatgagcacacagaccacctgggagcttactgaaatgcagactctggttcagtaggtctgggaggggtctgagattatgcattctagcaaggcaatggcttagcccattggacctgttctagaagagcagttctcaacagagggtgattttgccccccaaggggacatttggcagtgtctagagacatttttagttgtcaccactttagtggtagggtccttctattggcaactagtgggtagaggccagggacactgctaaataccctacaatacacaggacagcatccccccacaaccctgcacacaaggaattcccttgcctaaagggtcaatacagccagggttaagtaaccttgatctagaaagatcggagcgctaggtatatttacataccaaataaagttaatatttaagtaacgtctatatttgttctatatctcatcatcagtgagttgggtttctaagactga

SEQ ID NO: 158606 - DNA, 601 bp, Human; identical to SEQ ID NO: 21165

SEQ ID NO: 158607 - DNA, 601 bp, Human; identical to SEQ ID NO: 21166

SEQ ID NO: 158608 - DNA, 601 bp, Human; identical to SEQ ID NO: 21167

SEQ ID NO: 158609 - DNA, 601 bp, Human; identical to SEQ ID NO: 21168

SEQ ID NO: 158610 - DNA, 601 bp, Human; identical to SEQ ID NO: 21169

SEQ ID NO: 158611 - DNA, 601 bp, Human; identical to SEQ ID NO: 21170

SEQ ID NO: 158612 - DNA, 601 bp, Human; identical to SEQ ID NO: 21171

SEQ ID NO: 158613 - DNA, 601 bp, Human; identical to SEQ ID NO: 21172

SEQ ID NO: 158614 - DNA, 601 bp, Human; identical to SEQ ID NO: 21173

SEQ ID NO: 158615 - DNA, 601 bp, Human; identical to SEQ ID NO: 21174

SEQ ID NO: 158616 - DNA, 601 bp, Human; identical to SEQ ID NO: 21175

SEQ ID NO: 158617 - DNA, 601 bp, Human; identical to SEQ ID NO: 21176

SEQ ID NO: 158618 - DNA, 601 bp, Human; identical to SEQ ID NO: 21177

SEQ ID NO: 158619 - DNA, 601 bp, Human; identical to SEQ ID NO: 21178

SEQ ID NO: 158620 - DNA, 601 bp, Human; identical to SEQ ID NO: 21179

SEQ ID NO: 158621 - DNA, 601 bp, Human; identical to SEQ ID NO: 21180

SEQ ID NO: 158622 - DNA, 601 bp, Human; identical to SEQ ID NO: 21181

SEQ ID NO: 158623 - DNA, 601 bp, Human; identical to SEQ ID NO: 21182

SEQ ID NO: 158624 - DNA, 601 bp, Human; identical to SEQ ID NO: 21183

SEQ ID NO: 158625 - DNA, 601 bp, Human; identical to SEQ ID NO: 21184

SEQ ID NO: 158626 - DNA, 601 bp, Human; identical to SEQ ID NO: 21185

SEQ ID NO: 158627 - DNA, 601 bp, Human; identical to SEQ ID NO: 21186

SEQ ID NO: 158628 - DNA, 601 bp, Human; identical to SEQ ID NO: 21187

SEQ ID NO: 158629 - DNA, 601 bp, Human; identical to SEQ ID NO: 21188

SEQ ID NO: 158630 - DNA, 601 bp, Human; identical to SEQ ID NO: 21189

SEQ ID NO: 158631 - DNA, 601 bp, Human; identical to SEQ ID NO: 21190

SEQ ID NO: 158632 - DNA, 601 bp, Human; identical to SEQ ID NO: 21191

SEQ ID NO: 158633 - DNA, 601 bp, Human; identical to SEQ ID NO: 21192

SEQ ID NO: 158634 - DNA, 601 bp, Human; identical to SEQ ID NO: 21193

SEQ ID NO: 158635 - DNA, 601 bp, Human; identical to SEQ ID NO: 21194

SEQ ID NO: 158636 - DNA, 601 bp, Human; identical to SEQ ID NO: 21195

SEQ ID NO: 158637 - DNA, 601 bp, Human; identical to SEQ ID NO: 21196

SEQ ID NO: 158638 - DNA, 601 bp, Human; identical to SEQ ID NO: 21197

SEQ ID NO: 158639 - DNA, 601 bp, Human; identical to SEQ ID NO: 21198

SEQ ID NO: 158640 - DNA, 601 bp, Human; identical to SEQ ID NO: 21199

SEQ ID NO: 158641 - DNA, 601 bp, Human; identical to SEQ ID NO: 21200

SEQ ID NO: 158642 - DNA, 601 bp, Human; identical to SEQ ID NO: 21201

SEQ ID NO: 158643 - DNA, 601 bp, Human; identical to SEQ ID NO: 21202

SEQ ID NO: 158644 - DNA, 601 bp, Human; identical to SEQ ID NO: 21203

SEQ ID NO: 158645 - DNA, 601 bp, Human; identical to SEQ ID NO: 21204

SEQ ID NO: 158646 - DNA, 601 bp, Human
tggagacggggagcccgcgagacccgggtctccagggtctgcccaaggaagttgctcatgggagcagacctctagagcaggatttgaggccaggccaaagaggttagttactgatgggggctgcataaattgggggttgtggagggacgccagctgggagggagagactggagaagggggtgtgtggagagcccaagaggaggcccagggggaggtgcgcaggcacagcctctgttgaaggagtctctctaaggctgctagggtccttcacctgtcattgtcaggcctggagagcgggctyttaaggaggccaggccacacctcaagggaagatggaggttaccggaaggtcatacctaaaattacgggcaaaaccagggagaattatgaacaggctgagttaggacttgtgtttacgttaatctgaggccttgcttggatttctttttaacctaaaccacaggcaaatattcccctttagggagagaattcgccgacatctatttaacatcccttaattgttgagagcatccactgtgtgccagacacttcggtacacacagaaagaaacccagaggagggtaagatgcccttataggga

SEQ ID NO: 158647 - DNA, 601 bp, Human
ttgaggccaggccaaagaggttagttactgatgggggctgcataaattgggggttgtggagggacgccagctgggagggagagactggagaagggggtgtgtggagagcccaagaggaggcccagggggaggtgcgcaggcacagcctctgttgaaggagtctctctaaggctgctagggtccttcacctgtcattgtcaggcctggagagcgggctcttaaggaggccaggccacacctcaagggaagatggaggttaccggaaggtcatacctaaaattacgggcaaaaccagggagarttatgaacaggctgagttaggacttgtgtttacgttaatctgaggccttgcttggatttctttttaacctaaaccacaggcaaatattcccctttagggagagaattcgccgacatctatttaacatcccttaattgttgagagcatccactgtgtgccagacacttcggtacacacagaaagaaacccagaggagggtaagatgcccttatagggagatctttctcctcccttcctccatctctccctctctctctctctcgcttccctctctgaagacggtctagctttgggctaagt

SEQ ID NO: 158648 - DNA, 601 bp, Human
caacacaatgtgattggtgctgtgaagagagggagcacacggtactgggagagctcagggcagggggttgatccagttccgggcagggcgatggattcacaagacattttggcaaaggtagacccagcttccgtgtttcccagctcacaggtgcactcctaccctggggcctttgtacttgctcttccctctgcctggagctttcttcccctaggatgtccccatagcttgctccttcacggctttactcaagtgtcacctccccagcaagacctttcttggccaccctgtttaaagtggmcactccagcccagtgtggtggctcatgcctgtaatcccagcactttgggaggccgacgtgggtggatcacttgaggccaggagatcgagaccaatctggccaacatggtgaagccctgtccctactaaaaatacaaaaattagccaggtatgatggtgcacagctgtagtcccacctactcaggaggctgaggcaggagaattgcttgaacccaggtggcggaggttgcagtgagctgagatcgcaccgctgcgctccagcctggggcaacagagcaagatgtctcaaaaataaataaat

SEQ ID NO: 158649 - DNA, 601 bp, Human
atagttattgaatgataagtacgttaagtttacaaagatgagtaggagttgagtaagacaagaaagggagggaataacagatgaaaagggaacagggggagggagagagagacagagaaagagagagagagattgaaattagtgagtttaaggaactaaaagccttcacatccagcttattcccaggaatgcgttaggggtggtataaggcaaggctggcgtaggttgggggccaagctgtgcgaggccatgtcctgtgaggggagacaggtgcctctgacttgggcggatgtgctatgtsctgttacagaggttaggaagattgacccaggaaaaaaggaggaagccatgaactctgctggggagctatcagggaaggtgtctcaaaagaggaggcacctcctcttaggcccagggaaaaagtttcagtgttattctagacgtgacggacattctgaaggcctgttcccacatcccctgtcttaacagacagacactgggttagaaacttttcggtgcttgcacgggtggatttcactttgcatttggtcctcgtagtgcctaacgggacctctgcccacaaaattgctcaagaaagatt

SEQ ID NO: 158650 - DNA, 601 bp, Human
taaaaagaaactggaaatggaaatgtggaaatgtggatttctttctctttttttttttttttttttttgagacaaagtctcactctgtcccccaggatggtgtgcagtggcgcaacctcggctcactgcaacccccgccttccgggttcaagcgattctcctgcctcagcctcccaagtagctaggattacaggcactcgccaccacacccagctaatttttgtactttttagtagagacagggtttcacctcactggccaggctggtctcgaactcctgacctcaattcgggcctgcctygggctcccaaagtgctggtattacaggcatgagccactgtgcctggcctggaaatgtggatgtctgtctaggatctcttagcatttatacattggcagctaattccattttgttttttttaaagcaccgtgtagatcaagcaaagcatttcttagggctgtatggagccctgggctgaaagtttataaccaaaaatccagttccactcatcggcaattattggaacactgaaccaacttaaccaactgtaactcagctctcacttttccaccttgtttataaggaaaccacgtgacactc

SEQ ID NO: 158651 - DNA, 601 bp, Human
ttttttgagacaaagtctcactctgtcccccaggatggtgtgcagtggcgcaacctcggctcactgcaacccccgccttccgggttcaagcgattctcctgcctcagcctcccaagtagctaggattacaggcactcgccaccacacccagctaatttttgtactttttagtagagacagggtttcacctcactggccaggctggtctcgaactcctgacctcaattcgggcctgcctcgggctcccaaagtgctggtattacaggcatgagccactgtgcctggcctggaaatgtggatktctgtctaggatctcttagcatttatacattggcagctaattccattttgttttttttaaagcaccgtgtagatcaagcaaagcatttcttagggctgtatggagccctgggctgaaagtttataaccaaaaatccagttccactcatcggcaattattggaacactgaaccaacttaaccaactgtaactcagctctcacttttccaccttgtttataaggaaaccacgtgacactctggttagatgtcttgtgaaaatcccaatcattatgtccttactgggtctcaacccttttttg

SEQ ID NO: 158652 - DNA, 601 bp, Human
acagggtgccaggcactgtcccgggccgttctgcctgacttatctcatcgaattatcagcgttactaagtgagtctggttctatgattatcctattttacacagataaaactgagacccaaagaggagaaaaagctggttcaggtgacacagtggtcacagctgagacacagatttgaacacacgtctctcctacgttggatcttggatctgacattgtgctttctcctggttgctgtattcagtcattccttcattaagcattgtttgttgagtcaaagctagggccaaacttctctgtccgggacacccccggatgcctgcatagaaataagagctaaatccctgaactcgaatgagctcatccagagagtggctgagacagagaagggcaactccagagggcaggtcccacaaacacacctgcatttggggggccagcagagatgggatggggggattagccacaggagggcaggcggcacagtgcagccttgtgaagcccagagggagagagagtttcgagaaggaggaggtggacttcaagatgagtgccctgaaggactgaggaggtgacccccaagcttgggctatgccaggct

SEQ ID NO: 158653 - DNA, 601 bp, Human
actgtgacctgcttcagaaaacagctgcttctgtggcagtaatcccagcactttgggagtgtgaggtgggtggatcacttgaggtcaggagttcgagaccagcctgaccaacatagtaaaaccccgtctctactaaaaatacaaaaattagccaggcgtagtggcatgcacctgtaatcctagatacttaggaggttgaggcaggacaattgtttgaaccagggaggcagaggctgcagtgatctgagatagggctactgtcctccagtctgagggaaagccagacttcgtctcaaaaaaacaaccaaaataaacaactgcttctgaatacacaatggaaaaaaatccccaggggttgtgccagggtgaggggaagtagggcttcctgtgtgacttaccaggaatcttggagctggcccatgcaggggtgtgggaggtgacagagaggtctttaaaaccaggtgggcccagccccggcctcttctgtgggcctgaggacggagaaaaggtctcactggtgaggaatctcatctttggggctgctttgcctgagggaggtgcagagagcagggccgagagaggggctatgagaggagacacc

SEQ ID NO: 158654 - DNA, 601 bp, Human
cttcagaaaacagctgcttctgtggcagtaatcccagcactttgggagtgtgaggtgggtggatcacttgaggtcaggagttcgagaccagcctgaccaacatagtaaaaccccgtctctactaaaaatacaaaaattagccaggcgtagtggcatgcacctgtaatcctagatacttaggaggttgaggcaggacaattgtttgaaccagggaggcagaggctgcagtgatctgagatagggctactgtcctccagtctgagggaaagccagacttcgtctcaaaaaaacaaccaaaatmaacaactgcttctgaatacacaatggaaaaaaatccccaggggttgtgccagggtgaggggaagtagggcttcctgtgtgacttaccaggaatcttggagctggcccatgcaggggtgtgggaggtgacagagaggtctttaaaaccaggtgggcccagccccggcctcttctgtgggcctgaggacggagaaaaggtctcactggtgaggaatctcatctttggggctgctttgcctgagggaggtgcagagagcagggccgagagaggggctatgagaggagacacctggcccccttg

SEQ ID NO: 158655 - DNA, 601 bp, Human
agcatcctcaggtcttgcctcctcagaagaaagaattctcatggctgtaatcccagcactttaggaggccgaggtgggcggatcctgaggtcaggagattgagaccatcctggctaacatggtgaaacccatctctactgaaaatacaaaaaattagccaggcgtggtggcaggcacctgtaatctcagctacttgggaggctgaggcaggagaatcacttgaacctgggaggtggaggttgcagtgagccgagatggtgccactgcactccagcctggcgacagagtgagacaaaaaaaagaattcgactgagggacataaggcagaaggagagactgaggcaagtttcacagcagaagtgaaagcttattaaaaagctttagagcagggatgaaaagaagtaaagtacacttggaagaggggccaaccaggcgacttgagagattcaggggttctgtttgacctttgacttggggttttatacatggcatacttcaggggtcttgttttccttatcccctgattcctcccttgggttggtggggtgggctgtccgcacgctcagtgacctgccagcacttgggagggagcatgcacagt

SEQ ID NO: 158656 - DNA, 601 bp, Human
tcagctacttgggaggctgaggcaggagaatcacttgaacctgggaggtggaggttgcagtgagccgagatggtgccactgcactccagcctggcgacagagtgagacaaaaaaaagaattcgactgagggacataaggcagaaggagagactgaggcaagtttcacagcagaagtgaaagcttattaaaaagctttagagcagggatgaaaagaagtaaagtacacttggaagaggggccaaccaggcgacttgagagattcaggggttctgtttgacctttgacttggggttttatacrtggcatacttcaggggtcttgttttccttatcccctgattcctcccttgggttggtggggtgggctgtccgcacgctcagtgacctgccagcacttgggagggagcatgcacagtgtgttgactgtagttgtacgcatgctcccttgaggcgttcttcccttaccagccgaacgtccctagcaggtcatataccagttaaatgccgccattttgcctcttcatgcacatgtgtgagcccactcacccagctcctgagatcttactggaagctgctgatcacctgcttcaggtattcctgt

SEQ ID NO: 158657 - DNA, 601 bp, Human
tattttagagagatggttaataatttcctgcccatcacctgatggttgcctgacattcctgccctgctcctgtctgaccagctacctactgtcacagttggtctgtatatgaaaggcatgctcacagaggagccatctgaggtgtctaggaattaactagcagccctggaaggagcaggctgtctctggcctccaagatgtcaaagcgtcctaaaatatagaaaatcaaaagcatgtttagtgcccagggatgctcagaggcagtggagtagagtcagtcaaggaaatagattcacagttmtgggctaaacccttggggacctcacttcaattgtctgagcctcaatttccttatctgtaaaatcaacaactgttattcattgaacaagtgactgtttaaaaggacagacaccgggcctgccaaggtcattgatgggtttagagagatagaggatagtgcttggcacaccagaggtgctcagtgagtggcaggtggtgtccttgtgccacagctccagggagcagcagagaaagattggtgtggaatggtggggtctagggccatttctttggctgtttggagcccttggagcagaggcta

SEQ ID NO: 158658 - DNA, 601 bp, Human
taatttcctgcccatcacctgatggttgcctgacattcctgccctgctcctgtctgaccagctacctactgtcacagttggtctgtatatgaaaggcatgctcacagaggagccatctgaggtgtctaggaattaactagcagccctggaaggagcaggctgtctctggcctccaagatgtcaaagcgtcctaaaatatagaaaatcaaaagcatgtttagtgcccagggatgctcagaggcagtggagtagagtcagtcaaggaaatagattcacagttatgggctaaacccttggggamctcacttcaattgtctgagcctcaatttccttatctgtaaaatcaacaactgttattcattgaacaagtgactgtttaaaaggacagacaccgggcctgccaaggtcattgatgggtttagagagatagaggatagtgcttggcacaccagaggtgctcagtgagtggcaggtggtgtccttgtgccacagctccagggagcagcagagaaagattggtgtggaatggtggggtctagggccatttctttggctgtttggagcccttggagcagaggctatgggtggacagaaccctcag

SEQ ID NO: 158659 - DNA, 601 bp, Human
ataatgaatatataataataaatccagcttggattacatttttctttatagcatcatagttgtcaaaaataattatgtgaatatagatataaagatatagcagaaagatgcctacaaaggcaaaagcgcttggggcccataagagccataatcaggccctgaaagccactggcacattgtgggagcccaggcttcactgctgagcacctcctctgggccaggcactattctcagtggtagaatagaggtgtgcatccgcccagcctctgcctgcaaagaaccatcagggtagacatccttraaaacaggcaactacagcactgtgagctaaaaggagtatgagatgtagaatcaccggctttccttctgccctcctgctgtgggcgtcaagtgctctctgtccaggaatttttttcttccgtcttacatctttcatcaaaggccatgtctaggttatatcaagtcctgcttctccacgtatgccaccaaatctccatttaagaatcctgcccattctctggtcccttttagccattttgccaacggggtgagtatgtctggggtgtttgtggctaaaagtgcactggtggtagggacagtg

SEQ ID NO: 158660 - DNA, 601 bp, Human
cattgatggggatgtgacaagtggcacctgtgctgactgaaagagcccccagtggccaaccctggaacaatttagcaacaaaataaatggccccaaactccagtcttatcatgagaaaaaagaaaatcagacaaatcccaatcgtggggcatcttataaaatgtctaaccagtaccccctcaaaacagtcaagaacaaggaaagcatgaggaactgccacacccaagaggagcctaaagagacaagaccatgggccgggcgcggtggctcacgcctgtaatcccagcactttgggaggccragacaggtggatgacctgaggtcgggagtttgagaccagcctgaccaatgtggaaaaaccccatctctactaaaaatacaaaattatctgggcatggtggcacatgcctgtaatcccagctactcaggaggctgaggcaggagaatcacttgaacctgggaggcagaggttttggtggtgagctgagatcgcgccattgcactccagcctgggcgatgagagtgaaactccgtttcaaaaaaaaaaaaaggcaagacaatgaaatgtaacatgggatccccagtgggatcctgggacaga

SEQ ID NO: 158661 - DNA, 601 bp, Human
tcatcccttggactggttccaggatccccgtggacaccaaaatctgcagatgccctagtccctgatataaaatggcatagtatttgcatataacctatgtgattgtatccccccaaccatttttttttttctttgagacagggtctcactctggttgcccaggctggagtgcaatggtgcgatctcagctcactgcatcctagaccttctgcactcaggtgattctcccacctcagcctcctgagtagctgggactgcaggcacgtgccaccatgcctggctaattatatatacatttttwaatagagacagggtttcaccatgttgcccaggctggtctcaaactcctggacttgagcagtctgccttggcctcccaaactgctgagattataggcatgagccaccgcgcccagctgcgatcacatactttaaatcatttctaaattatttatcgtagctgatgcaacgtcagtgctatggaagttgttgttgtattgtttgggaataatgacaagaaaaaagactgtacatgtttagtatagacacaagaaaataggcctgcttacattttccatccatattggttgatccacagatgt

SEQ ID NO: 158662 - DNA, 601 bp, Human
ctgcttcctactgtatgtatctatgtttcttcggtaggataacaaagaaggctcaaaagctttcatgcccaagggctcttaaagagtaactagctgtgcattgttcagaaactgatcagagtatagatttcgtttctagttttgttattctgtctcagcaatactacttaggagtactcttagagattcttgaagataaacatagtttatgaggaatataatatagcattttttagttggtttttggtaaatcaatgaatttaaccaaaatataaataaatatttcatcaattattagacygctaagttcattaaaattcagtatactcctatataatcatgctaatgtctttcttattggatttaaaaacttatgtccaatgtattttcagaaataaattcaactggtcttacctctacatcttctggagctggcagaaattcagggacctagagcaaaagaaaatttgttctgagttatttttataagccaaaccctccttttatattaattgaaaagtatgatttagattttgttgtgacaaatatagtcttaccaagtcattcacataatttttcagctgatcaacaatatctataa

SEQ ID NO: 158663 - DNA, 601 bp, Human
actagtatagcttaaagatccaagttacactattactcacttatatcatagccagcattgcttgatcagattatcagatagatacagtatcacggagacaaaatcctttcattatgatgtaagataaaaaatatctttcattaacaacacacgtaaaggaagtacccactggaccaactcaggttagaaggtggaatctctttcttatttcttattttgcaagttatagactacagccaggaaactctggaaagaactctaaccataacagttaaacaaggtgcatgagatgctagaaatrtatgttttgataattaggcacattgattaagaagtattttcagttattggaaaagtctttccaataagctgaatgtgctactttcattttagatgctgcttattagaaaaggacctagtaaatgagagtgtttgggttcagagctagagagtgaattttagagaaaagcaatagttgtgactcattcactttctaaacttttacacatagtcatttacgataattgttttctttgcaatgtatcttcttaagtctccccctttgtagtgtcctaattactggtagcacttttagttattc

SEQ ID NO: 158664 - DNA, 601 bp, Human
tgcctactagtatagcttaaagatccaagttacactattactcacttatatcatagccagcattgcttgatcagattatcagatagatacagtatcacggagacaaaatcctttcattatgatgtaagataaaaaatatctttcattaacaacacacgtaaaggaagtacccactggaccaactcaggttagaaggtggaatctctttcttatttcttattttgcaagttatagactacagccaggaaactctggaaagaactctaaccataacagttaaacaaggtgcatgagatgctasaaatgtatgttttgataattaggcacattgattaagaagtattttcagttattggaaaagtctttccaataagctgaatgtgctactttcattttagatgctgcttattagaaaaggacctagtaaatgagagtgtttgggttcagagctagagagtgaattttagagaaaagcaatagttgtgactcattcactttctaaacttttacacatagtcatttacgataattgttttctttgcaatgtatcttcttaagtctccccctttgtagtgtcctaattactggtagcacttttagt

SEQ ID NO: 158665 - DNA, 601 bp, Human
tcttcctgagtttgcctactagtatagcttaaagatccaagttacactattactcacttatatcatagccagcattgcttgatcagattatcagatagatacagtatcacggagacaaaatcctttcattatgatgtaagataaaaaatatctttcattaacaacacacgtaaaggaagtacccactggaccaactcaggttagaaggtggaatctctttcttatttcttattttgcaagttatagactacagccaggaaactctggaaagaactctaaccataacagttaaacaaggtgmatgagatgctagaaatgtatgttttgataattaggcacattgattaagaagtattttcagttattggaaaagtctttccaataagctgaatgtgctactttcattttagatgctgcttattagaaaaggacctagtaaatgagagtgtttgggttcagagctagagagtgaattttagagaaaagcaatagttgtgactcattcactttctaaacttttacacatagtcatttacgataattgttttctttgcaatgtatcttcttaagtctccccctttgtagtgtcctaattactggt

SEQ ID NO: 158666 - DNA, 601 bp, Human
gggattacaggcaggagccacttcacccagctgaggcctatttttacatttttttccttttgcaaagaaagccctggccattcacactaagaagtcttgctaattgggcaagactacctttgtcctggctgggtgcagtggctcacgcctgtcatcccagcactttgggaggccaaggcaggtggatcacggggtcaagagattgagaccatcctggccaacatggtgaaaccccgtctctactaaaaaatacaaaaattagctgggtgtggtggcgtgcgcctgtagtcccagctactcrggaggctgaggcaggagaatcgcttgaacctgggaggcagaggttgcagtgagctgagatcgcaccactgcactccagcctagcaacatatcgagactccgtctcaaaaaaaaaaaaaaaaaaaaaaaaaaaggattacctttgtcctacacacaaactaggtttatatcagggtttctcaacggtgataccactgacatttggggctagataattctttgttgtcagggctgtcttgtgcattctagaatgtttagtacctggcttctacctactagatgccagtagcacccccattct

SEQ ID NO: 158667 - DNA, 601 bp, Human
aataatattcatatttaaagaggtaaattttccagctgaaactgaaaatactgactgcttcatccgtgatgatctgaaaaaccagcatttctcacagaggctcattttgctgagttaacatttacatgtgtatgctgaaagaaaattaggttccaaagaagtagaggggccctgccagccaaatgaactcccttgagataatattgccaggaatggtcagtaccggtactcaaagcactgaaattgtaaaactacaatttcagttgtaaaaacaactgaaaatcttttctgaaagcctttkaatggtacctggacactgacgcccatattgatggggctgtgcttcctctcccacccttccttgtttacctctgttaacagacaatggggttttgttttcttttgttctgcaagcagcagagctgtgtctggcaatatgtggtccaggataaataactgcgggaattggctttatatgcacatcaaaggcagcctcaaaagaggaaaagaagtagagggctgtcgccactaaactgccttaaggatgtattgagaaggagagtgaaaagattaaccttgatttaggcagcctcaggtgccc

SEQ ID NO: 158668 - DNA, 601 bp, Human
aactcctttgtagatctcactttcctcatctataagatgaacatgcttaactggagagttctaagtttagctccaaagctaccacttcatgagtttcaaaaatatgttcagctcctttctttctgaggaaagatttagagggatatttttcacatggtcaccaggccaagcaatcaaaagaaataagaataattttgataatataattaagatttcatttgaatcacatgtggaatgtttttggaggcaaaagaactaatttaaaaaatttgaggctgggtgcgatggctaacacctgttwatcccagcactttgggaggccgaggcgggcagatcacccgaggtcaggagttcgagaccagcctgaccaacatggtgaaaccccggcactactaaaaatacaaaaattagccaggcgtgatggtgtgcgcctgtagttccagctacttgggaggctgaggcaggagaattgcttgaactgggaggtggaagctgcagtgagccaagaccttgccactgcactccagcatgggcgacagactgagactctgtctcaaaaaaaaaaattttttttgagagtaatttattttatgtattttcc

SEQ ID NO: 158669 - DNA, 601 bp, Human
ttaactcctttgtagatctcactttcctcatctataagatgaacatgcttaactggagagttctaagtttagctccaaagctaccacttcatgagtttcaaaaatatgttcagctcctttctttctgaggaaagatttagagggatatttttcacatggtcaccaggccaagcaatcaaaagaaataagaataattttgataatataattaagatttcatttgaatcacatgtggaatgtttttggaggcaaaagaactaatttaaaaaatttgaggctgggtgcgatggctaacacctgtttatcccagcactttgggaggccgaggcgggcagatcacccgaggtcaggagttcgagaccagcctgaccaacatggtgaaaccccggcactactaaaaatacaaaaattagccaggcgtgatggtgtgcgcctgtagttccagctacttgggaggctgaggcaggagaattgcttgaactgggaggtggaagctgcagtgagccaagaccttgccactgcactccagcatgggcgacagactgagactctgtctcaaaaaaaaaaattttttttgagagtaatttattttatgtatttt

SEQ ID NO: 158670 - DNA, 601 bp, Human
ttatagggtattgtttaaaatgtttaattggaaaaaacaggatttccttgttttaacttgcatttatgtgattactagggagattgaacagtttttcatatatggattgctcacttagatttttaaaaagctttcttagtttatgctctttgtctttatccctatttagataccaaacaccaagccattgcttggtagttagcatctcaatgccagtgtgatgttgtagtgagagcatttcactaaaagatagtagatatacgttctaattctcattctgacactatttatggaacttggrgctagtgacttaactcctttgtagatctcactttcctcatctataagatgaacatgcttaactggagagttctaagtttagctccaaagctaccacttcatgagtttcaaaaatatgttcagctcctttctttctgaggaaagatttagagggatatttttcacatggtcaccaggccaagcaatcaaaagaaataagaataattttgataatataattaagatttcatttgaatcacatgtggaatgtttttggaggcaaaagaactaatttaaaaaatttgaggctgggtgcgatggc

SEQ ID NO: 158671 - DNA, 601 bp, Human
tcctaagtgttaaataatcttcaaaaatatgacatgtagtggttgttctgtattccaacataggatgcaactcttactatttttggacccaaaggttgcatctaactttttttttttttttttttttttggagacagtcttgctgtgtcacccaggctggagtgcagtggcgcgatctccactgactgcaacttccacctcctggattcaagcaattatcctgccttagcctcccaagtagctgggattacaggcacgcacgaccatgcctggctaatttttgtatttttagtagagaccrggtttcaccatgttggccaggctggcctcaaactcctgatctcaggtgatccgcctgcctcggcctcccaaagtgctgggaatacaggcatgagccaccacacccagctgtatctaactttttatttttgtctacattactccaaagaacatctctgtaaataatttttcatatatatctttgcttatttgatatattcctagaagtagaattactaaattaaagggataaaaattttaaggctttgatatacattataaagggttttacctcttttcacttggagcattcttattatta

SEQ ID NO: 158672 - DNA, 601 bp, Human
gagacacatttggtttgtcaacactctttgcaattatctagaccggtacctacgaaatacattctcaatgaatacttttttgattgaaagaatgaaaggatgtctcaaatatataaaactggtctgcgaaaaaagaaaataaattgttcattttagagttagcatgtttttgaatgaaaactccagttttatatttacttattgttgacatttgtcataactgcagtatattctaccatttattttttagctagtggaatttaatgtgacaaaaatgtgatatcaaacttatgtattctcwggtggattgttaccattttggtttcctgtaccaaacaagctttaaaacagaaaattttatagtgcactatgtggtcattttattttcaaaaatatctaatagtgtttaaatctctcatgtgttttatgccttcattcatttctgttttcttgtttacatatcagggacaaaataggaaatcaaataatataacactgtgcccatgtttagttaaggcttattccataaatgtgatctggtactttacatgtagacaataacatcactaaggacattgaaacaattaaataattgaaacat

SEQ ID NO: 158673 - DNA, 601 bp, Human
ctgttttcttgtttacatatcagggacaaaataggaaatcaaataatataacactgtgcccatgtttagttaaggcttattccataaatgtgatctggtactttacatgtagacaataacatcactaaggacattgaaacaattaaataattgaaacatggaaacggatttccttccgatacctcatcctgtttttttttgttcaacattttgattactgcaaccttcaatttggacaattttttttctctttttatttgagtgaaattaaaaggatgtaagttttcttttaatctccccyacactaaactcactgatttccattagcaatgttttatctaatgaatgtttttgaggtccaattatctaattatcatgtggtctatcatcacatcagtattacaggcggttatatcacaggggtaagtcacaaagtgggttaatgatcgatgactctgactttcataagaattcctattggcagtaggaaacttatatcacccatctctggagtagtttgaagtttattaaagagtaaattaaactttactaattgttctattatccactaattagatccacttataattatcttgagtgt

SEQ ID NO: 158674 - DNA, 601 bp, Human
ccaagacttgggacttgtaccctctgaagcaaggcccgatctgtacctttgcctgttttagcgactgctggagtgactgggatgcagggaaccaagtccctaggctgcacgctgcaatgggggcctggacctggcccaggaaactgtttttaccgcctaggcctctggagcctataatgggaggggctcctgtgaacatctctgacatgcctcggagacatttcccccattgtcttggtgattaacatttggctccttattacttatgcaaatttatgcagcaggcttgaatttttcccccaaatatgggcttttcttttttattgcatcgtcaggctgcaaattttccaaacttttatggtctgcttcctgttgaatgctttgctgcttagaaatttcttctgctagataccctaagtcatttctctcaagttgaaagttccacagatctctggggaaggggcaaaatgcccccagtctctttgcatagcaagagtgacctttagttcccaacaagttcctcatgtccatctgagaccacctaagcctggacttcgttgtctgtattagcattttgttccaagccattcaacaattctct

SEQ ID NO: 158675 - DNA, 601 bp, Human
atggaagcagcctgaaagattaccagcaatgcaaaaagtgtgctggttccccagagaatgtcttaaagcactacattgcagtctaaatatctgtctccttatttattcatttatttatttgtttatgagaaagaaaagaatattctcagaacggcttgacaaggaggagtttattcatggcttggcttgagagatattttggatatttagatgaggtaaaactttcagtggatggatgcagctgagagatcacaagttcatttggccaaggtgtcatgggagtcttccagtattcaggatrtgcttctgcagactgatttcagagtgacaatgtcttgtagattcatctgctggcaaaaaaaatctgcagacaatgggaaacatggcagacagaatacttttttaaagctaattttgcttggatgacctaaaaattgagaaggagtttgtaatccttttcttgatgatacaaacatctgattgttgccaaaaatgacctcctaaacttagaagaaaggaaaagaatgaacataaattcaactaaaaaagttgtgaattctgttgtttcttaatgtaaggttgctcctccgtgacaaagact

SEQ ID NO: 158676 - DNA, 601 bp, Human
ctgaaagattaccagcaatgcaaaaagtgtgctggttccccagagaatgtcttaaagcactacattgcagtctaaatatctgtctccttatttattcatttatttatttgtttatgagaaagaaaagaatattctcagaacggcttgacaaggaggagtttattcatggcttggcttgagagatattttggatatttagatgaggtaaaactttcagtggatggatgcagctgagagatcacaagttcatttggccaaggtgtcatgggagtcttccagtattcaggatgtgcttctgcaractgatttcagagtgacaatgtcttgtagattcatctgctggcaaaaaaaatctgcagacaatgggaaacatggcagacagaatacttttttaaagctaattttgcttggatgacctaaaaattgagaaggagtttgtaatccttttcttgatgatacaaacatctgattgttgccaaaaatgacctcctaaacttagaagaaaggaaaagaatgaacataaattcaactaaaaaagttgtgaattctgttgtttcttaatgtaaggttgctcctccgtgacaaagacttgctcccagat

SEQ ID NO: 158677 - DNA, 601 bp, Human
aagaaaggaaaagaatgaacataaattcaactaaaaaagttgtgaattctgttgtttcttaatgtaaggttgctcctccgtgacaaagacttgctcccagatgcatacctctgggagtcagggttttaggcatttattgccatcagttcaagaaattttgtgtatctaattgtgtgttcactgtgcaatttgaacattttgaatatctaacttatataagaattgtttgaaatttacatttataacaaactttctttttttcttaaaaggaagtaaccactattttagtattcaaaaatayctgatattttgaaaatcctgtcttatgttttgtctgagtgaaagaattaccagtttctctctctctttttttttttttttttttttttttttttttgagatggagcctcactctgtcacccaggctggagtgcaatggtgcaatctcagctcactgcaacctctgcctcccaggttcaagtgattctcctgcctcagtctcctgagtagctgggattacaggtgcatgtcaccatgcccagctgatttttgtatttttagtagagacggggttgtgccatatgggccaggctggtctcga

SEQ ID NO: 158678 - DNA, 601 bp, Human
gatgcatacctctgggagtcagggttttaggcatttattgccatcagttcaagaaattttgtgtatctaattgtgtgttcactgtgcaatttgaacattttgaatatctaacttatataagaattgtttgaaatttacatttataacaaactttctttttttcttaaaaggaagtaaccactattttagtattcaaaaatacctgatattttgaaaatcctgtcttatgttttgtctgagtgaaagaattaccagtttctctctctctttttttttttttttttttttttttttttttgakatggagcctcactctgtcacccaggctggagtgcaatggtgcaatctcagctcactgcaacctctgcctcccaggttcaagtgattctcctgcctcagtctcctgagtagctgggattacaggtgcatgtcaccatgcccagctgatttttgtatttttagtagagacggggttgtgccatatgggccaggctggtctcgaactcctgacctcaagtgatctgcctgcctcggcctcccaaagtgctgggattataggcatgagtcactgtgcccagccagaattaccaatttctaatgt

SEQ ID NO: 158679 - DNA, 601 bp, Human
gatgtgttgtttgaatgcctgaaaaggaaatcatagtattctttattttggtgataaaagtatttgtgtacatgtgccattttgatactgaacactatataatttttgtgatctttttggaatgtgaggactaagtaatgtaagtggtgaagaaatcccattaaaagtatacgttttctagctaagccatatattaaattttataatttgaaaaacaaaaatatcagtgtttagttatactgttttttgtttgtggacccattttctttcttgcttcatatttttctgcctttatttaaaatgtttgcttcaataataaatattttaaagtcattatatcttaacttttttgttcagaaaaggaacaacttagcataagaacagagcagaagtaggcatggcatagtggctcatgcctgtaatcccagcactttggaaggccaatgtgggaggatcacttgaggccaggagttcaagaccagcctggacaatatagtgggacccttctctctaccaaaaagaaaaaagtaaattagctgggcatggtgggacatgcctgtagtcccagctacttaggaggctgaggtgggagaataacttt

SEQ ID NO: 158680 - DNA, 601 bp, Human
ccagcctggacaatatagtgggacccttctctctaccaaaaagaaaaaagtaaattagctgggcatggtgggacatgcctgtagtcccagctacttaggaggctgaggtgggagaataactttagctggggagtttgaggctgcagtgagataagctaaggttgtgccagtgcactgcagcctgtccagcctgggtgacagagacagagtgagaccttgtctcacaaaaaaaaaaaaaaaaacaataacagaaacaaaaacaaacaaacaaaataaaaaaccagaagtagaaaatagcattgtaaaaactatgttgtaaaaggacatttcaatttaacaatattaatatttgcttattttcagttaatctacttcagcatgcaatctcatacttcatcaagcgcacttggtattgtcactgtttatacatgaagcaatacatgctgaaagtataagtgagttgctaaggaaaacaggtagtaagctaagctaggatagaattcaggccgctgttttatgaataccaaatcagtttttttttaaatttgtttagggataatttacaaacaattaaatgtacttatggtgagtatacagtttt

SEQ ID NO: 158681 - DNA, 601 bp, Human
caagaactgtaattctatatttgtcttacttctccttgaagtaatatcagacattacttcatgtattttgagtctttgttaattaggtgtaaaacattaagctttgacatgctctcttgatgagctgacctctttttcactatgaaatgaccctctaattctattgatgttatttgtcctgaaaatctactttatgcatgttcttatactcctctagttttcttttgattggaatccacgtggaatattttttcatccttttgcttttaattatttttctctttatgtaaattagatttcktttaggaagtgtatagttgggtgttgtttttttaatccagtctatcaatctgtgtttttccattgggatgtttaggccatttatgttttatgtaattattgacaattacataaaaaaatggtggtttaaaaatctactatctctgtttgttccatctttattttatttacttgttcctctctgttttattttgggttaagtattttttattattcttttatctttttagttatcttgttatctataactcatctttatgctatttttatgtttgctttagggtttatagcatacatcttt

SEQ ID NO: 158682 - DNA, 601 bp, Human
gatgagctgacctctttttcactatgaaatgaccctctaattctattgatgttatttgtcctgaaaatctactttatgcatgttcttatactcctctagttttcttttgattggaatccacgtggaatattttttcatccttttgcttttaattatttttctctttatgtaaattagatttcttttaggaagtgtatagttgggtgttgtttttttaatccagtctatcaatctgtgtttttccattgggatgtttaggccatttatgttttatgtaattattgacaattacataaaaaaatggtggtttaaaaatctactatctctgtttgttccatctttattttatttacttgttcctctctgttttattttgggttaagtattttttattattcttttatctttttagttatcttgttatctataactcatctttatgctatttttatgtttgctttagggtttatagcatacatctttaccttatcacagtctacattgaagtgatatactacttcacagatattatggcaccatactttcatttctgcttttatgagcttatgctattgtggtcatacattttacttctacatat

SEQ ID NO: 158683 - DNA, 601 bp, Human
tgttgggctttagacatttctgggacttgcaactcccttcttttttcctgtttctctttttggaatagaaatacctgtcttacgcctgcattgtgttttagagcgacaaaacttacctgtttgattttacagggaaatttgcttaaggattaattgttccttgagtctcacccatatctgatttagatgagactctggactttagacttttgtgttgctgctgaaatgagttaagacttttggggctactgggatggaatggatgtattttgtgtgttataaggacatgaatttggggggytaggggtggaatactatggtctgaatatgtctcccaaaatttgtgtgtggaaaacttaacccctgatatggtttggctatttccccacccaaatctcatcttgaattgtagctcccataattttcacatcttgtgggagggacctggtagatgataattgaattatgggggcagtttcccacatactgttttgtggtagtaagtctcacgagatctgatgcttttataaggtgatacccttttcacttggttctcattctctcttgcctgccgccatgtaagatgtgcctttcaccttct

SEQ ID NO: 158684 - DNA, 601 bp, Human
aatgcgggcccttttttggttccatatgaactttaaagtagtttttttcaattctgtgaagaaagtcattgctagcttggtggggatggcattgaatctataaattaccttgggcagtatggccattttcacaatattgattcttcctatccatgagcatggaatgttcttccatttgtttgtgtcctcttttatttcattgagcgtggtttgtagttctccttgaagaggtccttcgcatcccttgtaagttgtattcctaggtattttattctctttgtagcaattgtgaatgggagtwcactcatgatttagctctctgttattggagtataggaatgcttgtgatttttgtacattgattttgtatcctgagactttgctgaagttgcttatcagcttaaggagattttggcctgagatgatggggttttctaaatatacaatcatgtcatctgcaaacagggacaatttggcttcctcttttcctaattgaataccctttatttccttctcctgcctaattgccctggccagaacatccaacactgtgttgaataggggtggtaagagagggcatccctgtcttgtgccagttttc

SEQ ID NO: 158685 - DNA, 601 bp, Human
cactccggactctgtttgcctgggtatgaccatcggaggctgcagaatagcaaatattgcagaatggcaaatgctgctgcctgatgcttcttctggaagctttgtctcagaggggcacctggccatctgaggtgtcagtcggcccctactgggaggtgcctcccagttaggctactcgggcgtcagggacccacttgaggaggcagtctgtccattctcagatctccaagtctgtgctgggagaaccactactctcttcacagctgtcagacaggaacgtttaattgtgcagaagtttctkctgccttttgtttagctaggccctgcccccaaaggtggattctacagagccaggcaggcctccttgagctgcgttgggctccacccagttcgagctttctggccgctttgtttacctactcaagcctcagcaatggtggacgcccctaccctagccttgctgcccccttgcagtttgatctcagattgctgttctagcagtgagcgaggctccatgggcatgggactctccaagccaggcgtgggatataatctcccagtgtgctgtttgctaagaccattggaaaagcgcagtactagg

SEQ ID NO: 158686 - DNA, 601 bp, Human
actccggactctgtttgcctgggtatgaccatcggaggctgcagaatagcaaatattgcagaatggcaaatgctgctgcctgatgcttcttctggaagctttgtctcagaggggcacctggccatctgaggtgtcagtcggcccctactgggaggtgcctcccagttaggctactcgggcgtcagggacccacttgaggaggcagtctgtccattctcagatctccaagtctgtgctgggagaaccactactctcttcacagctgtcagacaggaacgtttaattgtgcagaagtttctgytgccttttgtttagctaggccctgcccccaaaggtggattctacagagccaggcaggcctccttgagctgcgttgggctccacccagttcgagctttctggccgctttgtttacctactcaagcctcagcaatggtggacgcccctaccctagccttgctgcccccttgcagtttgatctcagattgctgttctagcagtgagcgaggctccatgggcatgggactctccaagccaggcgtgggatataatctcccagtgtgctgtttgctaagaccattggaaaagcgcagtactaggg

SEQ ID NO: 158687 - DNA, 601 bp, Human
ctgggtatgaccatcggaggctgcagaatagcaaatattgcagaatggcaaatgctgctgcctgatgcttcttctggaagctttgtctcagaggggcacctggccatctgaggtgtcagtcggcccctactgggaggtgcctcccagttaggctactcgggcgtcagggacccacttgaggaggcagtctgtccattctcagatctccaagtctgtgctgggagaaccactactctcttcacagctgtcagacaggaacgtttaattgtgcagaagtttctgctgccttttgtttagctakgccctgcccccaaaggtggattctacagagccaggcaggcctccttgagctgcgttgggctccacccagttcgagctttctggccgctttgtttacctactcaagcctcagcaatggtggacgcccctaccctagccttgctgcccccttgcagtttgatctcagattgctgttctagcagtgagcgaggctccatgggcatgggactctccaagccaggcgtgggatataatctcccagtgtgctgtttgctaagaccattggaaaagcgcagtactagggtgggagtgtcctgatttt

SEQ ID NO: 158688 - DNA, 601 bp, Human
tttttcatctcaggcatggtgatttttatctttctaagtcttttaaaatatatttcaagttttgtttacattcttgaacatagggaataaaattgtaataacctttaatgaccttgtgtatgaatatttcttaatctttgttatttttggttttgatagatttttctgctccatatgtgttctgtttttctttttctttgcatgcctgtttatctttgattgtatgctaaacattgtgaatctttttatttggtacagtatatttgtatattcctatacacttttgctttgttctgggacrtaggtaagttatttagaaacagttatactttttgctcatgcttttaagctttgttaaacaggaacaaacatttattttaggtttaattttaccccgctattgaggcaaaatacttctgagtccttttacctgatccctattgtttttatacaagagggtatagtgaataattttgtgattatatgtggtattttagctttgtgtgtcaaatacatcatcttgtctttagcaagctagatcaccaattctgacgacccacctattaatagatttgtgcttattttgctcatgcagaaactt

SEQ ID NO: 158689 - DNA, 601 bp, Human
attgagtttatacatttttgacaagaataccatagaaatgatgttgtacctttctcagtgtaacatattagaggatacttgatattcttaagcattactgtgggtgatattaactttgaatacttgcttgaggttttgtttgctaggttttgctaatttctccttttgtaattaataagtatcttgtgaagagatattttaagagaatacaagtatcttttgtttcattatacttttaccaactaattttagcagagttagcaaatacagtcacatgttgtttaacagtggggatatgttytgagaaatcttcgttaggtgatttctttgatgatgtgcaaacatcatagagtatacttaatacaaacctagatgacatatcacacctaggatatatagtatgtatagcctgttgctccaaggctacaaacccatacagcatgttgctgtgctgagtactgtaggcagttgtaatacagtggtaaatctttgtgtatctacacacacctaaacacagaataggtacagtaaaaataaggtattataatcttatgggactacgcttttccttgttgactgaaatattgttatgtggtgcatg

SEQ ID NO: 158690 - DNA, 601 bp, Human
acctttctcagtgtaacatattagaggatacttgatattcttaagcattactgtgggtgatattaactttgaatacttgcttgaggttttgtttgctaggttttgctaatttctccttttgtaattaataagtatcttgtgaagagatattttaagagaatacaagtatcttttgtttcattatacttttaccaactaattttagcagagttagcaaatacagtcacatgttgtttaacagtggggatatgttctgagaaatcttcgttaggtgatttctttgatgatgtgcaaacatcayagagtatacttaatacaaacctagatgacatatcacacctaggatatatagtatgtatagcctgttgctccaaggctacaaacccatacagcatgttgctgtgctgagtactgtaggcagttgtaatacagtggtaaatctttgtgtatctacacacacctaaacacagaataggtacagtaaaaataaggtattataatcttatgggactacgcttttccttgttgactgaaatattgttatgtggtgcatgattttatggttggttgtatactcatacatatacattcacacatctgc

SEQ ID NO: 158691 - DNA, 601 bp, Human
ttttgtttgctaggttttgctaatttctccttttgtaattaataagtatcttgtgaagagatattttaagagaatacaagtatcttttgtttcattatacttttaccaactaattttagcagagttagcaaatacagtcacatgttgtttaacagtggggatatgttctgagaaatcttcgttaggtgatttctttgatgatgtgcaaacatcatagagtatacttaatacaaacctagatgacatatcacacctaggatatatagtatgtatagcctgttgctccaaggctacaaacccrtacagcatgttgctgtgctgagtactgtaggcagttgtaatacagtggtaaatctttgtgtatctacacacacctaaacacagaataggtacagtaaaaataaggtattataatcttatgggactacgcttttccttgttgactgaaatattgttatgtggtgcatgattttatggttggttgtatactcatacatatacattcacacatctgcatttgtccatctgtatttatgttaaaagccattagttcaatgtagagtttactctagcctttccttctttcttatttgtaactttc

SEQ ID NO: 158692 - DNA, 601 bp, Human
agtccaaaagcctcaagagcagggaagctgatagtctgtggccaaaggccagagatcccccgcaaaccaccgatgtaagtctaagagctcaagggccgaagaacctggagtctgatgtccaagggcaggaagcatccagcacaggagaaagatgaaagccagaagactcagcaagcagcttatcccacctttctcgcctgctttgttctagccgcactggcagcccattgagggtaggtcttcctctgccagtccactgactcagatgtcagtctctggcaacacccttaaagacacaccragatacaatattttgccagctatctaggcattcttcaatcaagttgacacgtaatattaatcatcacagcatgtaaaacagtttaagaattgctaatgaatatccctgtgaaaaacaaatttttaaaatatagtacagtatttgatatagtcctttttgtctttatgcatatatttaaaatttcttaatttagttttattctttcccacccctttctgtttctcaatttcattttggattcatctcaattctagctggtattgattaattatttacttttgggtatgtgaacaattacaa

SEQ ID NO: 158693 - DNA, 601 bp, Human
gtcctttttgtctttatgcatatatttaaaatttcttaatttagttttattctttcccacccctttctgtttctcaatttcattttggattcatctcaattctagctggtattgattaattatttacttttgggtatgtgaacaattacaaaaaatcagaactacctaaaaaggtatattcagagatgtgccactgcactcttaccctactacactcttctcatttccagacattttacattacatttccatccaacccttttatgtagccaagctcattagtttctggtttatgtgtccygtatttcttttgtacaaatgagtatgcacattttcttatattctttcttaaatgaagggtagtacgctataaacacaattcttttgcattttgcttttttacatagcaatgtattctggaaatcactccatatcagctcataaggaacttctccttttttgtgtgtacaagtacataatatgccatttagggatatgtcaactttcaacaaccctccaatgtatgggtatttgagttgtttccagtatttcattatgtaaacaacactgcaatgaataacctatgtatttttgtattgtt

SEQ ID NO: 158694 - DNA, 601 bp, Human
aatttcttaatttagttttattctttcccacccctttctgtttctcaatttcattttggattcatctcaattctagctggtattgattaattatttacttttgggtatgtgaacaattacaaaaaatcagaactacctaaaaaggtatattcagagatgtgccactgcactcttaccctactacactcttctcatttccagacattttacattacatttccatccaacccttttatgtagccaagctcattagtttctggtttatgtgtcccgtatttcttttgtacaaatgagtatgcayattttcttatattctttcttaaatgaagggtagtacgctataaacacaattcttttgcattttgcttttttacatagcaatgtattctggaaatcactccatatcagctcataaggaacttctccttttttgtgtgtacaagtacataatatgccatttagggatatgtcaactttcaacaaccctccaatgtatgggtatttgagttgtttccagtatttcattatgtaaacaacactgcaatgaataacctatgtatttttgtattgttgaaggtttatcttttcaggtgaattccta

SEQ ID NO: 158695 - DNA, 601 bp, Human
attatttacttttgggtatgtgaacaattacaaaaaatcagaactacctaaaaaggtatattcagagatgtgccactgcactcttaccctactacactcttctcatttccagacattttacattacatttccatccaacccttttatgtagccaagctcattagtttctggtttatgtgtcccgtatttcttttgtacaaatgagtatgcacattttcttatattctttcttaaatgaagggtagtacgctataaacacaattcttttgcattttgcttttttacatagcaatgtattctkgaaatcactccatatcagctcataaggaacttctccttttttgtgtgtacaagtacataatatgccatttagggatatgtcaactttcaacaaccctccaatgtatgggtatttgagttgtttccagtatttcattatgtaaacaacactgcaatgaataacctatgtatttttgtattgttgaaggtttatcttttcaggtgaattcctacatgtgtgattggtagatcaaaaagtaagtatgcatgttgttttcttagatgttgccaaatttctctccagaaaaggtggaccagtttg

SEQ ID NO: 158696 - DNA, 601 bp, Human
tctggtttatgtgtcccgtatttcttttgtacaaatgagtatgcacattttcttatattctttcttaaatgaagggtagtacgctataaacacaattcttttgcattttgcttttttacatagcaatgtattctggaaatcactccatatcagctcataaggaacttctccttttttgtgtgtacaagtacataatatgccatttagggatatgtcaactttcaacaaccctccaatgtatgggtatttgagttgtttccagtatttcattatgtaaacaacactgcaatgaataacctaygtatttttgtattgttgaaggtttatcttttcaggtgaattcctacatgtgtgattggtagatcaaaaagtaagtatgcatgttgttttcttagatgttgccaaatttctctccagaaaaggtggaccagtttgaattaccactagtaacatatgaaattgcctgattcctcacaccctcaccaacagaaccccattgtttttactttttaattttcttttctctgataggtgagaaattatatctcagtgttgttttagtttgcatttttccaattgcgagtgaatttgaacacatttt

SEQ ID NO: 158697 - DNA, 601 bp, Human
attttcttatattctttcttaaatgaagggtagtacgctataaacacaattcttttgcattttgcttttttacatagcaatgtattctggaaatcactccatatcagctcataaggaacttctccttttttgtgtgtacaagtacataatatgccatttagggatatgtcaactttcaacaaccctccaatgtatgggtatttgagttgtttccagtatttcattatgtaaacaacactgcaatgaataacctatgtatttttgtattgttgaaggtttatcttttcaggtgaattcctasatgtgtgattggtagatcaaaaagtaagtatgcatgttgttttcttagatgttgccaaatttctctccagaaaaggtggaccagtttgaattaccactagtaacatatgaaattgcctgattcctcacaccctcaccaacagaaccccattgtttttactttttaattttcttttctctgataggtgagaaattatatctcagtgttgttttagtttgcatttttccaattgcgagtgaatttgaacacattttcatgtctctaaaggtcatttctgtgtctttttttgtgtattgtttg

SEQ ID NO: 158698 - DNA, 601 bp, Human
tatgtaaacaacactgcaatgaataacctatgtatttttgtattgttgaaggtttatcttttcaggtgaattcctacatgtgtgattggtagatcaaaaagtaagtatgcatgttgttttcttagatgttgccaaatttctctccagaaaaggtggaccagtttgaattaccactagtaacatatgaaattgcctgattcctcacaccctcaccaacagaaccccattgtttttactttttaattttcttttctctgataggtgagaaattatatctcagtgttgttttagtttgcatttytccaattgcgagtgaatttgaacacattttcatgtctctaaaggtcatttctgtgtctttttttgtgtattgtttgtttgtgtctttttcctcttttttttctatttgattttgatcctttgtccttcaaatttgaagatgttgaaaatgtattagggacattaacactttatttgagtactacttattttgaagtgttccaatataatgtattcattgtgcttctttggtgttggacttcccaaaatattaatctggaacaggtaggtcaggtctcagatattctgaatcttgtacaaa

SEQ ID NO: 158699 - DNA, 601 bp, Human
tgaattcctacatgtgtgattggtagatcaaaaagtaagtatgcatgttgttttcttagatgttgccaaatttctctccagaaaaggtggaccagtttgaattaccactagtaacatatgaaattgcctgattcctcacaccctcaccaacagaaccccattgtttttactttttaattttcttttctctgataggtgagaaattatatctcagtgttgttttagtttgcatttttccaattgcgagtgaatttgaacacattttcatgtctctaaaggtcatttctgtgtctttttttgygtattgtttgtttgtgtctttttcctcttttttttctatttgattttgatcctttgtccttcaaatttgaagatgttgaaaatgtattagggacattaacactttatttgagtactacttattttgaagtgttccaatataatgtattcattgtgcttctttggtgttggacttcccaaaatattaatctggaacaggtaggtcaggtctcagatattctgaatcttgtacaaaaaaaaaaaaatgctgtttcaatctgtttgtgacagaaatgaataaacttaggaaatgtgattagaa

SEQ ID NO: 158700 - DNA, 601 bp, Human
gaattcctacatgtgtgattggtagatcaaaaagtaagtatgcatgttgttttcttagatgttgccaaatttctctccagaaaaggtggaccagtttgaattaccactagtaacatatgaaattgcctgattcctcacaccctcaccaacagaaccccattgtttttactttttaattttcttttctctgataggtgagaaattatatctcagtgttgttttagtttgcatttttccaattgcgagtgaatttgaacacattttcatgtctctaaaggtcatttctgtgtctttttttgtrtattgtttgtttgtgtctttttcctcttttttttctatttgattttgatcctttgtccttcaaatttgaagatgttgaaaatgtattagggacattaacactttatttgagtactacttattttgaagtgttccaatataatgtattcattgtgcttctttggtgttggacttcccaaaatattaatctggaacaggtaggtcaggtctcagatattctgaatcttgtacaaaaaaaaaaaaatgctgtttcaatctgtttgtgacagaaatgaataaacttaggaaatgtgattagaaa

SEQ ID NO: 158701 - DNA, 601 bp, Human
tgattggtagatcaaaaagtaagtatgcatgttgttttcttagatgttgccaaatttctctccagaaaaggtggaccagtttgaattaccactagtaacatatgaaattgcctgattcctcacaccctcaccaacagaaccccattgtttttactttttaattttcttttctctgataggtgagaaattatatctcagtgttgttttagtttgcatttttccaattgcgagtgaatttgaacacattttcatgtctctaaaggtcatttctgtgtctttttttgtgtattgtttgtttgtrtctttttcctcttttttttctatttgattttgatcctttgtccttcaaatttgaagatgttgaaaatgtattagggacattaacactttatttgagtactacttattttgaagtgttccaatataatgtattcattgtgcttctttggtgttggacttcccaaaatattaatctggaacaggtaggtcaggtctcagatattctgaatcttgtacaaaaaaaaaaaaatgctgtttcaatctgtttgtgacagaaatgaataaacttaggaaatgtgattagaaaatagacctctgtgtg

SEQ ID NO: 158702 - DNA, 601 bp, Human
aatttgaacacattttcatgtctctaaaggtcatttctgtgtctttttttgtgtattgtttgtttgtgtctttttcctcttttttttctatttgattttgatcctttgtccttcaaatttgaagatgttgaaaatgtattagggacattaacactttatttgagtactacttattttgaagtgttccaatataatgtattcattgtgcttctttggtgttggacttcccaaaatattaatctggaacaggtaggtcaggtctcagatattctgaatcttgtacaaaaaaaaaaaaatgctstttcaatctgtttgtgacagaaatgaataaacttaggaaatgtgattagaaaatagacctctgtgtggccattgttattctctctatatcttttacacctactgtcttctggaaagttcttattgcatgtgtggaaatatcttacctatcagttttcagttaccttcttttattcaaaactgttgtctcctttcttggtattcctatagattttctatatttcattattacatttacattgaattgtgggctggcgttttagctgcctgaggttcagggccttgttgtcatatttccctc

SEQ ID NO: 158703 - DNA, 601 bp, Human
tggtctccatctcctgacctcatgatccgcctgcctcggcctcccacagtgctgggcttacaggcatgaaccaccacgctcggctcataaattatttttaatccttaattacagtgataatagctaattaaaaatccttgtctgctaatttaaacatctagataaacttatgtcagtttccattgactgtggcttttcttcagtgtgttatttctctacttgttgacaacttttagatttaatactgaacattgtgaatgatgtagagaggagattctcttagactcatctgaggagtatkggttttttgaggtaaggaggagtctgttttctgagtcagttaacttggctgtatttcaacttcaaactttgtttcctatgtggtaggtgttagctgaaatttcaggtcagttcttttaaccttagcactgttacttggagtctgtctcaaatatacttcatttagagtttagcaagagatttgaacagtttatccataggatttagagcttctctcctctgcttcttcctttctaaaattgtcttcctcacttttcaagtgctgtgatttctctgaaagcctgtcttcaggatcttcaat

SEQ ID NO: 158704 - DNA, 601 bp, Human
tgttgacaacttttagatttaatactgaacattgtgaatgatgtagagaggagattctcttagactcatctgaggagtattggttttttgaggtaaggaggagtctgttttctgagtcagttaacttggctgtatttcaacttcaaactttgtttcctatgtggtaggtgttagctgaaatttcaggtcagttcttttaaccttagcactgttacttggagtctgtctcaaatatacttcatttagagtttagcaagagatttgaacagtttatccataggatttagagcttctctcctcygcttcttcctttctaaaattgtcttcctcacttttcaagtgctgtgatttctctgaaagcctgtcttcaggatcttcaatttaatagaactggtttctgctaaattttagctgctctgcatggctgatatttgagccctcactcaggttatgggaatcttattcagtgttattcttttttttccccagaatcaatctgctttcattcactttcctgtgcagtcaggtcttttttttttttttcctaatattttgtgctgagtttataattgttatctatgatagggttgttcctatggga

SEQ ID NO: 158705 - DNA, 601 bp, Human
tttaatttagtccactgtgaaatgttactgtaagaaaacaaagtatcaaagatatttgctggaagagagaatattaagcaaagcagttaatcatactgaatctgaagtcagatggtcctgacttttaattctggccacaaattacactcgttctgtggcctttgacaaatacttgctctgtgatctttaacaacttctcaagcttatctgaaccttagtatcatcgtgttttaaaaatgtgggtagaatccatggggtgtggtgatggacacctgtagtcctagctatttgggaagctgargtgggagggtctcttgaacccaggagttcaagtccagcctgggcaacatagcgaggctttgtctctaagaaacaaacaaaaactccatacacacaggaaagaatcaacccgggtatccatcagtagatgaatggagaaggaaaatgtgatagatctacaaaatagtatactattcagccttaaaacacaaggaaatactgtcacttgtggtaacatggataaacctggaggatattatgttaagtgaaataagccaggcactgaaagacaaatactatatgatttcacttatatgtggaa

SEQ ID NO: 158706 - DNA, 601 bp, Human
cttcatgtgtaataccagcactcttcataaaatattttttgtattgtctgtgttttgccattacaatgagatttttgagaatataagaaatgcacttgttactctgatatcattttattggatatccttgaattgcacacattcgtagcagtgtctcataatgaagtcagtgtattccttttttgggggaagcttcttaatgttaaaagcttcctaagcattatttgctagatcacagtttgaatggcagtgtaactgtgtagtctgatgatatattgtttgcataacagaggtcacatggagttctgagtatttcccagataacttaactaactgctcaattaagaaaaaaagcttgctgaaagatgaagtgatgctttcaatggtcacagagaatacaggtgcaatgaagatctctctaggtgttaactaatgactgagggtacaacataaatatacacacatgttcttatgttgatggaatatgaataatgagattattggacttgtgtgctgtgtgatttattccaaaaatgtatcctagcctttttgaaatttattctatgttctgtcatgacagccataaatcagcatgaggaat

SEQ ID NO: 158707 - DNA, 601 bp, Human
caagtgttggcataactagttattattttttaaacctacatattacaaaacataccaactaatgactaatgtgatagaaatgcaaaattgaagtaatagttctcagcaactaaagtattgaattaaatgttactaagcaataaaagattaacaaatgttaattccattgttgttaatgatagtttaatattgatgtctgattagtcaaattaaaaagatatagccaaacttttttaaattagtgtttaaggttttttaggcaactaaggttttcttcctaaattgaaacttcatgcctaasaatatttaatgatatatgtaggtataattgaaatagaacttcaggcctggcacggtggctcacgcctgtaatcccagcactttgggaggccgaggcgggtggatcacgaggtcagggattcgagactcagcctgaccaacatggtgaaaccctgtctcgactaaaaatacaaaaattagctgggcttggtggcgggtgcctgtaatcccagctactcaggaggctgaggcaggagaattgcttgaacccgggaggcagaggttgcagtgagccaagattgtgccactgcactccagcctg

SEQ ID NO: 158708 - DNA, 601 bp, Human
caaaggagatgttcattagagcatttcagatttcatttttggattcctgatgctaaactggtataatgcaaatattcccaaatctgaaagaatctgtatctgaagcacttctggtcccaagcatttcagataagggatatgcaatttgtataagaggcatggaatatcttaaggaactcaagaaccaaaatgtagacaattattaactatttgttctttccctgagtctttctggtttttctttcttattccatttggctttctttgtctttagttatattatggcccaggcatcaagagmaatagtctttcttttattgaacttgagcatttcaaaattccaagagaaggatttttttttctctcgtgttttgatttgatatctacccttgacaaacctattggacaaattgaaaagtaaccacgaggtgcctttcagtcacctacaggatatggttcagcttcacacaaccttcaagtctccattatctggcctgcgccttcatcccactgtcatctcttatcattcgcagtcttattcttttatatccaactacactggtatggcttttagtttctctgcagaaatcacactattttt

SEQ ID NO: 158709 - DNA, 601 bp, Human
tttgttctttccctgagtctttctggtttttctttcttattccatttggctttctttgtctttagttatattatggcccaggcatcaagagcaatagtctttcttttattgaacttgagcatttcaaaattccaagagaaggatttttttttctctcgtgttttgatttgatatctacccttgacaaacctattggacaaattgaaaagtaaccacgaggtgcctttcagtcacctacaggatatggttcagcttcacacaaccttcaagtctccattatctggcctgcgccttcatcccwctgtcatctcttatcattcgcagtcttattcttttatatccaactacactggtatggcttttagtttctctgcagaaatcacactatttttctattcagtgttcttgctgctgtttttaccttgtctggaaattctttactcctctacttattctttaatacaaaaattcttagtcctggggctggggcaggagaaagaggaaggatattgtttcaacaagcatatctaatattgtaataatcacatttggaaaattaagtttgtttcttggttttaaatttaaattactcaaagcaaag

SEQ ID NO: 158710 - DNA, 601 bp, Human
tctgcagaaatcacactatttttctattcagtgttcttgctgctgtttttaccttgtctggaaattctttactcctctacttattctttaatacaaaaattcttagtcctggggctggggcaggagaaagaggaaggatattgtttcaacaagcatatctaatattgtaataatcacatttggaaaattaagtttgtttcttggttttaaatttaaattactcaaagcaaagtttgttgtagtcttgcttactagaaatacactcatatcatgagtgtatatgattcttggtcagacttcyttggaggactactcatcagattctttgaggaggaactttgatgtatttctaaaggggaaaagttgtcactgttaggaagaatgttcttagttcttacatttgagcaaatcatatacaaaactactaattgctacatacataccagtcaactgcatatagtatttactagcgtaaaaggtatgtgcaggcattgattttatgtggtattacatgatgtgaaattggaaacagttgtataataggtataaaataaatgtatattgattgaatcttgaacgctgtcctcagtggacttaattc

SEQ ID NO: 158711 - DNA, 601 bp, Human
atattgtttcaacaagcatatctaatattgtaataatcacatttggaaaattaagtttgtttcttggttttaaatttaaattactcaaagcaaagtttgttgtagtcttgcttactagaaatacactcatatcatgagtgtatatgattcttggtcagacttccttggaggactactcatcagattctttgaggaggaactttgatgtatttctaaaggggaaaagttgtcactgttaggaagaatgttcttagttcttacatttgagcaaatcatatacaaaactactaattgctacatrcataccagtcaactgcatatagtatttactagcgtaaaaggtatgtgcaggcattgattttatgtggtattacatgatgtgaaattggaaacagttgtataataggtataaaataaatgtatattgattgaatcttgaacgctgtcctcagtggacttaattccagcacttgaagattcattgtagactagcctatactagtgtgacttattagttacttggatgatgtgtacacatttttccactgtattgaaaaatgcacctaaaatactgttaaaaattgtaagaacaattagaata

SEQ ID NO: 158712 - DNA, 601 bp, Human
agcaaaaatcctcacctctcatcccctttttaatttaaatctttacattcaaagagttttctttgctgtatttttgaaaatgctattttcctgtgctttggctaccaccctgtttgaatattgagactactctaaatttacttaaagagttatgaatatgtgtttggtaactgtagtttgtttcgtagttaaggaaatgttgcttgtggttacaattcgtgtgcagttattttagttaattttgggaaccataagtgaaataaaattgtgactgtttgcctaagtatttttttttttttttgcttttttgttggtaccctgtttaaattctagaaggagaaatatgttatttagagagagagctgtaaaggaagttttgggaaaacatatcaagatatggatataatgagttttgaagcctataatgagggggagagagaaagtcaaataaaataaaattttcctgattgacaaagaaaaaaggacattttattgtgataatcgtatttcattcattttttaatatcagagattctggttatttagtcagtatgtctcaaattttttttcactgagctatcccttcttggccgaagagtac

SEQ ID NO: 158713 - DNA, 601 bp, Human
agttttctttgctgtatttttgaaaatgctattttcctgtgctttggctaccaccctgtttgaatattgagactactctaaatttacttaaagagttatgaatatgtgtttggtaactgtagtttgtttcgtagttaaggaaatgttgcttgtggttacaattcgtgtgcagttattttagttaattttgggaaccataagtgaaataaaattgtgactgtttgcctaagtatttttttttttttttgcttttttgttggtaccctgtttaaattctagaaggagaaatatgttatttagrgagagagctgtaaaggaagttttgggaaaacatatcaagatatggatataatgagttttgaagcctataatgagggggagagagaaagtcaaataaaataaaattttcctgattgacaaagaaaaaaggacattttattgtgataatcgtatttcattcattttttaatatcagagattctggttatttagtcagtatgtctcaaattttttttcactgagctatcccttcttggccgaagagtacaaactgggtgtatggcctattagccagcataaatggagaatatctttgaagtgg

SEQ ID NO: 158714 - DNA, 601 bp, Human
aaattttcctgattgacaaagaaaaaaggacattttattgtgataatcgtatttcattcattttttaatatcagagattctggttatttagtcagtatgtctcaaattttttttcactgagctatcccttcttggccgaagagtacaaactgggtgtatggcctattagccagcataaatggagaatatctttgaagtggcttatattgccttaaatagttcacttgagactttctgttaatatggcagaaagcataaatttgcaaagccaagaatagtagagagggtctaataaatatcyatacatttttggaagatgcagatgcataatttgtaactaactaagtggtatggagaaagggtataggtgcttttaggagaggttgctagagaggcaaatggattcctaagcagaaacccccatgaattgggagtaccagttacctctaaatgtggacgtataaaacagtgctgaaaccatgaggatttgtttaaggcttgtaagggacacttagaccacccaggcagctgtacacctagttctccctcctttcatttttagaaaaaaaaatcaggattcacaatactaaacactggtaaa

SEQ ID NO: 158715 - DNA, 601 bp, Human
aaaaaggacattttattgtgataatcgtatttcattcattttttaatatcagagattctggttatttagtcagtatgtctcaaattttttttcactgagctatcccttcttggccgaagagtacaaactgggtgtatggcctattagccagcataaatggagaatatctttgaagtggcttatattgccttaaatagttcacttgagactttctgttaatatggcagaaagcataaatttgcaaagccaagaatagtagagagggtctaataaatatccatacatttttggaagatgcagrtgcataatttgtaactaactaagtggtatggagaaagggtataggtgcttttaggagaggttgctagagaggcaaatggattcctaagcagaaacccccatgaattgggagtaccagttacctctaaatgtggacgtataaaacagtgctgaaaccatgaggatttgtttaaggcttgtaagggacacttagaccacccaggcagctgtacacctagttctccctcctttcatttttagaaaaaaaaatcaggattcacaatactaaacactggtaaaggaagattgagggatggactgt

SEQ ID NO: 158716 - DNA, 601 bp, Human
tttctgttaatatggcagaaagcataaatttgcaaagccaagaatagtagagagggtctaataaatatccatacatttttggaagatgcagatgcataatttgtaactaactaagtggtatggagaaagggtataggtgcttttaggagaggttgctagagaggcaaatggattcctaagcagaaacccccatgaattgggagtaccagttacctctaaatgtggacgtataaaacagtgctgaaaccatgaggatttgtttaaggcttgtaagggacacttagaccacccaggcagctgyacacctagttctccctcctttcatttttagaaaaaaaaatcaggattcacaatactaaacactggtaaaggaagattgagggatggactgtacaaagaacgtgaggattaaatgaaagtctgcataattaaaaaagggaactggctcccttcctttgcttagttgcaagtcttctagcagcctatcttataactcccaagtaaagagtaagctgatccagaggaaagaccatcagatattgacagtcagggaggtcattcagtggaaggtctctgtgtgatcacactatcctctatcctt

SEQ ID NO: 158717 - DNA, 601 bp, Human
aaggcttgtaagggacacttagaccacccaggcagctgtacacctagttctccctcctttcatttttagaaaaaaaaatcaggattcacaatactaaacactggtaaaggaagattgagggatggactgtacaaagaacgtgaggattaaatgaaagtctgcataattaaaaaagggaactggctcccttcctttgcttagttgcaagtcttctagcagcctatcttataactcccaagtaaagagtaagctgatccagaggaaagaccatcagatattgacagtcagggaggtcattcartggaaggtctctgtgtgatcacactatcctctatccttcccactctatcctgaagcttccctactctgttctgcctattgtcggatgcctgaaaagttacttcatgtgtttgtttccagagtaactgttactctgtaaatagagtttataatcagttttttagttcctcagtcttaattgtgaatggataggcaaggcttgccaggcatttggggaaatcctgtaataaaaacgcagtgatcaaataaaataaaaaaaacatgaaacaggtttgagaaaaagagaccttgagagaacaga

SEQ ID NO: 158718 - DNA, 601 bp, Human
ggtcccaaataagggttactttcttttaaattgacccatagttgtacaaactgattgattactgtcgattgatatgtctttattcatcagcattgggaaatttaggaattgagcttcattaatgaaaccattttattggacacatagctgtaaattgcatgtctgttgacagagcactgtaaacaaaataaagcattaaaatttagataaattcagggagaagaccacatgtaagcatttaaatcataacagattcctggtatttatggctttaatatccaaatgatgagcaactcctacragtctatgacagggaattgtctggaattgtatatagctatgaattttaattttgcaccactgattcttaagtgggcgggttgtctattcatccacatataatatgaggctttgttttgtacttgtcattacaataaactttgaagtgtttaacacattgtgtctttgtggagaaatggtcatcaagtaagacaattttagggaatactgaaaatgctcttagcttgagatgtagcaaattgtatcagaaacatgtcccttgagagcagtgtggctttgaaaatgctaggagttgggagaa

SEQ ID NO: 158719 - DNA, 601 bp, Human
ttagacattactaaaatcaaaaacaacaaatttaaacatttacagtttgggacctaatttaagcatgtatcacagtttattaaagttatcttctgttagaaatagctcccttagttctggagatctgttgtgcagcatggtgactataataatagtgtattgtgtacatgacatttcctaagagagatcttaaatgttctcactacacacaaatgagaatgtgaggtaattgatatgttagtagcttgattgtggtaattatttcacaatgtgtatatgtatctcaaacatgttgtacaasttaaatgtatacaatttttatttcccaattataccttaataaatctagaagaaaataaaaatggtaagttaaccaaatttttttctctcagtctctcatattttctcccagattaagtaagggtacatctgtgaatcacactgatttcattttgttaaaaagcttaagaaattaagagtaagctataagtagttgtagctgacaatataagaactgttagaaatatgaacttgctttatgaatgctatatttattctgattgtgttgcattaaacatgtttattttattttaaataaaat

SEQ ID NO: 158720 - DNA, 601 bp, Human
aattactgaggagaatgataagtgatcttcaggccatttatttatttatttttaacttttattttaagttcagtgttacatgtgcagctttgttacataggtaaacttgtgttatggggttttgttgtacagattatttcaccacccatgtattaagcctagtacccatttttatttttcctgatcctctccctctcccaccgtctaccttccatcctccaacaggccccagtgtgtgttgttcccccaccacgtgtccatgtgttcttatcatttagcttccacttataagtgagaatgyacagtatttggttttctgtttctgtattagtttgccaaggattatggcctctgcttccatccatgtcctgcaaaggacatgatctcattcttgtggctgcgtagtatttcatggtgtgtatgtaccacatttttctttttcttttcttttttctttcttttttttttttttttgagatggagtcttactctgtttcccaggctggagtgcagtgacgcaatcttggctcactgcaacctccaccccctgggtccaaacaattctcctgccccagcctcccaagcagctgggattacaggc

SEQ ID NO: 158721 - DNA, 601 bp, Human
tgtgtgttgttcccccaccacgtgtccatgtgttcttatcatttagcttccacttataagtgagaatgcacagtatttggttttctgtttctgtattagtttgccaaggattatggcctctgcttccatccatgtcctgcaaaggacatgatctcattcttgtggctgcgtagtatttcatggtgtgtatgtaccacatttttctttttcttttcttttttctttcttttttttttttttttgagatggagtcttactctgtttcccaggctggagtgcagtgacgcaatcttggctcacygcaacctccaccccctgggtccaaacaattctcctgccccagcctcccaagcagctgggattacaggcatgtgctaccacgcctggctaattttttgtatttttagtagagatggggtttcgccatgttggccaggctggtcttgaactcctgacctcaagtgatccacccaccttggcctcccaaagtgctgggattacaggtgtgagccaccacacccggccacatttttcttatccattatatcattgatgggcatttatgttgattccatgtctttgctattgtttcagttgtgaa

SEQ ID NO: 158722 - DNA, 601 bp, Human
ccacttataagtgagaatgcacagtatttggttttctgtttctgtattagtttgccaaggattatggcctctgcttccatccatgtcctgcaaaggacatgatctcattcttgtggctgcgtagtatttcatggtgtgtatgtaccacatttttctttttcttttcttttttctttcttttttttttttttttgagatggagtcttactctgtttcccaggctggagtgcagtgacgcaatcttggctcactgcaacctccaccccctgggtccaaacaattctcctgccccagcctcccragcagctgggattacaggcatgtgctaccacgcctggctaattttttgtatttttagtagagatggggtttcgccatgttggccaggctggtcttgaactcctgacctcaagtgatccacccaccttggcctcccaaagtgctgggattacaggtgtgagccaccacacccggccacatttttcttatccattatatcattgatgggcatttatgttgattccatgtctttgctattgtttcagttgtgaatagtgctgcaatgaacatacatgtgcatttgtctttataatagaaagat

SEQ ID NO: 158723 - DNA, 601 bp, Human
attatggcctctgcttccatccatgtcctgcaaaggacatgatctcattcttgtggctgcgtagtatttcatggtgtgtatgtaccacatttttctttttcttttcttttttctttcttttttttttttttttgagatggagtcttactctgtttcccaggctggagtgcagtgacgcaatcttggctcactgcaacctccaccccctgggtccaaacaattctcctgccccagcctcccaagcagctgggattacaggcatgtgctaccacgcctggctaattttttgtatttttagtasagatggggtttcgccatgttggccaggctggtcttgaactcctgacctcaagtgatccacccaccttggcctcccaaagtgctgggattacaggtgtgagccaccacacccggccacatttttcttatccattatatcattgatgggcatttatgttgattccatgtctttgctattgtttcagttgtgaatagtgctgcaatgaacatacatgtgcatttgtctttataatagaaagattcatattcctttgggtatatacctagtaatggaattcctgggtcaaatggtatttctgtt

SEQ ID NO: 158724 - DNA, 601 bp, Human
atttacatgttaatcttttgccatatgtgattttttagttttagtagaaacttagccattttttctatagaatagagaaacttgaagatatacttggttatagcagttatgattgctagaataccttatgaaggcatttgattcaggaatgacatggcatttttcatgtttgttaactaccaataacatacttagtaacattgtgtcttgtgagcttgctacaactgtatgctttcttctgtagtctgttcaaaggtgcttactctaaaaaaacctagttgtaactgtccaactcctttastatgtaatttaaaattttatataacaccagtagttatttctctttgtactgaatcattttgtgccttatatgacatttggataaaactgagtgaaaccaaatttgctgttaaaaaggaaaaaaaaatcagcttgactcatttgtgacagttctaccaaccccatcaactgggttctctgctcaggatctcacaaggctgaaatcaaagtatcagttgggctgcattttcatgtggggctccggttctcttccaagctcacataattgttggcagcattcagttccttgctgcctcttagc

SEQ ID NO: 158725 - DNA, 601 bp, Human
gaaaaacaattcgctgaagtggaactggagtaatgcacaacagttgatttcttttggacttaactgaaactatgtttctggttttaaaatttgctaacaccaaggcactgttctatgtaacatgacttatttacatagttaccacacaacagttggtatttcatacagtaacataatttcattgcaaacagtaattttagtactgcaatagttcaacagttttgtctggctacatatgtagttagagcttttaaaagttaaaaattcatggtgtggtattataatcatagtttgtattaatttttatgaaaatcaatatattagcattgtaggccttatactactactctcttttcatttatataaagcagatagtctgattaatcgttctataatgtagactgccttgttcacatacatggtaggaactaaagaaagaatgttcaattgaatttcaagttttcttgtagcattctacagaagcttattgagtacacctcatatattccttatattagtttagtcttagattcagagtttgaaaactgaacttactactattaactccctcctgaaacttctgtattaactgacataatga

SEQ ID NO: 158726 - DNA, 601 bp, Human
agtggaactggagtaatgcacaacagttgatttcttttggacttaactgaaactatgtttctggttttaaaatttgctaacaccaaggcactgttctatgtaacatgacttatttacatagttaccacacaacagttggtatttcatacagtaacataatttcattgcaaacagtaattttagtactgcaatagttcaacagttttgtctggctacatatgtagttagagcttttaaaagttaaaaattcatggtgtggtattataatcatagtttgtattaatttttatgaaaatcaatwtattagcattgtaggccttatactactactctcttttcatttatataaagcagatagtctgattaatcgttctataatgtagactgccttgttcacatacatggtaggaactaaagaaagaatgttcaattgaatttcaagttttcttgtagcattctacagaagcttattgagtacacctcatatattccttatattagtttagtcttagattcagagtttgaaaactgaacttactactattaactccctcctgaaacttctgtattaactgacataatgaatgaaacatagtaagta

SEQ ID NO: 158727 - DNA, 601 bp, Human
atagtctgattaatcgttctataatgtagactgccttgttcacatacatggtaggaactaaagaaagaatgttcaattgaatttcaagttttcttgtagcattctacagaagcttattgagtacacctcatatattccttatattagtttagtcttagattcagagtttgaaaactgaacttactactattaactccctcctgaaacttctgtattaactgacataatgaatgaaacatagtaagtacttagtaaatgttatttagtagtaaatgttacctggtggtagtggtagtagaawacattatggtataatttttaaacttttcttgtatctcattccagttatagctccttatattcaatgctattgaaactaaaatgataaagacctttacatcccataataggaatatctggaaaaaatttttaaaaatatgtatttaaaaagtgacaacatgaatgaatgaataagagttattagtaaacttttgtaaataaactattagtaattcaagttattttgaccatagtaaatgctgctaattaaaattggagactggatgccgtggctcacacctgtaatcccagcactttggga

SEQ ID NO: 158728 - DNA, 601 bp, Human
tctgattaatcgttctataatgtagactgccttgttcacatacatggtaggaactaaagaaagaatgttcaattgaatttcaagttttcttgtagcattctacagaagcttattgagtacacctcatatattccttatattagtttagtcttagattcagagtttgaaaactgaacttactactattaactccctcctgaaacttctgtattaactgacataatgaatgaaacatagtaagtacttagtaaatgttatttagtagtaaatgttacctggtggtagtggtagtagaatacaytatggtataatttttaaacttttcttgtatctcattccagttatagctccttatattcaatgctattgaaactaaaatgataaagacctttacatcccataataggaatatctggaaaaaatttttaaaaatatgtatttaaaaagtgacaacatgaatgaatgaataagagttattagtaaacttttgtaaataaactattagtaattcaagttattttgaccatagtaaatgctgctaattaaaattggagactggatgccgtggctcacacctgtaatcccagcactttgggaggcc

SEQ ID NO: 158729 - DNA, 601 bp, Human
cctcatatattccttatattagtttagtcttagattcagagtttgaaaactgaacttactactattaactccctcctgaaacttctgtattaactgacataatgaatgaaacatagtaagtacttagtaaatgttatttagtagtaaatgttacctggtggtagtggtagtagaatacattatggtataatttttaaacttttcttgtatctcattccagttatagctccttatattcaatgctattgaaactaaaatgataaagacctttacatcccataataggaatatctggaaaaawtttttaaaaatatgtatttaaaaagtgacaacatgaatgaatgaataagagttattagtaaacttttgtaaataaactattagtaattcaagttattttgaccatagtaaatgctgctaattaaaattggagactggatgccgtggctcacacctgtaatcccagcactttgggaggccaaggtgggaggattacttgagggccaggagtttgattttttgtttttgtttttttttgagacattcttggtctgtcgcccacactgaagtgcagtggtgtcatctcggcttactgcaacct

SEQ ID NO: 158730 - DNA, 601 bp, Human
cagaatccagtgggattaagtagagctgtgaatacctggggtcaacgttgtaaacagtcgttagttttccagcatctgctttaacttcttggctctgtttgcagactgactttgtctgcttcattgttctcatggccaaaaaaatgtcttctatgccccagctctgtgagaacccaccagcacccagcacttaccctctaccagtttgcattattcacagagaactggataggctcaacccatcataaattgtttcttctacagtcagattagtctaatcctgctccactcagctctggcyaggggactcatgagatgacctctagggaggtcaacctggattataaggtgatgaattttctgagaaaaagatttagaaaggcaggccataattatctttaattaatagaatatagataagagtctaagtgtcaggaatctgaaagagttcatacttgatctggaatttttttactgaattagaaggcaaggtcatctgctaaatatagaaaaagtgtaagaatagtggtgaaggtttggaaaatctggtgcaagggaatagttaaagggccttaccagggaaaaaccaataagattgctc

SEQ ID NO: 158731 - DNA, 601 bp, Human
ttctacaaaccttataatgaaaaattggcagtcctgtacctgtccctccctgtccctgattgtactttaaactttctttttttttttttgcgaattctatttatcgcgaaggttctaaataactcccttgttccatttcctttttttttcaattttagatattatctattatctttttattatggaagatgagtaattttcttaatttattaccacctctaacaaaccttctcaatcttcccttaatttccagtatagttatggcttaattttttatattttaattgtactaatattgagkattttattatgactctttaaatattatcaacattagaggtatatagtgaacatttcctttcttgaaaaacattctagagtttttaaaaagtaaatatcagttttttgtgtatcaatctctaaattatatccaaattctctgacagatgtattagtcttctctcggtatttagacatggtataaaatgcatcagttcttttttatgcgttattcatttattgtgtaattctctgtccttgttactttggagtgatatgtctttaagcatctgcatgcctgttttctgagctctcctttcac

SEQ ID NO: 158732 - DNA, 601 bp, Human
aatggggggaattcaatattactttgtaattcattttggaaagaaattaattcctttcacaataatttgaaaattagtgtagttccaaaccacatgcccagcattaaaaaaaaaaaacaacactttattaaggtatgattgatatacaaaaaaagtatgtattatatatatatatatataaaacttaatgagtttgttggtaagtatacatgtgtgaaaccagcatttttctttaagttgctgtattttgtttattttggtttggatttgtctgaaattcgtagtcaaaatttcatgggaygttcttggtaaaactagatgatgaatgtttgaaaaaagaattaagagatggagtttatagttcttaataataaaacatagtataaagctataataattaaaacagcatgttattggtaaatggatagaaactaatgagactgaatagcaagctcaaaagcatacttaaatatatataaatacttaatttctaatagtggtatttcatatgaataaggagagaatagattgctaaataactggtgaagaagcattggttaggtatttggagagagaaattaaaaaatgaaaatatagatga

SEQ ID NO: 158733 - DNA, 601 bp, Human
atatataaaacttaatgagtttgttggtaagtatacatgtgtgaaaccagcatttttctttaagttgctgtattttgtttattttggtttggatttgtctgaaattcgtagtcaaaatttcatgggatgttcttggtaaaactagatgatgaatgtttgaaaaaagaattaagagatggagtttatagttcttaataataaaacatagtataaagctataataattaaaacagcatgttattggtaaatggatagaaactaatgagactgaatagcaagctcaaaagcatacttaaatatrtataaatacttaatttctaatagtggtatttcatatgaataaggagagaatagattgctaaataactggtgaagaagcattggttaggtatttggagagagaaattaaaaaatgaaaatatagatgaataatcactttctttgataggcaaagaccttaaaacaaaactatttttagacttaacaactttaaaatgtaactgctccacaagtaatattgccaaaccagaaaaatacttgcagcatgtatgacaaagtattaattaacttcactgacaaacactttctgaactcttactat

SEQ ID NO: 158734 - DNA, 601 bp, Human
ctaaatgtaactatattgtccatgaaccaaaagactcatcatctctgtttaagacaacaatagcatgaatatttatagcccttcaatgtaaagccaacttctgagatttctgtactatgtagacttttgtggagtttttttctttttttttgctctcaagaactctctgattcccactatgacttttgcaattattaagacctaaataagaattcttagatgacacacttgaaatattaaatcgtatagcgtagccttaaaatgcttataatttttgtagcacaataattacaattttgcytacttttcacccctagattattgcattttgattttaagaacctgtaagatccaaaatacatggagcttgattatatgatcagcttgagatatataagcattttttattagttctaagaaatttgggcaataatatgttgtagttgggaagatgagattagtagttttgcaaatatagttttcttatctttttagaaggagtccttatcagtatccttttctcagttccagttaccttttaagatcagtgtgagcagttgtcaactgagatatgttactgtcccttttaggaggtgcattt

SEQ ID NO: 158735 - DNA, 601 bp, Human
gagcagttgtcaactgagatatgttactgtcccttttaggaggtgcatttgtgatgttctttatttaaatctaaaacaaacatttcaggccagactcagtggcttacatctctaatctcagcactttgggaggccaaggcaggcatatcaatttaggtcaggagttcgagaccagcctggccaaagggtgaaactccgtctctactaaaaattcaaaaattagtcaggaatggtggcaggcacctgtaatcccagctacgtgggatgctgaggcaggagaatcacttgaacccaggaggcrgagcttgcaatgagccagggtcatgccagtgcactccagcctgcgtgacagagcgagaatctgtctcaaaaaaataaaataaaataaaaagtaaacattttagaaagtcactaaactgaagagttcaggatataaagacttaggttgtagttgattcaaaactacaaccaaaagttgatcaacttgtagttgatgaggaacatagctaggtcaaggtaatacagttcagtcacctttttttaaacatatcttgatcaatttcctgtattactagaattttacaactatgtatcacaacta

SEQ ID NO: 158736 - DNA, 601 bp, Human
ttgacatacaaccctgacctgggccagatataattttggccagaactgattattaatttaaggattactgcactgtgtctaaataccatatgttcacatttatatatctattattttattttgagctatcatttaatctgttgtttcatttttggtgttatttctgcatgaaattgttgtgtttttcctcctagtttgttattgttttgacatgttattcttagattgttttcccacccagagacattttattttgaatattcagtatttttttgtatttttttatccttttaattttttwaaaaaaattactattttttttgtccaaggttttagatacctcagtgctaggttgctaattaaatttagcattattgttctgttttcctagttattgtagaaaggatgaagtatcattagacctttcttgtttgatgttatttgtgatttcgtcccaatttgagatttgcctggatttgatccttggactagtgtggtctgatctagttgtacatgggctttttgttagtgtcaccagacttagcagtgaatcccatgtctcttctccactaaatgttctcacctaacagttcctgtccaa

SEQ ID NO: 158737 - DNA, 601 bp, Human
tgacctgggccagatataattttggccagaactgattattaatttaaggattactgcactgtgtctaaataccatatgttcacatttatatatctattattttattttgagctatcatttaatctgttgtttcatttttggtgttatttctgcatgaaattgttgtgtttttcctcctagtttgttattgttttgacatgttattcttagattgttttcccacccagagacattttattttgaatattcagtatttttttgtatttttttatccttttaattttttaaaaaaaattactattttttttgtccaaggttttagatacctcagtgctaggttgctaattaaatttagcattattgttctgttttcctagttattgtagaaaggatgaagtatcattagacctttcttgtttgatgttatttgtgatttcgtcccaatttgagatttgcctggatttgatccttggactagtgtggtctgatctagttgtacatgggctttttgttagtgtcaccagacttagcagtgaatcccatgtctcttctccactaaatgttctcacctaacagttcctgtccaatttcttgaggcata

SEQ ID NO: 158738 - DNA, 601 bp, Human
atccaaggaggtgagacaagtctactgagtccctgcaggccaatgtataacagctgtaggagtactgctggaagcttatcctccttctctagaaacctcagcctccgagaagagagacagctacactgaagaactcaaattggccatcacactgacaggaccggtaatgttcatatgaaatacctatacgaaggagaaagccagagtcatcaccaaggaggaagagaacttcaagactgccacgtcaggccaggtgcggtggctcacgcctgtaatcccagaactttgggaggctgaggcrgatggatcacgagctcaggagttcgagaccagtctgaccaacatggtgaaaccctgtctctactaaaagtacaaaaattagccaggcatggtggcaggtgcctgtaatctcagctactcgggaggctgaggcaggcgaatcgcttgaaaccagaaggcagaggttgtagtgagtggagatcgtgccactgccctccagcctgggcaacaacagcgaaagtctgtctcaaaaaaaaaaaaaacaaaaaacctgccatatcaatgcctggctctttggcctctgggcaaaaaggaccaagga

SEQ ID NO: 158739 - DNA, 601 bp, Human
cgtcaggccaggtgcggtggctcacgcctgtaatcccagaactttgggaggctgaggcagatggatcacgagctcaggagttcgagaccagtctgaccaacatggtgaaaccctgtctctactaaaagtacaaaaattagccaggcatggtggcaggtgcctgtaatctcagctactcgggaggctgaggcaggcgaatcgcttgaaaccagaaggcagaggttgtagtgagtggagatcgtgccactgccctccagcctgggcaacaacagcgaaagtctgtctcaaaaaaaaaaaaaamaaaaaacctgccatatcaatgcctggctctttggcctctgggcaaaaaggaccaaggaagctgcagaacaggatattgaaaagaaaaactaaagcactgttgaggccttgtaataactctgcagaaaagctgggaaaacgaataaaccactgggaaaataaataaaccaaaaagatgtccatattaatttattcactttattcgtttgtctaataagaacctaccaaacatctgtcgaatgctaaacactatgctgggcactgaggatacagtggccaataaaacacacatgctgtctgc

SEQ ID NO: 158740 - DNA, 601 bp, Human
tattaacatagtactgaggaaacaggctacatttactcttgtttgaaatttatcccataaaaacattcttttgtaaataaaccatatgtatcaataaattatctttaggcattttgattttctaaaggcttatttgtatcagttttcaattttgatccttatctcagtaaataaattacattaataaccaataatttctaattgtgtatttaaccatctttataaaacttccaagtcagtgaaagcatatgtgaaaataatctttaattgtattttccttgaaatcttcttgattattagrctgaattatgttaatgctaagcagaactgcatgactaatttgtttacttatttacttttttagatttgaaaaatgtgtgagtgctaaggaagctttggagactgatctttataagcggtttattctggtgttgaatgagaagaaaacaaaaatcagaagtttgcataataaattattaaatgcagctcaagaacgagaaaaggacatcaaacaagaagggtattttcgctatcttgtttttggatgacagatgaatacatttaagtggaatttcttcccaaagttaatgaacattagatg

SEQ ID NO: 158741 - DNA, 601 bp, Human
aagtattatttaattcttagacattagtaagacatactaatttaaaaaaaaactttcatctgcagaactacaaaagttggatgcatatttgtaatcttgatgtctaggcaatgattaactttagaatcaagtggttaatattaaattccagggagcacttattttatctgattagagtgtgattatcagttttattcttctttcacatattctctgaaagtacatatgtacttgatttttatggaagaatcctaagtgacaaatggctgatacggctttcgacgattataacttttttacgcattagcaaatacaagttagggtctgttgctttgaatcttagtagaagtacagaattaccagtgacgtagtataaaaaaatttgatatcagctagtcctagcacaggtactggtcttgcagtcatacctattagtttatagctttggacaagtcactttatcttcataataaaggtaaagatacccatcttagggttttgcagagatcaaatgaaatgcgaactgttctgagattagtaaaatgttaaatactctgtgactcacagagataatttgttagaaaaagtattttgatggaag

SEQ ID NO: 158742 - DNA, 601 bp, Human
acacatatactccaaggtatactattcctggttaaatataaccaggaaaagcataagcaatgaggaagaaacacctttatgctaaatatcatcagcttaaagctggttgcctttaacatttgagatcttatttagctaaagccatgaataggccactggagcagagtaatcaagaatgctctaaattatactgaagttgaggccttctttcactcttcagaaaaaagattgcaacaagtgagatgtaatagaggaaaagagaaggggaaaaatggcagtttagtacaaagtacctatgacttactcagtcctttggatcaagttcccagcaagtgtttaaacccatgagttattttttaaaatgttttatagatttcctagtgacggtggaaacaggagcctctgaactcattttatacttagatggttttgacctaaaaccaatactattaaaataaatgcttgatttatttatttagaaaatatttttgagttcctattatgtactagaaactttgctatgcattagacagcaaaacacaaaaatctgtgccattgtggagtttaaattgtagtcagggaaacatataagatgaataaa

SEQ ID NO: 158743 - DNA, 601 bp, Human
tatactccaaggtatactattcctggttaaatataaccaggaaaagcataagcaatgaggaagaaacacctttatgctaaatatcatcagcttaaagctggttgcctttaacatttgagatcttatttagctaaagccatgaataggccactggagcagagtaatcaagaatgctctaaattatactgaagttgaggccttctttcactcttcagaaaaaagattgcaacaagtgagatgtaatagaggaaaagagaaggggaaaaatggcagtttagtacaaagtacctatgacttactcagtcctttggatcaagttcccagcaagtgtttaaacccatgagttattttttaaaatgttttatagatttcctagtgacggtggaaacaggagcctctgaactcattttatacttagatggttttgacctaaaaccaatactattaaaataaatgcttgatttatttatttagaaaatatttttgagttcctattatgtactagaaactttgctatgcattagacagcaaaacacaaaaatctgtgccattgtggagtttaaattgtagtcagggaaacatataagatgaataaatataa

SEQ ID NO: 158744 - DNA, 601 bp, Human
atttacttttactatgtcttggattttagaatttccagatagatagtgattgtattactgactttatttcttaagctatggctgcatactaaggccctggattttataggtatttcactttgttttatattaagattatgataaatataatagttgctgtagtctctatttgtagctcaagctttggactagaaaagtagggatcactttcacccctatctagttggtattaagtacttgtggccttaaagatttcctgcttagtctggactcctcctgcctccaaagtgagtgtgtgtgwgtgtgtgtgtgtgtgtgtgtgtgtgtgtgaatttaatagaaatctgttgggttattatagatactgtgaaacagtcttccctataagaaactctttttctttccaaatcaaggtaaaacacgatgtccctatctaaggagaaacattgttaaactatgtccactaaataacagaacctcaacaaaatatgtagtgatagaagcaccattatgtatagcattagagccaaaatctgcaacaacaccacatgcaattggccttttatttgccccaaccatatcagatataatctaagaacag

SEQ ID NO: 158745 - DNA, 601 bp, Human
ggccttaaagatttcctgcttagtctggactcctcctgcctccaaagtgagtgtgtgtgtgtgtgtgtgtgtgtgtgtgtgtgtgtgtgaatttaatagaaatctgttgggttattatagatactgtgaaacagtcttccctataagaaactctttttctttccaaatcaaggtaaaacacgatgtccctatctaaggagaaacattgttaaactatgtccactaaataacagaacctcaacaaaatatgtagtgatagaagcaccattatgtatagcattagagccaaaatctgcaacamcaccacatgcaattggccttttatttgccccaaccatatcagatataatctaagaacagtttcgcattgtgcagttttaaaatattgcttcagaaccattttcatgctgtgataacagaattgtatgtgaaaacaattttaaaatatatatgaatattctaagaattttagccattatgaaacatttcttagtcttaacataattcaaaaagcatgcaaatatttagtggaaaatttgaatttatatgatagagttaggatttttcttgtgaaacattttgaaaagctatgcttaattgg

SEQ ID NO: 158746 - DNA, 601 bp, Human
gtgtgtgtgtgtgtgtgtgtgtgtgaatttaatagaaatctgttgggttattatagatactgtgaaacagtcttccctataagaaactctttttctttccaaatcaaggtaaaacacgatgtccctatctaaggagaaacattgttaaactatgtccactaaataacagaacctcaacaaaatatgtagtgatagaagcaccattatgtatagcattagagccaaaatctgcaacaacaccacatgcaattggccttttatttgccccaaccatatcagatataatctaagaacagtttcrcattgtgcagttttaaaatattgcttcagaaccattttcatgctgtgataacagaattgtatgtgaaaacaattttaaaatatatatgaatattctaagaattttagccattatgaaacatttcttagtcttaacataattcaaaaagcatgcaaatatttagtggaaaatttgaatttatatgatagagttaggatttttcttgtgaaacattttgaaaagctatgcttaattggctcctaattagttagctatcataaggctaatgattttaattcctcactaattattttaatatat

SEQ ID NO: 158747 - DNA, 601 bp, Human
tttaaaatattgcttcagaaccattttcatgctgtgataacagaattgtatgtgaaaacaattttaaaatatatatgaatattctaagaattttagccattatgaaacatttcttagtcttaacataattcaaaaagcatgcaaatatttagtggaaaatttgaatttatatgatagagttaggatttttcttgtgaaacattttgaaaagctatgcttaattggctcctaattagttagctatcataaggctaatgattttaattcctcactaattattttaatatataatcagtatttsaaaattatagttatttctatgaatagagttgacaatatttattacaattataggataattaagagcattactaaaatacaaataagaaatcttttctagaatgtttcactctttttagctgcatattaaaggtgcacaaccactaaaaacaaatataataagctttcctaccacttttctacataattactagcccaagatttagcacattagtttaattaatcctgcttcttaaccaacaggaaggtccctgtataactgctatcagtaatttaggctttcacttagttggtaggcttc

SEQ ID NO: 158748 - DNA, 601 bp, Human
aatatatatgaatattctaagaattttagccattatgaaacatttcttagtcttaacataattcaaaaagcatgcaaatatttagtggaaaatttgaatttatatgatagagttaggatttttcttgtgaaacattttgaaaagctatgcttaattggctcctaattagttagctatcataaggctaatgattttaattcctcactaattattttaatatataatcagtatttgaaaattatagttatttctatgaatagagttgacaatatttattacaattataggataattaagagcrttactaaaatacaaataagaaatcttttctagaatgtttcactctttttagctgcatattaaaggtgcacaaccactaaaaacaaatataataagctttcctaccacttttctacataattactagcccaagatttagcacattagtttaattaatcctgcttcttaaccaacaggaaggtccctgtataactgctatcagtaatttaggctttcacttagttggtaggcttcctgaaaggaagtgtgattatagaatagcctttttgaaaataaatgaatggctatgtccaacagttga

SEQ ID NO: 158749 - DNA, 601 bp, Human
ttaaggaaaagaattgccttcacaatagcatcaaaaaatacctagaaataagtctaacaaaagaaattcaagactcctacactgagaactatgcaacattgttgagagaaattaaagaagacttaagtaaatgggaaaacatcttatatttatagattagaaatttagtattgttggccgggtgtaatggcctacacctgtaatcctagcactttgggaagctgatgcgggcagatcatttgagctcagcagtttgagaccaacctgggcaatatggcaaaactccatctctacaaaaaayacaaaaaaacttagccaggcatagtggagcatgcctatagtcccagctagttgggaggctgagacaggaggattgcttgagcctgggaggcagaggttacggtgagccaagatcacaccactgcagtccagcctgggtgacagagcgagaccctgtctcaaaaaaaacaaaaaaattaatattgttaagataaatactttcaaattggtacatagattcagtgagatgcctatcaaaatcccagctggttttttagcaaaaattgacagaatgatcctaaaacttatatagaatttcaag

SEQ ID NO: 158750 - DNA, 601 bp, Human
cccaaaaaccaattgtgaggtcgggtagctcacacctgtaattccagtgcattgggaggacaaggcgggcagatcacctgaggccaggagttcaagaccagcctggccaacatggtgaaaccccgtctctactaaaaacacacaaaaaattagccaggcatggtggcgtatgcctgtagtcccagctacttgggaagctgagtcaggagaattgctcaaacctgggaggcagaggttgcagtgagccaagatcactccactgcactctagccggggcagcgcagagcaagactccgtctcaaaaaaaaaaaaaaaaaaaaccattgcgataatttgagctgttcagaaaaattcttgtacatcctaggtcaagaaagccagagttcaaaagtgcaagtttcattcaagagtaaattaatccggagggtaatgaaatacaagtatacttcttgtttttctattcttattagtattattttctgttcttattgctttgataaatccctaatattttcataaatcactggagctattgaagaatgaagtagagctgaacctcagcacaaggatgcagatgtcagcagaattctgtagcctgtgt

SEQ ID NO: 158751 - DNA, 601 bp, Human
tgagaaaagggaaggtatctaaagaaaacaggtatttcctaggacagtgtttgtatgtctgttttaagaggacatgtactaaatatgaggagaggatcatatatttgaggatacagttttaaaatgtagcataaaatcataagaataatattaaacctcaaacatgcaaaaacttggaggaattctgaaaatggttaaaaaacgatgttttgttttgtttttttaccattgttgtaaatggtaaaaacattctcagatctcagactactctgagaatttacttatcttagcacaaatgtcygttggcataactaatgttaatagatgacagaaacaatacacaaatgctacttaatttggtttattttgcctcaagttgagttcttaacttgtggtttttaagaagtgtttagtgaaaggatatctgaactctttggatttatgtgtaaaattttctatgtttatctgtctatatatctatttgtatatctatatgaatatgttagtttgccagggctgctgctgtaacaaagtacataactgagtgacttgaacaacagaaatatatttactcacattctggaggctaggatcctgaaat

SEQ ID NO: 158752 - DNA, 601 bp, Human
tggtaaaaacattctcagatctcagactactctgagaatttacttatcttagcacaaatgtctgttggcataactaatgttaatagatgacagaaacaatacacaaatgctacttaatttggtttattttgcctcaagttgagttcttaacttgtggtttttaagaagtgtttagtgaaaggatatctgaactctttggatttatgtgtaaaattttctatgtttatctgtctatatatctatttgtatatctatatgaatatgttagtttgccagggctgctgctgtaacaaagtacataactgagtgacttgaacaacagaaatatatttactcacattctggaggctaggatcctgaaattgagatgttggcagggttaatttcttctgagggctttgagggaatgatttattaaccaggcctctctccttggcttataggcaaccagcttctccctgttacatcaaattttcttccttctatacctatctctgttcaaattaccctttttataagggtaccagtcatattggattagggctcaccctaatgacctcattttaactttattacctctgtaaataccctacatccaaat

SEQ ID NO: 158753 - DNA, 601 bp, Human
atagatgacagaaacaatacacaaatgctacttaatttggtttattttgcctcaagttgagttcttaacttgtggtttttaagaagtgtttagtgaaaggatatctgaactctttggatttatgtgtaaaattttctatgtttatctgtctatatatctatttgtatatctatatgaatatgttagtttgccagggctgctgctgtaacaaagtacataactgagtgacttgaacaacagaaatatatttactcacattctggaggctaggatcctgaaattgagatgttggcagggttartttcttctgagggctttgagggaatgatttattaaccaggcctctctccttggcttataggcaaccagcttctccctgttacatcaaattttcttccttctatacctatctctgttcaaattaccctttttataagggtaccagtcatattggattagggctcaccctaatgacctcattttaactttattacctctgtaaataccctacatccaaataaggttgcattcttaggtcctgggagttcagactgcaaaatatctttttttgggtgtgttggggggtgagggggatttccac

SEQ ID NO: 158754 - DNA, 601 bp, Human
atcctgaaattgagatgttggcagggttaatttcttctgagggctttgagggaatgatttattaaccaggcctctctccttggcttataggcaaccagcttctccctgttacatcaaattttcttccttctatacctatctctgttcaaattaccctttttataagggtaccagtcatattggattagggctcaccctaatgacctcattttaactttattacctctgtaaataccctacatccaaataaggttgcattcttaggtcctgggagttcagactgcaaaatatctttttttgsgtgtgttggggggtgagggggatttccacccataacaatgccaataggtctatatctttctgaagcaaggatccaaatcaagatgttggctgggttgctgttttcaaaagggaccatattccaaaaatgattccaaaccattgatctaagagactgatatttaaactagaaagaatggagtaagacttgttaaaagggaactgaagtctacaatagatgagatgatgagataagaagagaaagtaacagcattcaaacagatagctaaatcactgtctgtctgtgcattagattggaggt

SEQ ID NO: 158755 - DNA, 601 bp, Human
tcatttatttgtttgtcccaggaacgtgaagctagacgtgttcattgtccctgttaaacagcaaaccatgactgagttcagacaaaaggtgatgtgaatgcagcaacaatttctaaatcagttaaatgtctataatataatatgtaggattcttgtctttctgggattgtgactggaatctctaccacaaacagcacatctggtcccctgagccaattcatcagcatcgcctgtaagccatatttaagatcaaaaggatagacaaggttaccaatgatgaggttctggaatgttgccagcscatcagcactaacatgatacttgccacgacttaactctgagggcctggggatgtgtgaaggatggatatcagcaggctctctaagcagattctgaatgcatggtgtggtgaaacagaacagttacaagtatggtggccagaagaaaagctcaatgtgagacccttagtggcaaattcaagccttgtggtaaaactcaggaatgctgagaaatagtaaacctagttaacacccaggattttttgaggagagagagaaaggatataatttggggagtgacaaaataaaaaagatcttaggta

SEQ ID NO: 158756 - DNA, 601 bp, Human
tgttaataatcaactatatcacttttgaagacttagtttaatatatgttgatcgtttccttactgtttgccttattgggggaacccattcttctccagaaaaggacagatcctctcttggatttatatatatatatattatgcagaaacgtttcttctagaacttctatatataaaagaattataggccaggcacggtggctcatgcctgtaatcccaacactttgggaggccaaggcaggtggatcatttgaaatcaggagttcaagaccagcctggccaacatagtgaaaccctgtctytactaaaaatgcaaaaaaaaaaaaaaagcaattagccaggcatggtggtgcacacctgtagtcctagctactcaggaggctgaggcagaagaatcgcttgaacctgggaggtggaggttgcaataagcttgagatcgcactactgcactccagcctgggtgacacagcaagacttcatctcaaaaaaaaaaaaaaaaaagaattctagctatcaacaacaatcaccgagtgatagacagcacagttatttacagcactatggagatctagggtttagttttagttctaccaatacctttg

SEQ ID NO: 158757 - DNA, 601 bp, Human
taaagggtccacaaaaaaatggaaagataatccatgttcatggcttgcgagaatcaatattgttaaaatggccatagacccaaagcaatctacagattcaatgcaatccctatcaaaataccaatgacatattcacagaaatagaaaaaataatcctaaaatgtatgtagaaccacaaaagactatcatagccaaaggaatcctgagcaaaaagaacaaaattgaaggcaacacataaccttacttcaaattatactacaaaattgtagtaaccaaaagagcatggtactgtctcataaaracagacacataagccactggaacagaatagagaaccctcagaaataaatccatgcatttacagtgaactcatgtttgaaaaggtcaccaagaacatacatggggaaaagaacagtctctttggtgctgggaaaattggatatctatatgcagaaaaatgaaactagaaccctatatctcaccatatacaaaaatcaaatcaaaatggattaaagacttaaatgtgagatctcaaactatgaaactagtagaagaaaacattgaaggggtgattcaggacatttgtctgggcaaagattat

SEQ ID NO: 158758 - DNA, 601 bp, Human
tccatgttcatggcttgcgagaatcaatattgttaaaatggccatagacccaaagcaatctacagattcaatgcaatccctatcaaaataccaatgacatattcacagaaatagaaaaaataatcctaaaatgtatgtagaaccacaaaagactatcatagccaaaggaatcctgagcaaaaagaacaaaattgaaggcaacacataaccttacttcaaattatactacaaaattgtagtaaccaaaagagcatggtactgtctcataaaaacagacacataagccactggaacagaataragaaccctcagaaataaatccatgcatttacagtgaactcatgtttgaaaaggtcaccaagaacatacatggggaaaagaacagtctctttggtgctgggaaaattggatatctatatgcagaaaaatgaaactagaaccctatatctcaccatatacaaaaatcaaatcaaaatggattaaagacttaaatgtgagatctcaaactatgaaactagtagaagaaaacattgaaggggtgattcaggacatttgtctgggcaaagattatttgcataagacctcaaaagcacaggcaacc

SEQ ID NO: 158759 - DNA, 601 bp, Human
taatttgtatatgtaagtaaatggagaactgtatttatatgagatttttctgatgatgatgtttggtctgtctctgaatcgttttatttttcataaaagaagtaaggttgggtccttttagctaaatggccttcgggtttatcagtaacaaaaaaaaattaaataattgtcaccaaaaatataaaagtttttaagaagagattttttgaagtgtgaagaactaggctaaataatgtcaacttttcctttaagaaatagttagctgctagaagaccacaaatgagtgataagtttcaggcarctctgaagtaggctggtatctctttagaaaagatgtttaattcctgttcacactagactgtgcaattaataattaaatgtctaatgattctgttctcacagaattttaaattttgctggggagaatagatgtaattgcagtgtagaagaaaatagtgtactagaaagtatcaaattaatgtttttactctaacatttgttaaatgcctgttaggtgttgggcctgatgtctggctccaggaatgccacattgaataagatattgtctctgccttttagtagttcactctctagttaagga

SEQ ID NO: 158760 - DNA, 601 bp, Human
gtaatatgaagtaaataaaataagaaaataaagattttagttgtaagatttttaagttaatgcatttattaactaattgcagccatattaatgatttatattgaaattcaagaagcacgacataattttacacaaatctatctttttgtgtaatgaatataatatacaagtgaattaattctgttaaataaaatagtacttccctactctcagttcactgatcttttttttcttctcatttgaggaaaaaagtccacctttcaaaagtgtcatatactctagataagaaggttcaaaactktttactgagacccacagtaagaatatatttcatctttcaaccaagtacagttgatccttgtacaatgcagagtttagaggtgctcacttcccatacaatcagaataccacatagaatttttgacttgtccaaatctttactaatagcctactgttgaccacagcctcaccgataacataaacagtcatttaacacatattttatgttttatgtactatatactattatatattcttacaataaagtaagctagagaaaaggaaatgttattaagaaaatcataaggaagagaaaatatat

SEQ ID NO: 158761 - DNA, 601 bp, Human
tactattcattaagtggaagtggattctcaaaaaggtctttaccctggcattcccattgagttggctgaggaagagtgggaggaggaggaagaggaggaggaggaggaggaggaggaggcggaagggttggtcttgctgtctcagggtggcagagtcggaagaagtggaagagaaggaaggggaagcaggagaggcaggcaaattcagtgtaacttttatttaaaaaaaaaaaaattcacgtataaatggatcctcacagttcaaatccatgttgcccaagggtcactcgtatacacattttgtgtgtgtgtgtgtgtgtgtgtgtgtgtgtgtaagctgacacaaaccttgcatgaaactacttacccttgtttgttcctgtactcaacacttttaatctccttaatttctttctgtgttttgcttcatggatatttattctgtttctcacttttgctaaatgtatgagattgtaaatatgaagttctgagattataagcatgcacaactctcctttattttaaaacaaataaacaagaaatatttatctcttgctctacttacttcattttccttttattttattattatttttttgcc

SEQ ID NO: 158762 - DNA, 601 bp, Human
aataaaggaaaaattagagaaagattactttttgaataattgcataagattttttggctgaaaattaatagatgttaaaatgtgccagtttatttagatttccaataaaaatgttcatttgatatccgtatttaaaagttattatttacctaaaaagcaactatgtatagtgtaaataattgtttggaagacatttgaaaatatcttatttgatcagggaagataatacagattaactttagaaaagtttcagtaaaaatctatttctcgatctgttctctttcccccacttttctcactccccccctccatctgtacttttaatacctctctcttaatctcctctacttccctctgcaacaatcacattacctacaagaaatagattattgtctattgagtactcattcttgaaagtaactgtttctttcatccttgtttttctatagattaaaatctctcaaattatttatcgaagtttcttgcaagttaatttttttctatcattgtcctttttcctattaagtttggcataatatttctcacttttacttacagcatttatattttttattttccaactgatataccagtatggata

SEQ ID NO: 158763 - DNA, 601 bp, Human
tcttatgaggttgaaatgtggacttcctagctgtttatgaatcatagtggagtgacatacatacattaacctttttaaactgtatttgccttctttgattgtgtttgctaggtaaatacagattttagaaagggaagagaaaatattttaaaatagttctgctgattgcctgcaattctgcttaaccaatttagttccacaaacagtggatttaatcaaacctgatagaagttaataccagttggaaaaaacttatgaacaagtatgcataattctaaggatttggggctattgacaaggraatcataaacactatttaggtagccaaccaagtaagatgatgatgccttcatccatatcttacagcaggggtcctcaatcccctagcagcagaccagttctggttcgtggcctgttaggaactgggccgcacagcagtcagtgaggagtcagccagcatgaattaccacctgagctccacctcctgtcagatcagtggcaaaatcatccccccaacctcacccggtccatggaaaaattgtctttcatgaaaccctgttcctggtgccaaaaaggttggggactgttgtcttagaggaag

SEQ ID NO: 158764 - DNA, 601 bp, Human
gtgacatacatacattaacctttttaaactgtatttgccttctttgattgtgtttgctaggtaaatacagattttagaaagggaagagaaaatattttaaaatagttctgctgattgcctgcaattctgcttaaccaatttagttccacaaacagtggatttaatcaaacctgatagaagttaataccagttggaaaaaacttatgaacaagtatgcataattctaaggatttggggctattgacaaggaaatcataaacactatttaggtagccaaccaagtaagatgatgatgccttcrtccatatcttacagcaggggtcctcaatcccctagcagcagaccagttctggttcgtggcctgttaggaactgggccgcacagcagtcagtgaggagtcagccagcatgaattaccacctgagctccacctcctgtcagatcagtggcaaaatcatccccccaacctcacccggtccatggaaaaattgtctttcatgaaaccctgttcctggtgccaaaaaggttggggactgttgtcttagaggaaggaaaacaatgaaaaattaattgggaactatcaagaaatctgaccaaggaag

SEQ ID NO: 158765 - DNA, 601 bp, Human
ttaacctttttaaactgtatttgccttctttgattgtgtttgctaggtaaatacagattttagaaagggaagagaaaatattttaaaatagttctgctgattgcctgcaattctgcttaaccaatttagttccacaaacagtggatttaatcaaacctgatagaagttaataccagttggaaaaaacttatgaacaagtatgcataattctaaggatttggggctattgacaaggaaatcataaacactatttaggtagccaaccaagtaagatgatgatgccttcatccatatcttacarcaggggtcctcaatcccctagcagcagaccagttctggttcgtggcctgttaggaactgggccgcacagcagtcagtgaggagtcagccagcatgaattaccacctgagctccacctcctgtcagatcagtggcaaaatcatccccccaacctcacccggtccatggaaaaattgtctttcatgaaaccctgttcctggtgccaaaaaggttggggactgttgtcttagaggaaggaaaacaatgaaaaattaattgggaactatcaagaaatctgaccaaggaagcatcagaggaactg

SEQ ID NO: 158766 - DNA, 601 bp, Human
aagggaagagaaaatattttaaaatagttctgctgattgcctgcaattctgcttaaccaatttagttccacaaacagtggatttaatcaaacctgatagaagttaataccagttggaaaaaacttatgaacaagtatgcataattctaaggatttggggctattgacaaggaaatcataaacactatttaggtagccaaccaagtaagatgatgatgccttcatccatatcttacagcaggggtcctcaatcccctagcagcagaccagttctggttcgtggcctgttaggaactgggcckcacagcagtcagtgaggagtcagccagcatgaattaccacctgagctccacctcctgtcagatcagtggcaaaatcatccccccaacctcacccggtccatggaaaaattgtctttcatgaaaccctgttcctggtgccaaaaaggttggggactgttgtcttagaggaaggaaaacaatgaaaaattaattgggaactatcaagaaatctgaccaaggaagcatcagaggaactgatatgtcatccacagaagatcaagatgatgccatcgtactagcaagttgaagctttctgtattc

SEQ ID NO: 158767 - DNA, 601 bp, Human
aatcaaacctgatagaagttaataccagttggaaaaaacttatgaacaagtatgcataattctaaggatttggggctattgacaaggaaatcataaacactatttaggtagccaaccaagtaagatgatgatgccttcatccatatcttacagcaggggtcctcaatcccctagcagcagaccagttctggttcgtggcctgttaggaactgggccgcacagcagtcagtgaggagtcagccagcatgaattaccacctgagctccacctcctgtcagatcagtggcaaaatcatcccccyaacctcacccggtccatggaaaaattgtctttcatgaaaccctgttcctggtgccaaaaaggttggggactgttgtcttagaggaaggaaaacaatgaaaaattaattgggaactatcaagaaatctgaccaaggaagcatcagaggaactgatatgtcatccacagaagatcaagatgatgccatcgtactagcaagttgaagctttctgtattcatgatatgttttagataattgaaaaccttgagtgattttctctctgaatacagttttttaatgaaactgtatactgtggtattt

SEQ ID NO: 158768 - DNA, 601 bp, Human
cacacaccggggcctgtcagtgggtgaggagcaagaggagggataccattaggagaaatacctaatatagatgacaagttgatgggtgcagcacaccaccgtggcacttgtatacatatgtaacaaacctgcacgttctgtacatgtatctcagaacttaaaagataataaaaaaaaactatgcagttttgtttttgttgctatgatttctagttacaatcctaataaaaatactatctccattaaatctccaagaacacgttcacccagcatcaaagatcattttgatcaaattattccrtgtgtacaatatacataatgttttttgttggtagtaaagtatcatatggcatctaactgacttgattcaacaaatctgcataaagatttgaaagaatagttttgctatattttaattgtcaccttatgtcaatgctaaaacagcaagttaatacttacaaatgatgtgcataattttgttgggtcacattctcatctcattttatttcagctgctgtaagtaaagatgattccattatttcaagtcttgatgtcactgatattgcaccaagtagaaaaaggagacagcgaatgcaaagaa

SEQ ID NO: 158769 - DNA, 601 bp, Human; identical to SEQ ID NO: 158672

SEQ ID NO: 158770 - DNA, 601 bp, Human; identical to SEQ ID NO: 158673

SEQ ID NO: 158771 - DNA, 601 bp, Human; identical to SEQ ID NO: 158674

SEQ ID NO: 158772 - DNA, 601 bp, Human; identical to SEQ ID NO: 158675

SEQ ID NO: 158773 - DNA, 601 bp, Human; identical to SEQ ID NO: 158676

SEQ ID NO: 158774 - DNA, 601 bp, Human; identical to SEQ ID NO: 158677

SEQ ID NO: 158775 - DNA, 601 bp, Human; identical to SEQ ID NO: 158678

SEQ ID NO: 158776 - DNA, 601 bp, Human; identical to SEQ ID NO: 158679

SEQ ID NO: 158777 - DNA, 601 bp, Human; identical to SEQ ID NO: 158680

SEQ ID NO: 158778 - DNA, 601 bp, Human; identical to SEQ ID NO: 158681

SEQ ID NO: 158779 - DNA, 601 bp, Human; identical to SEQ ID NO: 158682

SEQ ID NO: 158780 - DNA, 601 bp, Human; identical to SEQ ID NO: 158683

SEQ ID NO: 158781 - DNA, 601 bp, Human; identical to SEQ ID NO: 158684

SEQ ID NO: 158782 - DNA, 601 bp, Human; identical to SEQ ID NO: 158685

SEQ ID NO: 158783 - DNA, 601 bp, Human; identical to SEQ ID NO: 158686

SEQ ID NO: 158784 - DNA, 601 bp, Human; identical to SEQ ID NO: 158687

SEQ ID NO: 158785 - DNA, 601 bp, Human; identical to SEQ ID NO: 158688

SEQ ID NO: 158786 - DNA, 601 bp, Human; identical to SEQ ID NO: 158689

SEQ ID NO: 158787 - DNA, 601 bp, Human; identical to SEQ ID NO: 158690

SEQ ID NO: 158788 - DNA, 601 bp, Human; identical to SEQ ID NO: 158691

SEQ ID NO: 158789 - DNA, 601 bp, Human; identical to SEQ ID NO: 158692

SEQ ID NO: 158790 - DNA, 601 bp, Human; identical to SEQ ID NO: 158693

SEQ ID NO: 158791 - DNA, 601 bp, Human; identical to SEQ ID NO: 158694

SEQ ID NO: 158792 - DNA, 601 bp, Human; identical to SEQ ID NO: 158695

SEQ ID NO: 158793 - DNA, 601 bp, Human; identical to SEQ ID NO: 158696

SEQ ID NO: 158794 - DNA, 601 bp, Human; identical to SEQ ID NO: 158697

SEQ ID NO: 158795 - DNA, 601 bp, Human; identical to SEQ ID NO: 158698

SEQ ID NO: 158796 - DNA, 601 bp, Human; identical to SEQ ID NO: 158699

SEQ ID NO: 158797 - DNA, 601 bp, Human; identical to SEQ ID NO: 158700

SEQ ID NO: 158798 - DNA, 601 bp, Human; identical to SEQ ID NO: 158701

SEQ ID NO: 158799 - DNA, 601 bp, Human; identical to SEQ ID NO: 158702

SEQ ID NO: 158800 - DNA, 601 bp, Human; identical to SEQ ID NO: 158703

SEQ ID NO: 158801 - DNA, 601 bp, Human; identical to SEQ ID NO: 158704

SEQ ID NO: 158802 - DNA, 601 bp, Human; identical to SEQ ID NO: 158705

SEQ ID NO: 158803 - DNA, 601 bp, Human; identical to SEQ ID NO: 158706

SEQ ID NO: 158804 - DNA, 601 bp, Human; identical to SEQ ID NO: 158707

SEQ ID NO: 158805 - DNA, 601 bp, Human; identical to SEQ ID NO: 158708

SEQ ID NO: 158806 - DNA, 601 bp, Human; identical to SEQ ID NO: 158709

SEQ ID NO: 158807 - DNA, 601 bp, Human; identical to SEQ ID NO: 158710

SEQ ID NO: 158808 - DNA, 601 bp, Human; identical to SEQ ID NO: 158711

SEQ ID NO: 158809 - DNA, 601 bp, Human; identical to SEQ ID NO: 158712

SEQ ID NO: 158810 - DNA, 601 bp, Human; identical to SEQ ID NO: 158713

SEQ ID NO: 158811 - DNA, 601 bp, Human; identical to SEQ ID NO: 158714

SEQ ID NO: 158812 - DNA, 601 bp, Human; identical to SEQ ID NO: 158715

SEQ ID NO: 158813 - DNA, 601 bp, Human; identical to SEQ ID NO: 158716

SEQ ID NO: 158814 - DNA, 601 bp, Human; identical to SEQ ID NO: 158717

SEQ ID NO: 158815 - DNA, 601 bp, Human; identical to SEQ ID NO: 158718

SEQ ID NO: 158816 - DNA, 601 bp, Human; identical to SEQ ID NO: 158719

SEQ ID NO: 158817 - DNA, 601 bp, Human; identical to SEQ ID NO: 158720

SEQ ID NO: 158818 - DNA, 601 bp, Human; identical to SEQ ID NO: 158721

SEQ ID NO: 158819 - DNA, 601 bp, Human; identical to SEQ ID NO: 158722

SEQ ID NO: 158820 - DNA, 601 bp, Human; identical to SEQ ID NO: 158723

SEQ ID NO: 158821 - DNA, 601 bp, Human; identical to SEQ ID NO: 158724

SEQ ID NO: 158822 - DNA, 601 bp, Human; identical to SEQ ID NO: 158725

SEQ ID NO: 158823 - DNA, 601 bp, Human; identical to SEQ ID NO: 158726

SEQ ID NO: 158824 - DNA, 601 bp, Human; identical to SEQ ID NO: 158727

SEQ ID NO: 158825 - DNA, 601 bp, Human; identical to SEQ ID NO: 158728

SEQ ID NO: 158826 - DNA, 601 bp, Human; identical to SEQ ID NO: 158729

SEQ ID NO: 158827 - DNA, 601 bp, Human; identical to SEQ ID NO: 158730

SEQ ID NO: 158828 - DNA, 601 bp, Human; identical to SEQ ID NO: 158731

SEQ ID NO: 158829 - DNA, 601 bp, Human; identical to SEQ ID NO: 158732

SEQ ID NO: 158830 - DNA, 601 bp, Human; identical to SEQ ID NO: 158733

SEQ ID NO: 158831 - DNA, 601 bp, Human; identical to SEQ ID NO: 158734

SEQ ID NO: 158832 - DNA, 601 bp, Human; identical to SEQ ID NO: 158735

SEQ ID NO: 158833 - DNA, 601 bp, Human; identical to SEQ ID NO: 158736

SEQ ID NO: 158834 - DNA, 601 bp, Human; identical to SEQ ID NO: 158737

SEQ ID NO: 158835 - DNA, 601 bp, Human; identical to SEQ ID NO: 158738

SEQ ID NO: 158836 - DNA, 601 bp, Human; identical to SEQ ID NO: 158739

SEQ ID NO: 158837 - DNA, 601 bp, Human; identical to SEQ ID NO: 158740

SEQ ID NO: 158838 - DNA, 601 bp, Human; identical to SEQ ID NO: 158741

SEQ ID NO: 158839 - DNA, 601 bp, Human; identical to SEQ ID NO: 158742

SEQ ID NO: 158840 - DNA, 601 bp, Human; identical to SEQ ID NO: 158743

SEQ ID NO: 158841 - DNA, 601 bp, Human; identical to SEQ ID NO: 158744

SEQ ID NO: 158842 - DNA, 601 bp, Human; identical to SEQ ID NO: 158745

SEQ ID NO: 158843 - DNA, 601 bp, Human; identical to SEQ ID NO: 158746

SEQ ID NO: 158844 - DNA, 601 bp, Human; identical to SEQ ID NO: 158747

SEQ ID NO: 158845 - DNA, 601 bp, Human; identical to SEQ ID NO: 158748

SEQ ID NO: 158846 - DNA, 601 bp, Human; identical to SEQ ID NO: 158749

SEQ ID NO: 158847 - DNA, 601 bp, Human; identical to SEQ ID NO: 158750

SEQ ID NO: 158848 - DNA, 601 bp, Human; identical to SEQ ID NO: 158751

SEQ ID NO: 158849 - DNA, 601 bp, Human; identical to SEQ ID NO: 158752

SEQ ID NO: 158850 - DNA, 601 bp, Human; identical to SEQ ID NO: 158753

SEQ ID NO: 158851 - DNA, 601 bp, Human; identical to SEQ ID NO: 158754

SEQ ID NO: 158852 - DNA, 601 bp, Human; identical to SEQ ID NO: 158755

SEQ ID NO: 158853 - DNA, 601 bp, Human; identical to SEQ ID NO: 158756

SEQ ID NO: 158854 - DNA, 601 bp, Human; identical to SEQ ID NO: 158757

SEQ ID NO: 158855 - DNA, 601 bp, Human; identical to SEQ ID NO: 158758

SEQ ID NO: 158856 - DNA, 601 bp, Human; identical to SEQ ID NO: 158759

SEQ ID NO: 158857 - DNA, 601 bp, Human; identical to SEQ ID NO: 158760

SEQ ID NO: 158858 - DNA, 601 bp, Human; identical to SEQ ID NO: 158761

SEQ ID NO: 158859 - DNA, 601 bp, Human; identical to SEQ ID NO: 158762

SEQ ID NO: 158860 - DNA, 601 bp, Human; identical to SEQ ID NO: 158763

SEQ ID NO: 158861 - DNA, 601 bp, Human; identical to SEQ ID NO: 158764

SEQ ID NO: 158862 - DNA, 601 bp, Human; identical to SEQ ID NO: 158765

SEQ ID NO: 158863 - DNA, 601 bp, Human; identical to SEQ ID NO: 158766

SEQ ID NO: 158864 - DNA, 601 bp, Human; identical to SEQ ID NO: 158767

SEQ ID NO: 158865 - DNA, 601 bp, Human; identical to SEQ ID NO: 158768

SEQ ID NO: 158866 - DNA, 601 bp, Human
taactaattgattgagggcccactatgagcctagcattgagtgaggtgctcatgagctcagtgcgtgcttacaacaaccccatgaggctcagagaggtgaggtgatgtgcccaaaatcacacagcacataagtggagaaaagctctggctggccactacttagagctgtctactgagagggctctggactcatagccaggaggtctggcttccagttctggaagtggccttcaatcttaggttgctcatctgtacgctcatactgacttcacaaggagatttaaggaccggatataaatgycttttgttagtacaagtttaagtgtgctgcatgttagctttatttcagaaaccacccatcccctcagcccagccttgaagatggccagggctctggctctattttatctgcctttttcctaaggctttacacattttttcacctgtaaagtgggggtgttaatcccctgcctcacaaggctattgcagggatagagtgagataaggacttgagcggaaggcttggcatataattggtacttggtagacattagcaattgtctgttattattttctcctctgcacatcctctgctctagcc

SEQ ID NO: 158867 - DNA, 601 bp, Human
ttcctgtgcaactgactgattggatgaggaccttttgctctttttctgctggtggctcatacaaaataccactaggggttccgctggcagctccacagcccagctcccggcacaacacagccacgtccttaatgtcccagccgtcatcacacacggtgccccactggcctttctgttccacctccacccgcccttcacagcggtggaggccccccaccagccgcactccagatggagacgctgcaaagagacgggttgttagctagaggcctgagaggagctcagagggtccttaggcatrtactcagtcaatctgggactcttccaccattcaaatggtgcagagtgttggggaactagaaataagggatcagaagaaaagggaaggaagaggagcttcagaactccgtgtctgagttctggttctgctacagccttaatggtaccctgtcaagaaactctacttcaagatacctggacatgactgctggcattttcagattgaagattaaggaaaagaggttggttgaagatccagcagagttttagattctctggcggtcagaatcagaaggccctaaagagatcataaagtccaccc

SEQ ID NO: 158868 - DNA, 601 bp, Human
aacaatcataaacttcttcttgctcacactgagccaatgtatcttctgttcctgtgcaactgactgattggatgaggaccttttgctctttttctgctggtggctcatacaaaataccactaggggttccgctggcagctccacagcccagctcccggcacaacacagccacgtccttaatgtcccagccgtcatcacacacggtgccccactggcctttctgttccacctccacccgcccttcacagcggtggaggccccccaccagccgcactccagatggagacgctgcaaagagacrggttgttagctagaggcctgagaggagctcagagggtccttaggcatgtactcagtcaatctgggactcttccaccattcaaatggtgcagagtgttggggaactagaaataagggatcagaagaaaagggaaggaagaggagcttcagaactccgtgtctgagttctggttctgctacagccttaatggtaccctgtcaagaaactctacttcaagatacctggacatgactgctggcattttcagattgaagattaaggaaaagaggttggttgaagatccagcagagttttagattc

SEQ ID NO: 158869 - DNA, 601 bp, Human
ccactctcccagactagtttaaaatctaggagtgatgacaaatggaatgaggtagaaccctctttgatagtttaacttagagtttcaaggttagggtcatccaagagaataaccttgggttgagagtaaagatggtttattatggttctgctatatgatttgaaagcaattttaatgcttttgaaggttgcttattttctccgactctcactttatgtttactatgtttaatataaaaatgttggtgaaataattttcagaacgcctcttgtttttacattcaatacctgtatgttctcasgatcaatacgtatatagtgtcagccctacctctacccaccagccccaggaataaaacctaccacagggcctggacttccagccatatccctggaagtacagagcaggtgatgactatgagcagcttcatggcgcttgtgaaaatacccttttccccagagtacacccccatcatttcctcttcctttatcatcctccttgccagcccttatgaactccatctgtaggactcacctgagcagatgacagccacatcttcctggtgggtgcagtcgtgaaacccccaaaatctgtgctggca

SEQ ID NO: 158870 - DNA, 601 bp, Human
tatgggcattctcaaaaagctccctactgtagtcccactctcccagactagtttaaaatctaggagtgatgacaaatggaatgaggtagaaccctctttgatagtttaacttagagtttcaaggttagggtcatccaagagaataaccttgggttgagagtaaagatggtttattatggttctgctatatgatttgaaagcaattttaatgcttttgaaggttgcttattttctccgactctcactttatgtttactatgtttaatataaaaatgttggtgaaataattttcagaacgccwcttgtttttacattcaatacctgtatgttctcacgatcaatacgtatatagtgtcagccctacctctacccaccagccccaggaataaaacctaccacagggcctggacttccagccatatccctggaagtacagagcaggtgatgactatgagcagcttcatggcgcttgtgaaaatacccttttccccagagtacacccccatcatttcctcttcctttatcatcctccttgccagcccttatgaactccatctgtaggactcacctgagcagatgacagccacatcttcctggtggg

SEQ ID NO: 158871 - DNA, 601 bp, Human
ctagttccagagttagtggtttaaccaagtagccccacattgattacacaatggggcttcagacgggtggcttttttgagtcagccacgcagcggctgcacttgcattttctaacccaaattgggaaagggcttcttccttcaatcctctgaagagttctacagttcagggctggtattgtggtctctctgataactctcttatgggcattctcaaaaagctccctactgtagtcccactctcccagactagtttaaaatctaggagtgatgacaaatggaatgaggtagaaccctctttsatagtttaacttagagtttcaaggttagggtcatccaagagaataaccttgggttgagagtaaagatggtttattatggttctgctatatgatttgaaagcaattttaatgcttttgaaggttgcttattttctccgactctcactttatgtttactatgtttaatataaaaatgttggtgaaataattttcagaacgcctcttgtttttacattcaatacctgtatgttctcacgatcaatacgtatatagtgtcagccctacctctacccaccagccccaggaataaaacctaccaca

SEQ ID NO: 158872 - DNA, 601 bp, Human
gtaatgttatttttaattttaagagtaagaatcatatttttttcatagcatctgaaccattttacattcctaccaatgatgtacaaggtttcccttttttactcatcctcaccaacactggttattttctgtagttatttttttgacagtaccaaaaaacatcatcctaggagctccgatgttttgtgcatgtatgtttttaattgttatatctcattgtggtttttatgggtttgatttgtatttttctaaagattattgccgttgagcatactcatatgtgcttattggccatttgtayagcacctttgaagaaatgtctattcaagtcctttatcaatttttttttttttttttttgagacggagtttcgccctgtcgcccaggctggagtgcagtggcgcgatctcgactcactgcaagctccgcctcccgggttcacgccattctcctgcctcagcctcccatgtagctgggactacagacacgcgccaccatgcccggctaatttttgtatttttagtagagaaggggtttcaccgtgtttatcaatttttatcacactgtttggattctgttgttgttggagttgatttgtagg

SEQ ID NO: 158873 - DNA, 601 bp, Human
aagtctgaaacctccatgttcttgttttcaagattaaaaaaggctatttaaagtacctttaaattctacatgaattttaagacaaatttttgtgttcgtgtaaaaaacacttctgggattttgcattacagattacattgcaaattgcattgcatatgcagttccttgggtattgacaccttaacagtatcaagtcttctaacccctggacacagatgccttcccatgtacatttgtgccttctttaattccttcaaagtgttgtataatttaccaccttgattaagtttattcctaagtattttactactttaagctattgtatacagaaaaagaactgtttccttaatttcctttttgttcgttgttagcgtataaaaacacaactgatttgtatgtgttgcctttgattcctgtaactttgctggatttgtttatcaattctaagtatttacatagaatctttgggactttccacatataagatcatatcaccagtaaagagagagaatttaccttttttctttcttatttggatattttatattttctgtttattgcctatttttggtgggggggggggtgggtgttaaaccctcag

SEQ ID NO: 158874 - DNA, 601 bp, Human
tgtgttcgtgtaaaaaacacttctgggattttgcattacagattacattgcaaattgcattgcatatgcagttccttgggtattgacaccttaacagtatcaagtcttctaacccctggacacagatgccttcccatgtacatttgtgccttctttaattccttcaaagtgttgtataatttaccaccttgattaagtttattcctaagtattttactactttaagctattgtatacagaaaaagaactgtttccttaatttcctttttgttcgttgttagcgtataaaaacacaactgayttgtatgtgttgcctttgattcctgtaactttgctggatttgtttatcaattctaagtatttacatagaatctttgggactttccacatataagatcatatcaccagtaaagagagagaatttaccttttttctttcttatttggatattttatattttctgtttattgcctatttttggtgggggggggggtgggtgttaaaccctcagtactatctcaaacagaagtgaacaaaaaaatcatccttgtctttttcctgatgtttcaggagcaagagaaatgttttcagtctcttacca

SEQ ID NO: 158875 - DNA, 601 bp, Human
atttcaaacgtttaacatttattaacacttgtttggcatcctaatttgtggtatatgttgggacaatgttccatatgttcgtgtgaaaaatgtgtattctactgttgttggctttactgttttggatatatctgttagatataattggtctataagtggtctataatgtttttcaatatttattttttccaaattttcttctgtcagattgttctacctattattgaaagtggaacattaaagtctcttactattaccttagagttgtctatttctcccttcaattctgtaaatgtttcawatattaggagccctgatgttttgtgcatgtatgtttctaattgtcatatcttctaggtgaactggcctttttaacactatgtaatattctttgtctcttataacactttttgactgttatttttattttatctgatcctagtatagcaaactctgctctcttatttaatatttcaatggaatatctcttttattccttcactttctatctttgtccttacatctgtaaaatgagcctcttgtatgcaacatatacttggatcccctgtttttaaattcattgtgatatatatgtatatat

SEQ ID NO: 158876 - DNA, 601 bp, Human
tttccaaattttcttctgtcagattgttctacctattattgaaagtggaacattaaagtctcttactattaccttagagttgtctatttctcccttcaattctgtaaatgtttcatatattaggagccctgatgttttgtgcatgtatgtttctaattgtcatatcttctaggtgaactggcctttttaacactatgtaatattctttgtctcttataacactttttgactgttatttttattttatctgatcctagtatagcaaactctgctctcttatttaatatttcaatggaatatmtcttttattccttcactttctatctttgtccttacatctgtaaaatgagcctcttgtatgcaacatatacttggatcccctgtttttaaattcattgtgatatatatgtatatataattttaatatgctttttgattagtaagtttaaaccatttacatttgaactaattattgataaggaagaacttagaacttattgttgccattttttatttgttttctgtatgtcttaataggtttttgtctcttagtgacttctttttgttgatttttttctgtagtgaaacatttttatgttct

SEQ ID NO: 158877 - DNA, 601 bp, Human
aaaatagccactgtattagttccttctcacgctgctatgaagaaatacctgagactgggtaatttataaagaaaagagatttgatttactcacagttccgcacggctggggagtcctaaggaaacttacaatcatgatggaaggcacctcttcacagggtggcaggagagagaatgagtgctagcaggggaaatgcctgatgtttataaaaccatagatctcatgagaacttgctcactatcacaagatgatatttcaagatgagatttgggttgggacatagccaaaccatatcagccaygtattacttcacattatatctctaatttgcaagatgattttgctaccacacttccctgctaactctcatcccttcccaagcccccaaaccgcacaaatcttttcatccttcagtatcttcttaggttttaaaattgcagacatataattatggatcagtactatgtaaaaattactttcttaacctgctgcagactgttcaatcagattatttaatctttgtaggtgttctactcagtatttctggaagattttatcattttgcttttaatattctttggctttactatatgtgcccatg

SEQ ID NO: 158878 - DNA, 601 bp, Human
atttctaatgaatgtttgatcattagaacatctaatgatgtttgaggcttctggtgggcatggttcttcatttttaatgctgtccaagttgttttcactttgttgattgtctttgataatttcagtaggtagaggagatatttggatttgttattatattctaatctttctttaaagtttcttcacaacaatgttttcatcatctgctactctagattgttcatgcagaagatcatgctttgcttcaggaagattattctgagtcaatgagggtgatttaatttccaagcctgttgtctgytaccttaggctttcagtagctaaactttaccagctcatgtgcctttcctttctgttcagtaatccctgtctagcctagcccccagctccaaatatctgtgaaagttgttgggtcgaaagctctgcagagtcactcgtgcagagtgactttgtattcctgctcaaagtttttgttgttgtttgtttgtttgtttgtttgtttgtttgtttttgagacggagtctcgctctatcgcccaggctggagtgcagtggtgcgatctggtctcactgcaagctccgcctcccaggttcatgccatt

SEQ ID NO: 158879 - DNA, 601 bp, Human
catctaatgatgtttgaggcttctggtgggcatggttcttcatttttaatgctgtccaagttgttttcactttgttgattgtctttgataatttcagtaggtagaggagatatttggatttgttattatattctaatctttctttaaagtttcttcacaacaatgttttcatcatctgctactctagattgttcatgcagaagatcatgctttgcttcaggaagattattctgagtcaatgagggtgatttaatttccaagcctgttgtctgttaccttaggctttcagtagctaaacttyaccagctcatgtgcctttcctttctgttcagtaatccctgtctagcctagcccccagctccaaatatctgtgaaagttgttgggtcgaaagctctgcagagtcactcgtgcagagtgactttgtattcctgctcaaagtttttgttgttgtttgtttgtttgtttgtttgtttgtttgtttttgagacggagtctcgctctatcgcccaggctggagtgcagtggtgcgatctggtctcactgcaagctccgcctcccaggttcatgccattctgctgcctcagcctcccgagtagctgg

SEQ ID NO: 158880 - DNA, 601 bp, Human
tcttcacaacaatgttttcatcatctgctactctagattgttcatgcagaagatcatgctttgcttcaggaagattattctgagtcaatgagggtgatttaatttccaagcctgttgtctgttaccttaggctttcagtagctaaactttaccagctcatgtgcctttcctttctgttcagtaatccctgtctagcctagcccccagctccaaatatctgtgaaagttgttgggtcgaaagctctgcagagtcactcgtgcagagtgactttgtattcctgctcaaagtttttgttgttgtttgtttgtttgtttgtttgtttgtttgtttttgagacggagtctcgctctatcgcccaggctggagtgcagtggtgcgatctggtctcactgcaagctccgcctcccaggttcatgccattctgctgcctcagcctcccgagtagctgggactacagacgcccgctacaacgcccggctagttttttttgtatttttagtagagatgggggtttcaccatgttagccaggatggtctcgatcttctgacctcgtgatccacccgcctcggcttcccaaagtgctaggattacaggcgtga

SEQ ID NO: 158881 - DNA, 601 bp, Human
tgaactaggacaatacagggtccaaatcaacgggagcaagctaataacatcatctctttcagctccatcccaatgagcactgataattttactgtgagttttgataaatttattttaagtaatgaattgtgctaccaaggttgaattctggttgtgacataattttggagtaataagtggattggctggtatgctcataaatgcaaatacattcaacagctatccatacaatctaaacatttgtgcttagatcagttgcccttctatcttatttatttattcatttatttatgaagatagyattgaacaactgagaaatattgaattccatgatacttaaaggataaggcaatctcttcatactatttacaaaaaaaaaataattccaaggcacagagttttattgatatgtccatgtccaaattcaagatgctagttaggataatgcattccatccctttctccactctaaaacattacacatttctatgaactcaactaacattttatatgattgactgctttataaccctacatacatgtcttccaatatagccccttaaatttacctccacattttctcacactctctttaagagat

SEQ ID NO: 158882 - DNA, 601 bp, Human
ttagatcagttgcccttctatcttatttatttattcatttatttatgaagatagcattgaacaactgagaaatattgaattccatgatacttaaaggataaggcaatctcttcatactatttacaaaaaaaaaataattccaaggcacagagttttattgatatgtccatgtccaaattcaagatgctagttaggataatgcattccatccctttctccactctaaaacattacacatttctatgaactcaactaacattttatatgattgactgctttataaccctacatacatgtcttycaatatagccccttaaatttacctccacattttctcacactctctttaagagatcttgcttataaatgcaattacagaattgatgagtaatagcttaagtgtgtgaaacactacagagtatgaatggagggagttaggtcaatggggacaagatattggaaaagaataagtaatgaggaaggctgagaaagaatgaatgattgtgttatagaagatttttcctttaaaatttctcataatctgaagtaactcaggagtggaaaaccaaatattgtatgttctcacttgtaaggaggagct

SEQ ID NO: 158883 - DNA, 601 bp, Human
gagttttattgatatgtccatgtccaaattcaagatgctagttaggataatgcattccatccctttctccactctaaaacattacacatttctatgaactcaactaacattttatatgattgactgctttataaccctacatacatgtcttccaatatagccccttaaatttacctccacattttctcacactctctttaagagatcttgcttataaatgcaattacagaattgatgagtaatagcttaagtgtgtgaaacactacagagtatgaatggagggagttaggtcaatggggasaagatattggaaaagaataagtaatgaggaaggctgagaaagaatgaatgattgtgttatagaagatttttcctttaaaatttctcataatctgaagtaactcaggagtggaaaaccaaatattgtatgttctcacttgtaaggaggagctaagctatgagtacacaaaggcatacagagtgatctaataaactttcaagactcagaagcgggaggctgggagggaggtgagggatacaaaactatatattgggtacaatgtacactacttgggtaatggctgccctaaaatctcagaat

SEQ ID NO: 158884 - DNA, 601 bp, Human
aactggtgtgtggaagtcacagcttcatcaaggtgggaactggatagaggagaatgagtttgctaaagaggcaaataattttgcttaggctttgggaacaccaggttcctcatgtattactcagagagtccagcgagtggaaggagaacctaaacaatgcccttgcatttgtaactggaagattttcagaaggatattaaggtaaaggcattcatacagctctagaaaggatacaatactagtgttaattgatttaaagatgtgtctagcggcagggaacatagggctcaagagcaagggytctgaataagacagatctgatttgaatcctggatttaagaagcactagttggctgatattggggaaacagtttcattggtcctctaaaataatggaagtctccacttcattgggatggtttaaacattcagacaatgtatacatattaattatctcacaacctggcacatcataataaactgatctgtggtagatagttttatttttaggaaggtaaagcattggagggacttttaggcaaaggaaatgatacatgaaaattccaaaagtgtgacatagcgtaatgagttctgtacaact

SEQ ID NO: 158885 - DNA, 601 bp, Human
ctctagaaaggatacaatactagtgttaattgatttaaagatgtgtctagcggcagggaacatagggctcaagagcaagggctctgaataagacagatctgatttgaatcctggatttaagaagcactagttggctgatattggggaaacagtttcattggtcctctaaaataatggaagtctccacttcattgggatggtttaaacattcagacaatgtatacatattaattatctcacaacctggcacatcataataaactgatctgtggtagatagttttatttttaggaaggtaaarcattggagggacttttaggcaaaggaaatgatacatgaaaattccaaaagtgtgacatagcgtaatgagttctgtacaactgaaattcagtagatgcagaagactgtgggacccaaagattaaaaaaaagggactactgaggcccaaagatgaaaaagaaatagaagtgtggctttttcaaaagtaaattaatggaaactttattgttgaaaatacatgaaaaattgaaacaaaattatgcagaagaatgcctgatcactttgatattttagcaaaaaatattccggtgtctatctatgg

SEQ ID NO: 158886 - DNA, 601 bp, Human
tctagaaaggatacaatactagtgttaattgatttaaagatgtgtctagcggcagggaacatagggctcaagagcaagggctctgaataagacagatctgatttgaatcctggatttaagaagcactagttggctgatattggggaaacagtttcattggtcctctaaaataatggaagtctccacttcattgggatggtttaaacattcagacaatgtatacatattaattatctcacaacctggcacatcataataaactgatctgtggtagatagttttatttttaggaaggtaaagcattggagggacttttaggcaaaggaaatgatacatgaaaattccaaaagtgtgacatagcgtaatgagttctgtacaactgaaattcagtagatgcagaagactgtgggacccaaagattaaaaaaaagggactactgaggcccaaagatgaaaaagaaatagaagtgtggctttttcaaaagtaaattaatggaaactttattgttgaaaatacatgaaaaattgaaacaaaattatgcagaagaatgcctgatcactttgatattttagcaaaaaatattccggtgtctatctatgga

SEQ ID NO: 158887 - DNA, 601 bp, Human
taatgaaaggaccggccgggcgcagtggctcacgcctgtaatcccagcactttgggaggccgaggtgggaggatcacctgaggtcaggagttcaagaccagcctggccaacatggtgaaactccatctctactaaaaatacaaaaaaattagccgggtgtggcgggatgcgcctgtaatcccagctacttgggaggctgaggcaggagaatcacttgaagagagtgttgcagtgagccaagatcgtgccattgcactccagcctgggcaacaagagcgaaaactccatctcaaaaaaaaawaataataataataaaaaggaaaggaccaacgaccagaattaacagtgctgacaggtaggaaggtagggtagagatgtggtaaagggaatttaagattccaacgtaactgagcaggaagaccgcatatcttagctaatctttacagagacagaaatggatgcttagaaagagaaagcaccttgcccagtcagtggcagggagagatgagatacaaatcctcggctgggtatagtggctctcgcctataatcccaacactttaagagaccaaggtaagaagatcacttgagcccaggagatc

SEQ ID NO: 158888 - DNA, 601 bp, Human
actgcccaaatgcactgtcgatggaatggatgaatacgttgtgatatacttacacaaaacacaccatacagcaacaagaatgaacaatctacaaatacacgccaatcaatttctgaattccaggtcactcccatcataaaatacacaaggactaagctaaaatctcccttgttgtcagaacttgcttcaagtcctaagggcatggttagagatcagagtattttaactgaataggaaaatactttgaggtcactaggcttaagtttttgttgttgttgttttttgttttttgtttttttttgagacacagtttcactcttattgcccaggctgaaatgcaatggcacaatctcagctcaccgcagggtgagctccacctccagggttcaagcaattctcccgcctcagcctcccaagtagctgggattataggtatgcgccaccacacccggctaatttctgtatttttagtagagacggggtttctccatgttggtcaggttagtctcgaactgctgacctcaggtgatccacctgcctcgacctcccaagcaggcttaagatttttaaaaattaaagtaaaagtaaaaaaataaaataa

SEQ ID NO: 158889 - DNA, 601 bp, Human
agggtgaatacacaagatgcctgctgagccctaggggctgaggataccactcagcccagcccaatcagctttcccaggaaagctttaggcccagagcccagccctccaacccactgatctggaaaacacccagggcaggccagagaccacccaggaatcccaataaatcctgcctacttcaccatcaccaactgggagggaagctgagctcttggcattagctgtatattttgctacttaaaaactgagctgccgggcgtgttggctcacgcctgtaatcccagcactttgggaggctgargtgggcagatcacaaggtcaggagatcgagatcgagatcatcctggctaacacggtgaaaccccgtctctactaaaaatacaaaaaattagccaggcgtggtggcgggcgcctgtagtcccagctactcgggaggctgaggcaggagaatggcgtgaacccgggaggcggagcttgcagtgagccgagatcgcgccactgcactccaacctgggtgacagagcgaaactccgtctccaaaaaaaaaaaacaaaaaaacaaaaaaaactgagctaacactacacacatagcagaatggcta

SEQ ID NO: 158890 - DNA, 601 bp, Human
ctaaccactgactaggatggccctgtgactcttgggtcaagttgggctgcctcaccctgtccaagtctgggtggaccaaggccacgtagtcattgcaggtggtgacattgcccaaggctgagagccgctcctccacccgcctaatctgcactgtgtctgggaggctgttgcgaatgtgttgcagctcctggtcggtggtattgttgggtaccaggagaccgtgcctgttccctggagaaacccaaattagagggtgaatacacaagatgcctgctgagccctaggggctgaggataccacycagcccagcccaatcagctttcccaggaaagctttaggcccagagcccagccctccaacccactgatctggaaaacacccagggcaggccagagaccacccaggaatcccaataaatcctgcctacttcaccatcaccaactgggagggaagctgagctcttggcattagctgtatattttgctacttaaaaactgagctgccgggcgtgttggctcacgcctgtaatcccagcactttgggaggctgaggtgggcagatcacaaggtcaggagatcgagatcgagatcatcctggctaa

SEQ ID NO: 158891 - DNA, 601 bp, Human
cctgctcctccctgacctgcagccccagtcccaaactgtggcaggtaatgacccagactcccaaacactaggcgaaaggatctgcctcgggagacggggttcagaggacaggaatgcttaccacaagggggacttgaagaagagaggacagctcatcctggtcttcaattgaagtcttgggatgcaccagccctccctgattgctgaagacacagtagcttcctactagcacctggtcggccactgtctgtctgaagacttccaccttgagcacatctgccagaatttcttctgtctcctrtcaatcaaagatattgtgttcagggctcagaacttacagccccagaaccaaggttctccatgcccagaagcatccaggccttggctccctgagcccctcatttctcctctgtacctcatatgaaagcctcacccagagaaaggaggaagtacagcttagagcagagtcaagggcagctgtgaagcccctaatattcatgcatgccctgaacagctggaggctggtctcaatatcacttctttcccctctcacccacagtcaaaagttcaacagtcaatcacctatcctggcccaggatgc

SEQ ID NO: 158892 - DNA, 601 bp, Human
aggttggccacagtccagagccaggagcccatggaacaacttggaaggtgactcaggtgaggctgaagagaaaggaaagcgcacggtcagtagctgtttcacagagcccacctcactctcaagtgaggtgcctgcctcagccctcatcccgggaccagctctgacaagctgctcaagcagctactgctctagtatcctagccctgaaaaaccacaaagatgaggattagcagatgctcaagaaatattttttgaatatgctggctcttatctgctcagcagtgtacagatatgctctcacwctcgagaagctaccagaacaaactggtaggctcccattctagatgacatcttttccccatactctcaaaatgcaagttaacccccaaccctgagcagaagaaaggagaggccccaggtacctgtcaatgagggaatcccgcatgctggtggcaatggtgctaggctgggcttcattcagcttgaagacactctccaccactgacagctctgtgctggttgtgtccaggccacagaaggcacaccagtcattcaccaccatcccagcagcaatcacctcactgcctcggttcacagtcccc

SEQ ID NO: 158893 - DNA, 601 bp, Human
agagacggggtttctccgtgttaatcaggctggcctcgaactcccgacctcaggtgatccgcccgcctcggcctcccaaatcgctgggattacaggcgtgagccaccgcgcccggccaggagaccaactcttgacggagcctccctgaggggcggggcttcagagggcggagctggagccgggatagggctgcggtgggaccaaagcctgtgagagacttcccagctgtctggcttgtggactgagcaatctgcggcccggtctcgaggggaaaataggtctgtggtccgcaaggccccartggagcccttgggttcccgcagaaccgactgggtctccagtagtctctgaggagccgctcgaccttctcccgaccctggatctgaggcaggagatgcctcccccgcgggtgttcaagagctttctgagtacgggccaggccagctgcgatcccctctgaccctcgggttcccctctccgaactccagttctctctgagcccccggcccccgtttgagtatcgagcccctctccgagcctcaactcattcctagcccccatccaattatcctagccgaccctctcttcctgagccccaggc

SEQ ID NO: 158894 - DNA, 601 bp, Human
ctcagagaggggaagttatttttccaaggtaatacaactaacagttggcaggattaaatttaaaacctggtttcttcccgggaggtggagcttgcagtgagccaagatctcaccactgcactccagcctgggtgacagagcaacactccgtctcaaaataaataaataaataaaacctggtttcttagagcccacattctgaattacagtgtacgaccatcaaaaaatacatgagaacatgcatatagctattgaatacatagaagatcctcagcaaagttttcttctccccgccccccccgccccacctgtccccctcatagttcctcctttcattcttcacccaccagggcctccaggtttatgatgaaactgaagtttccttggggaaattcaccttcgatgttgagaaatcggagattcagactttccacctgcaggtgtgtttgtctctagggtgaaggtgccaagggagtggggcagtgagggatgaatgatccaggaggagggcagcccttggcatgatccatttgtctccccagaatgaccccccagctgcctttcccaaggtgaagatccagattctaagcaactggggcca

SEQ ID NO: 158895 - DNA, 601 bp, Human
cactcgaattctggttctgccaaaccagccttgtgatcttgggtaaattccctaccacctctggactccatcagtaaaattgggggtggactaggtgatctcatagatccttcctgctggaacattctatggcttgaattatattctcctaattattgtcaaaattgctgttattaagtatctactgtgtgccaggcactttaaataaatattgtgtctaatcttcaaaacaaatttgcaaggaaggtttttggagataaggaaactgagactcaggattaagtaacacacctaaagtcamaggtgagcttggaactgaacccaagtgtgcccccactccactggaatttgcttgccaggatgccaatgagttgtagcttcatttttcttagagactttcctggctgtggttgaacaatgaaaaggccctctagtggtgtttgttttagggacacttaggtgataacaattctggtattctttcccagacatgtaacaagagtaacatgtgtgaaagcagcaaagaggcactggcagaaaacaacctgaaccttccaaagatggctgaaaaagatggatgcttccaatctggattcaatga

SEQ ID NO: 158896 - DNA, 601 bp, Human
ccaatctggattcaatgaggtaccaacttgtcgcactcacttttcactattccttaggcaaaacttctccctcttgcatgcagtgcctgtatacatatagatccaggcagcaacaaaaagtgggtaaatgtaaagaatgttatgtaaatttcatgaggaggccaacttcaagcttttttaaaggcagtttattcttggacaggtatggccagagatggtgccactgtggtgagattttaacaactgtcaaatgtttaaaactcccacaggtttaattagttcatcctgggaaaggtactckcagggccttttccctctctggctgcccctggcagggtccaggtctgccctccctccctgcccagctcattctccacagtgagataacctgcactgtcttctgattattttataaaaggaggttccagcccagcattaacaagggcaagagtgcaggaagaacatcaagggggacaatcagagaaggatccccattgccacattctagcatctgttgggctttggataaaactaattacatggggcctctgattgtccagttatttaaaatggtgctgtccaatgtcccaaaacatgctgc

SEQ ID NO: 158897 - DNA, 601 bp, Human
tcaataagaaggggcctagaatgaaacccttggtgctgatcctgcctctgccatttctacttaagccagggtttctcatatgttaacatgcatgggaattccctgggcatcttcttgtggtgtggagtctgacttagcaagcctcgggtgggtttgagggtcaaatttctaccaggcttatatccctggtgatgctgcagaattccaggaccacacttggaggtttaaggccttccacaagttacttatcccatatggtgggtctatggaaaggtgtttcccagtcctctttacaccaccrgatcagtggtctttcaacagatcctaaagggatggtgagagggaaactggagaaaagtatcagatttagaggccactgaagaacccatattaaaatgcctttaagtatgggctcttcattcatatactaaatatgaactatgtgccaggcattatttcatatgacagaatacaaacaaataagatagtgatgctggtcaggcttggtggctcatgcctgtattccctaaactttgggagcctaaggtgagaactccttgaactcctaaggccaggagttcaagaccagcctggataacat

SEQ ID NO: 158898 - DNA, 601 bp, Human
gaggtatgggtcccaggacctctcgaattggagccactcggaaatccagcggtagagtttcgaaaacttccgaacggttcccggaatacgctctcggccctctaaccgaagagttccgaatattcccgagcgttgagcgaattgtcggcggaagcagccgaacatcatcgagccgcctcggaggtggggaccgacaactcctgtcgtgcccgcccggagaggaagcggaaatgcgtgtacggtattaaaggcgtcgcctcgcccctcgccttcctctttccgtctcaggtcgccgctgcgragggaggtgagcgttcgtcttcctcgcgtggtcgccatctccggcccgccgcgcactccctctcagtcctctgcctgccttctccccttgcgcctcaagggtcattggcggaccccaacccctccccgtgaagtcgttgtgaattttcaagttattttcccctcactctcattcgccgcagctagtctcggctgcctgaattcggtcccgccgccttaggtcactcagtcccgcctgacaagagttctaggtcgctgtctgccctcaggggtctcccattcacccaagttcccagtcgct

SEQ ID NO: 158899 - DNA, 601 bp, Human
ctagaaataaaattcaccagtgctcaggacaaggcctagaatataatgtgctcggtgagtgtttgttaaaatgtggaataattctgaatcctatgtccagctgctcccactcctgcagcagagaggagcctgcagtttgccatttccagatctccagggagaagggatctgggggcctgctctgtagacgcgttctggaaggggaaagaaggcatggtcctccatgctctgtatgctcagcggggagttaaacattggaaagaaacagtttctagccccctgggttcctgaatggctcttrttttctgtagtttgggatatactcctgggatcatttgcatgtgcctgcttttctagatccatctccctctcctacaataacaacaaaacaacaacagacattcctgaggcatttctttgaaggcagctgtgctgctggattacccatcaaaaagacagaaaacctcagtagcctggcaacttgagaagccccagccaagatgccccacacctctaccccacttcaataagctgatttaactcagaaaagtgtatatatggtgctggccgctcttgagaaggttatttggtttgggtacag

SEQ ID NO: 158900 - DNA, 601 bp, Human
ctcgtgtgcagaggccagtaacactgctaaacatcctacaatagacaggatagcttcccacaacaaagtatctgggcttcattgaagtttgaaggtagaacagggcttctcaacctcagcactgttacttttggttaagctctaatccctttcaaatttgagcctggatgatttttttttttaaagctaagcccaaaaatgtagtattcatgggaataactcatttttaaacagaacaaaattttcattgtggtaaagacacgtaacaaaatttaccatcttaaccatttttaagtctatrgtttagcagtgttaagtatattcacatcgttgtgaggcaatcttgaataatgatttgtttttgactgactgctattattcaatactcaccatgtactaggttataggatgtgaaagtgagacacagtgcctggtttcaaggaactgtgtggaaagggaagacacatgtgcacagacacagaactgataccaccacgcagagcagaagctgcatgagggctattgcaatatatggcaagattttaatgggtggaaaaaaaatcactggcatgggctgttcagaaaagtcttcctgggagag

SEQ ID NO: 158901 - DNA, 601 bp, Human
ttgagcgcccactctgtacatgcttgttttgggaggtaattgggaaacacttgttcacacatggacttttaatgaaacggatggagccaactaccagctactgaaagacaggcatcgtagcctgggggtggtggggggctgagtgttgcgccctcaaataagcccatgaaggacccacatcttgcctccagcattcccggcccaactggggagccaggcatccacagtgagaggctttgtcttccttggtggttttcaactgagaacaacttgtctaccacctcaagaagacagctggccrtatctggagacacttttggttgtcacaatgagggtgggagagctaccagcacctcgtgtgcagaggccagtaacactgctaaacatcctacaatagacaggatagcttcccacaacaaagtatctgggcttcattgaagtttgaaggtagaacagggcttctcaacctcagcactgttacttttggttaagctctaatccctttcaaatttgagcctggatgatttttttttttaaagctaagcccaaaaatgtagtattcatgggaataactcatttttaaacagaacaaaattttcat

SEQ ID NO: 158902 - DNA, 601 bp, Human
tgccaccatgccaggctaatttttgtattattagtaaagatggggtttcaccatgttggccaggctggtctcgaactcctgacctcaggcaatccgcctgcctcggcctcccaaagtgctgggattacacgcttggctgtgggtctcaccactctttcacccaagctggagtgcagtggtgtgatcatagctcactgcagcctcaaacccctgggctcaagtgatcctcctgtttcagcctcccaagtagctaggactatgggtgtgtgccactatacaaagctaatttttatgtttttcsatggggggagggggtctcactatgttgcccaggctggtctcgaatgcctggcctcaagtgatcctcctgccttggcttcctaaagtgctgagattacaggcacgagccatcctgcccggccaacacacgtttcttgatgagatataggaagaaagttgattactgtgggttttttcctccaatgttttagcttagactcattgtctgtaaagccacttagaatgagacgcacatccgtctggtattgctgaggtactcaaggttagagttttagtcctgcttctatcctccccaactaat

SEQ ID NO: 158903 - DNA, 601 bp, Human
ccaggctggagtgcagtggcacgatcttggctcactgcaacctctgcctcccaggttcaagtgattctcgtgcctcaacctccccagtagctgggattacaggtgtatgccaccacacctggctgatttttgtatttttagtagagatggggtttcaccatgttggccaggctggtctcgatctcctgacctcaagtgatccacccgcctcgacctcccaaagtgctaggattacaggtgtgagccactgcgcctggcctaccatctccaatttataggggaagaaagtaggacaattatwattcctatttttcaagtgggaaaaatgacggtattattatccctattttatggatgaagaaactgagacctagaaaggcagttatttgcctaaatcatagggtgagtttgttgtagctggaccggaagctaaatcttctgtcacagcctccagcttttccctgataataaaaggtcttcctaatacactggggtcagtcttctatgctgtacttcataggcaatgggaatggttcacaggaggcacttattgaagagttggaacacagatctgattccttccttctattgcagtaccacc

SEQ ID NO: 158904 - DNA, 601 bp, Human
acaatcaatagcagcagaaaaacaaggtttgactttggtctttaaggtactgaaaagggaggagtgtatagctaggtgcttcttagagccaagaatggctgttgcaagagggaaaatgaggatgggtgttatttaatagatcccatcttctcaggaatgaagagtgtcagtgttccactaagggttcgtagaaaacaaacactgcagcagggatcagtaagtgcttctcttctgttttcactctgacatttcgagtatgttcccttgttctaggccacaggagccactggaagatgggacrtgcaacactaactgcccacttcttgcctttgcttcttggaggccccaacctttaagaactctggcagagagctgccagagtgattgcgagggtcacagtagattggcattggaataagagtcctcacttcataaaaattgggtttctgcccccaaaaccttatttttgaccaaattaaaattacaaagataggccaggcattggtggctcatgcctgtaatcccagcactttgggaggctgaggcagaaggatcacttcagtccaggagttcgacaccagcctgggcgatatagggagat

SEQ ID NO: 158905 - DNA, 601 bp, Human
caaacggatccaggtggaaaggcagagctagagtatcctgaggtcagctggatttgactgtgttctaaggacatctcaagcctccatgatctctctgtagtagtctggaaccagtgagatggagattgtaaggtgctatgctcagcttttaaaaactgatggtcagatctcaaccataactcaacctcaatctagccctgagactgaaatataggatcagagggcacaggctgaagttagatgcagaggaaaaggaagcacatatttgtctcaaatatgtcttcctaattttggtgctaasagtctttcccaacagaacagggctgcttacagaaatgaaactaagagaaataattcctcatcatcaaattagtgataataattatcaggcaaagagaagatagaaaaaggagattctgagtgccaccaatcctttacagacttttcctcttcttgtaagtttatgtaaagttctatgataggacaacaggacatctttcagccctcctctctcagacagtccccatatgctctattcagaagtactgggttagcagggactacaaaacctgcttgtagtattccaggactttggacacgt

SEQ ID NO: 158906 - DNA, 601 bp, Human
ccaaacggatccaggtggaaaggcagagctagagtatcctgaggtcagctggatttgactgtgttctaaggacatctcaagcctccatgatctctctgtagtagtctggaaccagtgagatggagattgtaaggtgctatgctcagcttttaaaaactgatggtcagatctcaaccataactcaacctcaatctagccctgagactgaaatataggatcagagggcacaggctgaagttagatgcagaggaaaaggaagcacatatttgtctcaaatatgtcttcctaattttggtgctarcagtctttcccaacagaacagggctgcttacagaaatgaaactaagagaaataattcctcatcatcaaattagtgataataattatcaggcaaagagaagatagaaaaaggagattctgagtgccaccaatcctttacagacttttcctcttcttgtaagtttatgtaaagttctatgataggacaacaggacatctttcagccctcctctctcagacagtccccatatgctctattcagaagtactgggttagcagggactacaaaacctgcttgtagtattccaggactttggacacg

SEQ ID NO: 158907 - DNA, 601 bp, Human
accaaacggatccaggtggaaaggcagagctagagtatcctgaggtcagctggatttgactgtgttctaaggacatctcaagcctccatgatctctctgtagtagtctggaaccagtgagatggagattgtaaggtgctatgctcagcttttaaaaactgatggtcagatctcaaccataactcaacctcaatctagccctgagactgaaatataggatcagagggcacaggctgaagttagatgcagaggaaaaggaagcacatatttgtctcaaatatgtcttcctaattttggtgctracagtctttcccaacagaacagggctgcttacagaaatgaaactaagagaaataattcctcatcatcaaattagtgataataattatcaggcaaagagaagatagaaaaaggagattctgagtgccaccaatcctttacagacttttcctcttcttgtaagtttatgtaaagttctatgataggacaacaggacatctttcagccctcctctctcagacagtccccatatgctctattcagaagtactgggttagcagggactacaaaacctgcttgtagtattccaggactttggacac

SEQ ID NO: 158908 - DNA, 601 bp, Human
ctagctgctgggttgtgtgttacgcagacgaggagtaagagtgtggaggccgttcctgacatgcttcctcccaaatgttcctctgtccacttcttgtggtaaaagaggtcatcggggtccattgagtgggtgctttgaaagtgctgcttcatgctctgcccagctgcactgctaaatgcctgaggaaaggagcagagaccaaacggatccaggtggaaaggcagagctagagtatcctgaggtcagctggatttgactgtgttctaaggacatctcaagcctccatgatctctctgtagtrgtctggaaccagtgagatggagattgtaaggtgctatgctcagcttttaaaaactgatggtcagatctcaaccataactcaacctcaatctagccctgagactgaaatataggatcagagggcacaggctgaagttagatgcagaggaaaaggaagcacatatttgtctcaaatatgtcttcctaattttggtgctaacagtctttcccaacagaacagggctgcttacagaaatgaaactaagagaaataattcctcatcatcaaattagtgataataattatcaggcaaagagaagat

SEQ ID NO: 158909 - DNA, 601 bp, Human
agccggtactgaatggctagctgctgggttgtgtgttacgcagacgaggagtaagagtgtggaggccgttcctgacatgcttcctcccaaatgttcctctgtccacttcttgtggtaaaagaggtcatcggggtccattgagtgggtgctttgaaagtgctgcttcatgctctgcccagctgcactgctaaatgcctgaggaaaggagcagagaccaaacggatccaggtggaaaggcagagctagagtatcctgaggtcagctggatttgactgtgttctaaggacatctcaagcctccrtgatctctctgtagtagtctggaaccagtgagatggagattgtaaggtgctatgctcagcttttaaaaactgatggtcagatctcaaccataactcaacctcaatctagccctgagactgaaatataggatcagagggcacaggctgaagttagatgcagaggaaaaggaagcacatatttgtctcaaatatgtcttcctaattttggtgctaacagtctttcccaacagaacagggctgcttacagaaatgaaactaagagaaataattcctcatcatcaaattagtgataataattat

SEQ ID NO: 158910 - DNA, 601 bp, Human
atacttaatccggcaatctttccactaatccacttctgcttgtgtgcaggggctggttttctcctgagaggtgaggcccgcagccggtactgaatggctagctgctgggttgtgtgttacgcagacgaggagtaagagtgtggaggccgttcctgacatgcttcctcccaaatgttcctctgtccacttcttgtggtaaaagaggtcatcggggtccattgagtgggtgctttgaaagtgctgcttcatgctctgcccagctgcactgctaaatgcctgaggaaaggagcagagaccaaayggatccaggtggaaaggcagagctagagtatcctgaggtcagctggatttgactgtgttctaaggacatctcaagcctccatgatctctctgtagtagtctggaaccagtgagatggagattgtaaggtgctatgctcagcttttaaaaactgatggtcagatctcaaccataactcaacctcaatctagccctgagactgaaatataggatcagagggcacaggctgaagttagatgcagaggaaaaggaagcacatatttgtctcaaatatgtcttcctaattttggtgctaacagtc

SEQ ID NO: 158911 - DNA, 601 bp, Human
tgcattctttcaaaggtcattacccaccaatgtttcatgtgaccctcaaaacaaccttatggaattcagggagaggagaggggcaggtacttccctctctattttacaaactaagagattaagacatagaggggttaagtggctttctccaaattccacagctactgatgggtaaaattggatctagaagtcagtctcctgatacttaatccggcaatctttccactaatccacttctgcttgtgtgcaggggctggttttctcctgagaggtgaggcccgcagccggtactgaatggctrgctgctgggttgtgtgttacgcagacgaggagtaagagtgtggaggccgttcctgacatgcttcctcccaaatgttcctctgtccacttcttgtggtaaaagaggtcatcggggtccattgagtgggtgctttgaaagtgctgcttcatgctctgcccagctgcactgctaaatgcctgaggaaaggagcagagaccaaacggatccaggtggaaaggcagagctagagtatcctgaggtcagctggatttgactgtgttctaaggacatctcaagcctccatgatctctctgtagtagt

SEQ ID NO: 158912 - DNA, 601 bp, Human
acatctcatttaatcctcaggatgacactatggaatcagatatttctcacattttacagaggaggaaactgagtctcagagataccaagtgagttgcctaggtccacatcgcagtaagtgatggtgaagtattgaatctcaggaccctccagctgagcgacacgtggtccacccaaagtgacaaggccttcaagactctctgaaaatggcagggctggaaaagtgggctgttttcagagaccacctgccactggaaggcttcaaaaatgagccaaagggcaatattttttggacagattgyggtcataccccaagactgggggttttcaagacttacaagtgtggaaaacactcctggaggctggcttctaccctagacatgacggccccacccttggtgaagaacataaaataactctataaaaacagtcctagtggtttagaagtggtgtgtaggaatgcaatacatacaaagcctcagtactgcattctttcaaaggtcattacccaccaatgtttcatgtgaccctcaaaacaaccttatggaattcagggagaggagaggggcaggtacttccctctctattttacaaactaagag

SEQ ID NO: 158913 - DNA, 601 bp, Human
caagaagccagagtaatcttcctaggagcagctgggagtagccagcacagtgcagtgcactggacagacaagaaatcaggagcccttgcactccacgtggcctgcctccctgggcaagtcatttgcctggctctctgtttccttatctgttctgggaaaatgttaacactggcccagcttacctcatggacttgtcattaggcccaaatcagataatataggtgaaagtgctttgcgtaatgtcaagaaccctgccagtgaaaatcatagtgcctccaaggagctacttaagtttctttctttttttttttttaacaccagacaattgtatgcagaatccattcataaaaaacacacttgtaggaaattgaaagaaaagtaatggggaaaagaaaaggaggcagggtgaggtgggtcaggcctgtaatcccagcactttgggaggccaaggcgggcggatcacttgaggtcaggagttcaaaaccagcctggccaacagggtgaaaccccatctctacaaaaaatacaaaaattagccgggcatggtggctcacgcctgcaatcccagcaactcgggagtctgaggtgggagaatcacttg

SEQ ID NO: 158914 - DNA, 601 bp, Human
agataaagctttgagacttcctagaaatacggctctgcagaacttctctaggaagcctctctaacctattccagcccacagagatcttttccccttctctgaattttattgttattgttgtttttaatttcttttttttttttagagacaggatctcactatgttgcccaggctggagtgcagtggctattcataggtgtaatcatagctcactgtggcccagaactcccagggtcaatcgaccctcctacctcagcctcccaggtagctggaactacaggtgtacaccaccatgcctagytcccttctctgaatttttactgcaattgaatcctaaccacagtatctgtctatatggcttttctcctagttagaaaactcatcaagggcagggatcatggacaaacccttctccaagagagttaaaagagtgtgacttgacaagttgaggtagaagtagatgtggacctactgccaagaagccagagtaatcttcctaggagcagctgggagtagccagcacagtgcagtgcactggacagacaagaaatcaggagcccttgcactccacgtggcctgcctccctgggcaagtcatttgc

SEQ ID NO: 158915 - DNA, 601 bp, Human
ctagcacttctgtggccttgcctcccaccctcccattagctgatctgatggcagaaacagcactcttcctgcattcccacgccctcgctcttccccgctccccatctcaactctggatccagctaggatgcaaggataaagtggccccagcatcttgcccacccccagtgactgatatgactggggtgctgggtgtctaacactgtgctgagggtgtccccttccttctctcttgcagtccttgtgaccacgacctcttgaggcagctaggattacactccccatctcacagtagggtggrcgagtgattttgcccagcactcaccactgcagttagaaatggtggactggagatgcaggcgcaggcagcctggttttggagcctgcattcctctgcctccagatctgtgagcaggcctgatcaaacacaaggaatacacccccaaacaaatgtcttggccccatattgcaaatggcctgggtggtggaggtctgtcccagggttgaccagcactgccaaagagggctcacttgccaaggagaccgcctcttgggtcccagctgcctgccctgtaagaggctactgaggtgggtgagtgat

SEQ ID NO: 158916 - DNA, 601 bp, Human
gagtttggacctttctggtctgaggggacgccaaaaaggctacactactttggagggtctttgtgcaagaggtcaaacccttggcagatttggggaatgcaaagaaagccatggggtctggctgcctgggaacttcttcaacctgtggcctggctcctctcctagggtgcaaactgaacagcctcgggggttcttgatttctagtagaagggtaagggtggcctcttgtctgagacactttagcagcatcagcaggaaaaaggaagctgtctgtgtgcaaagaaacaccaaaacagcagtrgctagcacttctgtggccttgcctcccaccctcccattagctgatctgatggcagaaacagcactcttcctgcattcccacgccctcgctcttccccgctccccatctcaactctggatccagctaggatgcaaggataaagtggccccagcatcttgcccacccccagtgactgatatgactggggtgctgggtgtctaacactgtgctgagggtgtccccttccttctctcttgcagtccttgtgaccacgacctcttgaggcagctaggattacactccccatctcacagtagggtg

SEQ ID NO: 158917 - DNA, 601 bp, Human
tcctgtctttagaggacaagattggctactgttaagttggagataatttccttgcagttctgctgagaaggcagaggccaaacttagataagctttattgaatctttgactacaggaatagaggaggggggtcttgtcatttttgtcatcagccagtttctaaatttctccttggcttggtccttgcagtgtctaggtgaggggaaggctgtggagaggactgtgcaacatgtcattctggagcagggctacaggcaggtggcgttcttatctcctaggagagtttggacctttctggtcygaggggacgccaaaaaggctacactactttggagggtctttgtgcaagaggtcaaacccttggcagatttggggaatgcaaagaaagccatggggtctggctgcctgggaacttcttcaacctgtggcctggctcctctcctagggtgcaaactgaacagcctcgggggttcttgatttctagtagaagggtaagggtggcctcttgtctgagacactttagcagcatcagcaggaaaaaggaagctgtctgtgtgcaaagaaacaccaaaacagcagtagctagcacttctgtggcctt

SEQ ID NO: 158918 - DNA, 601 bp, Human
ccatttcccctaaaggaaataaggaagactacgcttgggaataagaaggatttaagatttttctgcttatgaaggtagacaaatatttgaacccatatttcaaggacattgaaaattcctgtctttagaggacaagattggctactgttaagttggagataatttccttgcagttctgctgagaaggcagaggccaaacttagataagctttattgaatctttgactacaggaatagaggaggggggtcttgtcatttttgtcatcagccagtttctaaatttctccttggcttggtcctwgcagtgtctaggtgaggggaaggctgtggagaggactgtgcaacatgtcattctggagcagggctacaggcaggtggcgttcttatctcctaggagagtttggacctttctggtctgaggggacgccaaaaaggctacactactttggagggtctttgtgcaagaggtcaaacccttggcagatttggggaatgcaaagaaagccatggggtctggctgcctgggaacttcttcaacctgtggcctggctcctctcctagggtgcaaactgaacagcctcgggggttcttgatttctagt

SEQ ID NO: 158919 - DNA, 601 bp, Human
ctgccataaaattcaaaaaaaaaagagaggatttgaggggcctatagaagtggattaaaaaaaaaaagtattcaacaaaccggaaaacagaacctctgtacacagactcaaagcagctgggagtgtcaggtataaggaaagggagagaggaagtttgttatagctaatgcatgtacgtgtgcaccctgccgggcagagggatggcagctccacatggccttcacagctaggaggaaagggacactgcagcgggacaggtgtggagctggtttccatttcccctaaaggaaataaggaagamtacgcttgggaataagaaggatttaagatttttctgcttatgaaggtagacaaatatttgaacccatatttcaaggacattgaaaattcctgtctttagaggacaagattggctactgttaagttggagataatttccttgcagttctgctgagaaggcagaggccaaacttagataagctttattgaatctttgactacaggaatagaggaggggggtcttgtcatttttgtcatcagccagtttctaaatttctccttggcttggtccttgcagtgtctaggtgaggggaaggctgtg

SEQ ID NO: 158920 - DNA, 601 bp, Human
gactacaggcccccgccaccacgcccagctaatttttgtatttttagtagcgacggggtttcaccatattgggcaggctggtctcgaactcctgacctcgtgatccacccgcctcagcctcccaaagtgctgggattacaggcgtaagccaccgcgcccggccgacatagaacacattctaactgcttgtcatcaatgctgggaacatttaagttgaaacgtatttcattttgatttggggacaaacttgattccttcccttagtagtcaattaatcaatatgtccagctgattctactcytaaatctttcttgtttttgtcatctctccatccttgttacttcattcttagttcaggctaccatctctctggcctggacaaatgcctagcctgcttgtctctctgcttcaagtttcagtcttttctttcccaaatgtgaacctaatcatgtgactcctctgctcaaaatctttcagtgattccctgttccttggataaaatctacttacctttcaacatttagctcaagctgggagcctttccaagcactgtcttcccaactttgaagccccgttctctgtgttgcccacattttttccc

SEQ ID NO: 158921 - DNA, 601 bp, Human
aagagtcccaatccctttctaagttatactgctctagagcaggcaaaattttgagcaggatcctgggagcaccaccctggggaaggttctaaccagagacctgctcagcacccctcggggctctagggaggacatggaaggcagacatggagtctagctctgtcgcccaggctggagtgcagtggcgcaatctcggctcactgcaacctccgcctcctgggttcaagtgattctcctacctcagcctcctgagcagctgggactacaggcccccgccaccacgcccagctaatttttgtakttttagtagcgacggggtttcaccatattgggcaggctggtctcgaactcctgacctcgtgatccacccgcctcagcctcccaaagtgctgggattacaggcgtaagccaccgcgcccggccgacatagaacacattctaactgcttgtcatcaatgctgggaacatttaagttgaaacgtatttcattttgatttggggacaaacttgattccttcccttagtagtcaattaatcaatatgtccagctgattctactcttaaatctttcttgtttttgtcatctctccatccttgttac

SEQ ID NO: 158922 - DNA, 601 bp, Human
caacccaaggctctgataaggttccagttctgcccacgcaggccacacggaacagtctttcctcgtcaaagacccagagaggcctggaggtgtgggggagtgggcagacacggatccagcttcacagaaccctcctagaatccttctctattccccgcccacccccacctcaagacattttttagagcgggtgaggggcccacattataaagtccttccgcacctggattattgtacatgtaacataacttgtctgataaagttatacatataacttgactggtgaaagagaaaaacgttaaaaaaaaaaaacccacaaaaagccacacaacagacaaaaaaaaaaaaaaaaaaaaatcaaagcagcccttcctcataaactgcgctttgatcccagcttctataaagtgcacagtggggagtgtggttttgaaacagatcttgcctatcgcacgatagtaacatttccccttctccagcccttttcatctcgaagcacttacaacgttttagaaatctcggaaccccctccaaaggagaggaggtgctctgagccttccggaagggcctctctcttccaaggacacaccagcagaggagg

SEQ ID NO: 158923 - DNA, 601 bp, Human
cactaacttcttgcaaggcgagtggagtgccaggatgttcacagacatgaatcctttattttctgcccccatgattttgttggtctccttatttcactggccagaagccacaatcaaaggccataaaagaagtcaagatagaaagctacgagattattatcccaagagtcctgagtctgagtacactcttcacatcagaggggacagagtggccccaccgtgtactgtcctgtggtagacaacaccaaaaacaccttggaagagcttgtcctgtatccttccgggctcagtcaacccattyttaaccctaaatcaatatacagtcatgtgctacataatgacattttgggcaacaacagactatttataccttggtggtcccataagattataagaccatatttttactgtatcttttctctgtttagatatgtttaatgcacaaatacaactgcctacagtgctcagtacagtaacatgctgtataggtttgtagactagcagcaacaggttacaccatgtagcctaggtgtgtagtagactatgccacctagtttcatgtcagtacactctatgatgtttgcataatgactaaatcatc

SEQ ID NO: 158924 - DNA, 601 bp, Human
gatatcaacgttctaatccctgagatttgtgactatgttttttaaatgacaaaaggaactttgcaaatgtgattaagttaaggattttttttttggagacagagtttcgctcttgttgcccaggctggagtgcaatggcgcagtctcagctctctgcaacctctgcctcccatgttaaaacgattctcctgcctcagcctcccaagtagctgggattacaggtgtccgccaccacgcctggctaatttttgtatttttagtagagacgggtttcaccatgttggccaggctggtctcgaaytcctgaactcaggtgatccacccacctcggcctcccaaagtgctgggattacaggcctgagccaccgcgcccagccaagttaaggatcttgagatggggagattatcctggattatccagagggaccagtgttgtcacaggagtcctttcaagagggaggcaagaaggtcagagttataaaaagacatgtgatcatggaaacatcagacagagagaaagagagatttgaagatgctacactgctggctttgaagatgaaagatggggccatgagccaaagaatgtgggaggtccctagaa

SEQ ID NO: 158925 - DNA, 601 bp, Human
agtcaggcaggaggaggaaaactcagattctagcaacctggaacactgcccagagtccagggcctcccagctgccaagcaggagagatgggctcaatgctttctgcaggactggcagagggattcagagtcctcgctgcagacctgcaactggcttgctcactgtggagcgctgggttccctacagagaaggtgccctcagccccatcccagctctgatcccagactttgatctccaggaattacagaagtctctccttcacttcctccccttggcaatgacagcagatctctttgggatggggggcagttgaaggcagaattatggccatccaagatatcaacgttctaatccctgagatttgtgactatgttttttaaatgacaaaaggaactttgcaaatgtgattaagttaaggattttttttttggagacagagtttcgctcttgttgcccaggctggagtgcaatggcgcagtctcagctctctgcaacctctgcctcccatgttaaaacgattctcctgcctcagcctcccaagtagctgggattacaggtgtccgccaccacgcctggctaatttttgtatttttagtagaga

SEQ ID NO: 158926 - DNA, 601 bp, Human
gggtaaaaaataagatgaaagactattaagaagacaagagttcaagaagatgctgaagtcaggggctggttacttaatccacccagtttgaagaactcaacatcaaggtgacagaagagatacaaataatgagtcaggcaggaggaggaaaactcagattctagcaacctggaacactgcccagagtccagggcctcccagctgccaagcaggagagatgggctcaatgctttctgcaggactggcagagggattcagagtcctcgctgcagacctgcaactggcttgctcactgtggagsgctgggttccctacagagaaggtgccctcagccccatcccagctctgatcccagactttgatctccaggaattacagaagtctctccttcacttcctccccttggcaatgacagcagatctctttgggatggggggcagttgaaggcagaattatggccatccaagatatcaacgttctaatccctgagatttgtgactatgttttttaaatgacaaaaggaactttgcaaatgtgattaagttaaggattttttttttggagacagagtttcgctcttgttgcccaggctggagtgcaa

SEQ ID NO: 158927 - DNA, 601 bp, Human
ggccgggcatggtggctcacgcttgtaatcccagcactttgggaggtcaaggtgggcagatcatgaggtcaggagttcgagaccagtctggctaacacagtgaaacccgtctctaccaaaaatacaaaaattagctgggcgtggtggtggcgcgcctgtaatcccagctactcaggaggctgaggcaggaaaatcacttgtacccgggaggcggaggttgcagtgagccgagattgtgccagtgttctccagcgtgggtgacagagctagaccacatctcaaaaaaaaaagaaaaaaaaatttttttttttttaagacaccaagggcaagtaaatgttttcatgtttttaaatctcaggacttatcattggcgcctgcaaatagtagatgctcagcaagtatttaataaatgaattttaaaatatcacaattcattagccttccaatatcatctcagtctacacattccacagcgcacatcaacctcttctgctccccaggaaccccatcaaaaggagacacaatccctagttggcttcatgttgccaaagggcaacagggaacttgacttcaagagcagaagctcctgactcctcatgga

SEQ ID NO: 158928 - DNA, 601 bp, Human
acctgcttctggccgggcatggtggctcacgcttgtaatcccagcactttgggaggtcaaggtgggcagatcatgaggtcaggagttcgagaccagtctggctaacacagtgaaacccgtctctaccaaaaatacaaaaattagctgggcgtggtggtggcgcgcctgtaatcccagctactcaggaggctgaggcaggaaaatcacttgtacccgggaggcggaggttgcagtgagccgagattgtgccagtgttctccagcgtgggtgacagagctagaccacatctcaaaaaaaaaagaaaaaaaaatttttttttttttaagacaccaagggcaagtaaatgttttcatgtttttaaatctcaggacttatcattggcgcctgcaaatagtagatgctcagcaagtatttaataaatgaattttaaaatatcacaattcattagccttccaatatcatctcagtctacacattccacagcgcacatcaacctcttctgctccccaggaaccccatcaaaaggagacacaatccctagttggcttcatgttgccaaagggcaacagggaacttgacttcaagagcagaagctcctgac

SEQ ID NO: 158929 - DNA, 601 bp, Human
ttaaacacaatttttttttttttttttttttttggctaataggcatgtagttgtatttcattatggttttgatttgcatttccctaatggctaatgatgttgagcaactcttcatgtgcttatttaccatccatttacaaatcttctttggtggcatggggagttgtaattctctataaaaaattttaaaaataagctgggtggtgtggtcgctctgacttcacttgaatggctgatcaagttttatcagtaccgtattcttatatggtacttctactttccaagtatttcccaaccttayttgatgctgagaacatttggttagggtaggatggtcctgacattaaccgtctgtaaccttcctttgtgcgccatctccacctggcaaaccccttctcctctttcaagatccagcttaaatgtcacctgttctgtgaatctctataattcagcatgttatttattcctaacaacatgcctgcaagggaagatatatcagctgtgttttgtagacgaggaacaaagtttgttccttctctctagaacaatcccagaccactttgtttatatctaatgttgggatgtatttcttttttctttt

SEQ ID NO: 158930 - DNA, 601 bp, Human
ccatagacatttgggttgctcacagtgtgggactattatgaatagagttgtgataaatacttgtgtagatgtcttttttctttttgtggattgtagagatctttgagtggggttttcattgctcttgagtaaatccccaggaatgagatcctgggccatagagtaaatgtgtttaactttctaagaaactgccaaactgtcttccacagtggctgtctcattttgcattcctactctcatgtcagagttcctgttgctctgtatctttcccagcatttggtattgtcagtttaaacacaawttttttttttttttttttttttggctaataggcatgtagttgtatttcattatggttttgatttgcatttccctaatggctaatgatgttgagcaactcttcatgtgcttatttaccatccatttacaaatcttctttggtggcatggggagttgtaattctctataaaaaattttaaaaataagctgggtggtgtggtcgctctgacttcacttgaatggctgatcaagttttatcagtaccgtattcttatatggtacttctactttccaagtatttcccaaccttatttgatgctga

SEQ ID NO: 158931 - DNA, 601 bp, Human
agcttcccagctgtgaagatgtcttgaacccgggtggcccaccgcacactggaacagttgacccatgtgaggagcactgaaatgaaagacccccaaacagaccttcaggggctgtatctggctgcatgatgcccaaggcacacaagcagaactgctccctcatcctgacgatgacattgtagtaggtgagccagacatccagcaagctcaaccccagggaccagagactttggctaggttaatgggttacaaatggggattatatgtcccaaattagagcttgggcccagcatgccctgckgagggctggaagccagaagtaggcatggaagtgtaggcactggctttgggggtaaaatcacatctgatcagggcacaagtatgggctttgtcttcaagttattatttgtgcaagagaagctgtgagcagctggtgggagtcaggaagccaccttcctgagcctgattttggggtaacagaggcttaggggaatcttatgttacttaggtttattgagatataatctacatcttactaaaactcacctttttaaagtgtacagtttgatgagatttgacaaatgcatttaatggcttaatc

SEQ ID NO: 158932 - DNA, 601 bp, Human
tgggattacaggtgtgagccaccacactcggccgatatgtggggtctttacctagctgtgctacagccttgaggtaagcatgggagaggtgacctttgcagcctaaagggagcattccctactcccagccacctcggggaaaatggtttctccttcccttttgtcaagcaagggaagaagaagagaagtcactcaaggctagaattggggaaatctcagggtgtggcatacttccaaagctgggctgagagggtgtgtacatgcaaggggaggaaagctgggcagtacctgtttttcctgygatactcacctttgcatatctgtacaatccccatgatgataatcagggccaaggccaggagcttcccagctgtgaagatgtcttgaacccgggtggcccaccgcacactggaacagttgacccatgtgaggagcactgaaatgaaagacccccaaacagaccttcaggggctgtatctggctgcatgatgcccaaggcacacaagcagaactgctccctcatcctgacgatgacattgtagtaggtgagccagacatccagcaagctcaaccccagggaccagagactttggctaggtta

SEQ ID NO: 158933 - DNA, 601 bp, Human
cttccgagaccccggaaactacgagtccaaatgagggtttaagtgccgttctgaatgctccttttgtaaaaggcaaagttatttaaaaggaaaggacatggtaaattgggctttggaaatacaggattggagtcattggtaatctcctgaccactttctctaagtttctacattttcatgaagaagcatccagggttgggcacagtggctcaggcctgtaatccaaacaatctgggaggtcaaggcagaaggaatgcttgaggccagaagtttgagaccagcctgggcaacatagtgagacccccatctccaccactaatttaaaaagttagctgggtgtggtggtgcatgcctataggctcacctatttgagaggctaaggtgggaggatcacttgagcccaggagtttgaggctgcagtgagctatgattgtgccactgcactccagggtggatgacagagcaagaccctgtctccaaaaaagaaaaaagaaaaaaacaaacaaacaaaaaaagcaagcatccagaacaacaaacactcaaacataagtttccataatgctatattagttcaagcttgttttgctgcttgctttgttga

SEQ ID NO: 158934 - DNA, 601 bp, Human
ggcttccgagaccccggaaactacgagtccaaatgagggtttaagtgccgttctgaatgctccttttgtaaaaggcaaagttatttaaaaggaaaggacatggtaaattgggctttggaaatacaggattggagtcattggtaatctcctgaccactttctctaagtttctacattttcatgaagaagcatccagggttgggcacagtggctcaggcctgtaatccaaacaatctgggaggtcaaggcagaaggaatgcttgaggccagaagtttgagaccagcctgggcaacatagtgaracccccatctccaccactaatttaaaaagttagctgggtgtggtggtgcatgcctataggctcacctatttgagaggctaaggtgggaggatcacttgagcccaggagtttgaggctgcagtgagctatgattgtgccactgcactccagggtggatgacagagcaagaccctgtctccaaaaaagaaaaaagaaaaaaacaaacaaacaaaaaaagcaagcatccagaacaacaaacactcaaacataagtttccataatgctatattagttcaagcttgttttgctgcttgctttgtt

SEQ ID NO: 158935 - DNA, 601 bp, Human
atctgtcaggcagatccaggctcaaatccttgccctccagctaggagctgtgagaccttgagcaaagtttatgatttttgagcctctgtctcccaactgcaaaatagggattaatccagaatcacagggtgagaatttctcaattcatcaaaacagatgagttgggggtaaaataataggaatgagcccctccttagtctgagaaagaaaaggctgtgaagctatagatgaatcttcatgtatttaaggactatacaatgcaggagaccagccttttctatattccctgagccaggtttayagcacattaccaaggagagattgttcagaatagaaggctgttggtcataagaacaggctgccccaggagatgggaggacctctttctttacagtcttttgagataaggccagtgaagagactggcaggctgggtggtggcccagcctgatgccaggtgagggagcaaggtgcctcccaggtccttcttagatgtgaaggatcccaaccccttgcaccagcatggtctctttccccaaagagcacacctgacttctgcttctggaggagaaggcagagagaaaaggcatgtcttgtgcaag

SEQ ID NO: 158936 - DNA, 601 bp, Human
ctgacacacacgccctcatgtgagcagtcacccctctgcaagcccaacatccagatgcccacacagacccctgctgacagagacaagcccaccatatacaaatagcaaagtgcacagcagagtggcccctggccggggaagggcccaggcagcactcaccgagaggaggtgaagagagacccattaactcctccaaatgtggacagggcaacagaaatgggcatgatccaggccatgactcctaggagcttctctccaaaagtctgggagaggaaccaaggagataagcaaaggagaggtyaccactccccgacccctcagctcccacttcactctgggaaaccgtttctcctatctccacccttgctaattctctctcgccaagcttcttaattgcccccaccctctcaagggtggacccctacacagggtggttaatgcatgttttaggctaattaactgaaggaggtagtacacactggtaataataataatgaactaacacttactaatcttgttttatgggtgaggaactgagtcacatagtgattaagtagcttgcctaagattacacacccagcgagtggaggggccagcattg

SEQ ID NO: 158937 - DNA, 601 bp, Human
ggagacgatgacattaagcataacacacatccacacactctgactcttcaggaaggatcatcctctccctacccgagaacacaaaggagtgacagagagataaagaaggagggaaggagaaggaaggaagaaggaactggaaagatgagcaggggaggcctgggtgggtgaggtctggcctctgaatcggaggtggagcacaccatgcgccaccgtttcctgcatgcacacacgactagaccacatgcacgcagaccgctgctaggcctgcctgagggacaaaccccactctaaagtgacygtagccagtcactctcctccaatagatctcagggagcctcacgggtcactgttcctccaccgcttggcctcggcggggcctccgtgtggccactgctcctgtgtaacatgcacacgaggttgctgtgggtgagcgtcacagggtcccggggtacaggggacacccacaccacctctttccagccctgggtcctaaaaacattgcactcccttgttatttcacaggaactcttcctgatgtgacggctttggaagcagctgaactcacggactcatctttggagcaggactgtactttctg

SEQ ID NO: 158938 - DNA, 601 bp, Human
agatatattttttttgaggctgtagaatcctgagacagtcagttcagtctgacccaaaaggatgggagaacggaaataagtcagcctgagagccttaggtatttcaagactcaggatctttccttgctatatctcttgatattaacaaagatgatgggtatcatttgccagatcctctaagatccagtgagacctagcagcagactgcaagggtaacaggggtgtgtgtgaaaagcatgaactcccagcttagactaggcacaaagagagggaggtgtgtggagagttacagcaggaaggkcccttactgtgaagagcagggctgggattggggtgcagcgcttcacgtggatcatggccaacacactgggaaggtggccctctcgggctccagcgaagaacagcctgtcagggagaaaagcaggtcagcctgggataacccagggaccaccaagccccagctccttcatccttgcctaccttctgcccacacaggggcatccccactccaaccaggcacccgccttcacatgcatactttccaccccaccagtcacagaacctgtgttcacaaatgcaggtgcaagcaaaccagaggcag

SEQ ID NO: 158939 - DNA, 601 bp, Human
atagttgatgagtgtgtacatgtcgctggtgaccagcatcagcagggtggagatgcactgggaaagtgggaggagctcatcagtgatccgaaagatattcagagactggtattacagattaggggctgtcccccagcctccaggcagatgatgccatcgtataatggatgtctcgaaatggagactttagaacctcccctagtaacccaatatgttacaacatctttattgctaggaaatcctttcttattacaggggtgatgatcaaaatatttaaccactcgtatggcacgggcactarccaattagaatggatactggacataagcagctagactggccacactggtattacctggctctgtgtcagccccggtctcatttgtatgcctctgttggttatagctcaagctaaattcatttttttaaaatcccttagggaagattgttaacaacagattaaggctgtattcctgccctcatccttttctcctggctgagtcatctatttttcttccttccttttctttattaatttcaaaactggttacatagcacttactgtgtgccaggtctctatgtttagcatttgacaaagatt

SEQ ID NO: 158940 - DNA, 601 bp, Human
aatctgaactgcagctagaaccatagaggaaggggaggggaccccaaagggagtttctctcaccttgatggggcgggggatatcaggcttcttccagcgaaggactatctgtccagcaaccgtgaccccatagaagaggtagttgatgaagcccacatagttgatgagtgtgtacatgtcgctggtgaccagcatcagcagggtggagatgcactgggaaagtgggaggagctcatcagtgatccgaaagatattcagagactggtattacagattaggggctgtcccccagcctccaggyagatgatgccatcgtataatggatgtctcgaaatggagactttagaacctcccctagtaacccaatatgttacaacatctttattgctaggaaatcctttcttattacaggggtgatgatcaaaatatttaaccactcgtatggcacgggcactagccaattagaatggatactggacataagcagctagactggccacactggtattacctggctctgtgtcagccccggtctcatttgtatgcctctgttggttatagctcaagctaaattcatttttttaaaatcccttagggaaga

SEQ ID NO: 158941 - DNA, 601 bp, Human
ccagctgcagtctgctccgatctcatccccagtggagaatggaaatagtggtcccattcacaaatggcccttgctttccaaagggtctgctaccatcagagatgatgacgtgtggtcagcagctaagaacagaggtgatttaaaaatctgaactgcagctagaaccatagaggaaggggaggggaccccaaagggagtttctctcaccttgatggggcgggggatatcaggcttcttccagcgaaggactatctgtccagcaaccgtgaccccatagaagaggtagttgatgaagcccacrtagttgatgagtgtgtacatgtcgctggtgaccagcatcagcagggtggagatgcactgggaaagtgggaggagctcatcagtgatccgaaagatattcagagactggtattacagattaggggctgtcccccagcctccaggcagatgatgccatcgtataatggatgtctcgaaatggagactttagaacctcccctagtaacccaatatgttacaacatctttattgctaggaaatcctttcttattacaggggtgatgatcaaaatatttaaccactcgtatggcacgggcactag

SEQ ID NO: 158942 - DNA, 601 bp, Human
catgggctgctgctgctcctccatgtcctcattagcctcctctgtccctgagccccgctccacctcggggtacacgaccacacacatcttctggctcaccagggttagcagctctgtaggaagagatcacacagaaaccaggccaatgctgagtatcccaccaacctggccaagtggccccggcccttcctggctctcctgctccaggttctgcctcttcagagcagtcagtgcgttgaagagaatcctcgccacctggtctgcctcctgcatctcccgccggctactctttgcttatgarggccccagccttcccaccttccctgtgcccactgacccctaagtccagggtctcctctggtctccacccagcctcgggcagctctcacagaatggctgacaggttgcctattttattttaaaatttttaataacagagatggagtcttgctatgtcgaccaggctggtctcaacctcctgggctcaagtgatcctctgtctcagcctcccaaagtgctgggattacaggcgtgagccactgtgcccagcccaggttgcctattcttgcgggtctaaggtctgtgtggaaatgccagctgt

SEQ ID NO: 158943 - DNA, 601 bp, Human
ccacccctcctcttcctgctcctcctttccccgctttccagtttctcctgcccctgaccccgaccctcctcactcaccccctgtgcttggtcaccggcaccacggtgcgcacgggctgcatgacccctccttcgggaccgctggagaagttggccagggccgtctctagaggcgggatgaggaggctggagctgcggaggtgttcctccacctcggccgcgctcaggaacgctggtacccggctcatctcgccacctgtgccttctaacctcagtctccgcaccgcgatccacgtaccctsggctgtgccctttatgagcgcgcccgctgctctgtggagccgcctgctggtcacagcccagcctccgggggcggagcaaccccgccccgccccgccagccctctcctcccccttcgcccacctcgacccctaagggtgggcgagatgggtcccttccagcaacggattccccaagatggacatcgcggtggcgtgctgggagtcaatattgtttggtccactttctcagttcctgtaatcagctgtagccacattccttgacttttgcttcctacataacccctccctattaactcgctt

SEQ ID NO: 158944 - DNA, 601 bp, Human; identical to SEQ ID NO: 23536

SEQ ID NO: 158945 - DNA, 601 bp, Human; identical to SEQ ID NO: 23537

SEQ ID NO: 158946 - DNA, 601 bp, Human; identical to SEQ ID NO: 23538

SEQ ID NO: 158947 - DNA, 601 bp, Human; identical to SEQ ID NO: 23539

SEQ ID NO: 158948 - DNA, 601 bp, Human; identical to SEQ ID NO: 23540

SEQ ID NO: 158949 - DNA, 601 bp, Human; identical to SEQ ID NO: 23541

SEQ ID NO: 158950 - DNA, 601 bp, Human; identical to SEQ ID NO: 23542

SEQ ID NO: 158951 - DNA, 601 bp, Human; identical to SEQ ID NO: 23543

SEQ ID NO: 158952 - DNA, 601 bp, Human; identical to SEQ ID NO: 23544

SEQ ID NO: 158953 - DNA, 601 bp, Human; identical to SEQ ID NO: 23545

SEQ ID NO: 158954 - DNA, 601 bp, Human; identical to SEQ ID NO: 23546

SEQ ID NO: 158955 - DNA, 601 bp, Human; identical to SEQ ID NO: 23547

SEQ ID NO: 158956 - DNA, 601 bp, Human; identical to SEQ ID NO: 23548

SEQ ID NO: 158957 - DNA, 601 bp, Human; identical to SEQ ID NO: 23549

SEQ ID NO: 158958 - DNA, 601 bp, Human; identical to SEQ ID NO: 23550

SEQ ID NO: 158959 - DNA, 601 bp, Human; identical to SEQ ID NO: 23551

SEQ ID NO: 158960 - DNA, 601 bp, Human; identical to SEQ ID NO: 23552

SEQ ID NO: 158961 - DNA, 601 bp, Human; identical to SEQ ID NO: 23553

SEQ ID NO: 158962 - DNA, 601 bp, Human; identical to SEQ ID NO: 23554

SEQ ID NO: 158963 - DNA, 601 bp, Human; identical to SEQ ID NO: 23555

SEQ ID NO: 158964 - DNA, 601 bp, Human; identical to SEQ ID NO: 23556

SEQ ID NO: 158965 - DNA, 601 bp, Human; identical to SEQ ID NO: 23557

SEQ ID NO: 158966 - DNA, 601 bp, Human; identical to SEQ ID NO: 23558

SEQ ID NO: 158967 - DNA, 601 bp, Human; identical to SEQ ID NO: 23559

SEQ ID NO: 158968 - DNA, 601 bp, Human; identical to SEQ ID NO: 23560

SEQ ID NO: 158969 - DNA, 601 bp, Human; identical to SEQ ID NO: 23561

SEQ ID NO: 158970 - DNA, 601 bp, Human; identical to SEQ ID NO: 23562

SEQ ID NO: 158971 - DNA, 601 bp, Human; identical to SEQ ID NO: 23563

SEQ ID NO: 158972 - DNA, 601 bp, Human; identical to SEQ ID NO: 23564

SEQ ID NO: 158973 - DNA, 601 bp, Human; identical to SEQ ID NO: 23565

SEQ ID NO: 158974 - DNA, 601 bp, Human; identical to SEQ ID NO: 23566

SEQ ID NO: 158975 - DNA, 601 bp, Human; identical to SEQ ID NO: 23567

SEQ ID NO: 158976 - DNA, 601 bp, Human; identical to SEQ ID NO: 23568

SEQ ID NO: 158977 - DNA, 601 bp, Human; identical to SEQ ID NO: 23569

SEQ ID NO: 158978 - DNA, 601 bp, Human; identical to SEQ ID NO: 23570

SEQ ID NO: 158979 - DNA, 601 bp, Human; identical to SEQ ID NO: 23571

SEQ ID NO: 158980 - DNA, 601 bp, Human
ttgccagcatcagcttttccctttttccctttgggtaccttctctcccttctttacaggggactttctaggcttgggctctggctttggaggagcaggtttggcagacaacctcgcggatcttctctgcggttcgtccttcaccttggctttatctcccttagcatccccttcagcctttctcttgggcatggtgacggccacgacggtggcgggatgtaggtgctggatgcgggatgcagctgcgcgcgggctttggtcagtccgggggtcgttctcgcctcttcttcgtcacactgctyctgtatcttctaagtggagcatttaggctatttacattcaatgttagtattgagatgtgaggtattgttccattcatcatgttaattgttgccttaatactttttttttctctgttgtgtttaggccctgtgagatttatgctttaaggaggttctatttttgtgtattttgaggttttgtttcaagatttagaattccttttagcatttcttgtagttctgacttagtagtgacaaaatctctctgtttctttgtctgaaaaatactttctctctcctttatttgtgaagcttagtttc

SEQ ID NO: 158981 - DNA, 601 bp, Human
tattcccctccttgccagcatcagcttttccctttttccctttgggtaccttctctcccttctttacaggggactttctaggcttgggctctggctttggaggagcaggtttggcagacaacctcgcggatcttctctgcggttcgtccttcaccttggctttatctcccttagcatccccttcagcctttctcttgggcatggtgacggccacgacggtggcgggatgtaggtgctggatgcgggatgcagctgcgcgcgggctttggtcagtccgggggtcgttctcgcctcttcttcktcacactgctcctgtatcttctaagtggagcatttaggctatttacattcaatgttagtattgagatgtgaggtattgttccattcatcatgttaattgttgccttaatactttttttttctctgttgtgtttaggccctgtgagatttatgctttaaggaggttctatttttgtgtattttgaggttttgtttcaagatttagaattccttttagcatttcttgtagttctgacttagtagtgacaaaatctctctgtttctttgtctgaaaaatactttctctctcctttatttgtga

SEQ ID NO: 158982 - DNA, 601 bp, Human
atagcttaaaaaaaaaaaaagtaaaacaaaattctgcatttttataaaacttgataaaaatagtatttcaaactgtacagtcaccagaagtacacagttatcaaaaatgtacacacttcacttggcatctccagcaccttcagctttctgtgcctggtctgttttggcatctccattttctgcagggttattcccctccttgccagcatcagcttttccctttttccctttgggtaccttctctcccttctttacaggggactttctaggcttgggctctggctttggaggagcaggtttrgcagacaacctcgcggatcttctctgcggttcgtccttcaccttggctttatctcccttagcatccccttcagcctttctcttgggcatggtgacggccacgacggtggcgggatgtaggtgctggatgcgggatgcagctgcgcgcgggctttggtcagtccgggggtcgttctcgcctcttcttcgtcacactgctcctgtatcttctaagtggagcatttaggctatttacattcaatgttagtattgagatgtgaggtattgttccattcatcatgttaattgttgccttaatact

SEQ ID NO: 158983 - DNA, 601 bp, Human
gtcaggtcccaacagatgtctcggctcaagggagttaagtctatgctgaaagatggaaaaggagaagaggacataaaaacgaatttgtttttctataccacaaggcttttgtgccaaggtggccatgtgtgtcagagtcagggaatccctcctcctgggagccaagaggaagtctctcaaaactagaagggaaaggtgttttcctcacataaatccagctttggagactttctgttagtgacatgtgccccttcccccaaaaacaacaatgaagtgttctgtgtgctaacaacatagcttaaaaaaaaaaaaagtaaaacaaaattctgcatttttataaaacttgataaaaatagtatttcaaactgtacagtcaccagaagtacacagttatcaaaaatgtacacacttcacttggcatctccagcaccttcagctttctgtgcctggtctgttttggcatctccattttctgcagggttattcccctccttgccagcatcagcttttccctttttccctttgggtaccttctctcccttctttacaggggactttctaggcttgggctctggctttggaggagcaggtttggcagaca

SEQ ID NO: 158984 - DNA, 601 bp, Human
gaattctttaagcttcttataaactacgaggctttattttatccttaaaattgatcccatactgtgtgattggtttccacctgttaccggtaaagtatagacttcttttatccaacatttcaactcacatttgatcaggttacgtcaccacacacacaaaattttattcaacgcattccagctttccatttttttccaacagatattcttgctctatacaaataacatgcctcagaactataaataaaataatcaatttcaatgtaataagcaaaaaatgtacaactaagtggactaaaarcaaaagatctaattctcagtgcaccctttccaacccactgaaaataaactatattcaaatgaaaaggcatttaatttactatttggaatatccttgataaacaccaattttctgtaacatccctgcacatctgataccacctcatgtataatgcaaaaaagctatttcattttcatctattgacagtgaatttaatttaccattgcagctcttttcctagaactatcacgttattaattctgcaatcaagctcttttgagtgcttttatttgtactaagggttttcacaattccacattg

SEQ ID NO: 158985 - DNA, 601 bp, Human
acaaactgttcagaattctttaagcttcttataaactacgaggctttattttatccttaaaattgatcccatactgtgtgattggtttccacctgttaccggtaaagtatagacttcttttatccaacatttcaactcacatttgatcaggttacgtcaccacacacacaaaattttattcaacgcattccagctttccatttttttccaacagatattcttgctctatacaaataacatgcctcagaactataaataaaataatcaatttcaatgtaataagcaaaaaatgtacaactargtggactaaaaacaaaagatctaattctcagtgcaccctttccaacccactgaaaataaactatattcaaatgaaaaggcatttaatttactatttggaatatccttgataaacaccaattttctgtaacatccctgcacatctgataccacctcatgtataatgcaaaaaagctatttcattttcatctattgacagtgaatttaatttaccattgcagctcttttcctagaactatcacgttattaattctgcaatcaagctcttttgagtgcttttatttgtactaagggttttcac

SEQ ID NO: 158986 - DNA, 601 bp, Human
cagaaataaacaaaaggataacagcaacagagctggctcaactgaaaagatatgttagactgagtagcagaatcaactggcctgatttcagtctttatctaaggatgctcagcaaccccacagcaaaagtacacaaagtgcaagacaataaaaacataaggctgagccacatgagatcttacattttatcttcaatactaacagctcaagaaagcaaagattacacttttttttttttttttttttgagacagagtctccctctgtcacccaggctggagtgcagtggcacaatctcagckcactgcaacctctgccaactgggctcaagcgattctcctgcctcagcatcccaagcagctgggattacaggcacctgttaccacgcctggctaatttttgtattttcagtagagacggggtttcaccatcttggccaggctggtcttgaactcctgacctcgtgatccacccccccccccccgccccctcggcctcccaaagtgctgggattacaggcgtgagccaccacgcccagccaagattacacatttttaaagattctcagaaatagaaacgagtatcataaaattgggaaaaat

SEQ ID NO: 158987 - DNA, 601 bp, Human
agcagaactgtcagatagagtattttaaaataagtattcttaacacatttcataagaggtttgaacatttacagtaaaaaaaatccgagaaagggtcaaacagcacttctagatttaaaaaatataactgcaattaatgaaccttgtaaagtattttgaatacagaatatcataatgtattttaattcatttatttcccattttcctcctcaaaacacaaacattttgattaaataggagcagcaaatttgaattatttaaaaatctgatttacaatatgcatttatctgtggcttattamatatttcttggcaacaaaccagaccattaaaatattaacaaaaacaaagaagtagatgtgaatgatacgttaagaaaagtttccaatgtaattttttaaaattacatgtttcttgaaatcttacttgctttatctagaaaattctgtttaccacagaaagcaattaggtaatccttagatctatatatacaatttatcaaaaacttcaaagtggcataatcaaagaagcaaaagtggcccattattgacaaataatcacacccaatttcaacttctataaacttgagagcacagtctaaa

SEQ ID NO: 158988 - DNA, 601 bp, Human
tcatcaaaataatagttaccattaataatcaagcatacacagagtatatttatatacatatatacatatatactagtttggctccaatgattgtaagtgagtaccttggaaagtgatttaattttttgtgcttcagttgtctatctttaagaatacatccttcttcataaagtttttgaaagaagtaaataacatatacacagtgtgttgaatatggctttgaaaatagtaaatgttcattagttaactattattattatcattattactatttcactacatcttccttatcatctattascctacctctcaactaataaggcgataaatcccataatatggccaaggctacagatgcaaaaattgtaaaactaaaagtaaaataacatgtgctaagaaacagaacccaccataatcttctttctcacttggcatttcttgttgacaatggcaatttctgtcatcaataaaaattgtggaaaaacggaagtcatcattataaggaaaacatattactatgttagaacacagcaaaaataaatgcatttacccatttttaaaaggctaaatgctactttttaaaatcttccttaagaaatca

SEQ ID NO: 158989 - DNA, 601 bp, Human
ttctatataggaaagttatttttaaaaatggtttagacaggtcattttgcaacatttaacaaaatactattttcatttcagaaagccagataatgccttagacataacaatattgatacgtaaggttatatttttaaaaatattcaaaccatacttatatcattctaaaatactctagcctacataattatattaggatggaataaggtaatattgtttgagcaaagtaaaacagaacacttctgattagaagaacacaaggataatttcccctccttgcctacatatcatgcacctcgcytggatgcaaaagaaaacttatagggagaagatcattttatattaactttgagataaattttcaacaagaaagtagtagttttctaccctttaaagttaaaaaaaaagttgcgattatttctctgaagcatgtagattcatccatactcctggtacgatcactactgtatataatgttcctatttaattttcctttgtcacttctatggctataatgcatctttcctaaaaagagaaatagtaatcaagtttagaaaaatataaaatatactggtagccacattaaagagtctcgttaaag

SEQ ID NO: 158990 - DNA, 601 bp, Human
atttctatataggaaagttatttttaaaaatggtttagacaggtcattttgcaacatttaacaaaatactattttcatttcagaaagccagataatgccttagacataacaatattgatacgtaaggttatatttttaaaaatattcaaaccatacttatatcattctaaaatactctagcctacataattatattaggatggaataaggtaatattgtttgagcaaagtaaaacagaacacttctgattagaagaacacaaggataatttcccctccttgcctacatatcatgcacctcrcttggatgcaaaagaaaacttatagggagaagatcattttatattaactttgagataaattttcaacaagaaagtagtagttttctaccctttaaagttaaaaaaaaagttgcgattatttctctgaagcatgtagattcatccatactcctggtacgatcactactgtatataatgttcctatttaattttcctttgtcacttctatggctataatgcatctttcctaaaaagagaaatagtaatcaagtttagaaaaatataaaatatactggtagccacattaaagagtctcgttaa

SEQ ID NO: 158991 - DNA, 601 bp, Human
aaaataaaaaataaaataaaaaactaatctaaatacaaatcataaacctttcacaaaaattaactcaaaatacaccaaagataaaactctacaactcctagaagataacataggataaaatcagggtgaccttgtgcttgataatgatgttttagatacaccaaaagcagatccatgtaagaacaaaattgatcagccggacttcattaaaattaaaacttctgctctgtggaaaacactattaagaaaatgaaaaggtaagccacagatagggaaaaacacatacctcataaagtactaktatctaaaatatcaaaaaagcactcacaattcaacaattagaaaagacggacaaaaggtctgaaaagacacctcattaaacagataaaatgatgtcaaaaaagcgtacgaaaagatgctcaatatcttatgtatatcaggactgttataacaaagtactacaaactgggtggcttaagtactggaggttgtaagagggaataaggtgttgtcaggggtgatttcttttgaggatgtatctttccaagcctctctccttggcttgtagatggcagcccatattcccatggcattctctctg

SEQ ID NO: 158992 - DNA, 601 bp, Human
tttccctttccacctttccccttacttcatcagcacacaggaggagaaataggtatatgagaaaaaaaaacaaaacaaaacagatcattctccactcactggattgagcaaagagaatgactagacttcaacctcttccaacactctataatctcctagaaaagtccaagtcatattgactgaaagaagagaaattgagttataggttggctatgaggttaaattcaagttaaactgactttactacattaaagtcagattaaattgaagtgctcagaaatctatgacatcatcttgagawgagtaaaagaaacaaaaaagagtgatttgactaatcataaacaaaaaaggtcacactggagaaaaataaaaccactccatgttcccattcccacttaattcaccatcccaattcatactgtattataaaatggttagtaccaatgaggtagtgattttgactattcatttctctaaaacattctatgaatactaggctgaatacctaaattaccacattcttatttattattcttaggaacaaccagcaattacctaactatggctattttgtggagatttcttagcgttttccttgcgt

SEQ ID NO: 158993 - DNA, 601 bp, Human
gcccaggggctggcaattagaaccgaaggctaagaacaaaggcatctatcaagtattttatatttggaagacagacttaaacaaatgagagccaactccacctccataacttaaacatctttaccttccttagttcttccttatccagaagtgccttctcctgtccccatcatgaggcaatcatcagagtttgcttcactgacttaatgtagctgaatagtgctgttgctgagagtccaaatcaagcgagagttcatctaaaagattagtaagaagggaagactggtatctcacctctcakttggacctctgcttgtgtgttagagttgcttattatcccatgcccacttcccttctctgtgcctatttgaagagagggagaaaagacatggagttggaagacaaggtacagataattggactccctctctgcaaaagcaaagagtgtagtgaatgtgaaagtagctggacttgagcctccagttgatggggactcaagcagccagaggctatgaatatagtggagaggtagaaattgagaaagaatagaaaaagacaattcagaaatggttggtatgacactccaaaaacaacccccatg

SEQ ID NO: 158994 - DNA, 601 bp, Human
agattgaatctaatagctagaattcattaattcatttattcactcaacaacaaaaaatccattgtttcctatgggtcaggaactattttaggcactgagtaaagtggtgaacaaagaagtcaatgtcctgccctcttgagaatcatgttaatgtaagtgatataactaactattaaatatacaatttaaggtatgaaaattagtgtataaaccaaaaataaagcaagtgatgggaagagaacaaatatactattttaaatgtattcagagaatactaaggaagcagcattacttaaataawgaatgaatgaagtgactctactctctggggttttagaataccacatacagatggcagatggtagaatgatagcaaagctctgagataggaacatgcgatcaaaaacttaacctgcagtcagatcacctggggccttccaagccataataaggactttgggtttgttttttgtttttactgttttagaaagccattacagtattttgactgagggaatgatataacctgtttaaaagggttacaacagcagctgtagtggaatgaacttcactgtagctaggaagaataaaactactaggc

SEQ ID NO: 158995 - DNA, 601 bp, Human
aaagattgaatctaatagctagaattcattaattcatttattcactcaacaacaaaaaatccattgtttcctatgggtcaggaactattttaggcactgagtaaagtggtgaacaaagaagtcaatgtcctgccctcttgagaatcatgttaatgtaagtgatataactaactattaaatatacaatttaaggtatgaaaattagtgtataaaccaaaaataaagcaagtgatgggaagagaacaaatatactattttaaatgtattcagagaatactaaggaagcagcattacttaaatratgaatgaatgaagtgactctactctctggggttttagaataccacatacagatggcagatggtagaatgatagcaaagctctgagataggaacatgcgatcaaaaacttaacctgcagtcagatcacctggggccttccaagccataataaggactttgggtttgttttttgtttttactgttttagaaagccattacagtattttgactgagggaatgatataacctgtttaaaagggttacaacagcagctgtagtggaatgaacttcactgtagctaggaagaataaaactactag

SEQ ID NO: 158996 - DNA, 601 bp, Human
atgtagcagaaaagagataaaatgtcatactattgactaaaaaaaaaccctaaaataacaaaatataacattccttatcatgttgtgtaacaacagacacagctgtttctaatgatatttctctattttataaggcataaacatgccaaactattactaaagacagcactcttataaaagtgcttttacaaaagaaaatctcattaaataattaaatgggagagactaaaactacagtaagcagaaattcaaatatttactgttccttctcttccccacttttttccccaaatgttaaagaaaaaaaaaaattgagcagagcacagtggctcacacctataatcccagcacttcaggagaccaaggcaggaggatcgcttgaggtcaggagtttgagatcaggttagtctcaaacagtgagaccctatctctacagaaagtaaaaagaaaaaagaaaaaaactagccagttgtggtagcgcatgcctgtagtgccagcttccagctactttgatagctgggaggctatctttgatacttgcaaggctgaggcaggaagatcgcttaagcccaagaggttgaggctgcagtgagccatgatc

SEQ ID NO: 158997 - DNA, 601 bp, Human
aacattaatccatttttaaaggaacttacctaaaggactataaaaaaagaaaaaagaaaaacaaggtaactccaaaacaaagaggacagagataaaccagaaagtcagaaactaagcagggtagtcaaaaccagacaaataaagtgtcaaccgcatcaaggaactatagttgggttatctccaaatactagaagtctttgatgaatccagaaaagcaagagaagaatccattaagacttccaacatacttttactaccaattagttcttccctacttctaatccctgaacttcagaaaacytaggtgatgcacagtgaggagggtgaaaacataaggttaaaaaaaaaaaaaaattaatgcaacagcctactagctgaccaacctatttccttccttattcaggtttttaaaccctctttgagcaaggttgatgtagaaaagacattttatattggaggagaatttaaaactttaattcattaaacattttcttcattatttgaaaatttagtctattttaaaatgccagagtgagaaaagaaggaatgaaagaatgagagagagaaagaaaaaaattgagaagaaaaaaagcaagcagca

SEQ ID NO: 158998 - DNA, 601 bp, Human
atctattaaaaacttcatatttccaacaacatgaaaataaggaagaaaaaagatcactgggctattatatggcaagttgatttatcatctttcagcctttaacaatgtgatttgaagggaaaatatgctttctcttttcttagtataccatctgtactcatctggaactttccaggaaaaagaatttttaaatagaggtaatttttcaattttctctacttaaaatgctttttggatttcttggttatctaatttttacttatttgcctgactatatgtattaaataattctacttttgaytaaatttcagtaataaagactgcattattataaaaagactgcattattattctcttgaggaatggcagaaattcggtgctgcatttcaaattgagacaacttatttagggtaatcactcaaaataacaggataatgtctgaatgaaacagaactttactcccaataaatataacaatttaattttctattataggaatattattcttttacaaccaaccctttttatgaccaataacttgtctttcatcatttctgaccatatctaaagatggaatctgaaaccctgaagaatttaaaaa

SEQ ID NO: 158999 - DNA, 601 bp, Human
ttgtatattcttcacatattaaagctgaccactctaaactctctggtccagtggtgatgaaaagtctaggaagccctggagttcctcccggccagctgaagtgagatatgtgtgattgccaacaccacttgctgcattctcaatttatgacgtgaatggcttggctctggatgaggagcttggctaaggtctatccaacaagtacacccgatcaccctactaggaggcatatttgctctcagcccctaaaagtacaattaagtgtagtatctaatgaagtggttatgcttttttttttttccttttttttctttttagacagaatctcgctctgtcacccaggctggagtgcagtggtgtaatctcggctcacagcaacttccacctcccagattcaagcatttctccggcctcagcctcccaagtagctgggattacaagcgcccaccaccatgcccagctaatttttgtatttttagtagagacggggtttcatcatgttggccaggctggtcttgaactcctgactgcaggtgatctgcccacttctgtctcccaaagtgctgggattacaggcatgagtcaccacgcccagccgaag

SEQ ID NO: 159000 - DNA, 601 bp, Human
ccaccgagccagtattacccagactactgctttcagctcaactgttgaccaatgaagaatcttaatctaaggaaagctgctgattgcaggagtgaacaagccacataacaagattaattttcgggacactgttatgattccctttagccgaatcctactattgttggtgccctgtggtcttcttctaatacttaaggaaagacaaactcttttgtatattcttcacatattaaagctgaccactctaaactctctggtccagtggtgatgaaaagtctaggaagccctggagttcctcccrgccagctgaagtgagatatgtgtgattgccaacaccacttgctgcattctcaatttatgacgtgaatggcttggctctggatgaggagcttggctaaggtctatccaacaagtacacccgatcaccctactaggaggcatatttgctctcagcccctaaaagtacaattaagtgtagtatctaatgaagtggttatgcttttttttttttccttttttttctttttagacagaatctcgctctgtcacccaggctggagtgcagtggtgtaatctcggctcacagcaacttccacctccc

SEQ ID NO: 159001 - DNA, 601 bp, Human
tttcatcaattactgaattccaaaagtcttacaaatttggattggttgctttcctgagtattcagtcattcttataatttcaaggctgatgttgcttggaaacctgcataaacactccatgtcttttcagagaaggaaataaaaaactccttggcactattttctttttagatggagagatctataaaactagacaaaatatacttttatttatttaaaagcccagcgctgtttacaaaaatcttggagatttttttaaaagacaggtttgctaaattttaatgttagaaaataaaaaaattactcactttatcagcatatgaaccatatcatcattttattccttcataattagctacattttatctgaaagaaacactaatactgggtggtaaattgcatgtttcagttttgccttgaatttagaatcaaggggataagagctaaaaacaatttgtcgttatttttcaccaatacctgctaccttcaagtggtccaaaataatttatgggcaaatctacttcttaaggcaatgtggtcttgcaaatgcatgataaaccagtgatgtgtatgttattaaagaaaatcataggcacatcag

SEQ ID NO: 159002 - DNA, 601 bp, Human
ctcaatggaaagtctctcaatacgctaataaataagagattaaactcatttggcagtattgaggaaatcaccccagatatattaagtaaacataacttaaatttgagaaatgttaaatataagaatatgtttttaaatctgcaaactggtgtaatttattgatgactaacatggttctgtttttcatcaattactgaattccaaaagtcttacaaatttggattggttgctttcctgagtattcagtcattcttataatttcaaggctgatgttgcttggaaacctgcataaacactccakgtcttttcagagaaggaaataaaaaactccttggcactattttctttttagatggagagatctataaaactagacaaaatatacttttatttatttaaaagcccagcgctgtttacaaaaatcttggagatttttttaaaagacaggtttgctaaattttaatgttagaaaataaaaaaaatactcactttatcagcatatgaaccatatcatcattttattccttcataattagctacattttatctgaaagaaacactaatactgggtggtaaattgcatgtttcagttttgccttga

SEQ ID NO: 159003 - DNA, 601 bp, Human
tgttagagctctctggtagagaacaccaaagtctaacatcagatttggtaaattctatccatatcaaaaaataaaataaaagtatggtcctaaagtagatttgataaatcagtcaaaaataataactttccaaagagtacaatttgaaaatcaatgctcatttgaggtagttcagcatgactattttaggtcacaagcagaaaaggtgtaaagaaaaagtgacatgctttgtaaatttcccagcagaattaggttgaaaactgacatgttaatatatttcataccttacaatgagtttactggacatattactctaacaatacatgaaaattatgcattatcagtaaactcaaagtaaaaattcaagttaatttaaaaagtgacatgcagttttaaaaaattttagatcgtttaattgctattacaaaacagaaagaaacaaaacagactcacgaactctattacaatattgtttgcctttgtgttttttaactgagcattaggttttgtttgtttttaaatggtatgagaaaactaatagactggtgcttttccttttataacagatttgtctttgtttaggatttggttaattgatcat

SEQ ID NO: 159004 - DNA, 601 bp, Human
ggcatacagttgcataggtgctagggaagacgagttagatgtggattcgactgcatatgaacacatatacaaactcatcttcaaatatatgtgtgcaacaagcaaaattaatagctggtatacagacaagctattatttctttttaaggaaaaaaatcactggaagtgtgtttatttgaagcaatcaacagatttgttttgaatgttggcaatacatatgaagtataaagaaataatatattattttatcttctcattaatacatctataaaggtaatttaaaaattgttatattatttgaaaaaaacacaggcattattggtaaggaatcaaggtattgtcctttttgttttgaaagttccgctttggcaaacttccaggaagactgaaattatatttggtacaaaagattttaaacattaataactattttgaggagaaaaaaatttactatgctcttctaagacttttcagctattaaaataatcaatcataaatcaaagtgcccatttactatgaatcaaagtattctactattcttttctcaagtttctcatttatggaaataaagataaggaataaactaatatgtctgaggatt

SEQ ID NO: 159005 - DNA, 601 bp, Human
agtctgtttcttcagccatcatcagactcttatcctcatagtaatccatatatctctgaatctcacccaattctgtatccttccctgtccctctaaatttcttcatagtgctcttggttacctcaagtttgagcatatgcctcatatccaaaacctcttttatgaatgtttcttttagctttgtctcttaggcaaaattagactgtgtccttagctctttatgtcctatggagcaggtagggaagctgttgtctttctcttctctctcaaatcccaggttttgggggaggggcatgaaatkttggctattttccttggtccactttgccacttctttgttaaagttgtcatagcctttcctcttttcttcaaagtgtttggaagcaaaggctgaacagatgtataggtgtagaggcagacattaaatcagttttcagtcaataaggcaaaatgacagagatactggtaaactgtagccatgaggaaaaatatcaagtgctatagtattatggcattttacctttccttttcatgtagtgacttccattaaccacttcctccttatggaaatagtttcctcttctggcttctgtgttgctac

SEQ ID NO: 159006 - DNA, 601 bp, Human
aaagtagatgttgtccagcttgtcgttcattcattctctgtctcatcatgcaaatggaatactaatttacttaactagctattcccataaagtagcatctgcacagctgaggaatctaacttctgaagaaccctgaaaacagatatatctgaaaattttatataacaactgcaattattctcaaatatattgcaatttatttctagtttttaaattttgaggccatgcaaaaaacagttaagatgatgacgattcattcatcctcagcataggtttatgctaaatttaggatcactatagyaatcctagttatgtcaatagtataaccttttaatttccacaattacagaaatataaaactgccataacaaatttttattaaagtgcaattacattttatatgtacataataaatagagatttgctgacttgtctccactccccctcaataccaccatttttgacagtaatttgtacttttaaatttttgctatgagaaaaatggcacttgaaattcttctatctatcctttatgtattaataggaattcacttttgcaaagcttgatttgatatcacatgtcccagctgggaaaacagtt

SEQ ID NO: 159007 - DNA, 601 bp, Human
agaatattattattaataaacactgtaataaacagagcttgctttcaagcaagtctgcagtaatagactgtcaagaacctctggtatttataggcaaagtgaaaacagcgacgaacaacaaatctcaattgtaattcaaaatctattactagtgaagtaacattactgaagtaatcaccttcccaatcccctattttgagttctgttaaataaatctgtgtactgtaacatttgtatacatactgtaccaaaatgaataaaatatttaaatatttaactgtcatctttagtttttaatttytgacaaatatcttcctctttccaacatgtgaactgtcttccagcatctgaactagtcaattcacagttctcttttcctatgaatagctgtacctacaagcaccctaagagtctgtctggatttttaatgcaagagagaacaaacagcataagtgacttcttttttttcccccccaaaatcttccagataaattaaaagggctctttaggaaaatgtttggcaaatctgtattccataggatgtcctttgattagacatccaaggtttttcattatctggctccctaacatctatctaaca

SEQ ID NO: 159008 - DNA, 601 bp, Human
gtaatatgtagactaagaacagactactggaattagcaaagtgctcatcattgatgtccttggcaaagagttttggtggaatggcggaggcaaaaatttgactgaagtggatttaagaatgggaatacagacactgggaaatagagagtagagataatactttgtaagttttactacaaaggagtagaagaaatagggcattagctggtgggggaagtgacattaagaaagttttgtttggttttctaagatgagagaaaaaacagttgcacactgatgggaatgattctgtagagagcawaaacttgacagaaaaaggagagagaaggtagaattgctgcaggaatgttcttgagtaaaggaagaatgaagtttaatggacaactgaaatgaatggttttagacaagagcagggaaaatttacctatagtaattgatgagaaggcagactatgtgggtacaaatgctgcttcattaagtatgtgttggtatgagtttgtggaagttacttttgattgcttcaatcttctcagtgaagtaggaaaggaagtaaggtcattagccgggagagaataagaagcaagaaacattgtgggggttg

SEQ ID NO: 159009 - DNA, 601 bp, Human
gtaggaacacagcattcatccccattttgtacttctgtcttctgcgatttcaagacacagcaagaaagccctcatcagatgccagtgccttgatcttggacttcccagccttcagagctgtgagaaaaaatgttctgttctttataaattaccatcacaggtattctgttacagcagcacaaaatggaccaaaatggactaagataacagtacatttgtcccacagtggagacacaaatttcacagatgtcagcatataaaagccaaggtaatggagaaagaagactcagaagaattcccmagtattgagacctggagcacttcaccattaagtagataaaaataagagaataaactagcaaaggattctgagaagaagcaaaatggaaccaggcaggaggaaaatcaaacgtgggtagtatcctggaagccaagtaaacaaagtatgccaaggaggtggaagtgataaattttaacaaatactgttggtagataaagtaatatgtagactaagaacagactactggaattagcaaagtgctcatcattgatgtccttggcaaagagttttggtggaatggcggaggcaaaaatttgactg

SEQ ID NO: 159010 - DNA, 601 bp, Human
atgtaggctgggcttggtggctcatgcctgtaatccgagcactttgggaggctgaggcgggcagatcacctgaggtcgagagttcaagaccagcctgaccaacatggagaaagcccatctttactaaaaaaaaaaaaaaaaaaaaatttgccaggcatgcatggtggctcatgcctgtcatcccagctactcaggaggctgaggcaggagaatctcttgaacctgggagtgggaggttcaggtgagccgagatcgcatcattgcactccagcctgggcaacaagagtgaaactccgtctcaaaaaaacaaaaacaaaaacatcccacaaaactcctaatgtaatctgcatataaaaatctctaagagaacctctaactgtatttaataatagtcaaaagtattaagctaaggtaaatttattattgacaaaaagattttttttttgtaaattcagtgtgccctaagcgtatagtgtttatagtctacagcagtatacaataacgtcccaggccttcacattcactaattatatctaaaaggataatcatcctttgtataataacccttcatagatttaagttgtattaattagtaaacacc

SEQ ID NO: 159011 - DNA, 601 bp, Human
gaatattgctaaacgaccttaaaaactcctaatgtaggctgggcttggtggctcatgcctgtaatccgagcactttgggaggctgaggcgggcagatcacctgaggtcgagagttcaagaccagcctgaccaacatggagaaagcccatctttactaaaaaaaaaaaaaaaaaaaaatttgccaggcatgcatggtggctcatgcctgtcatcccagctactcaggaggctgaggcaggagaatctcttgaacctgggagtgggaggttcaggtgagccgagatcgcatcattgcactccrgcctgggcaacaagagtgaaactccgtctcaaaaaaacaaaaacaaaaacatcccacaaaactcctaatgtaatctgcatataaaaatctctaagagaacctctaactgtatttaataatagtcaaaagtattaagctaaggtaaatttattattgacaaaaagattttttttttgtaaattcagtgtgccctaagcgtatagtgtttatagtctacagcagtatacaataacgtcccaggccttcacattcactaattatatctaaaaggataatcatcctttgtataataacccttca

SEQ ID NO: 159012 - DNA, 601 bp, Human
atccaagtgaagatgccaaataagtggctgattatgggtctggaggccaggggaaacgtgggagttaacatacaaattgtatttaaagtcacaggaagagatgaaattatttagggggaagtaaaagtgaagcaaattgttaaataatgaaaattaaagaattaagtatgaaaatatttaatttctaaaatggtgaaagatattcaaggtagagcagcaaaactgatcatcaagtaaaaaataaaccaaatataaatcagggagggggtaaactattatctttttcttttttaaaacattsgtgtccgtatatattgtcttttgcaaatcatattgtagtattcatcaaattttgaaatgggtatcatctttcactttgtttctgtccttatgcaattcttctggggaaatttccaaaacagaggacattgtacaatgtattagtacactgtacaatgaacactagtacactgcataatgtattagtgttttaaggtaagtgtttataagtcaaaacactaaatgtcatatacaaaggacagtatgcaggcactacactatatgaaattataaaatgatgtagaaaatagcaatgcaaagt

SEQ ID NO: 159013 - DNA, 601 bp, Human
ttctgttcaaaattcttcaatgaacccttccttcaactccccactgaattacccagacaattttctaaagacaaaatttaacttacttatttttccatttaacacattatttcactttgctcctgaaacattattcaaaatttaaagatatacaacactatatcccagggagggatataacttaggaataagaaaaatagaaaaaaaaaatctatgctttctaggtgaaggaggaacagaagagaagcacttcaaactattcctgttgagatgatgagcactctagacataattacttcamaaaagaaaactactagaagttaaataactatgaaaaaactatgaaggtcatataataataaactattgcaggaaagcccattatttaaaaatgaaaataatttggggtattgtcttcttaatgcttactaaaccagattttactaaattgaggttatactgatgaaaggcttataagccttcatcatccatgtgtcaagttaacaaaaagctctttgaaatcattattattttaaatcacctctttttagcccagctctttcagggcacatatagtaagacatatgttcagagttcttaa

SEQ ID NO: 159014 - DNA, 601 bp, Human
gtttgtttaatctacttttgataaccaaatccaaggcagaacagttttcatagcattgtctaatatctctcataaaataccatgccaccttgtctcatgtatttttacctttcacccattgctcactcagattttaaacctaggagctatctgtgacttctcctgctccctacatctatatgttctattatgtgctgttctccagtcttactactttatcctatctaaagcatagtgtagtataatacaaatatagaattggccattaatagatacgtggtcttaccctggctctgctatrtgacctttctcaaatgactttagtttcatcatctataaaatcaggcaacttagtgagactgaggataaggagtctttattttagcattatgagaaaattctgttcaaaattcttcaatgaacccttccttcaactccccactgaattacccagacaattttctaaagacaaaatttaacttacttatttttccatttaacacattatttcactttgctcctgaaacattattcaaaatttaaagatatacaacactatatcccagggagggatataacttaggaataagaaaaatagaaa

SEQ ID NO: 159015 - DNA, 601 bp, Human
attattcgcttttttggctatcattgctacatttttaaaattagggcttactaccatcttaccaaatggtactaccatattttcagaggatactgaaaaattactgcagtgacatgaatattcaatccaatatgaccacacatagacatctttatttgtattgaaacatccagccacaaaaatcagcatattttgacttaatcacaataaaaattattataagaaatatcaaatcaatatgacattttctatcatccctaaaattaaaatgtaaatagtaacatttaaaattatattatgraagcataatgacacatatgacaatgttttatgtctcactgggtaggtcaaaacttgtgattgttgtgttactgacaaagcactgaagtaattgctttccttgttccagacattaaaatgggcaggctaaaaaaagtgctaaaatttgagcaggacatttagttgtttgaggtattctatgagggatttcattagctaatttttagcaagcatctctaatgctatctttcaaacacaaatgtggataagaatattttaaagaaatacagccatgcatttcaggcaattttgttctggaagg

SEQ ID NO: 159016 - DNA, 601 bp, Human
cttcacagtagcacctcccttccctattatcagacctgctgtgctgttgggaactataatctttacctgtaattaaaaaaaatacgtataaataatacttctgttttgtgcatatacattatattactttgctatcctagaaaagtaaaataataaactgaaaattaaacataatttatgaaacagaaatatcacaactttaaagtgacttttatcacactttaatataactatcttgtaaaattagaattttcaaaggaaaaactcaattttcaggtcaaaattattaaataaaattttyccttgagtcactgtgaattttgcaacagaatttataagaaatcagtatcttaacaagaggggaccataactatacaccaaaggtaacatttttatatagctccaaaaatcacatgctgttgatgattcttcacctattgtaactttaagaaaatgctttgttctaaaacatttaaaaaacaaagaatgcagaattaaaaagcaaagttaataaagataacagtaggaaagttcaagcctgagtcccttcaaaacattaatttcatgttccttatcacccagtaatttttttgttattaaa

SEQ ID NO: 159017 - DNA, 601 bp, Human
ggtgtgtcaaatggcctggacagttggcactcaggagaggtacagaagagggtgacagttgttgggtcttgggaacaaaggcttactctgaaatgacctgtcaaaaagcctgacaaaggtagataacactacctctcaagataagctgcctcttctaaataagcatgcaggaaatactgtctggttggtgacataaaaatgctccacaaaacatgcaaattaccgagtattagaaactgcattggctgctagcgccatgctgcaaagactccatcatgggagcaaacagctaaatcacagttagcttcacagtaaaatctacattcacaatactaataggtttctagtgttaacaaattatacacaattataagctcttaaaatgcaacatacttatcaagcagttgcagataatgaaacattatcagctatcaataatttgttggcactttcacttttgtttataaaatttccaatacactgtaccacagttatgtgtctaaacagtgaggatgttaatggagtaatgactgttctactggccaggcgatgggatcagtagtgaattcagtgcttaaaaacaaatgtacaaacctctgaa

SEQ ID NO: 159018 - DNA, 601 bp, Human
aggaaaaaatgagacgggagacaagtgatgctacatgatgaactaagcacatttataatgataaaatgagtaaatataatagcggcaatgctaaccactgattccacgagatacactatttgtcaaaacttacacagctacagagtatcgacgataaatagtcattaccaattaacacagtttactacagcttttctctttcatttaaacaagcatatcattcccttttaaaatcattctctaaataaatatttagagatagagaactctaaatgaaataacagtccaatgttaaaaactaaaaaaaaaaaaatgagtctactcttacagtttgacagaaatgaattattaatagtggaaggggaagggatcaggaaataatttcaagttctcaatgtccaaaagtaaattgcacagtaaatcaatatgaaatgaagagtccatatagttcaatgaacaaaagggaaagttcatgaggacaaagatcacagttcagagagaggctggacgaaattcagacatggagcatcacactcattgttctttaattggttgcacagaaaggagcagctgggatgccatttagcttgctaggatggac

SEQ ID NO: 159019 - DNA, 601 bp, Human
tttcttctcctctcctcctctccccttccttcccctctccttccttctaattctttccttcttcttcttttctttcttgatgcaggtgtttaaaattatccaactgccatagagctaaattcttttttggaaaattgaaccgaacttctactgaatacaagatgaaaatgtggttgctggtcagtcatcttgtgataatatctattactacctgtttagcaggtaagaaatatcctttgtatattctacatatattatgtcaacataattgatatgcgtgtttattaaatgtattgtatgmagtaaaaattcttattttctcgacatctgggtcagataagtagataaatatgtatcaagggtgaccctatttcctttttaatttcaattaagatttcacaaaacattgtcaatcttgggtaatagtgtgctggtgaatgtttaaaatctagatctctggggagatccctggagtgtagcatttgtctattactggggagtaaattatcctaccatggccagtttcaacctgacatcatttaatgtggaactggaaagatgtgcaaccgctcaccagtctgtagtattttcaccaccctga

SEQ ID NO: 159020 - DNA, 601 bp, Human
agaatgaaaaatcatgaagaatcactgaacaaccagtgctagaacttgcatgccaaatcaaggttacccattgtattagtctgttttcacgctgttgataaagacatatcccagactgggaagaaaaagaagtttaattggacatacagttccacttggctggggaggcctcagaattacggcaggaggcgaaaggcactttttaatttatttatttatttatttttgagatggagtctcgctctgtcacccaggctggagtgcagcggcgcgatctcggctcactgcaagctccacctcygggattcacgccattctcctgcctcagcctcccgagtagctgggactacaggcacccgcaaccacgcccggctaattttttgtatttttagtagagacggggtttcaccatattagccaggatggtctcaatctcctgacctcgtgatccgcccgccttagcctcccaaagagctaggattacaggcgtgagccaccgtgcccggccgcaaaaggcacttcttacatggccgcagcaaaagaaaaatggggaagaagcaacagcggaaacccctgataaacccatcaggtcttgtgagac

SEQ ID NO: 159021 - DNA, 601 bp, Human
cagtgctagaacttgcatgccaaatcaaggttacccattgtattagtctgttttcacgctgttgataaagacatatcccagactgggaagaaaaagaagtttaattggacatacagttccacttggctggggaggcctcagaattacggcaggaggcgaaaggcactttttaatttatttatttatttatttttgagatggagtctcgctctgtcacccaggctggagtgcagcggcgcgatctcggctcactgcaagctccacctctgggattcacgccattctcctgcctcagcctccygagtagctgggactacaggcacccgcaaccacgcccggctaattttttgtatttttagtagagacggggtttcaccatattagccaggatggtctcaatctcctgacctcgtgatccgcccgccttagcctcccaaagagctaggattacaggcgtgagccaccgtgcccggccgcaaaaggcacttcttacatggccgcagcaaaagaaaaatggggaagaagcaacagcggaaacccctgataaacccatcaggtcttgtgagacttattcactaagtattttttaaaaatagcctat

SEQ ID NO: 159022 - DNA, 601 bp, Human
aaaaatgaaataaaatagcagtataatatatattttgtaagaattgggatatgaaataatatataatttatactttgtacatttagagttatgatatgactgtataatatccaaagctaatatttaaaaaaaaaaactatcttcattgcttagctgtagggaggacaggtagaacatttcatatatctttacagtacttgcaccaagatttcctgtatattttttcaactagactcacatcagtcagtaagaattattttcagtacatatttctatctctaaatatgattgacattttatrgcagtcagtgacctgtctctattttgatctatggtcccacatagccccattaatcaaaatagactagagttagactgaaacaggccaagttctggaagtaggcccaccagcccagtcatgctatatattaggatgtagtaagacgtgaggtaggtgtcagaagatgcccagccaggtatgtaaaacagaatctagatgcttcagaggtgggtcacaggacaaggaagtagttcctctagagagatgtgacaggctccccttgggcaggtaaagccaagcaaggagaatttagttcactta

SEQ ID NO: 159023 - DNA, 601 bp, Human
gcatcttcagtaaaagtattagaagtgaagcagaaaacattatattcatttatggcttttacagcctcaagaaggatatggaactagagacaacctacaacacaactttcaaaattattagcagagagcatctctgtgactacctcatatttgtaatcttaataataattgtggtaggcacatggagtccttaggacatatgctcatgttcctttcttttctgaatgtacgagccctgtaaaacaaattgcttgcctaagacaataactagaaaagttcatggcaggagctaagtctcagytcctctcattcttctgattctgatccagctatttcctatctgaaataggatggtggttatggaatatgtctgaggtctataaactattgaataaaagtttcagcaaatttcaaccaagaatgaggcagctccctttgaaacattttgggttaacttttttattaaataaattaattcttcataccagtggtgggggcgggggggggggcagaactaacttgaggattttagtaaccatctatatgtacaataaaaatgtactgagtgtcccaaacaacacagtgctaatagcaccagagc

SEQ ID NO: 159024 - DNA, 601 bp, Human
acctcatatttgtaatcttaataataattgtggtaggcacatggagtccttaggacatatgctcatgttcctttcttttctgaatgtacgagccctgtaaaacaaattgcttgcctaagacaataactagaaaagttcatggcaggagctaagtctcagttcctctcattcttctgattctgatccagctatttcctatctgaaataggatggtggttatggaatatgtctgaggtctataaactattgaataaaagtttcagcaaatttcaaccaagaatgaggcagctccctttgaaayattttgggttaacttttttattaaataaattaattcttcataccagtggtgggggcgggggggggggcagaactaacttgaggattttagtaaccatctatatgtacaataaaaatgtactgagtgtcccaaacaacacagtgctaatagcaccagagccaaaggagtgaaaacttggcttttggtttttagaagcttcatgattagttgaatagcttatatacataagaaacataaacaaaattttgaagagattggcaaattcatgagagtgtttttaaaattagcatttattcattg

SEQ ID NO: 159025 - DNA, 601 bp, Human
gctcatgttcctttcttttctgaatgtacgagccctgtaaaacaaattgcttgcctaagacaataactagaaaagttcatggcaggagctaagtctcagttcctctcattcttctgattctgatccagctatttcctatctgaaataggatggtggttatggaatatgtctgaggtctataaactattgaataaaagtttcagcaaatttcaaccaagaatgaggcagctccctttgaaacattttgggttaacttttttattaaataaattaattcttcataccagtggtgggggcgggtgggggggcagaactaacttgaggattttagtaaccatctatatgtacaataaaaatgtactgagtgtcccaaacaacacagtgctaatagcaccagagccaaaggagtgaaaacttggcttttggtttttagaagcttcatgattagttgaatagcttatatacataagaaacataaacaaaattttgaagagattggcaaattcatgagagtgtttttaaaattagcatttattcattgctgattataagctaggtacattgccatctttcatgaattgtctcaaaataattctgataa

SEQ ID NO: 159026 - DNA, 601 bp, Human
ttcctttcttttctgaatgtacgagccctgtaaaacaaattgcttgcctaagacaataactagaaaagttcatggcaggagctaagtctcagttcctctcattcttctgattctgatccagctatttcctatctgaaataggatggtggttatggaatatgtctgaggtctataaactattgaataaaagtttcagcaaatttcaaccaagaatgaggcagctccctttgaaacattttgggttaacttttttattaaataaattaattcttcataccagtggtgggggcgggggggggggcagaactaacttgaggattttagtaaccatctatatgtacaataaaaatgtactgagtgtcccaaacaacacagtgctaatagcaccagagccaaaggagtgaaaacttggcttttggtttttagaagcttcatgattagttgaatagcttatatacataagaaacataaacaaaattttgaagagattggcaaattcatgagagtgtttttaaaattagcatttattcattgctgattataagctaggtacattgccatctttcatgaattgtctcaaaataattctgataataacctt

SEQ ID NO: 159027 - DNA, 601 bp, Human
ctaagtctcagttcctctcattcttctgattctgatccagctatttcctatctgaaataggatggtggttatggaatatgtctgaggtctataaactattgaataaaagtttcagcaaatttcaaccaagaatgaggcagctccctttgaaacattttgggttaacttttttattaaataaattaattcttcataccagtggtgggggcgggggggggggcagaactaacttgaggattttagtaaccatctatatgtacaataaaaatgtactgagtgtcccaaacaacacagtgctaayagcaccagagccaaaggagtgaaaacttggcttttggtttttagaagcttcatgattagttgaatagcttatatacataagaaacataaacaaaattttgaagagattggcaaattcatgagagtgtttttaaaattagcatttattcattgctgattataagctaggtacattgccatctttcatgaattgtctcaaaataattctgataataaccttttcaggtagattttattatccccattttataaagagtgatattgagctttggagagattaaataatttgtccaaaggcaca

SEQ ID NO: 159028 - DNA, 601 bp, Human
ttcatgagagtgtttttaaaattagcatttattcattgctgattataagctaggtacattgccatctttcatgaattgtctcaaaataattctgataataaccttttcaggtagattttattatccccattttataaagagtgatattgagctttggagagattaaataatttgtccaaaggcacactgataatgttactgaaacaagatttaaatgacataatgaaactatttgttcaaaaggaagctcgaacagcactctcatcttcaagtttagtgtcagagaagacaaaatatttgkgtgccattgtctttacctctctcttaaaaaacaactggaggagtgaaccatcgcttagattgggcagagacattccagtgacctgtaagaatattcgttctttctagccacacagatgattattaattcatttgaggcatatggctttgcactgtgctctctaaatgctgccgcagtggtggcatgtgaatgattttcttctcctcatcctgctatgaagtgtcactcttccctgccagggagaatagaccatgaggaataactgcttctcaacacggctgtttgtgataaattttaaac

SEQ ID NO: 159029 - DNA, 601 bp, Human
ataatgaaactatttgttcaaaaggaagctcgaacagcactctcatcttcaagtttagtgtcagagaagacaaaatatttgtgtgccattgtctttacctctctcttaaaaaacaactggaggagtgaaccatcgcttagattgggcagagacattccagtgacctgtaagaatattcgttctttctagccacacagatgattattaattcatttgaggcatatggctttgcactgtgctctctaaatgctgccgcagtggtggcatgtgaatgattttcttctcctcatcctgctatgargtgtcactcttccctgccagggagaatagaccatgaggaataactgcttctcaacacggctgtttgtgataaattttaaaccagttgttcagatccaatatccgtgtaatttattgattgattgttctagatggtgctgagtgccaacgctagtcacatgtttagaaaaaaatcaacaaaaactggctcagaaaagagactgattttctcaacatcaagaagctctcctttgcattcagactcttgttcaaaaatcattaggctccttttgttttccagacaacccaggagaatgatgta

SEQ ID NO: 159030 - DNA, 601 bp, Human
tcatatagtagttatatatttgtagcatgttctgggacaacgtgctattcatagcaacatcctgagaggtacaacagggtactttacttctgacttataagccttgaggctttcattatcttgcccccatccccaaagaaacaagcattacaataaaaaagtattaaaagggattgtagcaatagtctatgtttctgaaactagaccagtgaacttcttcaaagacagaaaaaggtaatccttatatgatgtcacaagcacaatcagatccatgtggaggaaggtaagataataaacaaawatttggaaccaatataatgagggagaaattacaaaaattggagctgcccaacaaagaaacccactgtcttgacaagagctaagcaacttaacactagatggttcaggcagggacaatattgccatcacctgggggaagaggaaggctttattcattggattgtaatttagtaagttttaaaaatgcaaaatcacagttttctatacttgcttttaaattatctcctatactgcgaaaattgtaactaataatgttccagtaactttgatttgacaacagatattctaaagtcattaggac

SEQ ID NO: 159031 - DNA, 601 bp, Human
gctgcccaacaaagaaacccactgtcttgacaagagctaagcaacttaacactagatggttcaggcagggacaatattgccatcacctgggggaagaggaaggctttattcattggattgtaatttagtaagttttaaaaatgcaaaatcacagttttctatacttgcttttaaattatctcctatactgcgaaaattgtaactaataatgttccagtaactttgatttgacaacagatattctaaagtcattaggacttttgggcatgattattactctaattagaagtggccaggaaatgagcgatgtggccacgagccactactacttgagcgatttgaccacagctctaggcttatgactttcctgaggacatggaactttaaaggataaaccctgataaagaatgattataaaattatacagttggttctcttagttgagaactattttctacatgcattcttttcatcatcacatcagaaagttagatccctgtttccagtctatttataacactatccctatcagttaatgctctgattatctgcagcatgtcttatattgttatgatattatgtggttggggagaaaaagaat

SEQ ID NO: 159032 - DNA, 601 bp, Human
gacttttatcattttcaaattgtgtgactgacctctagtggtcagaatatgtcacttattgagcagaacccactgtcaattagtttgttttattgaaaaattactttgaaatttagagtcagatattgatattttgtattttatttatggtagaacaatgcttttaatactttatacagtatatctgcatatgtatgaatctaactggtgcatagatggctatcaattacatcccaagaaatcaatttatggagaaaaactcaacaaaatatttgtcacttgagatacctcacaaaaaaaagacaaaatacgtcatgtactttgatgtttccttgtctgtacttgagctaaattacaaattatggtcctagagactcagaatcatagagtacaaagaaataccacctgaatcatattcttaattgtctgacttcacatggagccgtacccaaattattttagaactgtgttagctccgtagagtttctaggtctcatgacctgtgatatgacctttgtgtctttttctcatagatggagaatgaataatggggacgttgatctcacaagtgatcgatacagtatggtaggaggaaaccttg

SEQ ID NO: 159033 - DNA, 601 bp, Human
caggctgggcgcggtggctcacacctgtaatcccagcactttgggaggctgaggctggtggatcatgaggtcaggagatcgagaccatcctggccaacatggtgaaaccctgtctctacttaaaatacaaaaattagctgggcgttgtggtgcatgcctgtaatcccagctactcgggaggctgaggcaggagaattgatggaacctgggaggcggaggttgcagtaagccgagattgtgccactgcattccagcctgatgacagagcaagactctgccttaaaaaaaaaaaaaaaaaaaagacatcaatggaagcaacaagccatgtattatcaaaggggcactatcacccctaagggggtgaaaattgtcttttgggggaagaaaatgtcacatattgcaacataatgtctgtgactcttcaaagatcaacccaatatgacaatattgtattccctaatatttaacttctaatagtaggaataaatttaattatattttagttaatttattttaaatttaaattacatgaaacatttcttttaattagggctaataatgaaaaactgtgctaagctaaaaattagaggttgttttgaaa

SEQ ID NO: 159034 - DNA, 601 bp, Human
ggctgggcgcggtggctcacacctgtaatcccagcactttgggaggctgaggctggtggatcatgaggtcaggagatcgagaccatcctggccaacatggtgaaaccctgtctctacttaaaatacaaaaattagctgggcgttgtggtgcatgcctgtaatcccagctactcgggaggctgaggcaggagaattgatggaacctgggaggcggaggttgcagtaagccgagattgtgccactgcattccagcctgatgacagagcaagactctgccttaaaaaaaaaaaaaaaaaaaagrcatcaatggaagcaacaagccatgtattatcaaaggggcactatcacccctaagggggtgaaaattgtcttttgggggaagaaaatgtcacatattgcaacataatgtctgtgactcttcaaagatcaacccaatatgacaatattgtattccctaatatttaacttctaatagtaggaataaatttaattatattttagttaatttattttaaatttaaattacatgaaacatttcttttaattagggctaataatgaaaaactgtgctaagctaaaaattagaggttgttttgaaaga

SEQ ID NO: 159035 - DNA, 601 bp, Human
acatgccatgttagatattgctaaataaggatagatagatagatagatagatagatagatagatagatagatagatagatataatgcagggaagtggggagagtaagtattgaggggaatgactgaactcaggaggagcatcactagaaggaaagttggaataaacacctgaaggaagtaaaggagctaacaatatgagtatccgagagaagagcatgccaggaagatgctgaggtcagactatggaagaccaaggaagccagggtggctgtcatagagtgaataaggcagagggtagtargaaatgaaataagagaggtacaagagctgcattatggaggaccttatgatccataacaattattaatactttggcttttactttgaatgcgatttacattggtgggctttgagcagaggagacacatgacatgacttaagttatagaaaggtgactctggttactgttttaagaaaggacctggggaggacaaaggtggaaacaagagatctgtttggaggtattgcaatagtttaggtagcatatgatgggccagagtggtggcagtggaggtgggaagataaatccaagcatattcta

SEQ ID NO: 159036 - DNA, 601 bp, Human
aagaccaaggaagccagggtggctgtcatagagtgaataaggcagagggtagtaagaaatgaaataagagaggtacaagagctgcattatggaggaccttatgatccataacaattattaatactttggcttttactttgaatgcgatttacattggtgggctttgagcagaggagacacatgacatgacttaagttatagaaaggtgactctggttactgttttaagaaaggacctggggaggacaaaggtggaaacaagagatctgtttggaggtattgcaatagtttaggtagcataygatgggccagagtggtggcagtggaggtgggaagataaatccaagcatattctagataaaatagaatatactaaattctatatagaaatctaggtatactttggttaaattctagatatattttgaaggaaaagccaataggatttgcttgttgactttatgtggtatataagataaatacaagagttgagggtggcataaaagtttttgctgtgagatcctaaaagaatgaagttgccattacttcagctgaaggaatagatgtggacatgttaaatgtgaagcatctgttaagcttcc

SEQ ID NO: 159037 - DNA, 601 bp, Human
acagaaatccttacaaaatttggatttacatttcaactgagaataggaaatattaattcagaatcagaaaagatcaaagtcttcttttaaatgtactatacatatcagcttggatgaaagactacttaatactcctttctgaatgtgatacttctttacttatcccaggagccctcatttaagaaatttaagcagctccctaaatattttcctatactaattatcctgtgaccctaaatcagcaagaagaaaacaaatgaaaagaattcaattattcacagatataagtgcctagaaatayatgttaaccgtaattctgagttagaggctaattatggtagtctaattttctgcctctttttatctgtattctgtttcttcaataataaacatatgctgctgcttctataatttgaaaaaatcaatgttgaaaaccaaaagaatataatcatattcactgcctgtcttgatgttgtattttgctggagaaaattacatagctaagctaaatataatgcccaggttattattcccaattatgtgaagcttatataatgtgcatctcttttagtttttcatagtcattgtgctttcacactct

SEQ ID NO: 159038 - DNA, 601 bp, Human
tcagaaaagatcaaagtcttcttttaaatgtactatacatatcagcttggatgaaagactacttaatactcctttctgaatgtgatacttctttacttatcccaggagccctcatttaagaaatttaagcagctccctaaatattttcctatactaattatcctgtgaccctaaatcagcaagaagaaaacaaatgaaaagaattcaattattcacagatataagtgcctagaaatatatgttaaccgtaattctgagttagaggctaattatggtagtctaattttctgcctctttttawctgtattctgtttcttcaataataaacatatgctgctgcttctataatttgaaaaaatcaatgttgaaaaccaaaagaatataatcatattcactgcctgtcttgatgttgtattttgctggagaaaattacatagctaagctaaatataatgcccaggttattattcccaattatgtgaagcttatataatgtgcatctcttttagtttttcatagtcattgtgctttcacactctctttgaaagctttgctagccacgctgagttcccgaaagcaaaatagccatttgtcatgattat

SEQ ID NO: 159039 - DNA, 601 bp, Human
ctgtcttgatgttgtattttgctggagaaaattacatagctaagctaaatataatgcccaggttattattcccaattatgtgaagcttatataatgtgcatctcttttagtttttcatagtcattgtgctttcacactctctttgaaagctttgctagccacgctgagttcccgaaagcaaaatagccatttgtcatgattattcatctttaaaagaagcctgagtgctgtgatttcttggtttttcaccattttacacctaaaatcctatctagtctgacctagagagattcccacttayattcttcccagtagaaattgtctttatgtgatcaagatgttttgaagggaatcatcattttttgacctaaaggtatgcattgcccattgtctccttgtgtatttgttgaatgactcctggggagtcattcatcaaaacagagaggaaagaaggaatagaaaactataggaaatgcagcaaattaaggaggaaattcagttttccatttaactagttagtgtgttcagccaaaggaatttcatgtgggtaagagttaccatatgatacatctcctaatatttaattaaaccagtaccatac

SEQ ID NO: 159040 - DNA, 601 bp, Human
ccgtaatgaaaagaaatatccagtgaagactagctgacttttcaggaaggacaatataaaaggggatgcatgttgaaggggccaaaggcttggtcctaagctttttgcgttgagaagatttagctaataaaattgctgtaagaaggttgagttcggatgagttgcctctagctcggaaaatacacaggggactgataccttagtccagttctagtgtattggttacagtggaaatcactgacatctactttttgttttgtggccattcctacttcttagtaagctcatgaagaaatcaaakgattggtagatcaaaacaaacaatagtaattgtagaattttttaagtcattttgattattttggtatttttaaggaactatttacatgatacaaataagtaaataaatggtcttttctaatctacataatcagcatgaggtgctaccctggtagcaccatggcagatgacactgacaatctgattggcctttccccaggctccaattgaactacttcccttttaaaaagcactgctgcttaagagaatcaaatcacagtatacttgcttactttacattatttctatccaagtccttctg

SEQ ID NO: 159041 - DNA, 601 bp, Human
ttgcactccaacatgatttgcatctctgcctctccacagaaacctttcttttcatgaccacagacttccatattgctaaagctaatgatcaattctcagttgtacttttttttgatctaacagcagtggttgccacagttggtccctcccttcttcatgattcactttctgcacttcatgtctgcaacctactttgttattaatttccttgtataatctttcattctccattgcctttcaactccatacttttctaacattggtgtgatcagggttccatctgtgaaccccatctccattkcagtcactccatttatgatcccactcgtgatcatggctttagacacactctgtaccctgaatgctctaacccaaacatttactctgaacttcagactcgtatgtccaatgccacagtaacattaatgcaatacatatcaagtctgcatgaaatggcctcctaaaaggaagaaaatactaggtaaggtcctttaaacttttgaaataaatccaccactttctactaggtttctaaagcttatagacctgtttttattcaacatattaagaaaactacactccaggttctcaacagagtaaa

SEQ ID NO: 159042 - DNA, 601 bp, Human
cctttcttttcatgaccacagacttccatattgctaaagctaatgatcaattctcagttgtacttttttttgatctaacagcagtggttgccacagttggtccctcccttcttcatgattcactttctgcacttcatgtctgcaacctactttgttattaatttccttgtataatctttcattctccattgcctttcaactccatacttttctaacattggtgtgatcagggttccatctgtgaaccccatctccatttcagtcactccatttatgatcccactcgtgatcatggctttasacacactctgtaccctgaatgctctaacccaaacatttactctgaacttcagactcgtatgtccaatgccacagtaacattaatgcaatacatatcaagtctgcatgaaatggcctcctaaaaggaagaaaatactaggtaaggtcctttaaacttttgaaataaatccaccactttctactaggtttctaaagcttatagacctgtttttattcaacatattaagaaaactacactccaggttctcaacagagtaaaattttgaactgtctaatatctaaagccttagaagaaccaagg

SEQ ID NO: 159043 - DNA, 601 bp, Human
ccctcccttcttcatgattcactttctgcacttcatgtctgcaacctactttgttattaatttccttgtataatctttcattctccattgcctttcaactccatacttttctaacattggtgtgatcagggttccatctgtgaaccccatctccatttcagtcactccatttatgatcccactcgtgatcatggctttagacacactctgtaccctgaatgctctaacccaaacatttactctgaacttcagactcgtatgtccaatgccacagtaacattaatgcaatacatatcaagtstgcatgaaatggcctcctaaaaggaagaaaatactaggtaaggtcctttaaacttttgaaataaatccaccactttctactaggtttctaaagcttatagacctgtttttattcaacatattaagaaaactacactccaggttctcaacagagtaaaattttgaactgtctaatatctaaagccttagaagaaccaaggtgacagagcacatatttacagaaggtaatttaagagaaatattatttattctttactaatgcagcatactaagtattatctttaggtctgatcacatcact

SEQ ID NO: 159044 - DNA, 601 bp, Human
aacctactttgttattaatttccttgtataatctttcattctccattgcctttcaactccatacttttctaacattggtgtgatcagggttccatctgtgaaccccatctccatttcagtcactccatttatgatcccactcgtgatcatggctttagacacactctgtaccctgaatgctctaacccaaacatttactctgaacttcagactcgtatgtccaatgccacagtaacattaatgcaatacatatcaagtctgcatgaaatggcctcctaaaaggaagaaaatactaggtaargtcctttaaacttttgaaataaatccaccactttctactaggtttctaaagcttatagacctgtttttattcaacatattaagaaaactacactccaggttctcaacagagtaaaattttgaactgtctaatatctaaagccttagaagaaccaaggtgacagagcacatatttacagaaggtaatttaagagaaatattatttattctttactaatgcagcatactaagtattatctttaggtctgatcacatcactagaaggttacataattaagccatatatagactgtgtcaagcc

SEQ ID NO: 159045 - DNA, 601 bp, Human
taagtgaaagtatttctattaaagttcattgagaatatgtttcaattttattcttttcagtatcataaaggggaattaagactgtatgatgtgacttttgaaaatgccggaatgtatcagtgcatagctgaaaacacatatggagccatttatgcaaatgctgagttgaagatcttgggtcagtatcatttctaatttctgttaaacattgttaaagcaatatgtcatatcacacaaaatgtttattgagcctacacaaaatacccagtattgtgttaggtgtacaacatatgttggttgyttactgatttatttattgctaattatcataattcagactaacgaaacaatggaatagaatgaatctttgccacaacaaaagtcttcttcagagcatcagcagcagtggccatacctaggagcacattagaagtgcagaatcccaggctcaccccagacctactgaatggacactttaaaaagatacccagatgattttaatacaaagataattttgagaatgaccagaccagaggatgaagagtcaaaacccagatgaagatatgcttaggcctagaaaagcctccagaaagtacatagt

SEQ ID NO: 159046 - DNA, 601 bp, Human
tcatttctaatttctgttaaacattgttaaagcaatatgtcatatcacacaaaatgtttattgagcctacacaaaatacccagtattgtgttaggtgtacaacatatgttggttgcttactgatttatttattgctaattatcataattcagactaacgaaacaatggaatagaatgaatctttgccacaacaaaagtcttcttcagagcatcagcagcagtggccatacctaggagcacattagaagtgcagaatcccaggctcaccccagacctactgaatggacactttaaaaagatmcccagatgattttaatacaaagataattttgagaatgaccagaccagaggatgaagagtcaaaacccagatgaagatatgcttaggcctagaaaagcctccagaaagtacatagttacggatgattgtaatgtgttgaaatatatggatgaaatctgcttggagtctgccaagggaagaggagagtgagcagtggattaaatgtgtggatgctgaggaaagtctgagcatgacatcaatgaagtaaccttttttaagcctctgtattctgttctaataattattgctctgtacttggagg

SEQ ID NO: 159047 - DNA, 601 bp, Human
aatagaatgaatctttgccacaacaaaagtcttcttcagagcatcagcagcagtggccatacctaggagcacattagaagtgcagaatcccaggctcaccccagacctactgaatggacactttaaaaagatacccagatgattttaatacaaagataattttgagaatgaccagaccagaggatgaagagtcaaaacccagatgaagatatgcttaggcctagaaaagcctccagaaagtacatagttacggatgattgtaatgtgttgaaatatatggatgaaatctgcttggagtctrccaagggaagaggagagtgagcagtggattaaatgtgtggatgctgaggaaagtctgagcatgacatcaatgaagtaaccttttttaagcctctgtattctgttctaataattattgctctgtacttggaggtaatgatgaactacaaatgatcatgtctccttaattagttgattagatccattattcccatagctgtttatagatagatcctgaaagcaggactccaattattttggcattttgcagggtgtttgcatacagatgatgctcagtaattgtataaagaaggagagactg

SEQ ID NO: 159048 - DNA, 601 bp, Human
tccagcctttcactttactttccttgtggaattgagtcaaagcaacagaattcagagttaattttaaggtaaatgtgtataaaacatttgattgaaattgaagttatttatttattgagacagggtctcacggtgttgcccagcctggagtgcagtgaggcgatcacgcttcactgcagccttgaccttctaggttcaggtgatcctccacctcagcctcctggatagctgggactacaggcatgcaccaacatgcccagctaatttttttgtattttaggtagagatggagttttgccgygttacccagtctgctctcaaactcctgggtaagccatctgcccacctcagcctctgaaactgctgggattataggtgtgagccacccatgcctggattctaattaaagtttctaataatcaattcagttatcatcaagaattgtacatttgaattgggtgaattttataagtcaaagttattaaataaaagttacaaagcattaggtatagaatgcctattggtgacagctgatcatatttaccgagattaatcctttccattaactattaaggagaataaaagattctacaacacagaa

SEQ ID NO: 159049 - DNA, 601 bp, Human
gtgaggcgatcacgcttcactgcagccttgaccttctaggttcaggtgatcctccacctcagcctcctggatagctgggactacaggcatgcaccaacatgcccagctaatttttttgtattttaggtagagatggagttttgccgtgttacccagtctgctctcaaactcctgggtaagccatctgcccacctcagcctctgaaactgctgggattataggtgtgagccacccatgcctggattctaattaaagtttctaataatcaattcagttatcatcaagaattgtacatttgaaytgggtgaattttataagtcaaagttattaaataaaagttacaaagcattaggtatagaatgcctattggtgacagctgatcatatttaccgagattaatcctttccattaactattaaggagaataaaagattctacaacacagaagcaatgtttaggctttacaaacagaaagagaaagataacaatttgttttctttttagcgttggctccaacttttgaaatgaatcctatgaagaaaaagatcctggctgctaaaggtggaagggtgataattgaatgcaaacctaaagctgcacc

SEQ ID NO: 159050 - DNA, 601 bp, Human
tttttgtattttaggtagagatggagttttgccgtgttacccagtctgctctcaaactcctgggtaagccatctgcccacctcagcctctgaaactgctgggattataggtgtgagccacccatgcctggattctaattaaagtttctaataatcaattcagttatcatcaagaattgtacatttgaattgggtgaattttataagtcaaagttattaaataaaagttacaaagcattaggtatagaatgcctattggtgacagctgatcatatttaccgagattaatcctttccattaaytattaaggagaataaaagattctacaacacagaagcaatgtttaggctttacaaacagaaagagaaagataacaatttgttttctttttagcgttggctccaacttttgaaatgaatcctatgaagaaaaagatcctggctgctaaaggtggaagggtgataattgaatgcaaacctaaagctgcaccgaaaccaaagttttcatggagtaaagggacagagtggcttgtcaatagcagcaggtcagtgctgaaactagaaatccaattgcaaaatctgtttgaaaaagtttattttata

SEQ ID NO: 159051 - DNA, 601 bp, Human
attttaggtagagatggagttttgccgtgttacccagtctgctctcaaactcctgggtaagccatctgcccacctcagcctctgaaactgctgggattataggtgtgagccacccatgcctggattctaattaaagtttctaataatcaattcagttatcatcaagaattgtacatttgaattgggtgaattttataagtcaaagttattaaataaaagttacaaagcattaggtatagaatgcctattggtgacagctgatcatatttaccgagattaatcctttccattaactattaargagaataaaagattctacaacacagaagcaatgtttaggctttacaaacagaaagagaaagataacaatttgttttctttttagcgttggctccaacttttgaaatgaatcctatgaagaaaaagatcctggctgctaaaggtggaagggtgataattgaatgcaaacctaaagctgcaccgaaaccaaagttttcatggagtaaagggacagagtggcttgtcaatagcagcaggtcagtgctgaaactagaaatccaattgcaaaatctgtttgaaaaagtttattttatagaagact

SEQ ID NO: 159052 - DNA, 601 bp, Human
tctaaactagaacttgaagttgtaagacattgatataaattgagaatatgccagcacagccctcttattaggatgagcacaggcacggctgtttatggaatggggcaagagggcagggacatcaggggcttccctgaacacactgacttttaaagttaatatgtttgacctcagggttgttaagattttaacaaaatgatactacaagaagggttaaaggaaaagtccatttgttcaatttgccgctgaaacattaatggtcagacaatgagcaatgcagagaccatgatcaaagggcagytacatgtgtaggtgcttactccttccacagcctagagcagggcattccccaatggacaaaccattagttctcttccgtgataataaaatctttttctgattctgatgaagacccatgtcatggacctcttcaaccaaggatttcccagaactatgtttcatggacttgtttttcctaaatatcaatatgtgttcaaaaaaagaagagaaagatctagctcctgaaattttacaagtttgattgtgttctgatatttttaaagcctttgaaatcaaattgcattatttccttgattaaaga

SEQ ID NO: 159053 - DNA, 601 bp, Human
atgatactacaagaagggttaaaggaaaagtccatttgttcaatttgccgctgaaacattaatggtcagacaatgagcaatgcagagaccatgatcaaagggcagctacatgtgtaggtgcttactccttccacagcctagagcagggcattccccaatggacaaaccattagttctcttccgtgataataaaatctttttctgattctgatgaagacccatgtcatggacctcttcaaccaaggatttcccagaactatgtttcatggacttgtttttcctaaatatcaatatgtgttcmaaaaaagaagagaaagatctagctcctgaaattttacaagtttgattgtgttctgatatttttaaagcctttgaaatcaaattgcattatttccttgattaaagagtctataaatctaatttttacttagtactttaacccattactatctcagtgtaaatactatttaatagtagatatagtattcatatgcaaatatatttgaattgtaaaataagatgtataaaaagctaaacataaaaattttggtgtctattttgaaaaagaatacacaaggactaactaaatattggtctttaa

SEQ ID NO: 159054 - DNA, 601 bp, Human
agatacaggtctgatcccagatgaaggacagagggaaggaaggaaaaaagattgtgttgaaatgacttggactgcactgcacttctaagagtatggtcatgccactggaaagtcttccattcaaaaatgcatatcagaggagtttgctgtcttccaggagcaggcctggtttaaaattcctcccatggtcagtcattggctaagaacagcctgtggaatgtgtggctttgaataaacacagtgatggatttctgagtacggcgtctgggacagagaataaattacactcctcagagttggrgagtggcatattctcagagcttccatgatcttaaataattacttttatcattatattattttgatacttcatttctccttcaacaacaaaaagtactctgaaatgagcttcaagtcaggactggattgttcaagaaaggaaaggaaatcctggactataatgttagcggaaattttgttattttcttatatgaagatttttatcagtaaggtagatagttttgcttcttttatcagactttgcccttaaaatggatatacgtttgcatgttttgtgcaaactttcaaagataatttagtt

SEQ ID NO: 159055 - DNA, 601 bp, Human
gcctgtcccatagtggaaggtcagttagaagactacggcaatagttcaagaaaaagatgaaagtggatttccaaaacaaaatgtcaatgatgagaaaaaatattataactaaaggctagaatttgtcatcttacaaaaatgtctgtggtcgcatgatttatatagaatgtaataattgaaaaatattagtgtttgtaatctaagacataataatgtattttactaaatcaggtttgtgaattatatatatttttatttcactagaatactcatttgggaagatggtagcttggaaatcaayaacattacaaggaatgatggaggtatctatacatgctttgcagaaaataacagagggaaagctaatagcactggaacccttgttatcacaggtaagttaatgtttgagggtgcttaatttctaatgtattaaaaaacatgattcagcactaagcatctaaacagtcaatgtatttgtaagtttctttttcaaaagaatttcaggcaagtttcttgcttgatgatattgttcttggaatttggaagtgaaaacatcttattattttgcacaaataaaaatatattggttattattttaata

SEQ ID NO: 159056 - DNA, 601 bp, Human
caaaaattgccctaaactgaaacttcatatttagagcttatttatattctttaaaatactaattacattgtgctggtacatgtaaataatgactgcaaaaagaaaatggaaaaaaaaaggaatttaaagagaaagaaaaatagatcccagtcccctttaaaaaaaaaaacaggaaaacaaagaaataactggaatactaattaggaaacaaataataaattagaccataaaaatgtaaaagaccttgtggccacttagtgcacactctcccttttcagatgatagctgcagagattcacayagttacccctccagctaatccagagcagagtcctgaccgcaggctcaccacctcaggtttcagttcattccatcaaataatgatctgacagtgggagcaaacctactcaactgactagataagcatcttaattgaatcagaatatcaaatgcacatgtttagcacttcatagatggacagatgcattcaattatctcgatttttaaaaagcctggataagaatcattttaaaataaatagttaaactgaattctatctttcaaaccaacacaagactaatgaagctatccctggcacctt

SEQ ID NO: 159057 - DNA, 601 bp, Human
gaccttgtggccacttagtgcacactctcccttttcagatgatagctgcagagattcacatagttacccctccagctaatccagagcagagtcctgaccgcaggctcaccacctcaggtttcagttcattccatcaaataatgatctgacagtgggagcaaacctactcaactgactagataagcatcttaattgaatcagaatatcaaatgcacatgtttagcacttcatagatggacagatgcattcaattatctcgatttttaaaaagcctggataagaatcattttaaaataaatarttaaactgaattctatctttcaaaccaacacaagactaatgaagctatccctggcaccttccttctcttttaaggcaaactacaaagttaaacttcactggtcaatatgccatgcaaaatttaagtaaaaacgctataaatatttgatccaccttttggaagatagtcctaacagctattaattgcttctaggattgttaatagatcattctcagaattagtggctcctcctatgaaaatcttagtgaatatatatatgtctcttaaataatgatttggtattttatgtagttctcccaa

SEQ ID NO: 159058 - DNA, 601 bp, Human
attaattgcttctaggattgttaatagatcattctcagaattagtggctcctcctatgaaaatcttagtgaatatatatatgtctcttaaataatgatttggtattttatgtagttctcccaatatttcaacaattgaatagcatttgttcattaagaatatgtactaagcacatgccataagcagacacagttgtaggcactaggttaaataaaacactgaaatagacatggacaccagcccaaaataaaccaatgataccccaagagtttaagattcagatgtaaatgttttttggtarctattacagttaacaaaaccaacataattaacatgttctaacaattttcattgctaaaaactaatacaggaagttctgactaataataaaaaggaatagggaaatcaaattttaaactttttatttcaagaacctaagtttttattttccaatttagtttcaataataaattgaattcaataattaagtatgcactgattttagcttgctattcttgattttaaccactaaggggcaaccttgtataaggattcaaatttcacagcccggtgtaatttgggacttcttttccttcatgaa

SEQ ID NO: 159059 - DNA, 601 bp, Human
aaataaaacactgaaatagacatggacaccagcccaaaataaaccaatgataccccaagagtttaagattcagatgtaaatgttttttggtagctattacagttaacaaaaccaacataattaacatgttctaacaattttcattgctaaaaactaatacaggaagttctgactaataataaaaaggaatagggaaatcaaattttaaactttttatttcaagaacctaagtttttattttccaatttagtttcaataataaattgaattcaataattaagtatgcactgattttagcttsctattcttgattttaaccactaaggggcaaccttgtataaggattcaaatttcacagcccggtgtaatttgggacttcttttccttcatgaaattaaacaaatgcatttgctcctacttatgaataaattgtgagattataggtgatttttaaatgtcttctttatattttttctaattaaagttatgtaattattaggaaaaatgtaactgtacatttttaaagatgtatatttcttttaagagtttaatgggaacaccaaaaaagcaaaaataacactgtctttgtatttagtaatcc

SEQ ID NO: 159060 - DNA, 601 bp, Human
actaaggggcaaccttgtataaggattcaaatttcacagcccggtgtaatttgggacttcttttccttcatgaaattaaacaaatgcatttgctcctacttatgaataaattgtgagattataggtgatttttaaatgtcttctttatattttttctaattaaagttatgtaattattaggaaaaatgtaactgtacatttttaaagatgtatatttcttttaagagtttaatgggaacaccaaaaaagcaaaaataacactgtctttgtatttagtaatcctactttatgtaaaactttrggattaatttattttttaatgtaactttcaattttaaggcagtaattgcacacctagtactgattatagaaaaacactaaggagttaaacatctaaaaatttcctgagtattatattaatatgtaataattgtcagatgttccactggaacttgaactcatgcatgggggatgttaaaaatacaagctcgaagcagaaatttaataaatctgaggctttgatacaataagatattaaagcagtttatctgccattcttttattttgttgatgttatatggcaaatgatcataaatgtttc

SEQ ID NO: 159061 - DNA, 601 bp, Human
gagtgtgatattccccttcctgtgtccatgtgatctcattgttcaatatttcattgtctctattcactattttggttgttgttgctgtttttgtgggttttcttcttttcttttctttcttttttttttttttttttttttttttgagacgtaggttagctcttgttgcccaggctggagtgcaatgacgcaatctcggctcactgcaacctctcccaggttcaagtaattctctggcctcagcctcccaagtagctgggattgcaggtgcctgccaccacacctgaccatttttttgtayttttagtagagatggggtttcaccatcttggccaggctggtctcgaactcctgacctcaggtgatccacccgcctcggcctcccaaagcactggggttacaggcatgagccaccgcacccggcctctattcactgttgaacaagaaggttaagattatccagaattatgtgggagaaaacgaggacggttgggcaataatccttggtaagaatcagattcgagccgaaaaaaattagagcaggataccaggcagccacagggagatcgtggaagccctgaagtattgtaactttggtccc

SEQ ID NO: 159062 - DNA, 601 bp, Human
tcttcttttcttttctttcttttttttttttttttttttttttttgagacgtaggttagctcttgttgcccaggctggagtgcaatgacgcaatctcggctcactgcaacctctcccaggttcaagtaattctctggcctcagcctcccaagtagctgggattgcaggtgcctgccaccacacctgaccatttttttgtatttttagtagagatggggtttcaccatcttggccaggctggtctcgaactcctgacctcaggtgatccacccgcctcggcctcccaaagcactggggttayaggcatgagccaccgcacccggcctctattcactgttgaacaagaaggttaagattatccagaattatgtgggagaaaacgaggacggttgggcaataatccttggtaagaatcagattcgagccgaaaaaaattagagcaggataccaggcagccacagggagatcgtggaagccctgaagtattgtaactttggtcccatgtggagacatttttggttatcacaactgtagaggtgttgagagggtgtgtgtgtgtgtgtgtgtgtgtgtgtgtgtgtgtgtgtgtgtgtattgcatc

SEQ ID NO: 159063 - DNA, 601 bp, Human
ctggcctcagcctcccaagtagctgggattgcaggtgcctgccaccacacctgaccatttttttgtatttttagtagagatggggtttcaccatcttggccaggctggtctcgaactcctgacctcaggtgatccacccgcctcggcctcccaaagcactggggttacaggcatgagccaccgcacccggcctctattcactgttgaacaagaaggttaagattatccagaattatgtgggagaaaacgaggacggttgggcaataatccttggtaagaatcagattcgagccgaaaaaarttagagcaggataccaggcagccacagggagatcgtggaagccctgaagtattgtaactttggtcccatgtggagacatttttggttatcacaactgtagaggtgttgagagggtgtgtgtgtgtgtgtgtgtgtgtgtgtgtgtgtgtgtgtgtgtgtattgcatctatttagctattaaatatcctataatgcacaagacagattccaaaaacctagtattatctggcccaaattatcgatagaaccaagcttgagaaacgtcctcaagaaagatattaaaaaagagacttagcaata

SEQ ID NO: 159064 - DNA, 601 bp, Human
agaaaacgaggacggttgggcaataatccttggtaagaatcagattcgagccgaaaaaaattagagcaggataccaggcagccacagggagatcgtggaagccctgaagtattgtaactttggtcccatgtggagacatttttggttatcacaactgtagaggtgttgagagggtgtgtgtgtgtgtgtgtgtgtgtgtgtgtgtgtgtgtgtgtgtgtattgcatctatttagctattaaatatcctataatgcacaagacagattccaaaaacctagtattatctggcccaaattatcratagaaccaagcttgagaaacgtcctcaagaaagatattaaaaaagagacttagcaatactgggactagccactgcaaggttttaagcatgatgtattggaaacaaagagatgttatattgttttgagcatctgagagtattggggacacgaataaaaagaaactagatttttcaaaatgcatatccaaaatagtttaagtagtagaggatgggttttatgtgcttcttgaatttaagactcttaaattttgatgagcagtggaaaagagggagaaatacataaaaagtatacaggctcc

SEQ ID NO: 159065 - DNA, 601 bp, Human
gaaacagcttgacttggtgaaactagggctatatattacctatggagccttccacaagtagcttaatgtaaaatctcaaggtccttatttctaaaatgggaatattaatagtaaatctttgggtagtgttacttctggaactcagaagtgaaaaggagatagtcctagtttcattattagggctatgaaattataaatataattacataaattgaataagaaaatgtatgtaaagtagctagcacattgctagacatttaaaaaacattcagtaaattagatttggtaatagtaggagttyaatagtagtatcagtagtggcagtaacaatagaagttatattagccattttaatagtaataggagcagttttagtagtattaatagcgacactagtaatattagtggctatagttatagtagttttgtgtcttcctctgtaaaatacagctaaaaatagtacgtatctcataggcttgttattaagagtaagtcagttcgcatgtatatttataacaacctttgacacctagttaaccctaattaaatatctgctgttagtagagttggtggtggtagtaatgtttgcagttggatatga

SEQ ID NO: 159066 - DNA, 601 bp, Human
taggagcagttttagtagtattaatagcgacactagtaatattagtggctatagttatagtagttttgtgtcttcctctgtaaaatacagctaaaaatagtacgtatctcataggcttgttattaagagtaagtcagttcgcatgtatatttataacaacctttgacacctagttaaccctaattaaatatctgctgttagtagagttggtggtggtagtaatgtttgcagttggatatgacatatttgctatagtatttttgctttctctactctaacaagccaaaagtaaagaagaaamgttttattatttcatggatatagcatatatcagacatatttaataatttttatgtttgtgaaacatattctttaaaggatgcacttctttccaaacatctatatctctccctttactctgaacttgaatggaacaaattatttaaatgacaattatgagctctaagttttatctagaccttttctgtaccatatagaatctttctttgttcactaagattaattcaatttgttaatacagcgtcatcactgagactcatttacattgcagaaatgattttgcagttagtttacgggggaa

SEQ ID NO: 159067 - DNA, 601 bp, Human
agttcgcatgtatatttataacaacctttgacacctagttaaccctaattaaatatctgctgttagtagagttggtggtggtagtaatgtttgcagttggatatgacatatttgctatagtatttttgctttctctactctaacaagccaaaagtaaagaagaaacgttttattatttcatggatatagcatatatcagacatatttaataatttttatgtttgtgaaacatattctttaaaggatgcacttctttccaaacatctatatctctccctttactctgaacttgaatggaacraattatttaaatgacaattatgagctctaagttttatctagaccttttctgtaccatatagaatctttctttgttcactaagattaattcaatttgttaatacagcgtcatcactgagactcatttacattgcagaaatgattttgcagttagtttacgggggaaggtgaaggaagggctgggtatttatatgttggaagtcttttgatttaaacttgggaaacttctaagtggtcaaccacatatacactttggaacatccctgagctttgctatcacaatttccagtatgtgattcaa

SEQ ID NO: 159068 - DNA, 601 bp, Human
tagtttacgggggaaggtgaaggaagggctgggtatttatatgttggaagtcttttgatttaaacttgggaaacttctaagtggtcaaccacatatacactttggaacatccctgagctttgctatcacaatttccagtatgtgattcaactctcctcatctgaagggaggaattttgtaattgagccaagctgtggcttttagtaaaaatacagtgagcatttgtatctaatttgtggctagaatgtgctgaggcccatgatctttacttgctttgtaagcgttctgccaaccactgagracctcaacttctcttgaggtatggaaagtgctagtagtatttacaaaaactttaggagtgctttcatacatacacaactatattgggaatgatactttatattttttcttctttccttctgagaagttttattgctacatgttcaccaaatgtagaaccagtgagaataaacattacagttgcttcttactgctttatgcaagtgggcttatcgataaaagagttaattttcaaactagtttaacattaaacttttagagtagtttaaaaatcgtaaaagagttcatggtgaaaaattaa

SEQ ID NO: 159069 - DNA, 601 bp, Human
ttcctcactaaaaattacttagacatatatgtcaattaacttttatgatagaccaagaaaaactcatatttaccttctctatatatgaatcttattctctgcttacctcaaaaaaaattttaatataagtaataaaataacatcttttacctcctttgttagatgaattctatttagtataagaagttaggccagctgcaaagttgggcacagtcccccaaaccaccctcacttctgacaccaactgcaagttcaaggggttgcaaaaatcaccctcagtttccatgcttcgctagaaggkattcacagaattctcttaaagctgttatatacatgggtacagcttcttacaggagaaggatacaaattaaaattagccaaaggaaaaagcacacagggcagagtcaagaagtacaaaacacagagcttctattatcttctccccgtgcagttaaaatgcattactctgactgctctgatgtgtgacagtatgcttgaagtactgccaaccagcaaagcttaccaagcctttctgtccagagtttttggggggacttcatcaactagacatgattgatggactcattgctcacatggttaa

SEQ ID NO: 159070 - DNA, 601 bp, Human
tataccctattcactgtggctggggcacaggagttaggtgcaggggtaatctgtggaggctgaaggtgtgtgtacttcactctcacacaagaaaagcctcattatttgtttagtaaatgctgtcactgtcatgggttatatgtacttgctaacataattctgaatgtagctgaaaagaagtgaatacatattatcttaagagcagataccaaaattcttgacaatttgacaagttcattcaaacaaggcatatttagcgtgattatttgcttggcactgtgctggacttgagaagacagcrcatacagctgtatacatatataacacagggatacaacatgtctgctaaataaaacagacgtatttcctcacatcaaacttatagtcggccagggagaacaacttcaaccacataatcacaaaagtgtttaactgcatttacgatatgtaatatgacagaagtttcatggtagcataataaaatatagaaagggtacctgcctagtccacagaaaatggaaagacttgctggagaaaatgatttcaactggtattgggtagaggtgaaggtgataggggagggggtattgaggttatgagg

SEQ ID NO: 159071 - DNA, 601 bp, Human
gagttaggtgcaggggtaatctgtggaggctgaaggtgtgtgtacttcactctcacacaagaaaagcctcattatttgtttagtaaatgctgtcactgtcatgggttatatgtacttgctaacataattctgaatgtagctgaaaagaagtgaatacatattatcttaagagcagataccaaaattcttgacaatttgacaagttcattcaaacaaggcatatttagcgtgattatttgcttggcactgtgctggacttgagaagacagcgcatacagctgtatacatatataacacagggatacaacatgtctgctaaataaaacagacgtatttcctcacatcaaacttatagtcggccagggagaacaacttcaaccacataatcacaaaagtgtttaactgcatttacgatatgtaatatgacagaagtttcatggtagcataataaaatatagaaagggtacctgcctagtccacagaaaatggaaagacttgctggagaaaatgatttcaactggtattgggtagaggtgaaggtgataggggagggggtattgaggttatgaggggtatgaatcacaattccagaagacaagac

SEQ ID NO: 159072 - DNA, 601 bp, Human
caacatgtctgctaaataaaacagacgtatttcctcacatcaaacttatagtcggccagggagaacaacttcaaccacataatcacaaaagtgtttaactgcatttacgatatgtaatatgacagaagtttcatggtagcataataaaatatagaaagggtacctgcctagtccacagaaaatggaaagacttgctggagaaaatgatttcaactggtattgggtagaggtgaaggtgataggggagggggtattgaggttatgaggggtatgaatcacaattccagaagacaagacaatrtgatgaaccagagactgaagagaacaagatacatttgtggtcctaaaaagagaatgttctgcctggagagcagagtgtgagtgagatggcacactaggtgagctggagcatcagagagagcctagagaatggaatcaagttggctacaataatgctatggcttttgtcccaggaaagggaaattttaaaggtttcagtttatctgcttttatggagacaagtgagttgggcccagctgcatttttaaaaggttattctaggtaaccaatagaggaaagaatagagtggaacagtggtgga

SEQ ID NO: 159073 - DNA, 601 bp, Human
agaacaacttcaaccacataatcacaaaagtgtttaactgcatttacgatatgtaatatgacagaagtttcatggtagcataataaaatatagaaagggtacctgcctagtccacagaaaatggaaagacttgctggagaaaatgatttcaactggtattgggtagaggtgaaggtgataggggagggggtattgaggttatgaggggtatgaatcacaattccagaagacaagacaatgtgatgaaccagagactgaagagaacaagatacatttgtggtcctaaaaagagaatgttctkcctggagagcagagtgtgagtgagatggcacactaggtgagctggagcatcagagagagcctagagaatggaatcaagttggctacaataatgctatggcttttgtcccaggaaagggaaattttaaaggtttcagtttatctgcttttatggagacaagtgagttgggcccagctgcatttttaaaaggttattctaggtaaccaatagaggaaagaatagagtggaacagtggtggaagtagtgatcaaataagatgtaggggttcaggtgagagatgtgggtagtttggacaagagg

SEQ ID NO: 159074 - DNA, 601 bp, Human
aggtgagctggagcatcagagagagcctagagaatggaatcaagttggctacaataatgctatggcttttgtcccaggaaagggaaattttaaaggtttcagtttatctgcttttatggagacaagtgagttgggcccagctgcatttttaaaaggttattctaggtaaccaatagaggaaagaatagagtggaacagtggtggaagtagtgatcaaataagatgtaggggttcaggtgagagatgtgggtagtttggacaagaggcagtagtgatggaaagaatggataaattcaagaawttatgatgagtttatgagaaagttgaagaaagggaggggttaagaatgtcctagaagttcctggaaagtcagatgactagaaaaaaatgagtatttgaggaaggaaagccaaatgctatcaagaagtcaaataagatgagctgaagcagtgggactcagatgagaattgattgaagagtaagaaatgaagaaatggaaaaactaaaaacagaatagatattgtcagaatccaagtaaaaatcaaacaatcaaacagcttaatatgagaaaataagaattatttatttccaagagaaagaa

SEQ ID NO: 159075 - DNA, 601 bp, Human
aagaaatggaaaaactaaaaacagaatagatattgtcagaatccaagtaaaaatcaaacaatcaaacagcttaatatgagaaaataagaattatttatttccaagagaaagaagagaaaagaagagagaagtaagagattggtagtaggagtggctgccaacaagatggcagagcactgggagaggtgaaggttactgggaaattcccagtaaatttacggccaacaggacttttaaaaacagaattatgcagtggatgatacttttcaaggttgatttaccctaccttttttttttttttgatataaccagttccagctccttcagttgttcagtaaactaactttactaggtaagacttcatgctatttggttttctgataaaatagagaaagtgctgaatttctagtctggagctccctggtatgacaaaaataaataaataaataaataaataaataaataacagaccaagaggacagaaggaaaaaaactcccctattgcaggaatttgtagaaatcttgggaactgtttcaatttttgaccaatctatacctcaagggactggaagatctcaatcgacattaaattaagactggc

SEQ ID NO: 159076 - DNA, 601 bp, Human
aattgagttttccaagttttcattctaagaaaatatcttggagataattaacatgaactttgacatgctcctgctaccatacaagctgagtgaccttagttatcttagttaaattacttggattccttaagtctaacttttactgttaatcaaatggatataataagacctatctcatagggcagttgtcaaaaaagaattgaataaaagtgtgtgtatgtgtgtgtgtgcctgtatgtgtgtatgtatgtgtatatgtgtgtgtgtatatatgtgtgtgtgtgtgtgtgtgtgtgtgtggatgtatgtatgtatgtatatacttgcacagaccaggacccggtatagagtaggcattgaataactattagctatttttggaaattacattgaaatggtgtctcatcatcacaagcaaaatttcctcaagactcaaaaatatgtgttgaacactcttggaggcaatagaatagagcattgaacaaaacaaatactcttgtcctcgcagaacttataatttggcaacagagtacatgttagtggaattgtacattttctcaatttctgcaaacttttagtatctttgtaaaatgaactgtgg

SEQ ID NO: 159077 - DNA, 601 bp, Human
gaaagttacaccacatatctcctactaaatgtttgtgctttgtagacttaccaaaagttctcgtttcctgctaatactttttagtgtgttgtgtatagtgctgtttccttttttatttctatggaaaagatatatactgatgctgtttactataacctcaactgttatatatttatcacttttgtcttagagtgtaaagttaatttatacatgtatcatgtttttatttgttgctggttttttcaaattagtgttttcgttcttatgaataatataattgagattgtgatggaatatacayttattaaaaatgcaacccctttgctactggccgctgccatagcagtgaggctggctgggaacacagcacaccttgtttaaaataaagagctggctcttcactgactgccctttagttttgcacccaagaagtaccatgtgttgaccccagcttgcttacctttaatatctcacttcatgtaaccaactccaaccatctaactaatccacaaaaatacactttaacttccatgtcagttgctttattcacagtattccttccatgtctttttctcatgatttgttgaccaaatcttattca

SEQ ID NO: 159078 - DNA, 601 bp, Human
atgaatacatagtaagaacagtgttgctgccctaatcaacatgtgtgtgtgcgtgtgtgtgcgtgtgtgcacgcatttgtaattgtgggtggaaaagggtgagtatatgcatacagcatgatgaaagcaatttctatcagaaaagaagtgtgttttaatttattccttgcctttttattgtatattgagcttagaatgtaagcagtcaagtagttaaatctgaatgcctctaaatataaaactaaaattaaatgtaggaaaaatatagtcaatggaaaatgtagcattggatctgatttcwtggggccttttactgagagaaaacactcccgctgtgagttttttgtgtcatgtatggtaggatttagaaatgaagaaagcagtggcaattgtcgccaaagaaaaacaatctgtagaaaatgtccccgataataagatatgaactattgtaattctgtaaaagcataaatgtgtacttatagaaagctatagcactttaatttatttaccatataactgggtccaaagatgcttgaggaaaagaggccagtaaagttgcatgcattgtctaatcctccagctctgcaaacaacttcaaatc

SEQ ID NO: 159079 - DNA, 601 bp, Human
atcactatagattacttaatatttaagaggccttaaatatgttgcgttatgtttaaaatgtttaaaatatttatattttaaaatgttaatattaatatttaaaatgttaatatttaaaggtcttaaatatgttgccttatattgccttagctttaaaataagaaccaggtattacacttcagatgtttttaggcttctggtataaaagtctacattaagagtattgatacaaatttcctctgttgttgcaataaaatttttatttcttaggtcccataaaagtatatttcgggttgcctcrtcaaagtaagtgtctgatgcttgtgaacagccctgtatgaatattttttagcaaacaacatttctaaagctcttcagctaaaagagtgtcatttagaggcaagagttttgcaggatttatacagcaagatttattttggaaacctatgtgcagcttgccaaatctaaattctcattcatgagtgcacctttggacaacattcaaaaatagaccataaaattaggccccaaatgaaaaagaaattaggctttaacttgtacatgtattaccactttctctggtatttctgatgtattataa

SEQ ID NO: 159080 - DNA, 601 bp, Human
aatgtcttacgaccttttttttactatttaccgtaaggactgaatttacaacaagcagtcagcataggcaagttttcctagtttccgtttcttctatttaaatagctatctccagggggcagtagtggctataaaatggtataattctaataataactatccttagttatgcgtaggggaatgaggtaggtgatcactctgttaattacatggttttctataacaatattgctgtattaatatacacatactgttgttaaatgattacatggttttctataacaatatttctgtattaatwtacacatactgctgttaaatgatttgcatggtgtgatctaaaagctgtggcctttggtattaggtaaatcgattagatatccactttgcctacctaacctatggtcttaggctagtctattaatcactgtaagcctcaagttccatatttatgaaagagaatatgagtagttacagtccatacattgttcatggcaactttttataaacattgtcctttacttccttccctttactatgaatgtatatatcgacataagaaataaataaaatataactcaagacacagttctcacaaaac

SEQ ID NO: 159081 - DNA, 601 bp, Human
tggtagagatatttaataagattcagcttcatcttagtacaacttcaaacatcaacatgatcagaaaacattgatttatattttaaaataggatattggagccattgtcttagataattttcaaggcaagaacaagcctgcaataaataatgagactttgacattccttggcgaagaagatgtctcctgccctaatatgactgtcactcagcaatttcaattttatgtttacttgatttaaaaagggaggataaattgttctgaaaagttttttgtttccttaacatttcaaagttttcaytgaaatttgttgttttggtaaaaataaacagttaactacagaatatttttacgtggtgctttgcttttaattacttactagggaattaccagtggaaaaaagaatgtcaccagtgtttttcctacttacaccagttctgcagcatgaatatttatattaaatgtatgtgctatatgaattccccaaagggtcagtagttttggggggtttatttccaactatagttgtttagaaagccagtgtttaagagggagagagcaggttagggctactatctaagtagtggcaccaactcaaatg

SEQ ID NO: 159082 - DNA, 601 bp, Human
atttgttgttttggtaaaaataaacagttaactacagaatatttttacgtggtgctttgcttttaattacttactagggaattaccagtggaaaaaagaatgtcaccagtgtttttcctacttacaccagttctgcagcatgaatatttatattaaatgtatgtgctatatgaattccccaaagggtcagtagttttggggggtttatttccaactatagttgtttagaaagccagtgtttaagagggagagagcaggttagggctactatctaagtagtggcaccaactcaaatgatacrtggggtgtagtcacagctactttacatcctgtttataaattgagacacgaggatcttaatttctagtcttctatccaatttgatttatcaaaaaaatgaatcttgattattgattaagaaaatatggtcagcttactatgtgtgaatggtcatttggaaaatttatatattgttttctcactatctttcctcaaatgtctaaattcctcttcattgaatgttactacatttttaaagcagaaatgacagaactgattaactatatttctcctcatttttaaaaattagtttacatatgaa

SEQ ID NO: 159083 - DNA, 601 bp, Human
tggtgctttgcttttaattacttactagggaattaccagtggaaaaaagaatgtcaccagtgtttttcctacttacaccagttctgcagcatgaatatttatattaaatgtatgtgctatatgaattccccaaagggtcagtagttttggggggtttatttccaactatagttgtttagaaagccagtgtttaagagggagagagcaggttagggctactatctaagtagtggcaccaactcaaatgatacgtggggtgtagtcacagctactttacatcctgtttataaattgagacacraggatcttaatttctagtcttctatccaatttgatttatcaaaaaaatgaatcttgattattgattaagaaaatatggtcagcttactatgtgtgaatggtcatttggaaaatttatatattgttttctcactatctttcctcaaatgtctaaattcctcttcattgaatgttactacatttttaaagcagaaatgacagaactgattaactatatttctcctcatttttaaaaattagtttacatatgaatgaaaactgagtaaaaatcaaatctatattttgttcatacataggtatg

SEQ ID NO: 159084 - DNA, 601 bp, Human
tcagtagttttggggggtttatttccaactatagttgtttagaaagccagtgtttaagagggagagagcaggttagggctactatctaagtagtggcaccaactcaaatgatacgtggggtgtagtcacagctactttacatcctgtttataaattgagacacgaggatcttaatttctagtcttctatccaatttgatttatcaaaaaaatgaatcttgattattgattaagaaaatatggtcagcttactatgtgtgaatggtcatttggaaaatttatatattgttttctcactatcyttcctcaaatgtctaaattcctcttcattgaatgttactacatttttaaagcagaaatgacagaactgattaactatatttctcctcatttttaaaaattagtttacatatgaatgaaaactgagtaaaaatcaaatctatattttgttcatacataggtatgtttttctaaaaacattagtaaaatccaggaaagattaccaaatatatttatagcaatcaataaagagtgggaatgtattgaatatgaatttataaatggatgatgtgtttatctttacttatctgagttaacactga

SEQ ID NO: 159085 - DNA, 601 bp, Human
gcccaggcaacgtggtgaaacctcatctccataaaaataaaaaataaaaataaaaaataaaaaaaagctatgatcagtatgttacagtttttgtcatattttccaaaatattcacttgtatacaagtaattcatattcttcccaaaaagaaaagtcagcaacggaaacctaataacatttttgaatgtgatactgacaatgctgttttaaaaatattgtttttaggatagttgttgaaaatttggtctcatgacaaattgattaggctcagattctaactttgacatttacttgctgggtgaacgtggccattttatttaacctattcctgtctgtttcctcacctgtaaaataggaaaaataatagcacttacatcatagggttattggtaagaattataaaagatttggcagtgacttcaatataagtactcagaaaaaagcataatttttattaaaatgtacagtataaatttcccctttttgaatgactaataattttataccatgtaaattttatattgttagcagttcaagtccaaagagaacaatagtgtagacttgttgtcatccaggtaattacttggaagtcttttgcaga

SEQ ID NO: 159086 - DNA, 601 bp, Human
taaaatggattatatatatatatatatatatatatatatatatatatatatatatgttttagtggactcttaaatgtatgtgatctaccttaaatattgaaatgtttctattatttgtctgtagtgcatgatttaattgtaaaaatgttgaaaacataaatttagagaaagagagtaggggtgtggcaaatgagactctgcattgaaccatgaatgacagaatgacaggagatcattcaggccgtttccccagtcctttactaggttaaaaagtgacagaaacaggtctcagtagctgttygtaaacttgtttttagtcaactttgaagaacccccaaggtaagaaacataacactaacaaggactttgatagatcattatttttgtatgccccataggtgaaattttatggaacattctcagtcagcattctctaagaggaatttttaaagtgagagtgaaagaatataatgggtgcaaaacaagaatagtaagagagggggtcatgcaaataggaaagaaagaatagtccatagaggcagccaccatctgaagtacagaaaggtagcccaaagaagggtagcaatttgaacactatgat

SEQ ID NO: 159087 - DNA, 601 bp, Human
ctaaaaacaatcctatatgttcggtttttattactcttgttttacagatgagtaaacaggaacttaacgattttaagaaacttgcccaagataaatcagggcacagaactgaaagctgagtctatcttaattctaaaatccctgttttttaatacaattatgattttaatagtattatttttctcaggcatttttggggagatatttgtaggcaattactagatggaaaaatctacttcatatcagtggaaccattaccgagtaaaattcccacaccagggttttgaagataccaacacamccctttccatttgtcttctcgattccacctcttcatgatgatatagtatttcaagacaattggaaaaatgaagactgtattgtggatgacaattatgtttacagaactgcctgaacattaattataataaatttatttatctatacaccaaatatttatgaagaacctaccataggccagacatgtatccgagaaaacaatggacaagtataattatagtgttttgctcaacaatattacccttaaatgagtggatgactgaattattatgcatataatgtctcaacaaatacactaata

SEQ ID NO: 159088 - DNA, 601 bp, Human
tatttttctcaggcatttttggggagatatttgtaggcaattactagatggaaaaatctacttcatatcagtggaaccattaccgagtaaaattcccacaccagggttttgaagataccaacacacccctttccatttgtcttctcgattccacctcttcatgatgatatagtatttcaagacaattggaaaaatgaagactgtattgtggatgacaattatgtttacagaactgcctgaacattaattataataaatttatttatctatacaccaaatatttatgaagaacctaccatargccagacatgtatccgagaaaacaatggacaagtataattatagtgttttgctcaacaatattacccttaaatgagtggatgactgaattattatgcatataatgtctcaacaaatacactaataatatgcagctttattctgacctttatgaaatattactcatttgacacctcaagaacatcagagaataacagcagggaaatgatttacattttaatggttaatgactaacctatgataattttgtcttaaattccctttaacgttttctgaatgccatacccctatgctcagaaaa

SEQ ID NO: 159089 - DNA, 601 bp, Human
atttgtcttctcgattccacctcttcatgatgatatagtatttcaagacaattggaaaaatgaagactgtattgtggatgacaattatgtttacagaactgcctgaacattaattataataaatttatttatctatacaccaaatatttatgaagaacctaccataggccagacatgtatccgagaaaacaatggacaagtataattatagtgttttgctcaacaatattacccttaaatgagtggatgactgaattattatgcatataatgtctcaacaaatacactaataatatgcagytttattctgacctttatgaaatattactcatttgacacctcaagaacatcagagaataacagcagggaaatgatttacattttaatggttaatgactaacctatgataattttgtcttaaattccctttaacgttttctgaatgccatacccctatgctcagaaaaagtaactgaatgcatgcattacagggctttttcttcatttgagaaattcttttattattcacctctaattttttattttaacactctgaaatattctacttagtaattgacttaggatgctgcattatgtgaag

SEQ ID NO: 159090 - DNA, 601 bp, Human
acttattcttatgactataactaacatgaaatgtattatgcaaaatgatacatgaaattattcccagaaatttccacttcaagtaaaatgaattacctataacatttagagttataagaaagtatgtgggccagtgcggtggttcacacctgtagtcccaacactttggaatgcctaggcatgaggatcacttgagcccagaacttggagaccagcctggacaacacggtgaaacccagtctctgcaaaagagtacacacatgcacacaaaaattagttgggtgttgtggagtgcttgtastcccagctacttgggcggctgagctgggaggatctcttgagctggggaggcagggagaggctgcagtgagccatgatcatccccactgcactccagcctgggtgacagagtgagaccctaactcaaaaaaaaaaaaaaaaagccacaaagaacaaagaggatgtgttcagttctggggaggcagaatgacaatagaccaaatgttcccatatctaaactgaattgtgctaccatctgattcatgcattcagcaagaattcattaaatcatgctatgctacaatctgttaggtccccttgg

SEQ ID NO: 159091 - DNA, 601 bp, Human
agaaagtatgtgggccagtgcggtggttcacacctgtagtcccaacactttggaatgcctaggcatgaggatcacttgagcccagaacttggagaccagcctggacaacacggtgaaacccagtctctgcaaaagagtacacacatgcacacaaaaattagttgggtgttgtggagtgcttgtagtcccagctacttgggcggctgagctgggaggatctcttgagctggggaggcagggagaggctgcagtgagccatgatcatccccactgcactccagcctgggtgacagagtgagamcctaactcaaaaaaaaaaaaaaaaagccacaaagaacaaagaggatgtgttcagttctggggaggcagaatgacaatagaccaaatgttcccatatctaaactgaattgtgctaccatctgattcatgcattcagcaagaattcattaaatcatgctatgctacaatctgttaggtccccttggtgccaattgcatataatgagtcagagattactatatctgcataacaatgtcatttttaaatgatagcatttatccccttccttaaaaagagatacatgaaatcattcagtgaaaac

SEQ ID NO: 159092 - DNA, 601 bp, Human
gttcacacctgtagtcccaacactttggaatgcctaggcatgaggatcacttgagcccagaacttggagaccagcctggacaacacggtgaaacccagtctctgcaaaagagtacacacatgcacacaaaaattagttgggtgttgtggagtgcttgtagtcccagctacttgggcggctgagctgggaggatctcttgagctggggaggcagggagaggctgcagtgagccatgatcatccccactgcactccagcctgggtgacagagtgagaccctaactcaaaaaaaaaaaaaaaaagccacaaagaacaaagaggatgtgttcagttctggggaggcagaatgacaatagaccaaatgttcccatatctaaactgaattgtgctaccatctgattcatgcattcagcaagaattcattaaatcatgctatgctacaatctgttaggtccccttggtgccaattgcatataatgagtcagagattactatatctgcataacaatgtcatttttaaatgatagcatttatccccttccttaaaaagagatacatgaaatcattcagtgaaaactacaaatgatatcacttcttataat

SEQ ID NO: 159093 - DNA, 601 bp, Human
cacctgtagtcccaacactttggaatgcctaggcatgaggatcacttgagcccagaacttggagaccagcctggacaacacggtgaaacccagtctctgcaaaagagtacacacatgcacacaaaaattagttgggtgttgtggagtgcttgtagtcccagctacttgggcggctgagctgggaggatctcttgagctggggaggcagggagaggctgcagtgagccatgatcatccccactgcactccagcctgggtgacagagtgagaccctaactcaaaaaaaaaaaaaaaaagccayaaagaacaaagaggatgtgttcagttctggggaggcagaatgacaatagaccaaatgttcccatatctaaactgaattgtgctaccatctgattcatgcattcagcaagaattcattaaatcatgctatgctacaatctgttaggtccccttggtgccaattgcatataatgagtcagagattactatatctgcataacaatgtcatttttaaatgatagcatttatccccttccttaaaaagagatacatgaaatcattcagtgaaaactacaaatgatatcacttcttataatctata

SEQ ID NO: 159094 - DNA, 601 bp, Human
ctatgctacaatctgttaggtccccttggtgccaattgcatataatgagtcagagattactatatctgcataacaatgtcatttttaaatgatagcatttatccccttccttaaaaagagatacatgaaatcattcagtgaaaactacaaatgatatcacttcttataatctatatttaaaagaaatgcagacacactgattatattggacaaatgttctttagattaatggttagaagacatttttatattctaatgtgtgtttgactcactagatggaattcactgattcattacccamattttcatttcaggccctccaggccctccaggtggtctgagaatagaagacattagagccacttctgtggcacttacttggagccgtggttcagacaatcatagtcctatttctaaatacactatccagaccaagactattctttcagatgactggaaagatgcaaagacaggtgagttttatttgtctgattaatccgtgcatgttttcaaagtgaattcttttctcaaaaacaaaaatttggaggttttaaaaatgtcattatctaccttgaaaggctttctttcttaaattttttaa

SEQ ID NO: 159095 - DNA, 601 bp, Human
ataatctatatttaaaagaaatgcagacacactgattatattggacaaatgttctttagattaatggttagaagacatttttatattctaatgtgtgtttgactcactagatggaattcactgattcattacccacattttcatttcaggccctccaggccctccaggtggtctgagaatagaagacattagagccacttctgtggcacttacttggagccgtggttcagacaatcatagtcctatttctaaatacactatccagaccaagactattctttcagatgactggaaagatgcraagacaggtgagttttatttgtctgattaatccgtgcatgttttcaaagtgaattcttttctcaaaaacaaaaatttggaggttttaaaaatgtcattatctaccttgaaaggctttctttcttaaattttttaaaatgtattctaatattttggtaatgaagaaaattacatagaatttacacatttaaatgtgttaaagctatagaaaaagaagtatcatttctaaatcaatatataatggaaagcaaaatgaggcctcctgggtttcttacttgagttttgtgtgagatttactgcc

SEQ ID NO: 159096 - DNA, 601 bp, Human
gtgtgtttgactcactagatggaattcactgattcattacccacattttcatttcaggccctccaggccctccaggtggtctgagaatagaagacattagagccacttctgtggcacttacttggagccgtggttcagacaatcatagtcctatttctaaatacactatccagaccaagactattctttcagatgactggaaagatgcaaagacaggtgagttttatttgtctgattaatccgtgcatgttttcaaagtgaattcttttctcaaaaacaaaaatttggaggttttaaaaatgtcattatctaccttgaaaggctttctttcttaaattttttaaaatgtattctaatattttggtaatgaagaaaattacatagaatttacacatttaaatgtgttaaagctatagaaaaagaagtatcatttctaaatcaatatataatggaaagcaaaatgaggcctcctgggtttcttacttgagttttgtgtgagatttactgccccaaaatcatcgggaagtctatttttgagcaaatagcatttatagcatattatttatgaccctttttatttgggtatatatgtactatagtt

SEQ ID NO: 159097 - DNA, 601 bp, Human
aatagcatttatagcatattatttatgaccctttttatttgggtatatatgtactatagttctgaatttctaaaaaaccacattgatcataaatcttaaattaagcatccaaatcttactactataaccctttatgtgaatgatctcacccggtttgaatttcctcaaaacagatttttaaagacattttggatctttcaacctttttcttttcttatattaagattttctaaagttgatcgggaaaaattaactaagaataagtgggtactttcctttgtctacaactttgccatttgtyatgactagcctacaatatcacacattaatacatatattttctcctgtaaaatggaagattgaagacctttttgataaaataacctgtttatctttgtaacttttgacaatatttttaaacaaacttgtcattgccagaattctttaagatggaaaagaggagacatagaaatattttcccagttgtcacaagaggagaaatgagacacgagtgtgtgaataaaatgttcctcctttttaaaaaactaaaaaaaaaaaaaatactctaatctcccaaatctgctttcattttagatttatc

SEQ ID NO: 159098 - DNA, 601 bp, Human
atctgctttcattttagatttatcttaacataatggaaatcccatttccaaaatgccaatatttgtattgctcactaagatattttaatttaaatttacttctatttgatacttctctccctccagggaaataaatcaaatataaacttgaggtctgttgcaaggatttaggatatattttaatatcagatgattccccacctaagtgtataaagttgcaataaattagaaataggtgaaatatttccattacattatgcttattgttttaagaattatctgtaaatattcttgacaaaawcagatcatctgaaaaataattttaaaaaccttttagatactttataaacctaaagcatgggcagtttctacttttctgaagagaatggaaaagtatgataataatgaaactattagaaatctagccacattaaaataaataaatggtttaaatttggtttggccctgaaaaaagaaatactaattgcaatcattttcattatttatgtatgcttactatgtagctcaatttaaatatgcttcttattttaaaatatccactagaaagtaagttccatgaaggtaaaaactgttttattca

SEQ ID NO: 159099 - DNA, 601 bp, Human
gaagagaatggaaaagtatgataataatgaaactattagaaatctagccacattaaaataaataaatggtttaaatttggtttggccctgaaaaaagaaatactaattgcaatcattttcattatttatgtatgcttactatgtagctcaatttaaatatgcttcttattttaaaatatccactagaaagtaagttccatgaaggtaaaaactgttttattcactgttctatctctagcacctatatcagggcccacagtgctcattcattaaacatgtttattgagtccccactgtgtgycagaacctattctagatgcagtatgtataggtgagtagcagtgaacataataacaacaataaaacctgtcttcaaggagcttatattatagtagaagagatgccaatacagaattaaaatatatagtaagtcatgtggtgatgaatgctagagagaaacaacagaaaagaggaatggggaagtaggagatgtgttttaaatagggtatttctcatattctcactcataggtgggaattgaataatgagaacacttggacacagggtggggaacatcacacaccggggcctgtcttggggt

SEQ ID NO: 159100 - DNA, 601 bp, Human
ctctatatgtcacaaacccaataatcttatattaatattatcactttctataaatgtttgcctattaaaccaatatgtttatattatcctttgttaatttgtctgttatattatcctttatatttactacttctaatcctcctcacttgttcatgttgatttgaatttcatctgtctaagtctattttgcattgctataaagaaatatctgaggccgggtgattttgaaagaaaagagttttatttggctcacagttctgcaggatatacaagaatcatagtgccagcatctgctccttgygagggcttcaggaagctttcattcatggtgaaagcaaattggcttgtcacatggtgagagagggagcaacaaagagagaagcaaggtgctaggctcttcgtaacaatcagttcttgcatgagctaataaagcaagaactcactcattattggaagaaaggcacaaagtcattcattgggaatccacccccatgacccaaactcctcttattaggccccacctccaatattggggatcaaatttcaacatgagatttagagtggacaaatataccaactatgtatcaccatctgatatgat

SEQ ID NO: 159101 - DNA, 601 bp, Human
atatgtcacaaacccaataatcttatattaatattatcactttctataaatgtttgcctattaaaccaatatgtttatattatcctttgttaatttgtctgttatattatcctttatatttactacttctaatcctcctcacttgttcatgttgatttgaatttcatctgtctaagtctattttgcattgctataaagaaatatctgaggccgggtgattttgaaagaaaagagttttatttggctcacagttctgcaggatatacaagaatcatagtgccagcatctgctccttgcgagrgcttcaggaagctttcattcatggtgaaagcaaattggcttgtcacatggtgagagagggagcaacaaagagagaagcaaggtgctaggctcttcgtaacaatcagttcttgcatgagctaataaagcaagaactcactcattattggaagaaaggcacaaagtcattcattgggaatccacccccatgacccaaactcctcttattaggccccacctccaatattggggatcaaatttcaacatgagatttagagtggacaaatataccaactatgtatcaccatctgatatgatttct

SEQ ID NO: 159102 - DNA, 601 bp, Human
atatttactacttctaatcctcctcacttgttcatgttgatttgaatttcatctgtctaagtctattttgcattgctataaagaaatatctgaggccgggtgattttgaaagaaaagagttttatttggctcacagttctgcaggatatacaagaatcatagtgccagcatctgctccttgcgagggcttcaggaagctttcattcatggtgaaagcaaattggcttgtcacatggtgagagagggagcaacaaagagagaagcaaggtgctaggctcttcgtaacaatcagttcttgcaygagctaataaagcaagaactcactcattattggaagaaaggcacaaagtcattcattgggaatccacccccatgacccaaactcctcttattaggccccacctccaatattggggatcaaatttcaacatgagatttagagtggacaaatataccaactatgtatcaccatctgatatgatttctttacaactttgctcctacctgtcccctttgtgcagctagtatcaaatatattacatttaaatatattatagatccaataagacaattatatatatacatgcatatataaatgcac

SEQ ID NO: 159103 - DNA, 601 bp, Human
aattacttttaaataagttaagagaagatagaagaaaaaataagtatttatatcatcttttataattacaaaattacctttaccaatgctcattattttgggggagtttattcaaattgctgtttgggatcaactactttcaacttgaagaactttaattttgttttgtaagataagtcttttactaacagtttctctcagtttttgtttatctaggagtgcattttgcctttggttttaaaatatatttgcttggatatgatattcttggttgacagtttttgtttttcttttctttttyactgctttgaatatgtcatcttagatgccttttttaggctgagaagattgttttctattctatttgctgaaaagtgtctcaaaatccctttatatttaccagtatatttattatatctgggttcctcattcctttctgtaaaactctttttttatctggtataatttgcattactaagaaacttatagcatttcaaattgttcaggttgttggactcaaaggtttttacattttttctatcagaaaatgtctttaatttcatctttaagtattatttttatttcatacaaaatccaaatt

SEQ ID NO: 159104 - DNA, 601 bp, Human
ttaaagtctagctctgttgatttattttttctttcttgacagtgggtcatatttctttgtttgctcatgtgtctgataactttttgctcaattccaaacattgtgtatagaagaacagtgattactaaagtaaatattaattgatgtctgggaaagtgcatgtcattactttagggactgagtcaatcagatttgtagttgagatgatctgagcattgttagattcagtttagcacaggcttcaagtaattcgaatgtatgatcagacctcctacatatctgagtgtctggaggttttcckgtcctgctatcagatttcggcagactcttctacgttggaccccacagagggctctttcagttcccctgcttctgcccagatacctgctgctgataatcagtctaaagcccagagtgctcgggctttttactcagttctccttctcttcccttagacttcaacaggtccaaagcacctgtccctcacggggaagcagatctctctcagcactcctgccactatctcatgtttgtggtatcggtgccgcagagggaagtcttttttggctcttttgttctgccccaaaactttcttgagtac

SEQ ID NO: 159105 - DNA, 601 bp, Human
tcagatttgtagttgagatgatctgagcattgttagattcagtttagcacaggcttcaagtaattcgaatgtatgatcagacctcctacatatctgagtgtctggaggttttcctgtcctgctatcagatttcggcagactcttctacgttggaccccacagagggctctttcagttcccctgcttctgcccagatacctgctgctgataatcagtctaaagcccagagtgctcgggctttttactcagttctccttctcttcccttagacttcaacaggtccaaagcacctgtccctcamggggaagcagatctctctcagcactcctgccactatctcatgtttgtggtatcggtgccgcagagggaagtcttttttggctcttttgttctgccccaaaactttcttgagtacacatgatgaaggcctatgaaaaataattgtcaaattactatagattctccttgttctttgatctccccacgtttttaaacagccataccagcctatactttgtctgtaaatatctgttagaagttaaactgttttcttcttgctaacatctgtgactacaaccttctttcatcactgttctaccaa

SEQ ID NO: 159106 - DNA, 601 bp, Human
atctttgaattattgcttacagctggttgctaaactgagtactttggcctaagtactaaagtaagaactaaggtctcctgctttatatctctttgcttaaaatttacactaaaagtaaaacaaatttttaaagaactacccatttaatacacaaagtttagttttttttaaaagagagatgcctctaacaggcattatactgttaagatctgatttttcactgctgagattaactgtattgcctgactcagaactgacccggttaaaaatcaggtctagaacaaggtctgctcctgatccmtccccagtatttgcctccattatgcaaagtactttactctctttctggctccaagaataacaaacaggttgcaaggaacttggctgaagaaaaaggacacaaagtctctccgttcctgtttctcttcatttggcttgaggcataaatctgcttccaaagcaaagctgacttctttagggagcaggcctctgctcccaaactgcataggtgattttggaagcagtaaaaaaagaagaaagagaagaagagaaaaggatccaatagttcctaccagggcttaaggaataggaaagaagattg

SEQ ID NO: 159107 - DNA, 601 bp, Human
acagcctgttttctataaggggttaaaatcattgaaaagtgtccagtaaaaaagggctaccttggccgggtatggtggctcacgcctgtaatcccaggactttgggaggccaaggtgggtggatcacgaggtcaggagatcgagaccatcctggctaacacggtgaaatgccgtctctactacaaatacaaaaattagccgggcctggtggcataagcctgtagtcccagctactcgggaggctgaggcaggagaatggcgtgaacccaggaggcagagcttgcagtaagcagagatcacscaactgcactccagcctgggtgacagagtgagactccgtctcaaaacaaacaaacaaacaaacaaacaaaaaggctaccttactcagcgttatcagttatcacttcactctgtaaacagcccttcacaaaccaaaacttcactttacttctttcaattacctagaaaaatgtccttatgcatgtgaattaaaacaaacagtttccgatttggtgtgagggaggagtgaaagaggagataaagaggtagaaatccttaatgaatcttaataaatcaaaacagaggcgaaggtaaagggaaa

SEQ ID NO: 159108 - DNA, 601 bp, Human
gatataaacattaaccttttctacctagttataaatcgtttgctagccatagactatatcagtggcaatacataaaattttgctgctccaattgtacctttatctcaggaaatctttttagattgcaccttcagaatacagctccttgctattcaaggtgcagctcatggactagcaccaagcctggaggcttgttagacatgcagaattgcagactccctgcctcaaacttacttacataggtgattcatatgcatatcactctttgtaagtttattatttattaaacctcttctcttastcccttgaatttaacattttgtcattcctagttgtagtttttacttcaactcagtgtaatatataccattctccctgaaatagtaaaataaaaagggaagttataaaagtgataagttaatcaacctgtattctctatttactatttattttattcagatcccccaattattgaaggaaatatggaggcagcaagagcagtggacttaatcccatggatggagtatgaattccgcgtggtagcaaccaatacactgggtagaggagagcccagtataccatctaacagaattaaaacaga

SEQ ID NO: 159109 - DNA, 601 bp, Human
ggtaaataccaactgcaattaaatagtgccaaaattttaggtttgatattacttggaaataattttttcctaacatttaaggataagtagacatcatggtaaatattcttcagagttacatgcgaaccactgatagtgagcatatcacttctagatatgatcttaagtattcagagtccagagtgttcaccattaccccgtggaaccagctctagatatgatcttaagtataaattatattcagacatttaggtatgaaagaattagattgaatctctccgagacattgtttttgttattrttattcttaaaaaatatttaatgttgtcacttctactttgagattaaaaaataatttaagacagatcttatggtaatcatgtctagatgatgagcctatatattgtaaagaaatcattttctgagataaataatacagataatatttgcaacaaaattccaagaaagaaggagggaggcctacatctattatcagtgtcaaagaaagtatcctttctctctgacgatttttacttcaaagaatggtgttcagctaagacttaggtcatattgtattagtcaagaaatcacagaaaattaa

SEQ ID NO: 159110 - DNA, 601 bp, Human
tgttcaccattaccccgtggaaccagctctagatatgatcttaagtataaattatattcagacatttaggtatgaaagaattagattgaatctctccgagacattgtttttgttattattattcttaaaaaatatttaatgttgtcacttctactttgagattaaaaaataatttaagacagatcttatggtaatcatgtctagatgatgagcctatatattgtaaagaaatcattttctgagataaataatacagataatatttgcaacaaaattccaagaaagaaggagggaggcctayatctattatcagtgtcaaagaaagtatcctttctctctgacgatttttacttcaaagaatggtgttcagctaagacttaggtcatattgtattagtcaagaaatcacagaaaattaattaaactccatgattaaaggtctgtatttgagataggtaagtaaaaatattttacctgagatgtttgtttagaccaatttaatcacttagtatttttctgcaattttagtgaatgcttgttaaatcaaatcaaatacatgatctgtcagtataaaattacataggtaaaccaccagtggaatc

SEQ ID NO: 159111 - DNA, 601 bp, Human
gcagtccctgtttaaagacattagaactcataactatatttagaagttaggccaaggaactgaggtaaacagaaatgtagagaagtgatattaagagatcacagtagcattttaatggaactctgccattcatttaaaatcttctctacaccatctaaaacactgaagtttggcaagtcctagtcaaatgagctcagagaggctacattttttttttgatatagggaataataaaagaagagctatcattagaatcagaacaacatttttccttagtgatataggggagaaggaaaaaatwatagagtatttcctgctctaaaggcacagttgttactttaaaccaacttatttttgtcatcaccttctttaggcatcacctcttacattttctcaaatggtattttgttaaggacttagttccccatctgatgtgcttacaaaataacttcccttacaagccattagagccaaggccaaaagcaaacacacctattcacagagtaagatacaaccttgtagtgatatgagatgattcattcttctcaattgtaaaaaaaaaattaattctgtaacttctaacacatttgttaatctatca

SEQ ID NO: 159112 - DNA, 601 bp, Human
ggcagagctgggattcaaatctaggtgtttctcatctaaaggctttgctcctaaaccactttctgaagacagtgggcagtattgtggctccgggccactgatcctttggtggaatgcccgcattattatctaaaagctatgtaatttgaggcacattacttaacctctgagcctcacttttttttttttttagacagttcagtggctctttttttggagtgcagtggcacaatcacagctcactgcagcctcgacctccaggtctcaagctaccctactgcctcagccatcctagtagctyggattacaggggcttgtcaccacgcccagctattttgtgtgttttttggtagagactgggtttctccatgttgcccagctgatcttgaactcctgggctgatgcaatccacccaccttggcctcccaaagtgttgggattacaggcatgagccaccgggtctggcctgagtctcacttttttcatttctaaatgggaatcatttatcttaagggatgatttttatgtttacaaacatattaggaaagcagttagcactgcactgcatagtatttgctcaataaaatttatttattatgct

SEQ ID NO: 159113 - DNA, 601 bp, Human
ttaacccatttaattttgactgtagaaaagagataacaaaagtaccctttgaaataatgtgtcattgtaagacatgcccccatggctaatagctctgcaggttcagttggtgagtccacatcctaaaatggtacattcaggtttgttttaacagctttctttattagccagatcaagccagtcaaagaaaggaaagagaaaaaagaataaaaccaggaacaacactttcatattatgtataaagccttgatttcatgcctaatgaaggtctgttgttctttcatttagtattctttctcattctttcttttttctttctctttttcacacatatttgataaaagagaagaatagaactaagaaaatattttatagctggtaaggtactatgtgatgttagttgctgtcattaatacttaaatagataaatctttaaaagaagcaaagaggatagatttttaagccatctgaagacctgaattaaagatggcagcttctccacatgtaagcagtataatctgggcaagttaattagtgtattcgggacacatttgcctttcctattaagagaggggataatgccaattctccatgatgctga

SEQ ID NO: 159114 - DNA, 601 bp, Human
tatttacataaccatgttgaatctcttactaaaaaaattgtattaaatcaccatgaaattccaatgcaagttaaagtaaaaagttacattcatgattaacttttcatctgtaaaaatgactgtataagttaaagttataattaacaagaattaaagtagtcaatatgttttcaatcaagagcttatcttcatatactttataatttttataatttaggatttgtcacaagccaatttgtacattcttaaataaaacatcaaagcccaaagagatacttatatgcaaattatttaagcattsagatctgaaaggaaaattggcagcattaatttcttttcatgggaaagaatagtcatggcattggcttgattttctttaaaaaaaatttttagatctatgactgaaatacagaagcactcttataagcatcataagggaattactattaaatagaaattaagacaaaaggacaagttaaagcagctcactatttttaaccgttcacagtaaaattatacatgttattaataaatgattaataattcaataatttttctgaatagtttaaattctttttaatgatttattgtgtaaagaatg

SEQ ID NO: 159115 - DNA, 601 bp, Human
aaaaagttacattcatgattaacttttcatctgtaaaaatgactgtataagttaaagttataattaacaagaattaaagtagtcaatatgttttcaatcaagagcttatcttcatatactttataatttttataatttaggatttgtcacaagccaatttgtacattcttaaataaaacatcaaagcccaaagagatacttatatgcaaattatttaagcattgagatctgaaaggaaaattggcagcattaatttcttttcatgggaaagaatagtcatggcattggcttgattttcttyaaaaaaaatttttagatctatgactgaaatacagaagcactcttataagcatcataagggaattactattaaatagaaattaagacaaaaggacaagttaaagcagctcactatttttaaccgttcacagtaaaattatacatgttattaataaatgattaataattcaataatttttctgaatagtttaaattctttttaatgatttattgtgtaaagaatgtctagtttgtttcctgttaagtgcactggagcctaaacttaagcttccttgtacttagggtgatttacttccctgaa

SEQ ID NO: 159116 - DNA, 601 bp, Human
gcttccttgtacttagggtgatttacttccctgaaacaaatcatgctttggccaagtccccatttctgcagggctgagtgcaaatagagcacctaactcctctattctcagattcatgttaaatatgtaggttttgtgtcaattccacctgtgaaaaactttttctaatatgctaaggctacaattgaacattcaaagctaaatgagagaaattaaatcaataatccaagtaagatataaaaacactttattaagagaagcagttactgttcttctgtgctttttttttttttttttttttgagacagcatcttgctctgtcgcccaggctggagtgcagtggcaggatctcggctcacagcaagctctgcctcccaggttcacgccattctcctgcctcagccttccaagtagctgggactacaggcgctcaccaccacgcccagctagttttgtttttgtatttttagtagagatggggtttcactgtgttagccagggtggtcttgatctcctgacctcgtgatccgcccgcctcagcctcccaaagtgctagattacagatgtgagctaccatgtccggcctattctgtgcttttgt

SEQ ID NO: 159117 - DNA, 601 bp, Human
agaagcagttactgttcttctgtgctttttttttttttttttttttgagacagcatcttgctctgtcgcccaggctggagtgcagtggcaggatctcggctcacagcaagctctgcctcccaggttcacgccattctcctgcctcagccttccaagtagctgggactacaggcgctcaccaccacgcccagctagttttgtttttgtatttttagtagagatggggtttcactgtgttagccagggtggtcttgatctcctgacctcgtgatccgcccgcctcagcctcccaaagtgctarattacagatgtgagctaccatgtccggcctattctgtgcttttgtttatgtcccattttccatggactgagctcagtgaatgatctctgaagagcaaatcagtcttgaaaatatattacaaagtgcttaaaagaaacatgataaaatggaaagagatattcaatctaatttaaacatactccatttttaggtctgttccaaataaaaaggctaatattgcttataatgaaaaacatttcagtaaaatgctttaacaaataatacttgtcctaaggaaggcaatatttgattcaacaaatt

SEQ ID NO: 159118 - DNA, 601 bp, Human
tatagtttgagattttacatttatgtcttcaattcatcttgagttcattttcatatatggtgtaaggaaggggtccaatttcaatcttctgcatatggcttgccagttatcccaacaccatttattgaatacggtgtcctatccccatttcttgtttttgtcagctttttcaaaaatcagatagctgtaagtgtgtgaccttatttctgggttctctattctgtttcattggtctatgtgtctgtttttatgtaccagtaccatgttttttttgattaccgtagccctgtagaataaagtygggcagtgtgatgcctccagctttgtcctttttacttagggtttgctttggctatttgggcttttattttattttatttttttggttccatgtgaattttaaaagagtcttttctagttctgtgaagaatctcaatggtaatttaataggaatagcattgaatctataaattgctttgggcagtatggccatttttatagtattgatgctttctatccacgagcatggaatgtttttccatttgtttgtatcatctctgatttgtttgagcagtggtttgtagttctccttgtagagata

SEQ ID NO: 159119 - DNA, 601 bp, Human
atagaggtgttcataatatcctctggtggtttcttatatttccgtggggtaagtggtaatatccctccttgtcatttctgattgtgtttatttgaatcctctctcttttcttcattagtctagttagcagtctattttatttttttccaaagcaccagctcctagatttgttaatcttttgaatgaaattttgtgtctcaaacttcttcagttgagctgtgactttggttacttcttgtcttctgctagctttaggatttgtttgctctttgttctctagtttttttagttgtgattttakgtttttaacttgagatctttctaactttttgattgggcatttagtgctatgaattttcctcttaacactgcattagctgtgtcccagagattctggtatgttgtatctttgttttcattaattttaaatatcttctcgatttctgctttaattttattatttacccaaatatcattcaggagcagttattcaattttcatgtgattgtatggtgttgagtgaatttcattcttgatttctaatttgattttgctgtggtccaagagattgtttcttattatttcatttcttttgcatttt

SEQ ID NO: 159120 - DNA, 601 bp, Human
atatattctgttattttggggtggagagttctgtaggtatctatcaggtccatttgatccaatgctgagttcaggtcctgattatctttgttaattttccatcttgatgatctgtctaatattgtcagtgaggtgttaaagactcattattatgtgggagtctgagtctctttaaagctctctaagaatttgctttatgaatctgggtgctcctgtcttaggtgtatacatatttattatagttagattttcttgttgaattgaaccctttaccattatgtaattcccttgacttttttttatctttattggttaaaagtctgttttgtcagaaactaggattgcaaaccctactttttactgttttccatttgcttggtggatttttcttcatcactttattttgaggctatgagtgtcattgcatgtgagatggatctcttgaagacaacataccaatgggtcttggttctttatccagcttgccactttgtgtgttttaattggggcatttagtcatttacatttaaggtaactgttgatatgtgtggattttacactgtcattatgacgttagctggttattttgcagacttgttta

SEQ ID NO: 159121 - DNA, 601 bp, Human
gggacaccaatgagttgcagattcagtcacatattttttgaatttttttcatttctttttattcttttttctctattcctgtctgactgtcttatttcagaaagccagtcttcaagctctgagattatttcctctgcttggtctattctgctgttgatacttgtgattgcattatgaaattcttgtagtgtgtcttttagctctatcaggttggttacattcttttctaaactgtctattttttctgtcagttccttcattgttttataattatttttagcttccttaccttgggttacartatactgctctagctcagtaatcttcattcctgtggataatctgaattctatttctgtgaatccagccatctgagcccagttcagaacctttgctggagaggtgattccatcatttggaggaaacaaggcactctggctttttcaattttaagccttctcagaggattctttttcatctttgtgggcttatctacctttaagctttgaaattgacaacctttgattttttttctcttttatcctatttgatgaccttgagggtttgattgtggtataaggtagattcagtagactagctt

SEQ ID NO: 159122 - DNA, 601 bp, Human
ccctgactttgtcctctggctcctcaaggtttggaatccactgcactggaagggagggctaaggtgtagcagctgtagcagagtgctaacaagtgctggggtatctgcctccctgcaggtgttcaccacagtggcagaggcaacacagctggcaggcaggagcagaggacccctgctggagactgtgtgtgggcatgctggaggtggtattagctcaggggctgggtactggtgggaaaagtctggatgtcttctctgtgtcccctaagcaggtgtgatccaccatatagttctgcatatmgttttatttgtttctgtgcaattaatgtacatacttcaccaaagaatttacatagctaatatcagaagttttcatgtaggtatctttgaatcacaattattaggagctacaattcagtaaaaggataccttgctttcagcactctaaggaagatgtggctattccaaaatgggagggcatttggggactaatatttcatctctttgaaatgttaacagatttgaggatggtatgtcagactgagtcaaagcatttgcatgggaaaaggtatgtcctctatagaaacatggacttcatcca

SEQ ID NO: 159123 - DNA, 601 bp, Human
gttaggtgctaagcatacaaatccaataaggtacagtgcttacctgaaggagtttgaaggagagagaaaaacttggagagaatcaatgaagaggccattggacttggcagttaaaagcagttttgtgtggtttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccrgctaatttttttgtatttttagtagagacggggtttcaccgttttagccgggatggtcttgatctcctgaccttgtgatccgcccgcctcggcctcccaaagtgctgggattacaggcgtgagccaccgcgcccggccagttttgtgtgtttttaaagagaaatttcagttatttaaagaaatggatatgaagcagctatatcacctggggtatataccctggggtttgtcatcttgcaccaggaaaacttaggacatggactcacacgaggagtttagcagcagaggtttaataggcag

SEQ ID NO: 159124 - DNA, 601 bp, Human
caggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtcttgatctcctgaccttgtgatccgcccgcctcggcctcccaaagtgctgggattacaggcgtgagccaccgcgcccggccagttttgtgtgtttttaaagagaaatttcagttatttaaagaratggatatgaagcagctatatcacctggggtatataccctggggtttgtcatcttgcaccaggaaaacttaggacatggactcacacgaggagtttagcagcagaggtttaataggcagaagagaagtgaaagagaaacagttctctctctatagagagaggggtccctcagtggaaaagactggctgtcagtgaatgtgccaaattttatagtcaggtttgaggaggcggtgcctgatttacatagggctcacagattggtttgatcaggtatgacgttcacacaatgcatgcggaagg

SEQ ID NO: 159125 - DNA, 601 bp, Human
aaatgggctttccagttgactggtgccatcttctctgcttctcactgtacacttggccgacaaagggaagagaagatggaccatcttgaacatgtatagtccttacttcctgccagcattcacccatgcaagctcccagcttgcttgtttatgtctgcagctcaactttacaggctgctctttgttagaaaatgatttgtggctgcctttcaataaaaagcaaagccttaccaaggactctcattcagttactttctgcctaagtgatttcttaacttctatatcgttcccccctctggartggtaaccctaattgctgttagtggtcatttgaatgatgactctttctggcaacttcctcctataaaggggcattgtgtggggaacagcagctatggctcctcctggggtcaatctaagggtccttggaagaaaggcatgtccatgtatggttctgtctgcagcaccatttggagtttgattgtttctaaatgagaagagatgaatgttagttcgaatatgactattaagattgccactattagtggaggtaccataggccacaatcataacagtagggtttgttacctgtcagtcattt

SEQ ID NO: 159126 - DNA, 601 bp, Human
tttacaggctgctctttgttagaaaatgatttgtggctgcctttcaataaaaagcaaagccttaccaaggactctcattcagttactttctgcctaagtgatttcttaacttctatatcgttcccccctctggagtggtaaccctaattgctgttagtggtcatttgaatgatgactctttctggcaacttcctcctataaaggggcattgtgtggggaacagcagctatggctcctcctggggtcaatctaagggtccttggaagaaaggcatgtccatgtatggttctgtctgcagcascatttggagtttgattgtttctaaatgagaagagatgaatgttagttcgaatatgactattaagattgccactattagtggaggtaccataggccacaatcataacagtagggtttgttacctgtcagtcattttgatgaaatgaaatactggtttgcttctaccaaatgttgctgtactttatcagaagtgttgatataaaagcaacatttttttttctttgagaaaaacatatatacccccgttgctttgccattaggggataatttctggtctaggtcatcttttttaacttgcaat

SEQ ID NO: 159127 - DNA, 601 bp, Human
tgtatggttctgtctgcagcaccatttggagtttgattgtttctaaatgagaagagatgaatgttagttcgaatatgactattaagattgccactattagtggaggtaccataggccacaatcataacagtagggtttgttacctgtcagtcattttgatgaaatgaaatactggtttgcttctaccaaatgttgctgtactttatcagaagtgttgatataaaagcaacatttttttttctttgagaaaaacatatatacccccgttgctttgccattaggggataatttctggtctagrtcatcttttttaacttgcaatatgattgggagaaatatgtcattgggtggctagtgtaattttagtgttaaccctagctaaatctttcctgcaattaattccttcacagcttccaccaactatctatgacatgcttaaactttctggcttgtcctaaacatccttctttttaaacaaccaactattctttttaggacatgtatttaccatccttctaatcctttcatgacttccatgaaccatctatgacatgcttaaaccttctgacttgtcctaaacatctctcttttaaacaactag

SEQ ID NO: 159128 - DNA, 601 bp, Human
tctaaatgagaagagatgaatgttagttcgaatatgactattaagattgccactattagtggaggtaccataggccacaatcataacagtagggtttgttacctgtcagtcattttgatgaaatgaaatactggtttgcttctaccaaatgttgctgtactttatcagaagtgttgatataaaagcaacatttttttttctttgagaaaaacatatatacccccgttgctttgccattaggggataatttctggtctaggtcatcttttttaacttgcaatatgattgggagaaatatgtyattgggtggctagtgtaattttagtgttaaccctagctaaatctttcctgcaattaattccttcacagcttccaccaactatctatgacatgcttaaactttctggcttgtcctaaacatccttctttttaaacaaccaactattctttttaggacatgtatttaccatccttctaatcctttcatgacttccatgaaccatctatgacatgcttaaaccttctgacttgtcctaaacatctctcttttaaacaactagctattttctttaggacaagtatttctcatacaagatccctt

SEQ ID NO: 159129 - DNA, 601 bp, Human
ctgcaacctaaggggttgtgaaaaatattgaattagactttttcctgagatgccctgtgatgcctggtcatgctacagaaagaggggaggcctggattagagaggagaagagagagagagactggctctagtgttcacaaggagatctaccttccttcaatttccagaatcacccagggctcctgtgctgtatgttggtttgagccactggagctccgggacccatcaatcctgttggacaatctgtgagactggtttggaacccggtgaccttcatctctgggggcagtccgacttccartggttccttccacaggctagacaaggttaaggtggttttttcttgctgcctgggcactctttcttaaagtgccctgacttgctgcacctatagaaactagcagatgtacctcagggatcctgggctttgtatgtttgcagagcagctattagtgcctctgtccttctcttttgcttcctctctttctcctggatctcctcctcctggtccctattataaaacaccaaagtggtcacccttaggaggttctccaagatgctatctggtgctatagcctccttctgtattttccttctaata

SEQ ID NO: 159130 - DNA, 601 bp, Human
ttccagaatcacccagggctcctgtgctgtatgttggtttgagccactggagctccgggacccatcaatcctgttggacaatctgtgagactggtttggaacccggtgaccttcatctctgggggcagtccgacttccaatggttccttccacaggctagacaaggttaaggtggttttttcttgctgcctgggcactctttcttaaagtgccctgacttgctgcacctatagaaactagcagatgtacctcagggatcctgggctttgtatgtttgcagagcagctattagtgcctctgkccttctcttttgcttcctctctttctcctggatctcctcctcctggtccctattataaaacaccaaagtggtcacccttaggaggttctccaagatgctatctggtgctatagcctccttctgtattttccttctaatattgggaggtgcctttttaataaacttgtcccttaggatgagctgtcctcgactgattcaggggataaaggtatgttttatgagtgcctatcagtctttccataaaggctgcaggattctcatctggttttgttctatcttggaaagtatagagtaattaat

SEQ ID NO: 159131 - DNA, 601 bp, Human
agcctccttctgtattttccttctaatattgggaggtgcctttttaataaacttgtcccttaggatgagctgtcctcgactgattcaggggataaaggtatgttttatgagtgcctatcagtctttccataaaggctgcaggattctcatctggttttgttctatcttggaaagtatagagtaattaatagattttgcccttgctcttcataggccctccaatatgtgcattaaatggtgtttccttttccatccatctgtggcatcaccggtgttccaactagggtttgtttttttttttagaggaactgcttcccttcctatcgggaatggtgtttccattatttctttgccttccttatctcctttttcctttttaatctaccacaggagacatgttgttcatcgccagaattttctgctgcctgcagaactgcctgcttttccactgtggttaggatttggcttaagagcagcaaaacatctctccgtgtgtggtgaaacacttgagttaaattttggaagggttctatatacctatcaggatcgtcagaaaattggcctaaatcttcctttatttgcctaagattctgtaatgaga

SEQ ID NO: 159132 - DNA, 601 bp, Human
atattgggaggtgcctttttaataaacttgtcccttaggatgagctgtcctcgactgattcaggggataaaggtatgttttatgagtgcctatcagtctttccataaaggctgcaggattctcatctggttttgttctatcttggaaagtatagagtaattaatagattttgcccttgctcttcataggccctccaatatgtgcattaaatggtgtttccttttccatccatctgtggcatcaccggtgttccaactagggtttgtttttttttttagaggaactgcttcccttcctatcrggaatggtgtttccattatttctttgccttccttatctcctttttcctttttaatctaccacaggagacatgttgttcatcgccagaattttctgctgcctgcagaactgcctgcttttccactgtggttaggatttggcttaagagcagcaaaacatctctccgtgtgtggtgaaacacttgagttaaattttggaagggttctatatacctatcaggatcgtcagaaaattggcctaaatcttcctttatttgcctaagattctgtaatgagatgggaacttgaggtgaccccaaata

SEQ ID NO: 159133 - DNA, 601 bp, Human
tccatccatctgtggcatcaccggtgttccaactagggtttgtttttttttttagaggaactgcttcccttcctatcgggaatggtgtttccattatttctttgccttccttatctcctttttcctttttaatctaccacaggagacatgttgttcatcgccagaattttctgctgcctgcagaactgcctgcttttccactgtggttaggatttggcttaagagcagcaaaacatctctccgtgtgtggtgaaacacttgagttaaattttggaagggttctatatacctatcaggatcrtcagaaaattggcctaaatcttcctttatttgcctaagattctgtaatgagatgggaacttgaggtgaccccaaataacggggattctcagatggctcctctggaagttgcttttctagtcttagggaatcattccctttgggcctgcctgatatgattgctacacttgcaaaggtctagtaagaaggccatgcccttgtgcaaaagaaaatgagccattttttcttcaaagtctcaggatcaaaggagtccctgtgcttcagaatgcactccagaggagtacaggccttagatgataaa

SEQ ID NO: 159134 - DNA, 601 bp, Human
taattggaggcagaataggtatcttaaaagaatgtagggaccaaatggccattttcctgaaggaaggacagtattaagactaaaatttggttttggaggacattttactcctaattgctgaaggcagagttttcccattcacagaaacagcataaagcctggtttctagtagagaggcgtaaaaaggggagagaattgggaagctagagtgcttgggtaaaggagaggattcctattccactaggtggtgctgctgactttgagatgccatgtgctctccagaccaagggcagagtgaccytgacatgccatgtgctctccagatcaagggcagagagagagagacctggaaatgccatgtgctctctagaacaagggcagggagagatgctcactgggggtaccctctgtttctagaacatcacaaaaacaccttcccttgagctatatgcccatttactatgacattatctgatcttgccaaacaggattccttccctgaaccataaatcttcccacacattgcatacacagagaggataagagttatgacagttgccaacaggaaagaaagaaattatgataggaaagttggagatct

SEQ ID NO: 159135 - DNA, 601 bp, Human
ataggctttccagttgatcagtgacatcttgtctgcttcttactgtacatgtggctgagaaagaaaagggaagatggagccgccatcttgaacatgtgtagtccatagttcctgccggcattcacccgttcaagctcccagcttgcttgtttatgtctgcagctcgactttacaggctgctctttcttagaaaatgatttggggctgcttttcattaaaaagcaaagccttaccaaggactcccatacccttactttctgcctcagtgatttcttcttaactcctatattggatatattgwgggttgttaaaaagtgattatggagtgaagtacaaaaaaaaaaatagccatatatcagttcttccatgcagtacagtggcagaaaaggatgtgatggcttggggattaagaagaaagcagtatgacagaaagatttttaagatcagagactacaaagggtctttctagcagggaaactgatactacaagatgatataagagaacgggggagagagtactttggagtcactgacggcgcagtttcagaaaaaattggggaattgaaagtgagagcataagagacgatattagatttataat

SEQ ID NO: 159136 - DNA, 601 bp, Human
gtacatgtggctgagaaagaaaagggaagatggagccgccatcttgaacatgtgtagtccatagttcctgccggcattcacccgttcaagctcccagcttgcttgtttatgtctgcagctcgactttacaggctgctctttcttagaaaatgatttggggctgcttttcattaaaaagcaaagccttaccaaggactcccatacccttactttctgcctcagtgatttcttcttaactcctatattggatatattgtgggttgttaaaaagtgattatggagtgaagtacaaaaaaaaaaatagccatatatcagttcttccatgcagtacagtggcagaaaaggatgtgatggcttggggattaagaagaaagcagtatgacagaaagatttttaagatcagagactacaaagggtctttctagcagggaaactgatactacaagatgatataagagaacgggggagagagtactttggagtcactgacggcgcagtttcagaaaaaattggggaattgaaagtgagagcataagagacgatattagatttataatatttctagatatttggggaaacattatccaatacaaatgcatgg

SEQ ID NO: 159137 - DNA, 601 bp, Human
tccatagttcctgccggcattcacccgttcaagctcccagcttgcttgtttatgtctgcagctcgactttacaggctgctctttcttagaaaatgatttggggctgcttttcattaaaaagcaaagccttaccaaggactcccatacccttactttctgcctcagtgatttcttcttaactcctatattggatatattgtgggttgttaaaaagtgattatggagtgaagtacaaaaaaaaaaatagccatatatcagttcttccatgcagtacagtggcagaaaaggatgtgatggcttrgggattaagaagaaagcagtatgacagaaagatttttaagatcagagactacaaagggtctttctagcagggaaactgatactacaagatgatataagagaacgggggagagagtactttggagtcactgacggcgcagtttcagaaaaaattggggaattgaaagtgagagcataagagacgatattagatttataatatttctagatatttggggaaacattatccaatacaaatgcatggtttcttaacatttatttgtagaatgaagcatgaaactaacacaacattaagttgtta

SEQ ID NO: 159138 - DNA, 601 bp, Human
attccatttacaaactttgtatcaaaacccatttttaaattggagactgcctcctcacttgaagcttactttgatcactggtgtaatctagcatgataggtcagtcttagaagtcacccatgggactagttactgaggtatccaaagcattttattacagtttcgtgagtcaaagagttctgtatcagagactacaatctctagaaaacaatacatcttggctggatttttgaaataggaaagatattgggaggggtgggaaaagttgtctgacaaaactgtctgacttagacatctggcwtttatccagataacatggtttatacagattcatttattcattaaatacacttagtgttgaatcactgcagatagtcaaagagcacaatttaggctccaaaggattttgaagactgtggaaaaaatgacaggttttattctttgcattggtcaaatggatttatttaataaatgaatgtttagcaaaacttgactcactgtgtgctttgtagtcattttctatacttagcatttaaatcacattttaaagcaagatttagcaaaaaaaaatctaatctgaatcgtaaaatatttatttcta

SEQ ID NO: 159139 - DNA, 601 bp, Human
tgatcactggtgtaatctagcatgataggtcagtcttagaagtcacccatgggactagttactgaggtatccaaagcattttattacagtttcgtgagtcaaagagttctgtatcagagactacaatctctagaaaacaatacatcttggctggatttttgaaataggaaagatattgggaggggtgggaaaagttgtctgacaaaactgtctgacttagacatctggcatttatccagataacatggtttatacagattcatttattcattaaatacacttagtgttgaatcactgcagwtagtcaaagagcacaatttaggctccaaaggattttgaagactgtggaaaaaatgacaggttttattctttgcattggtcaaatggatttatttaataaatgaatgtttagcaaaacttgactcactgtgtgctttgtagtcattttctatacttagcatttaaatcacattttaaagcaagatttagcaaaaaaaaatctaatctgaatcgtaaaatatttatttctaagtttaactgccaatgaaatgtccaaaaatgcaaatattataaaaattagaacatttcgctctttctctta

SEQ ID NO: 159140 - DNA, 601 bp, Human
atacctttctggcctggcatggtggctcacgcctgtaatcccagcacttagggaggctgaggcaggtggatcacctgaggttgggagttcgagaccagtgtgaccaacatggagaaaccctgtctctactaaaactacaaaatgagccaggattggtggcacatgcctgtaatgccagctacttgggaggctgaggcaggagaatcgcctggacccgggaggtgaagttgccgtgagccgagatcaggccattgcactccagcctgggcaacaaaagcgaaagtccatctcaaaaaaaaawaataataataataataatagctttctttattcatgtgcactgtgtaaataattaatgactagaaaaacaaatagagatgtcattgccttctgatctttggcaatgtacatttacccttggccaagtttctctttgcacatgtgtgagaagcacaaatagaagagcttgaaaactaaaggtgtgtgaggtactcttctatcattagaggaaatgggctctattggttcacccaacttccattgttttcactccaagatagacatttagccatgccttatacctcaacagaaattctcacgt

SEQ ID NO: 159141 - DNA, 601 bp, Human
cctttctggcctggcatggtggctcacgcctgtaatcccagcacttagggaggctgaggcaggtggatcacctgaggttgggagttcgagaccagtgtgaccaacatggagaaaccctgtctctactaaaactacaaaatgagccaggattggtggcacatgcctgtaatgccagctacttgggaggctgaggcaggagaatcgcctggacccgggaggtgaagttgccgtgagccgagatcaggccattgcactccagcctgggcaacaaaagcgaaagtccatctcaaaaaaaaataawaataataataataatagctttctttattcatgtgcactgtgtaaataattaatgactagaaaaacaaatagagatgtcattgccttctgatctttggcaatgtacatttacccttggccaagtttctctttgcacatgtgtgagaagcacaaatagaagagcttgaaaactaaaggtgtgtgaggtactcttctatcattagaggaaatgggctctattggttcacccaacttccattgttttcactccaagatagacatttagccatgccttatacctcaacagaaattctcacgtata

SEQ ID NO: 159142 - DNA, 601 bp, Human
gtactcttctatcattagaggaaatgggctctattggttcacccaacttccattgttttcactccaagatagacatttagccatgccttatacctcaacagaaattctcacgtatattcatcggtcacagaattattagttttagtatttgttaaaaatgtaatatataattaaatcatcctatgatctttacttttattaaacaccattgtattctatatatgtatgtcataataccatgtcatatgtcttaaatatacataacaaaatttaatataaaaggcagttattcatatatgtwaaagtatatatgtgtgtatatataagtatatatgtatatatttaaagttatatatatactttttactatattttttactgcatacaaaagtatgtgtattttaatatatgtgtgtgtgtgtgtgtgtatgtgtatgtgtgtatttttttacttttaagttagcacaaccaaatatgtcaaaagaataaaatgtagaaataatttgtttattatcaaacagtggaaaagtcctgatgacaaacttatattctctatgcttgtgctcattcagcagaaatatgataacttggctgagcgtgg

SEQ ID NO: 159143 - DNA, 601 bp, Human
ttccattgttttcactccaagatagacatttagccatgccttatacctcaacagaaattctcacgtatattcatcggtcacagaattattagttttagtatttgttaaaaatgtaatatataattaaatcatcctatgatctttacttttattaaacaccattgtattctatatatgtatgtcataataccatgtcatatgtcttaaatatacataacaaaatttaatataaaaggcagttattcatatatgtaaaagtatatatgtgtgtatatataagtatatatgtatatatttaaarttatatatatactttttactatattttttactgcatacaaaagtatgtgtattttaatatatgtgtgtgtgtgtgtgtgtatgtgtatgtgtgtatttttttacttttaagttagcacaaccaaatatgtcaaaagaataaaatgtagaaataatttgtttattatcaaacagtggaaaagtcctgatgacaaacttatattctctatgcttgtgctcattcagcagaaatatgataacttggctgagcgtggtggctcatgcctataatcccagcactttgggaggtcgaggtgggcgg

SEQ ID NO: 159144 - DNA, 601 bp, Human
catttagccatgccttatacctcaacagaaattctcacgtatattcatcggtcacagaattattagttttagtatttgttaaaaatgtaatatataattaaatcatcctatgatctttacttttattaaacaccattgtattctatatatgtatgtcataataccatgtcatatgtcttaaatatacataacaaaatttaatataaaaggcagttattcatatatgtaaaagtatatatgtgtgtatatataagtatatatgtatatatttaaagttatatatatactttttactatattktttactgcatacaaaagtatgtgtattttaatatatgtgtgtgtgtgtgtgtgtatgtgtatgtgtgtatttttttacttttaagttagcacaaccaaatatgtcaaaagaataaaatgtagaaataatttgtttattatcaaacagtggaaaagtcctgatgacaaacttatattctctatgcttgtgctcattcagcagaaatatgataacttggctgagcgtggtggctcatgcctataatcccagcactttgggaggtcgaggtgggcggatcacctgaagtcaggagttcgagac

SEQ ID NO: 159145 - DNA, 601 bp, Human
atgtaaaagtatatatgtgtgtatatataagtatatatgtatatatttaaagttatatatatactttttactatattttttactgcatacaaaagtatgtgtattttaatatatgtgtgtgtgtgtgtgtgtatgtgtatgtgtgtatttttttacttttaagttagcacaaccaaatatgtcaaaagaataaaatgtagaaataatttgtttattatcaaacagtggaaaagtcctgatgacaaacttatattctctatgcttgtgctcattcagcagaaatatgataacttggctgagygtggtggctcatgcctataatcccagcactttgggaggtcgaggtgggcggatcacctgaagtcaggagttcgagactagcctgaccaacatggagaaaccctatctctactaaaaatacaaaattagccaggtgttgtggcacaagcctgtaatctcagctactcaggaggctgaggcaggagaatcacttgaacctgggaggtggaggttgtggtgaaccgagatcgcgccattgcactccagcctgggcaacaagagcgaaactccatctcaaaaacaaaacaaaacaacaatgaaa

SEQ ID NO: 159146 - DNA, 601 bp, Human
ctttacttgatgctaaaataagttttcaggcaaatagcttgtcatctatttagtcatggctatttgtatttaattatatttctttcctaaatatttcatgagtctcataaaacttgcatgtgttgaaacttgtataagtgttaatctcttcttccactgctgagaaatcaatcatagtgctacacatttgccttgttttagaaagtcaacagtgttcatgtgtagaacatttttaaacattaaataggattatggcattttaatgaaagacaataaaaattgatcacccctgcttaaagcyttcattggtttctttgtgtaaatttcataagggatgtcagttactttttttctgtgaacagagacctttttgatacatatttgacttgatgcccagttggaagattagacatataaaagctttcttgagcccaggaaacagtggatgttacaacttgtttcaaaggctcttaaaaatttttttttaaagatcttagcttgaacataaaaagggaagttttattaataatattgctgtttgtagttagttcacacaaatagcaaataagagaaaatgtattatattgaacaattttctata

SEQ ID NO: 159147 - DNA, 601 bp, Human
tgagtctcataaaacttgcatgtgttgaaacttgtataagtgttaatctcttcttccactgctgagaaatcaatcatagtgctacacatttgccttgttttagaaagtcaacagtgttcatgtgtagaacatttttaaacattaaataggattatggcattttaatgaaagacaataaaaattgatcacccctgcttaaagccttcattggtttctttgtgtaaatttcataagggatgtcagttactttttttctgtgaacagagacctttttgatacatatttgacttgatgcccagttggaagattagacatataaaagctttcttgagcccaggaaacagtggatgttacaacttgtttcaaaggctcttaaaaatttttttttaaagatcttagcttgaacataaaaagggaagttttattaataatattgctgtttgtagttagttcacacaaatagcaaataagagaaaatgtattatattgaacaattttctataattccaaatttcctatttctgataatatagagttgacagctaaatattaataattttaatttgcatcaacaggctttcttaagcatatcagttgagag

SEQ ID NO: 159148 - DNA, 601 bp, Human
tcccccagccagcttgcattctcagcttcagcaccctcccttatcccttgtccatggaatattagccccatgagggcagggtattgttctattctcagtgccatgcaagaccagtgctgagcacctggcaggctctaaatagatattaattgaatactgataggaataatgaagtatgattaaataaaatgttacaattgggctttctcaaggccatgtttctgagatgtagctgtaaaagaaactcaaggctttgagcagacacacccagaccaacaggaagctttttttttttttttttgacacaataggttataatttgggaagatcttaaagagccctcagatcatctatgcaagggttcagctgaatttattacagtacacagaagagtagactgggaataattagactgagaatacccaatattcataacttactaacctgacaattgtgtttgcggctagtaggaaagagagaaattcactagatgttacaaacccctgtaataaatacgcctgaggtatctttgggagaagacatcaatgtgtagagcttggaaagtaaaattttggagcacaggatttttttcttcttttat

SEQ ID NO: 159149 - DNA, 601 bp, Human
cattccaagatggtggtgatgatgatgatgctgatggcagtgaggaagatgatgatgatgttaatgatgaaaagactgataacacgtcttgagttcttattgtgctaaacacttaactaagctcattttattaaatccacacaaccctagaggatagacactattattatccctattttagagatgaagaacttgaggattagaaatgtttgtctgagtaataattgtcataatcagattttaatctagttcttgcctctccagagaacggttgattaaaattgctggaagtaaatcatasaattattcttcccattcattctttcttaaaatccttttaaaccttttacacagggtcttggatatcaaagagacaagcacgaacacttaaaagagaaaaatccatattatttattgttctgcaggaaatgctcctgtgactgtggccggtaggggggaggggggtcttgactgactataatgtggttattgtttccattttaaaatatgatgggagaagccaatggtttaacaagatagatgatggtgaaaaccaataccccaatgcacttcccatgaaaatgtacgatggatctctatt

SEQ ID NO: 159150 - DNA, 601 bp, Human
aattattttatgggtaaataatttctacagtttatccagttattagatatatttctttgatatctagcttctatatgggttcaaaggaaataacattagatacttctgaaaggaggcagaagaaagtattactttagcgtattctaggccacatagtaactatttttatccagcaaaattatattcctctccaactgctttaagaatggctcagaagaagtttgaaatcatgcaaacagaagtaaaacaggaaataaatgataaaaattatagtgacaaatacttccaaatggagaccacytttatattttgaaagtaagtctgcttcaaagtttttgggatttttaaattttttattttttattttttttagtcaatgtaaaacaattttgggcaatgaagtaagactttgattcgcttttggcatctttagtcattcctgccctgtatgctttactatattctaaggctgataaaagggtagatatcattaagaaacatttgaaaatatgatgatcagccaacaccaatggtaatagaaccagttgaagagaacttttcatagctgaagactctaaatcatggcaaaatataactcatc

SEQ ID NO: 159151 - DNA, 601 bp, Human
agcacgtgagtctcacgttttgtttttagacttgtcaaaaactaccactggattcaatcatgatacgaatatatttgaaggaaatttcctacctagctacctgagcacatttttcaatatcctttacagccacacaagatttcccttaaaacgtgaattattgtagatgatgaaaaaatgtgaaaaataccctcacacgttaaatattccattatagaaataaagttagagaactatccttttgtaaaggctgtcctctcaaattctgtgccattaacttgtctttaccctgtacttattratttaaacattgttttcataggagtacatcaacagcatgtgaaaactaaaattctgcttatttttacatgctttaatttataaacctctgtcattgcacagtgcaatgcaagttaagtgtgtagcattatgcttactctcttattactgtatgttctagtactgtatgttttaggtggttcataaaacaagaccgcctatccctgctcacgttctggtcattctaatctctctgggttcattttgatatctctgttcttgaacccaagtggaataagtaaaaaggagaatttttatgtag

SEQ ID NO: 159152 - DNA, 601 bp, Human
tattaatttaaacattgttttcataggagtacatcaacagcatgtgaaaactaaaattctgcttatttttacatgctttaatttataaacctctgtcattgcacagtgcaatgcaagttaagtgtgtagcattatgcttactctcttattactgtatgttctagtactgtatgttttaggtggttcataaaacaagaccgcctatccctgctcacgttctggtcattctaatctctctgggttcattttgatatctctgttcttgaacccaagtggaataagtaaaaaggagaatttttaygtaggactctagggaatgtctcaagaatctgaagatgtgattaccattagagtgtgaaaatttatgaaattcactttgggacagagactctcccagtgagatgacagaatgtagtgacaagaactagaatttggtgtctaacatgtgtttgagatctgtctctgccacttgctagatgtatgacaatagataaattacctatttaaacctcagttttctaatttgtaaaaggagcattcatttttgttctttttccatttgttcatgtatttattcattcatcaaaaatatgctgtgtgc

SEQ ID NO: 159153 - DNA, 601 bp, Human
gtgtgctcagcactattcttgatggtgaggatacaaaagggatcaaaccagtccaaggtgctattctcgcatggtttacaagctaatgaaatgagatagaaacttcaaacaaacacaaactctgacaaataaataagtgggattaaagcagctgacagggcaataaaatgaataaatagacaaaagtaaagtgacttagataaaagtgaaattctgattgggtggccaggaaaggcctctgagaagatgccagttaagctatgatttgagtgataaatgataagaagaacccactatgtgratagctttaggcagagccttaaggttctttgcactctaagtagtacaaaaccttaaggtgaagagcacttaaaatattttaggtgtggaaaggccactgggtccagggcataggttctgagtaaggagggggaagtgttctggggcccaattacggagaaccttgtaagtaattgtgatgagtttgagttctttctaaacatgataagaagccattgaaagattttaaaacagagagtgatatctaatttatgatgttgtttttaaaaaagtcattctggcatctgtacagaaaatggat

SEQ ID NO: 159154 - DNA, 601 bp, Human
aggtgaagagcacttaaaatattttaggtgtggaaaggccactgggtccagggcataggttctgagtaaggagggggaagtgttctggggcccaattacggagaaccttgtaagtaattgtgatgagtttgagttctttctaaacatgataagaagccattgaaagattttaaaacagagagtgatatctaatttatgatgttgtttttaaaaaagtcattctggcatctgtacagaaaatggattgtggtgggttaacagtggaagcagaaaagccagttaggagactatttcagcagtsaaggagagaattgatagtggctagcactaagtgaaaatggagacagaagtggaaagttttctgtaggcagagttgacaacttgctgccaatttggatgttggcaatgagtgggatgagagactaaataccaaatttctgcttgagaaactagggggttggttgtgccatttgctgacgatggcaaagagtcattggagaaagatttgaggatactcgacattatattacatttgaaaaatgtattacatttgattatattacatttgagaaatcttttagagactcaagtagaaataggc

SEQ ID NO: 159155 - DNA, 601 bp, Human
atcacctgggatcatgtcgttgcactatcaaatgaatctacagtgacgggatataaggtatatacaaatagtgatgattaatgtttgcaattcttgctatttcagtgaaacccaagatgggtttcttttctttttttgagatggaattttgctctgtcacccagaccggagtgcagtggtacaatcttggctcattgcagcctccacttcctgggttcaagtgattctcctgcctcagcctcccaagtagctgggattacaggtgcccacacccacacccggctaatttttgtatttttartagagacagggtttcaccgtcttggccagggtggtctcgaactcctgaccccaaattatccacctacctcaacttcccaaagtgctgggattacaggcatgagccaccacggctggccccattcaactttcttattctatttaatagttgtagagcagaatcagataacgtagtgccatgatacattttgaaatggaaaacattatcttcagtgaatttcagcaaaatgttatgtcaaaagtgtaagataagtagaatactttaaagataaaatagaataatcagagcttaaggaggaga

SEQ ID NO: 159156 - DNA, 601 bp, Human
acagtgacgggatataaggtatatacaaatagtgatgattaatgtttgcaattcttgctatttcagtgaaacccaagatgggtttcttttctttttttgagatggaattttgctctgtcacccagaccggagtgcagtggtacaatcttggctcattgcagcctccacttcctgggttcaagtgattctcctgcctcagcctcccaagtagctgggattacaggtgcccacacccacacccggctaatttttgtatttttagtagagacagggtttcaccgtcttggccagggtggtctcraactcctgaccccaaattatccacctacctcaacttcccaaagtgctgggattacaggcatgagccaccacggctggccccattcaactttcttattctatttaatagttgtagagcagaatcagataacgtagtgccatgatacattttgaaatggaaaacattatcttcagtgaatttcagcaaaatgttatgtcaaaagtgtaagataagtagaatactttaaagataaaatagaataatcagagcttaaggaggagagagaacgaaactatttttgtttggcaatgattatgatag

SEQ ID NO: 159157 - DNA, 601 bp, Human
ggtttcttttctttttttgagatggaattttgctctgtcacccagaccggagtgcagtggtacaatcttggctcattgcagcctccacttcctgggttcaagtgattctcctgcctcagcctcccaagtagctgggattacaggtgcccacacccacacccggctaatttttgtatttttagtagagacagggtttcaccgtcttggccagggtggtctcgaactcctgaccccaaattatccacctacctcaacttcccaaagtgctgggattacaggcatgagccaccacggctggccycattcaactttcttattctatttaatagttgtagagcagaatcagataacgtagtgccatgatacattttgaaatggaaaacattatcttcagtgaatttcagcaaaatgttatgtcaaaagtgtaagataagtagaatactttaaagataaaatagaataatcagagcttaaggaggagagagaacgaaactatttttgtttggcaatgattatgatagggttgcccagcacccagaaaactccttgataaactgagttactgtttataaatgaataaaaaggagaaaagcttatttta

SEQ ID NO: 159158 - DNA, 601 bp, Human
ttatcttatttattaatttgtatttgtttatcatgtctctccatccttacttgaagctaagctccatgggagcaagctcttgtttgcctcagttgacctttgaatctccagcacttaggggactatctggcatgtagcagggttttaaaaaataactgttgaattaattcatgatttctgtatagagaaaagcccactaacaagaataacttgggcaacttaaaactatagttttcatctctagaaaactgatatacttccccattaggttcatgatttatattatttcatgtgctgatcygcaaatttgattcttaaaaaaataagacttccttttagacatattttggaaatatttcagatttgattatctgtaactgcacttctatctgacttgaacactgttatccattgctttaataacttattccttattgaatatttgtagtgcatatcaaggcaaatgtaacaccacaaatgtttcatcacacatatactatctctaataattctatattatccttcaaaaaccgtttttaataattatgagcaaattaagaaaatatacatatagctataattttcaatattaatttcaata

SEQ ID NO: 159159 - DNA, 601 bp, Human
aggcagtggtggatgtctagggtagattctaaaagagcaaggcattttttccatttgatttaaagttactatatattcattttgtgtattttgtcttctaataaatctgtaatttatcctgatattaccactgatgatgtaatctgtatatttaacctaatatttttgttaactccaagatattaagttaaactgtataaccaaacccactgacttaaacactgtgatggaaaacacattttgttgttttgctttgtcctctcctgccagtagcagaagaaggtctagaaaactatttttkgggtagaacttttatatgtttaactccatcactactcctgtcctcccttctccatttcctaagtattgcagtgtaagagggacaagaggatagtaggatgtttagattcatttcatatgttattacatttagtctgtgattaagatacaatcagatattatcattcaggaaatgctgtctcttcaaccatcttgaaataaccaaatattttgttttcctttaccccatttttcatgggatcaatttgagtattcaagtatataaatctagcctatatattttagattgacaaatagctta

SEQ ID NO: 159160 - DNA, 601 bp, Human
ggagatgaaggacatgatctaatttaagatcatttgctgcttttgtgcagaaaatagattggagtgagacaagaggggagggagttgatagagctagtgaaaagaaagcaagtctgagacacaatcagaacaaggcactctctttcagaaataattaatttataggctactgtaggtttttttatgactctaagaagcaaagcaaatcatgacaagatcttttccaggataaatggttaaagagtgtatgtgaagactccagcttcttcttttctatgacttcccaattcttccccttctrccttttggtggcaggagagtctggagggaatgtagtgtccacatttttaccccagggagatgcaggagggcattgagagcaagaagaatgatgctgagattctgagagaaaatgcttcataccttctaaaaaaataaagagttttttatggtaatcatcaagactaacttagagaaccaagccaaatgtggactttttaggaaacatgaaatgaaatgaaagaaggacaataaattagctcttagcttctaaatcagtttcatggtatataaattgatatttttagtagcaccattaaaa

SEQ ID NO: 159161 - DNA, 601 bp, Human
ttcagaaataattaatttataggctactgtaggtttttttatgactctaagaagcaaagcaaatcatgacaagatcttttccaggataaatggttaaagagtgtatgtgaagactccagcttcttcttttctatgacttcccaattcttccccttctgccttttggtggcaggagagtctggagggaatgtagtgtccacatttttaccccagggagatgcaggagggcattgagagcaagaagaatgatgctgagattctgagagaaaatgcttcataccttctaaaaaaataaagagtkttttatggtaatcatcaagactaacttagagaaccaagccaaatgtggactttttaggaaacatgaaatgaaatgaaagaaggacaataaattagctcttagcttctaaatcagtttcatggtatataaattgatatttttagtagcaccattaaaattatagaacaaaagctccagatgttgaagtgatatgatgatgatatttacaagcaagatttacccaagattcagaaaatagtgattaatataacctaatcaccaaggcccacagataatagtgtagccattatatttagttac

SEQ ID NO: 159162 - DNA, 601 bp, Human
tgctagttcaatatgcctatgagacatcccagtggagagagagaaaaagagaatcatctagcaaaactgagaaagcagctgaggtcagatgacataaacttgtcagagaaccaactggcataattatataactttatttgcaatgcataccagcctggatggagatggaggaaacagagatagcagatgtttcttggtgttgcccaaagttggcaaatggcatggttaatataagtggagatcaaggaaaacaaggatttattacttctagttaaagaataattaaaattgctgaacagaatcagtattatatattatgaatattagaatattttcagctgttagtaacaaactctcaactcaactctcaactcaaaattgcttaagaaagcccctgtggaatcagtgtctcaaaaatataactaaagaacaatttttccccatttctccacttgagaggcctcagcttcattctaaggcttgttccctctgtggttgaaagattctgcagatgtgttaggaatcacacagaccctataatgtccaagaaagaagagggtctgtctcttttgaagcttcatcttcaaaggaagcccagctt

SEQ ID NO: 159163 - DNA, 601 bp, Human
aagttggcaaatggcatggttaatataagtggagatcaaggaaaacaaggatttattacttctagttaaagaataattaaaattgctgaacagagtcagtattatatattatgaatattagaatattttcagctgttagtaacaaactctcaactcaactctcaactcaaaattgcttaagaaagcccctgtggaatcagtgtctcaaaaatataactaaagaacaatttttccccatttctccacttgagaggcctcagcttcattctaaggcttgttccctctgtggttgaaagattcygcagatgtgttaggaatcacacagaccctataatgtccaagaaagaagagggtctgtctcttttgaagcttcatcttcaaaggaagcccagcttttaacagaagctcctcagaaaaaccttccccataatgttcagaagtgtgtcaaaagtctttccttaaactagttaaatatcatttctataattgctcaaagcgatcaagattcatggctggtctgtgattgagaaaaccttccttgatgagtgaataatatctgaacaaaatatgaagagtattagcaaagaagcagagagagaaa

SEQ ID NO: 159164 - DNA, 601 bp, Human
taagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcactcataggtgggaattgaacaatgagaacacatggacacaggaaggggaacatcacactctggggactgttgtggggtggggggaggggggtgggatagcattaggagatatacctaatgctaaatgacgagttaatgggtgcagcacamcagcatggcacatgtatatatatgtaactaacctgcacattgtgcacatgtaccctaaaacttaaagtataataataataaaataaataaaaaaataaaataaaaaattcagagaaagagtaatggaaatttacagaaaggctaggatgttagcttcaaaatgcaggattgttttggattcaagaaacagaaattgctgacaagatggatactgagattaaaacaatttatgatgctgggtaaattgccaaggattatgtcaataagttgagttgtaagaattctggtgcaaacaaagtc

SEQ ID NO: 159165 - DNA, 601 bp, Human
ggatactgagattaaaacaatttatgatgctgggtaaattgccaaggattatgtcaataagttgagttgtaagaattctggtgcaaacaaagtcagtaaacacaggtttatcctttaaaaatatattatttggctctatcactgttaaataacatttaagtagtcaagtagagaggaatatttaaggattggtttacatcattaatgacataaaaattgtaaatgtttttgttttgttttatattttagattagttattccacaattttgaaatctatgaggcaaatccttcacctcaaakaactgcatttggtgatgtgttctaaatttagaatgttatactgggagggtagaatctggaaagaatattgctgaaggaactaaaattggaatctagcatgaggaggaactcccatatatagtgagtgctttggaaaaggacgtcagaaattaaagaaattaatcatttttggagaatgtaattatagtgaagaattttcggagaatgaaccaatagtcctaagggagatacctttattcaaagatgatttcatttttctgagtattgggtattagcaaaattttaattttactaaaaagt

SEQ ID NO: 159166 - DNA, 601 bp, Human
gtgtttctcttacctgtaagtataacaccaaggtttgagaaacttcgttgtaaagtttcaaccaatttatgatatatgcatgaataaattattcatgagaaaatggataatcttttacaatgatttatatgaagaattttaattattggtaagcctaattttgtatttttctatgaatgttgatttactaatgacataaaaagttacattaagatatctattctttacactcaagtggattgaaaacatcctgttcctaaggatgaactaagatacacctacccccgccccaaatcatagratattactttaccttctcttctgaaataagagcaacacaaaagttaattaaaacaatcagattatctttaatagatatatgcatcaaccatcagaacaagacttcaaaattcactttcctttgaaacattataggctgtgttgaaatttgtaaccctcttaggaaaatataaaaacaattgtctgttctgagaaagggagttgggttttaaattttctctcctgaggtttgacacttattcactataacataaatttgaaaaccatttagaaaggaaagtgactttgtgatttttaaaaa

SEQ ID NO: 159167 - DNA, 601 bp, Human
ggttacagaaaatgcaggaagagtcgagggtgtggcagagtacagagactaactcctcaagtcccttagcccatagagatgccttagaattctgatgtgcctgaaagttgtgaatctttaggatatcaacatccatgtagatgattcatccaatgccatagcttcttaatttatctaacttttcttttctgatgatcttgtcctgtgtcctgcctcagccacccactcatgatcacaaccgaaacaggaattcacagatttcagtgtgaatttgaatttgagggatttctgaaacttggayggtaaaaaattacattataattttcatgaatttctaactgaaatttggcattttaaaatatatgaatttaggtcacatattactctgtcaccaataacaatcaaacatattctcatatatttcagctgttgaagtattacttcaataatacatttcttaaatctgctcctagatcctgttatttaatgtgttaataagcatactatttgaatgtgttagtaacttacatttggtttcttgatacttttataaatgaatttcaatacaataggtttttaaaaaactctatgtattatattt

SEQ ID NO: 159168 - DNA, 601 bp, Human
gtattatattttatgcatgtaataagagcattattctcagtattttcagaaatccacagaccactaaacgggtccatgacaccaaaaagtttaagaacccctgtaaatcttaatattactaataactgcaaatttttttctttaattttgattttaaatactgtgttctctgaccactgattcttctttttctagtttatttccttaaatctcctcccaactccagcagttcttctactttcccctacccagactaccagtgatcttattgcttatttcttttttttttttttttttttgkccttcattcatcctcatgtcctcagctcctgccttgaatgtcagctcagattccacggttcatattgaaaacaactgccctatataccttgtccctttccctctttatgcttctcacttggccaaacccaaactcatattaaatataactgttcacattttatgtgtccacatccaggcagaaggcagaagccatatgcccctaccaagatctcccctttgcattcccatcccccttgcattcccatccccaacattcaccctctcaccagcaccacatacctagagactctgagatata

SEQ ID NO: 159169 - DNA, 601 bp, Human
ttaattcaagaatattgcttcaactaccctttccttcctcttctacatcattatatttctttttttctatttgatttttctcatcaccatacaagtattctgcaatattgcccacttttaaggggggaaaatacaaataagacaaaacaaaacagagcaacaattgaaagaaagaagaaggaaaaaaatgaaggaaggaaagagggaaggaaggagagaaagagaagaaggagagaaagagaaggaaggaaggaaggaacgaagaaaaacaaaaaaagaaaatctcttccagtaactaacrcatgttctattatcttctttggagtaaaattcaacaaataatttatcatcttcaccacctaattcctcttccaaaattctatcttaaatttgttccaatcagattttcaccacaacaccctgtcaaaacagctcttgtcgaggttgctaatgacctccatgtttctaatttaggagtagtcctctccttactcaagctctcagcagcactgatgcatatggccactttctctttcttggctttctgggcaccagtctgttttgatttttcttttccccttaagagctgccattctcagtc

SEQ ID NO: 159170 - DNA, 601 bp, Human
actcactatcacaagaacagcaagggagacattcatccccatgatccaatcaccttccaccaggtccctcccccaacactggggattacagttcaatctgagacttgggtggggacacagccaaaccattatcatatgccttgattatttaacataggtatgttctctttttgcataaatgagaataatggtgtctacctttgatatgagccataaatgaataaattaaacctgtttttatatatcttaaacctttgccacccaattataaccggaagtatgagtgggaaagacaacactytatatcagcatttctcaaactttcttcattattgcctccctaggaagcctcgttacatattatttttccaagtgttaccacttatgaaattttaataccaaaaatctactgtatagctgtttatgttatgtggccctttagagatccaaaactattatgagatttcagattttcccaccccacaagaaccaactttcacttagttggaggccatgttggccctattgagaatgcatgctcggtggagattctcactcattccactccctggagacacagtaaattctatgaatcaatcag

SEQ ID NO: 159171 - DNA, 601 bp, Human
aatgtcctctttttaaggaactgtgaatgaaagttctctcaggtaggggtgaacctatagaagtgagcaccctggtctaggccaataaataaatatttaatgtctaaataaaataatttaatattaacattaaattagtcttgaaattcctgcatactatgtatttaatggagaagatgagatcttgtaagaggaagaatgcaaggaggatcacttctgtctaaactctggaacagttcatctcctaacatccaccccacacaaacacacacacacacacacacacacacacacacacacccacacacaaagaaacctacagttaaataatccattctctgtgagcagtgtagatattacttattggaatgtattaaatagcagactcactctccacacacacacactctaaatagcttatcagcatcttccttcagtagagaactgtgggggtagaatactgtgataaatatgctttcccaatttcttgtatttctagtactgtgttggcatccagtacagtttatatcccggatatctgcccaactagactgttccataaactttgtctctggtcttaagaccagaagtagataagctc

SEQ ID NO: 159172 - DNA, 601 bp, Human
ggggtgaacctatagaagtgagcaccctggtctaggccaataaataaatatttaatgtctaaataaaataatttaatattaacattaaattagtcttgaaattcctgcatactatgtatttaatggagaagatgagatcttgtaagaggaagaatgcaaggaggatcacttctgtctaaactctggaacagttcatctcctaacatccaccccacacaaacacacacacacacacacacacacacacacacacacacacacacaaagaaacctacagttaaataatccattctctgtgagmagtgtagatattacttattggaatgtattaaatagcagactcactctccacacacacacactctaaatagcttatcagcatcttccttcagtagagaactgtgggggtagaatactgtgataaatatgctttcccaatttcttgtatttctagtactgtgttggcatccagtacagtttatatcccggatatctgcccaactagactgttccataaactttgtctctggtcttaagaccagaagtagataagctcttcctgagacattacttgtttttatcttttggataaagacattgg

SEQ ID NO: 159173 - DNA, 601 bp, Human
aaactctggaacagttcatctcctaacatccaccccacacaaacacacacacacacacacacacacacacacacacacacacacacaaagaaacctacagttaaataatccattctctgtgagcagtgtagatattacttattggaatgtattaaatagcagactcactctccacacacacacactctaaatagcttatcagcatcttccttcagtagagaactgtgggggtagaatactgtgataaatatgctttcccaatttcttgtatttctagtactgtgttggcatccagtacagwttatatcccggatatctgcccaactagactgttccataaactttgtctctggtcttaagaccagaagtagataagctcttcctgagacattacttgtttttatcttttggataaagacattggaaactcaatggctgatgtatttccgtgtttgcactgcatggccaaagctcagagccaaatctgctacatgcctatagcaaaatatataaagtattgtatattttactttaaaatgtctgaatatatatgcagtggctttaaaaagtgcctggaacaacacagacacaataaatatta

SEQ ID NO: 159174 - DNA, 601 bp, Human
tgatgatttagatgtttgaacatatcttttgtagctctctgcagccacatgttattctttttgcttttgctcctgggactgaaaactgtcgtcatcaagaacttttaactaatctttaacagattttaaaataactaacatatatttaaatgtcattacaaataatataatgctagctcatatttattattatacttgttgaactttggattcagttaaaggaataaagaattatttaacttagcattttcttactctgactttttaatccttttttacccatttttaaaataaatacagwgtaccactaaggcaaaagtccccaaaactctattgtcttcttgttctttcattctttaaaaatatatattgtatgccagctcttaattgtgttcatggaaacttgtaaaacactaatcaatattctataagccagataaaataaatataaaaggaaacattttatatctgaattttagaggctaattccctttcctcaaagaaagagaagttatattattctcaaattaaagtgaaaatgagtatgctttcttattgctacttgattatttaggactatatagtgccttaaagtctctat

SEQ ID NO: 159175 - DNA, 601 bp, Human
ttttcatttatatgtgttaattttaaaatattgtttcaatcatttaatatattttctacacagctctgctgcatggtcaatgaacagtatgtcatttgtggtttatcgtcagccatttttaattagacgaaatccaacattgcaagttttaaaactgaagattaggcatcattccaagtagcaaatatttttgttttggttttcttctaggttaataacttctctgacatttgcacaactgtgtttgaaatatagtctaatagaatatgtatttgccttctataaaattaatgtcctagamgatgataaaatatgttgaagttttaagggaattattttttttattatcttggattggtctatgaattaatgaaatggaaattaatatacatgagaggatcaactataactttacattaatttagagtattataagcagtggcttagaataagagtttactttttgtgaatatccaggataactttcactagcttctccctttttcacaatgcatttcttggtaaatattttgttatcatcacgacagtgggtgtttctaaaacccattcatatattttgccccatctcttcttccttagt

SEQ ID NO: 159176 - DNA, 601 bp, Human
caggaggatggacaatttttataggagtagtggcaggaatagggagtatagagggagagagaagtggtcctgtgacaaacgcaagaacctcaacatggaaaaacaggtaaagtgaacaagagataaaacaatccaggtaagacatagtaaatccaaaatgagtcaatgctcccaagcttctttttaggtttcctaacatttctctcaacacctagaaaattcattatgaattacttcatacatgttactatatcatcattgacaaacacctaaaagtccctgtttccactgtcaagataawtgagtataataagacacaagtcttgaaaagagaaaaagcaataataaccaaaaattgtatgatggaatgaataaaagaagcctggcaatactgatagaaatgctggtattgaaggaatttcagttccattcacttgtgggaatttgatttgttcaatgtaaacaaaatggtttcttaaagaatttcccagaattccaaatggttagaaagaagtaactactctgctgattttataaataaactcctgcaaaagtgatgaaagttaatctttttttcccctttttttaacttaaaaagaat

SEQ ID NO: 159177 - DNA, 601 bp, Human
gaggatggacaatttttataggagtagtggcaggaatagggagtatagagggagagagaagtggtcctgtgacaaacgcaagaacctcaacatggaaaaacaggtaaagtgaacaagagataaaacaatccaggtaagacatagtaaatccaaaatgagtcaatgctcccaagcttctttttaggtttcctaacatttctctcaacacctagaaaattcattatgaattacttcatacatgttactatatcatcattgacaaacacctaaaagtccctgtttccactgtcaagataaatgwgtataataagacacaagtcttgaaaagagaaaaagcaataataaccaaaaattgtatgatggaatgaataaaagaagcctggcaatactgatagaaatgctggtattgaaggaatttcagttccattcacttgtgggaatttgatttgttcaatgtaaacaaaatggtttcttaaagaatttcccagaattccaaatggttagaaagaagtaactactctgctgattttataaataaactcctgcaaaagtgatgaaagttaatctttttttcccctttttttaacttaaaaagaatttg

SEQ ID NO: 159178 - DNA, 601 bp, Human
acgcaagaacctcaacatggaaaaacaggtaaagtgaacaagagataaaacaatccaggtaagacatagtaaatccaaaatgagtcaatgctcccaagcttctttttaggtttcctaacatttctctcaacacctagaaaattcattatgaattacttcatacatgttactatatcatcattgacaaacacctaaaagtccctgtttccactgtcaagataaatgagtataataagacacaagtcttgaaaagagaaaaagcaataataaccaaaaattgtatgatggaatgaataaaagragcctggcaatactgatagaaatgctggtattgaaggaatttcagttccattcacttgtgggaatttgatttgttcaatgtaaacaaaatggtttcttaaagaatttcccagaattccaaatggttagaaagaagtaactactctgctgattttataaataaactcctgcaaaagtgatgaaagttaatctttttttcccctttttttaacttaaaaagaatttgaaaagaacttaaaatttcaaggtttaacaccatgaaactatgactaaggatgagccttttcagaaaagaaggaag

SEQ ID NO: 159179 - DNA, 601 bp, Human
tgaaataattttaaggaaaattgagtctcatggccagttagtttcactctttctctttattgtcaatacccacaaacaccagccagtctccacaaaaaaagagaagcaaagcaatagaacgagcaatttttgtggtgggggatgattgcaagggacagtctttctttgtatgtaaataaacccacagggccatgtatctgttgaaaatgtccaagaagtcctagtcacagtgctcaactggtccctcaagacttgcactgaagaggaaccattaaccttggcatagtggaacatgtaaatkttcaaactttctctctggttctacttgtctctttgcctcaaaaactaatttggagaaggcaaggtagaggcagtggaaggaataatttagcacttgtttttataagtatggcaaaatggaatgggcatttgaagttgccagtctttctaactttgattgaggctgagaaaagttactcctggtgataactcagtgtatttcacaaagttggggctgtaaatgtgagaacattctgtcaaatagctatttccaaagccaagtgcacagattacctaataaactggctctggttgttggtta

SEQ ID NO: 159180 - DNA, 601 bp, Human
ttataagtatggcaaaatggaatgggcatttgaagttgccagtctttctaactttgattgaggctgagaaaagttactcctggtgataactcagtgtatttcacaaagttggggctgtaaatgtgagaacattctgtcaaatagctatttccaaagccaagtgcacagattacctaataaactggctctggttgttggttaattaatcacaaattaaaaacttgaatgttatttataaaatattttgtatacgttgggaataaaacaaacccatgaaacccattatacataattctgtgtwttctatagaacagaacccagataccaaggtctgagtctcttctgtcttattccagactgagtatgttctcactaaatactcactaaaaaatcaaatatctttttaaatgaatgaactacatttaatattgcaaattcacaattcatagatggtttttactttgcattttaaccccattatgtaagtattagactcccaattttacaaataagtaaatggagcacagagagatttagtaccttatgagaggccacacactcaagtgagtggtaacagtatgcagatagaattgtctcacct

SEQ ID NO: 159181 - DNA, 601 bp, Human
aaaaagaaatatcaggggtcacactgaaggtcacagtggtttcctctaaccatcttcttccttagaccccctgtgctctgtaataagaaaaaattcagggcctacaatggaggcataactcaatcatttaacattataggttgagtactttctatgcactaggcttggtattagtcaacacagctaaaacataatttggatatcatctctgtcttgaagttgttcataatatagagatattagcagttgtggtcacaaaatgtgacaccacaaagagaaaattctaaatgttatggcatcrtcagcaataggcaagcagtagaaacaaagactgcatcacagtgtccagattgaagaatcagaaaggaagtttgtattaaaaaccaagtagagcagttttctacttatcagaaagcctgcagtactgctcaacttttaattgaaatgtctgttttcagcatcactctccatatagcgggaattctccctgaaggaagtatgaaatcaaagtttagatttaaaaaaaaatcaagaattcccatggaagagatatagtactccaaattggttttacatttcttctgatagagaaaaattattc

SEQ ID NO: 159182 - DNA, 601 bp, Human
acataagtaccagaattatgattgatagcagtattctgatatatatgttgttagattcaaaaccaatatatattgaaaaactcctcaagaatatatgtcatttaaaatgacattagatagtacttcaattcggtctctaatttctgtttggaatgtgggatagaagtaaagatgaagaccaaaattacataagcttgagccattagagaaattaaatataacacacgtaaacatggagagtttatttcaaatatcctgatgtcaaagccacaaattatgaaattgtatttggttttcatastagtaccaaaacatcaagatggcatccacaattcactaaatttctttcgagcagccacagtttgtactttgccaacccacatattcagccaagtacataaacatgtccccatgatagatgtaatttgtggtcaaaagacagagcattgtggagaccctgcagtcatcctcagacaaaaaaggcttcagaatgatgatttccaattcctatcgcaagaacaaaaaaccaaacaccgcatattctcactcataggtgggaattgaacaatgagatcacatggacacaggaaggggaatatca

SEQ ID NO: 159183 - DNA, 601 bp, Human
cagctggacaaatttgaattctaatcccttctctgccctctagtgactattggacttgagcaactcattttacctgactcagttacaaaatatataaaattagggtaaaagacctaccattgtaggttgttgtagtcatgtcataatctacataatgagccaacatagtcttgtagctggctgtagggcagtaagtagcatctctcaaagtaatgataagtttactattgttattgatagtgtccttaggagctctgctacttgagggctgtttatattccccttgttatctgccctcacyttttgaccctcactttcctgctcatttctaagaactactttatctgtatccgataaagctttccctcttatgtttccaggcagctccaaaagccccaggcagggcaatgttgaagacaagcaagcagacagacactattatcttccaccttatagggaacatgaatgtgcttttaatgaccagagattcaggagaaatgcactaaatctccctgaatataaaaggaccatgccaaagaatgagctgtttatggtcacttttaatgtgatagataataataatttatttggtggtttcaaa

SEQ ID NO: 159184 - DNA, 601 bp, Human
atgtttccaggcagctccaaaagccccaggcagggcaatgttgaagacaagcaagcagacagacactattatcttccaccttatagggaacatgaatgtgcttttaatgaccagagattcaggagaaatgcactaaatctccctgaatataaaaggaccatgccaaagaatgagctgtttatggtcacttttaatgtgatagataataataatttatttggtggtttcaaatttagagagtaaacttccaaaaattaatgaaaactgttatattagtaagccattgactaaattttttagktcttcactcattctagcagcatgttcattgaagatagtgccagccaggcatggtggcttatgcctgtaatcccagcactttgggagactgaggcaggaggatcacatgggcccaggagtttgaggctgcagtcagctatgactgaaccactgcactccagcctgagcaatagaacaagaccctgtctcttaaaaaataataattaatttatttaaaaagaagatagtgcctaatagttgtggacattgggaagaaagagtatgactttttggtcctactttacaatagtttctcaaaaat

SEQ ID NO: 159185 - DNA, 601 bp, Human
acttttaatgtgatagataataataatttatttggtggtttcaaatttagagagtaaacttccaaaaattaatgaaaactgttatattagtaagccattgactaaattttttaggtcttcactcattctagcagcatgttcattgaagatagtgccagccaggcatggtggcttatgcctgtaatcccagcactttgggagactgaggcaggaggatcacatgggcccaggagtttgaggctgcagtcagctatgactgaaccactgcactccagcctgagcaatagaacaagaccctgtmtcttaaaaaataataattaatttatttaaaaagaagatagtgcctaatagttgtggacattgggaagaaagagtatgactttttggtcctactttacaatagtttctcaaaaattctcatgtcggcaggacacggacccataaacttacttgactacaggagtagcccttctaagtgtcacccaagacgtaaattaagtccatagcatattataatacatcatttcaatttttaattcacagtgtaatatctcagggcaattgttctttagataaaaattgaatgagattatttaatatc

SEQ ID NO: 159186 - DNA, 601 bp, Human
tgtatctctttttttacattttattattattatactttaagttttagggtacatgtgcacaatgtgcaggtttgttacatatgtatacaagtgccatgttggtgtgctgcacccattaactcgtcatttagcattaggtatatctcctaatgctatccctccccactccccccaccccacaactttatcttatttttaaaacttacttttttaatgcatgtatatatgtttcttgacattttgccttctggtaggaatttgggactgctggatcatagggacagcatacacatttgtgatmatattattttaaatgattaatcatgttgtgtaaacagttcacatggtctcacacagaaaatctttgatcaaaagcttttgtttttcttaaatcatgtaagaataagagattctgttttgtgaaaggacccatttgttttccagggctatgcaatcttgccttagccgaagcagactaaatgagcaatagtgacatgtatcaatgaaataatatgcacacttttggtttaccttgcaggtgcacccaccctatccccaagtcttctcggcttactgctgcctgcctttggcatccttgtct

SEQ ID NO: 159187 - DNA, 601 bp, Human
cctccccactccccccaccccacaactttatcttatttttaaaacttacttttttaatgcatgtatatatgtttcttgacattttgccttctggtaggaatttgggactgctggatcatagggacagcatacacatttgtgatcatattattttaaatgattaatcatgttgtgtaaacagttcacatggtctcacacagaaaatctttgatcaaaagcttttgtttttcttaaatcatgtaagaataagagattctgttttgtgaaaggacccatttgttttccagggctatgcaatctygccttagccgaagcagactaaatgagcaatagtgacatgtatcaatgaaataatatgcacacttttggtttaccttgcaggtgcacccaccctatccccaagtcttctcggcttactgctgcctgcctttggcatccttgtctacttggaattctgaatgtgttgtgacagctgctgttcccatcccagctcagaagacacccttcaaccctgggatgaccacaattccttccaatttctgcggctccatcctaagccaaataaattatactttaacaaactattcaactgatttacaac

SEQ ID NO: 159188 - DNA, 601 bp, Human
tccccccaccccacaactttatcttatttttaaaacttacttttttaatgcatgtatatatgtttcttgacattttgccttctggtaggaatttgggactgctggatcatagggacagcatacacatttgtgatcatattattttaaatgattaatcatgttgtgtaaacagttcacatggtctcacacagaaaatctttgatcaaaagcttttgtttttcttaaatcatgtaagaataagagattctgttttgtgaaaggacccatttgttttccagggctatgcaatcttgccttagcygaagcagactaaatgagcaatagtgacatgtatcaatgaaataatatgcacacttttggtttaccttgcaggtgcacccaccctatccccaagtcttctcggcttactgctgcctgcctttggcatccttgtctacttggaattctgaatgtgttgtgacagctgctgttcccatcccagctcagaagacacccttcaaccctgggatgaccacaattccttccaatttctgcggctccatcctaagccaaataaattatactttaacaaactattcaactgatttacaacacacatgat

SEQ ID NO: 159189 - DNA, 601 bp, Human; identical to SEQ ID NO: 22138

SEQ ID NO: 159190 - DNA, 601 bp, Human; identical to SEQ ID NO: 22139

SEQ ID NO: 159191 - DNA, 601 bp, Human; identical to SEQ ID NO: 22140

SEQ ID NO: 159192 - DNA, 601 bp, Human; identical to SEQ ID NO: 22141

SEQ ID NO: 159193 - DNA, 601 bp, Human; identical to SEQ ID NO: 22142

SEQ ID NO: 159194 - DNA, 601 bp, Human; identical to SEQ ID NO: 22143

SEQ ID NO: 159195 - DNA, 601 bp, Human; identical to SEQ ID NO: 22144

SEQ ID NO: 159196 - DNA, 601 bp, Human; identical to SEQ ID NO: 22145

SEQ ID NO: 159197 - DNA, 601 bp, Human; identical to SEQ ID NO: 22146

SEQ ID NO: 159198 - DNA, 601 bp, Human; identical to SEQ ID NO: 22147

SEQ ID NO: 159199 - DNA, 601 bp, Human; identical to SEQ ID NO: 22148

SEQ ID NO: 159200 - DNA, 601 bp, Human; identical to SEQ ID NO: 22149

SEQ ID NO: 159201 - DNA, 601 bp, Human; identical to SEQ ID NO: 22150

SEQ ID NO: 159202 - DNA, 601 bp, Human; identical to SEQ ID NO: 22151

SEQ ID NO: 159203 - DNA, 601 bp, Human; identical to SEQ ID NO: 22152

SEQ ID NO: 159204 - DNA, 601 bp, Human; identical to SEQ ID NO: 22153

SEQ ID NO: 159205 - DNA, 601 bp, Human; identical to SEQ ID NO: 22154

SEQ ID NO: 159206 - DNA, 601 bp, Human; identical to SEQ ID NO: 22155

SEQ ID NO: 159207 - DNA, 601 bp, Human; identical to SEQ ID NO: 22156

SEQ ID NO: 159208 - DNA, 601 bp, Human; identical to SEQ ID NO: 35291

SEQ ID NO: 159209 - DNA, 601 bp, Human; identical to SEQ ID NO: 35292

SEQ ID NO: 159210 - DNA, 601 bp, Human
actctccctcaacacagggtagactgcctcaagtccatctgccaggccacttccacgtcacaccccagtttcatcctgagcctggggcacacccctcctcttccgtggaactctgcctggtgcagggcttccccttcctttgaatgcccaagttcttgaattgctacttgcctttagggattaaatcagaagccctatggaatgctaagaaaacgcactgtgtgcgctccccctatgctgactgaggaagcacttccagctctacgcctgttacagttattttattttatttattattatyattttttttttttttgagacagagacttactctgctgcccaggctggaatgcagtggcacgatctcggctcaccataacctctgcctcccgggttcaagcgattctcctgcctcagcctcccaagtagctgagacttcaagtacgagccaccatgcctggctaatctttgtatttttagtagagatggggtttcactatgttagccaggctggtctcaaactcctgaccttgtgatctgcccgcctcggcctcccaaagtgctgggattacaggcgtgagccaccgcacccggctgttac

SEQ ID NO: 159211 - DNA, 601 bp, Human
ttactcagtggctcacgcctgtaatccgaacactttgggaggccgaggcaggcagatcacctgaggtcaggagttcgagatcagcctggccaacatggtgaaaccccatctctactaaaaatacaaaaattagccaggcgtggtggcacgcacctgtaatcccagctgtttgggaggctgagggaggagaattgcttgaactcggaaggtggaggttgcagtgagccaagatcaagccactgcacttcagcctgggggagagggcaagactccatctcaaaaaaaaaaaaaaaaaaaaaaaggagttagagaccagcctggccaacgtggtgaaaccccatctctactaaaagtacaaaaattagccgggcatggtggcaggtgcctgtaatagcagctactcggaaagctgtttatttgaaccctggaggtggaggttgcagtgagccgagattgtgccactgcaccccagcctgggtgacagaatgagactctgtctcaaaaaacaaaaaaacaaaacaaaacaacaacaacaaaaaacccaccttaattcaacactggccataggacaaaattttaaaagtctttgagcttaacattc

SEQ ID NO: 159212 - DNA, 601 bp, Human
ctcctgcggtctctcagtctgtcctcattttttttacggctgtcactggtgctcccccctgataagctgtgggctcatggtgctcacagtgatgactgcaaggttctctgcctccatccagaggcttccctactcttcaaagccagattcattctcctaaaataccatcgatcattatgttactcagtggctcacgcctgtaatccgaacactttgggaggccgaggcaggcagatcacctgaggtcaggagttcgagatcagcctggccaacatggtgaaaccccatctctactaaaaayacaaaaattagccaggcgtggtggcacgcacctgtaatcccagctgtttgggaggctgagggaggagaattgcttgaactcggaaggtggaggttgcagtgagccaagatcaagccactgcacttcagcctgggggagagggcaagactccatctcaaaaaaaaaaaaaaaaaaaaaaaggagttagagaccagcctggccaacgtggtgaaaccccatctctactaaaagtacaaaaattagccgggcatggtggcaggtgcctgtaatagcagctactcggaaagctgtttatttgaa

SEQ ID NO: 159213 - DNA, 601 bp, Human
aagcaaagaagccttctttccccacagttcaccttaggagtcattcattttctcagtgcctatctcactacacaacactgcctgcggggcccagcagctgcctcagagcaaaacctgcggctgcgtggctgcccgctctgccctgccctctctgatcacttctccttaacctaaaaaaaaggcataaatacacagttttcacctgtctctacagtgaattattatattttgcttcattccattcaaaactcttaccatctgaggtttaccttttcaataacaaatttatagaataagaggkctggtgattcattcattcaacaattcattgtttactgggcacctatccccggcaaaccacattgctctaccagcctctatgtcctcactggaagccccactcgtctggttttgtaccctctactcagatgaactgtcaaaagtcaccctaacacgctcactgccaaatccaaagttcctcttcctcctccacatccctgtgcctcgccctactgccagcgcctcatttcctgtcccctccagcctacaggtccctgttactggcacatcttcctcgcttgtctgctgatgcaccttcagt

SEQ ID NO: 159214 - DNA, 601 bp, Human
gtaaaagcaaagaagccttctttccccacagttcaccttaggagtcattcattttctcagtgcctatctcactacacaacactgcctgcggggcccagcagctgcctcagagcaaaacctgcggctgcgtggctgcccgctctgccctgccctctctgatcacttctccttaacctaaaaaaaaggcataaatacacagttttcacctgtctctacagtgaattattatattttgcttcattccattcaaaactcttaccatctgaggtttaccttttcaataacaaatttatagaataaragggctggtgattcattcattcaacaattcattgtttactgggcacctatccccggcaaaccacattgctctaccagcctctatgtcctcactggaagccccactcgtctggttttgtaccctctactcagatgaactgtcaaaagtcaccctaacacgctcactgccaaatccaaagttcctcttcctcctccacatccctgtgcctcgccctactgccagcgcctcatttcctgtcccctccagcctacaggtccctgttactggcacatcttcctcgcttgtctgctgatgcacctt

SEQ ID NO: 159215 - DNA, 601 bp, Human
ttacaaaacaggagttaagtctgtctgccgatgaacacttctggcttacctgtaaaagcaaagaagccttctttccccacagttcaccttaggagtcattcattttctcagtgcctatctcactacacaacactgcctgcggggcccagcagctgcctcagagcaaaacctgcggctgcgtggctgcccgctctgccctgccctctctgatcacttctccttaacctaaaaaaaaggcataaatacacagttttcacctgtctctacagtgaattattatattttgcttcattccattcamaactcttaccatctgaggtttaccttttcaataacaaatttatagaataagagggctggtgattcattcattcaacaattcattgtttactgggcacctatccccggcaaaccacattgctctaccagcctctatgtcctcactggaagccccactcgtctggttttgtaccctctactcagatgaactgtcaaaagtcaccctaacacgctcactgccaaatccaaagttcctcttcctcctccacatccctgtgcctcgccctactgccagcgcctcatttcctgtcccctccagcct

SEQ ID NO: 159216 - DNA, 601 bp, Human
gacacagggcccacaagacccgtgctgcagcccgcgtccaccacagtgctgaccggactctagtctgagcgtgattcttctctggcctggatcaacgtgggctctgcccctcactccatacctctgtgctgtaaaaactaactgcgccatttgtactaaaacaaatcatcacacagtggcaaaagtagttttgccatgttcatggtaatccacctgagaatttctcagctgatgttaaggagactggaagacaaaaacaaaagctgtgttcccaatgacacaacccaagacaagcatatgycacagggcgggaagttacaaaacaggagttaagtctgtctgccgatgaacacttctggcttacctgtaaaagcaaagaagccttctttccccacagttcaccttaggagtcattcattttctcagtgcctatctcactacacaacactgcctgcggggcccagcagctgcctcagagcaaaacctgcggctgcgtggctgcccgctctgccctgccctctctgatcacttctccttaacctaaaaaaaaggcataaatacacagttttcacctgtctctacagtgaattattatattttg

SEQ ID NO: 159217 - DNA, 601 bp, Human; identical to SEQ ID NO: 35293

SEQ ID NO: 159218 - DNA, 601 bp, Human; identical to SEQ ID NO: 35294

SEQ ID NO: 159219 - DNA, 601 bp, Human; identical to SEQ ID NO: 35295

SEQ ID NO: 159220 - DNA, 601 bp, Human; identical to SEQ ID NO: 35296

SEQ ID NO: 159221 - DNA, 601 bp, Human; identical to SEQ ID NO: 35297

SEQ ID NO: 159222 - DNA, 601 bp, Human; identical to SEQ ID NO: 35298

SEQ ID NO: 159223 - DNA, 601 bp, Human; identical to SEQ ID NO: 35299

SEQ ID NO: 159224 - DNA, 601 bp, Human
caaaaaagctgggcgcagtggctcacgcctgtaatcccagcactttgggaggctggaggatcacaaggtcaggagataagaccatcctggctaacacagtgaaaccctgtctctactaaaaatacaaaaaaatcagccaggcgtggtggtgggcgcctgtaaccccagctcctcaggagactgaggcagaagaatggtgtgaacctgggaggcagagcttgcagtgagccgagattgcaccactgcactccagcctgggcaagagtgcgaggctcagtctcaaaaaaaaaaaaaaaaaaaraattagccacatgtggtggcgcatgcctgtaatcccagctactcaggaggctgaggcaggacaatcacttgaacccaggaggcagaggttgcagtgagccaagatagagccactgcactccagcctgggcaacagagggagactgtgtctcaaaaaaataaagtttctcttcataagttttaattgctttacttcttttaagagataatccttgcctaaaaagcctaaaacagtgaagcacaactatattgtttcagagccattcatagaatgtcaatttctcgtgcaaatatgaataca

SEQ ID NO: 159225 - DNA, 601 bp, Human
aaattatcctcccacttcagcttcccaaagtgctgggattacaggtatgagccaccgtgcccagcctgatattactatctgcacaagagaaagtagagaagaagcaagaagcatctgatagacctgaagaaacaagaacccccagctgccaacaggttcttcccagaaggatggcatgccactcacgctgagaacatgtgagaccagaagggcaactgcatttccccgttcactgagtccatggggcccagggaacagtctgaagaagctgatccagtctggacccatgagcccccaaaaytaaccagcaccacaaaggaggaggcttctgcaagtaagacccaaactcactggaaaaaagagaaggcccagataagagtggggatcaaacagccagggatgcttggaaggtaggaaaccacattcctaacatttcatgaatacagtcagaaaagctcctagacctcctcccacctaagagagcagcagaacaaatttcatgtaaaaataggcaatagaaaaatcccttataaagttattataagaaaaaaataagctgaatagtttctccagagataagaaaagtgggatgaaaagacgt

SEQ ID NO: 159226 - DNA, 601 bp, Human
aagagaaatttggcatggctgactccatcttgcttctagcctcacacactgtcctcgcttgttcctgggtgtgggccaagctagcttcgggaggaatttatagtttaaatgataatagcacttccccaaaactaaactacccttgtaaaactaatgaaaggccaccaaattaggaggataagaggagactgcattctactaagatgtaggcatggttaaataattaccagccattattatggaggtcagatttgcaacttccccaattactcctacagataacatctactgtaaaacttargcttggccttttgcgatagcttttcagctttttgcatttctgacaaccaatggctccacctggacttaccaactggtcctgtggccccactcagaaactgactcagcacaggaggatagcttccatgccctatgatttcacctctgccccaaccaaccagccagcattcctcactccctggcccttacctgccaaactatccttgaaaaaccctggtctccaaggagaccgatttgagtaataataaaactccaggctgccattcagccagctctgcatgaattaagctctttctctact

SEQ ID NO: 159227 - DNA, 601 bp, Human
cctatctcctgcagagccgtcctggaccactctgcccatgctggccttttcttcctcagagccctgctgcatgctttccagtgttttggggatgctggtgctcactcatttcactgcacacttttgtgcaccgacagcatggattcttctgaagtctaacataggggttatagtcggcttcttgaagacttgctgattgaacagcataatcttagtgaagctgcctttgcaaaattataacagcaagagaaatttggcatggctgactccatcttgcttctagcctcacacactgtcctcrcttgttcctgggtgtgggccaagctagcttcgggaggaatttatagtttaaatgataatagcacttccccaaaactaaactacccttgtaaaactaatgaaaggccaccaaattaggaggataagaggagactgcattctactaagatgtaggcatggttaaataattaccagccattattatggaggtcagatttgcaacttccccaattactcctacagataacatctactgtaaaacttaggcttggccttttgcgatagcttttcagctttttgcatttctgacaaccaatggctc

SEQ ID NO: 159228 - DNA, 601 bp, Human
acatgtggattcaatgggcaaaaatcaagaatgcgaccactcaccttcaccacctaccctccccttttctcccttcctccttcccttcctgccactctttcccctttaaatattcaagccctcgaagctctctctggaaaaagcagggaccacagatcccctgtaactggtgtttctttttccctgggtacatcctcaaccttgacgaaataaacctctaagctgacagagatctgtctcagccactcttgggtctacagggtccaccacctgcaagtgcagcaggctcagggctgccccygggctccacgccgcacactcttccttccccttccttcagctctatgacctgctcatccttctgggtacctcggccctatctcctgcagagccgtcctggaccactctgcccatgctggccttttcttcctcagagccctgctgcatgctttccagtgttttggggatgctggtgctcactcatttcactgcacacttttgtgcaccgacagcatggattcttctgaagtctaacataggggttatagtcggcttcttgaagacttgctgattgaacagcataatcttagtgaagctgcct

SEQ ID NO: 159229 - DNA, 601 bp, Human
tatgtttactttattgcatgtaaaatgaggatttactgaacaagagatgcatgcgtaactgacatccctctactcctcctttcacatgtcacatgtggattcaatgggcaaaaatcaagaatgcgaccactcaccttcaccacctaccctccccttttctcccttcctccttcccttcctgccactctttcccctttaaatattcaagccctcgaagctctctctggaaaaagcagggaccacagatcccctgtaactggtgtttctttttccctgggtacatcctcaaccttgacgaaayaaacctctaagctgacagagatctgtctcagccactcttgggtctacagggtccaccacctgcaagtgcagcaggctcagggctgcccctgggctccacgccgcacactcttccttccccttccttcagctctatgacctgctcatccttctgggtacctcggccctatctcctgcagagccgtcctggaccactctgcccatgctggccttttcttcctcagagccctgctgcatgctttccagtgttttggggatgctggtgctcactcatttcactgcacacttttgtgcaccgaca

SEQ ID NO: 159230 - DNA, 601 bp, Human
gagtctggaaggcaatggtttcaggagcacaggccctagcccctctcttctccatagcctccctacctcctggctggctctgcagtattctgcacgtggctcattctctctgatggaccagaaagtacttcaaaactgtccagtgtttcaagagcctcaccatgctaacccaattctcctttcaataaacagaccttagttgtgcagcgtgagtcgtgtgagtacagacactgagactgtggatgggtgggagaactggggagattctcacatcactgcagacctcctcagtgcctcacasagggctcatctggactgggctcttctgcattcctgtctttcacagctcaacacctggctatctggcagccctgacctctgttcatattctgattgcaaatgcgccttgctcaaatcctcttgggtgttgagaccaaaccgtttatcactccctttcctccccctgcccagggatgccttggagtcattcttgggctttcttctcttttgttctctatgaagtcttggttttacagctctgcctttgcctttttattttcatggccacccctgcaggcaccacctgaggagtgttgagatg

SEQ ID NO: 159231 - DNA, 601 bp, Human
gaatgctggcaagccctcaggtacacactccctgccctcgcagagtctggaaggcaatggtttcaggagcacaggccctagcccctctcttctccatagcctccctacctcctggctggctctgcagtattctgcacgtggctcattctctctgatggaccagaaagtacttcaaaactgtccagtgtttcaagagcctcaccatgctaacccaattctcctttcaataaacagaccttagttgtgcagcgtgagtcgtgtgagtacagacactgagactgtggatgggtgggagaactgrggagattctcacatcactgcagacctcctcagtgcctcacagagggctcatctggactgggctcttctgcattcctgtctttcacagctcaacacctggctatctggcagccctgacctctgttcatattctgattgcaaatgcgccttgctcaaatcctcttgggtgttgagaccaaaccgtttatcactccctttcctccccctgcccagggatgccttggagtcattcttgggctttcttctcttttgttctctatgaagtcttggttttacagctctgcctttgcctttttatttt

SEQ ID NO: 159232 - DNA, 601 bp, Human
ctcacttgtcacccaggctggaatgcagtgacgtgatcacagctcactgtagcctctagcctcaacttcctgggctcaggtgatcctcccatctcagcctccaagtagctgggactacagatgcacaccaccatgccgggctaattttttatatttttagtacaaacagggtttcaccatgttgcccaggctagtctcgaattcctgggctcaagtgatccacccacctcagcctcccaaagtgctgggattatagacatgtgccacagttcttggccaaaatattatttcaacatgtgaygacacaaaacatgattgaggtttttttacattcctttcttcatgctgaatcttcagtaaccagcatgcacttgacatttaacagttctcgattcacagcggccaccaagtgctcggcagccctccgcagctgccttacagggccacacaggctcagggagaggggaacgaccagggctctgcaggcaggacacctgggtcagaccctggctgtgctgcttacccactgtatgaccctaagcaaagctacctgacctctctctgttaacagcttcttcacctgaaactgatgtaagaggtc

SEQ ID NO: 159233 - DNA, 582 bp, Human
gcctaggagcaataggccacaccacacagcctaggtgtgcggcaggtgtagcgcactctgatgcctgcacgacgacaaaatcaactaacagcaaactcctcagaccgtatccccatcattaagcaacacatgactgcagtttctttctttgcttctaggctcagcctacaaaagcttgctgctcatgctgccggagcagagctctgaacttctaattctgagggctgcccgattcccaaactgttctttgctcaaataaacttatctgttaaatttactttgtctaaagtttcttttaaayggtacataaaaaatatatggccacgcgcaatggctcacgcctgtaatcccagcactttggggcggcggatcacctgaggtcaggagttcgagaccagcctgcccaacatggtgaaaccctgtctctactaaaaatacaaaaattagcctggcgttgtggcacctgcctgtaatcccagctactcaggaggctgaggcgggagaattacttgaacccaggaggcggaggttgcagtgagccaagatggaggcactgcactccagcctgggcaacagagggag

SEQ ID NO: 159234 - DNA, 601 bp, Human
tgcttttctgaggtgataagaatgtatctttttatgtgcattaaagcagaataggcagccaagtgcagtggctcacacctgtaatcccagcactttgggaggccgaggtgggcggatcacctgaggtccaaagttcgacaccagcctggccaaaatggcaaaaccccgtctctactaaaaatacaaaaattagccaggcgcagtggtgggtgcctgtaagcccagctactcaggaggccgaggcaggagaatggcttgaacccaggaggcagaggttgcagtgagccgagatcgcgccatygcactccagcagcctgggcaacagagcaagactcggtctcaaaaaaaaaaaaacagactaggcaggagccatcagcttagggctttttctgtacccagaacccatccatacacaaactggaacttaacctagaggcattctttgtaactaacttcaaattaagcttctaccaatcataaacagccaaccagccaactgtggcagaacttgggaccatgcattggaccacacaaataaggcaaatgcccagcagtagccaatcaagcagtcatgcaccgctaagagcagtcatgcactgct

SEQ ID NO: 159235 - DNA, 601 bp, Human
tgagccaagattgtgccactgcactccagcctgggcgacagagcgagactccttctcaaaacaaacaaacaaaaaaaaataggaggaggctgtgtatgttctatatacatctcagagatacacacttcaattaaaaaaacaagatgttcagtgtgcacagcatcttacgtttgcttttctgaggtgataagaatgtatctttttatgtgcattaaagcagaataggcagccaagtgcagtggctcacacctgtaatcccagcactttgggaggccgaggtgggcggatcacctgaggtccraagttcgacaccagcctggccaaaatggcaaaaccccgtctctactaaaaatacaaaaattagccaggcgcagtggtgggtgcctgtaagcccagctactcaggaggccgaggcaggagaatggcttgaacccaggaggcagaggttgcagtgagccgagatcgcgccattgcactccagcagcctgggcaacagagcaagactcggtctcaaaaaaaaaaaaacagactaggcaggagccatcagcttagggctttttctgtacccagaacccatccatacacaaactggaacttaacc

SEQ ID NO: 159236 - DNA, 601 bp, Human
tgaacaattttcattaaatacagttactcagcaaagtctattcagaaatattaattttttatttacaggtgaccccattccaaaaaaggatttaagaccaatgaaaaagatgtctcatacataaggttgcatagttttagagtaagatgtgcaaaatatcaaagcaaccaatgtccatctgtaagggatacatttccatactagacatatttccacacatctgcacaatgaatgctgaccatctataatgaggaggaagctggccgggcgcggtagctcgcgcctgtaatcctagcacttygggaggccgaggcgggtggatcacaaggtcaagaccatcctggccaacagggtgaaaccgtgtctctactaaaaatgcaaaaaaatagctgggcatggtggtgtgcgcctgtagtcccagctacttgggaggctgaggcaggaggatcacttgaacccgggaggcggaggttgcagtgagccaagattgtgccactgcactccagcctgggcgacagagcgagactccttctcaaaacaaacaaacaaaaaaaaataggaggaggctgtgtatgttctatatacatctcagagatacaca

SEQ ID NO: 159237 - DNA, 601 bp, Human; identical to SEQ ID NO: 35300

SEQ ID NO: 159238 - DNA, 601 bp, Human; identical to SEQ ID NO: 36562

SEQ ID NO: 159239 - DNA, 601 bp, Human; identical to SEQ ID NO: 36563

SEQ ID NO: 159240 - DNA, 601 bp, Human; identical to SEQ ID NO: 36564

SEQ ID NO: 159241 - DNA, 601 bp, Human; identical to SEQ ID NO: 36565

SEQ ID NO: 159242 - DNA, 601 bp, Human; identical to SEQ ID NO: 36566

SEQ ID NO: 159243 - DNA, 601 bp, Human; identical to SEQ ID NO: 36567

SEQ ID NO: 159244 - DNA, 601 bp, Human; identical to SEQ ID NO: 36568

SEQ ID NO: 159245 - DNA, 601 bp, Human; identical to SEQ ID NO: 36569

SEQ ID NO: 159246 - DNA, 601 bp, Human; identical to SEQ ID NO: 36570

SEQ ID NO: 159247 - DNA, 601 bp, Human; identical to SEQ ID NO: 36571

SEQ ID NO: 159248 - DNA, 601 bp, Human; identical to SEQ ID NO: 36572

SEQ ID NO: 159249 - DNA, 601 bp, Human; identical to SEQ ID NO: 36573

SEQ ID NO: 159250 - DNA, 601 bp, Human; identical to SEQ ID NO: 36574

SEQ ID NO: 159251 - DNA, 601 bp, Human; identical to SEQ ID NO: 36575

SEQ ID NO: 159252 - DNA, 601 bp, Human
cctttggaaggactggcttacaaacaaaacttctacaaactaatcatagaatttcataaagtataaggtgctatgttaagtgatttacattaattcattaaccttttgagataggtgctattacattaccaccttatagatgttagctctagggcacggagttagagaaatttgcttaaggtcacaagtggcagaacctgggttcaacctatgcagtgagtccagacattttgcccctaagtactatactatactatactatactatactatactatactatactatactatactatctacactaaattactcaatacataattttaagaagattttggttgtttttctgcagaatctaagtttgttttccttaactgatcaaagacgtgctactgttgaaaaagtattaagctttggttcagatgacttaatggtcatttgacaaatatgtttgggcacctacgtacacttagtattattaagtacctgcctagtgctaaggatttgcacataactcatttactaaatcctcccgacaagtttgtgagtttggtattgctaatcttaaagatgaggaaatctgggcactgcaaaataact

SEQ ID NO: 159253 - DNA, 601 bp, Human
cactcctttggaaggactggcttacaaacaaaacttctacaaactaatcatagaatttcataaagtataaggtgctatgttaagtgatttacattaattcattaaccttttgagataggtgctattacattaccaccttatagatgttagctctagggcacggagttagagaaatttgcttaaggtcacaagtggcagaacctgggttcaacctatgcagtgagtccagacattttgcccctaagtactatactatactatactatactatactatactatactatactatactatactaactatactaaattactcaatacataattttaagaagattttggttgtttttctgcagaatctaagtttgttttccttaactgatcaaagacgtgctactgttgaaaaagtattaagctttggttcagatgacttaatggtcatttgacaaatatgtttgggcacctacgtacacttagtattattaagtacctgcctagtgctaaggatttgcacataactcatttactaaatcctcccgacaagtttgtgagtttggtattgctaatcttaaagatgaggaaatctgggcactgcaaaat

SEQ ID NO: 159254 - DNA, 601 bp, Human
acccaccatttcgcatcttataaagttgcacgtttttctgaatatattctgcaaactgtacagtgtctccagcctctccaacacacaggagtaatatcttttcactcatcttaaacatcttgtcatgatctgctcaaagaagaaaactgtgttagaaactgccttaacagacattgaccgtcattatttatgtaaccataaacaggtttattaattactacagttggccttccatatacatggattctgaatccacaattcaacaaactatggatcaaaattattcagaaaaaaaaaaaaatggatgcttgcatctatcctgaacatgtactgactttttttctggtcattattccctaaacaatatggtataacaactatttacatagcacttatgtcatattaagtattataaataatctagagatgatttgaagtacacaggagtacctgcataggtaatatgcaaatactataccatgtatataatggactttaagcatctatggatttgggtatctgcaggggttctggaaccaatccctacagataccaagggacgactgtatattgaataatttaactaattattgcttttaga

SEQ ID NO: 159255 - DNA, 601 bp, Human
tgacacaggtaaccaaaactgcaaatagggagggattactacctctccaaagaatcctgacacaatcagtccatagacaaccattaaaaaatttcctccttacctgcactacagttctgaaaatttcttcagtttatactaatgttccaagggctttagaacaatggcctttcaccaagatcaattctaaacttaatattataacctgagttcacattagaagtgttaaaaaaataaaagtccccaacatccaagttgagcttacaaagaaatgttgtgattttgcctcaaagtttactgrgttgcattacctcgaataaggcgctgagtctcactatgcagttgttttaatgcttctttacttaatctggctgcctttctttccttaaagaaaacaagaagtgagactacattaattatatgaatatccagaaagatagatattcatcactcaagagtttgctctctccaagaaaagaggaaaggaaatagtaagcatgagtaagcccaaatgcagtataaactcaaggaattcatttattcccaagtctcagagaatttgttcaatccaatccatattttgttcctactatgtacaaag

SEQ ID NO: 159256 - DNA, 601 bp, Human
tcctacgaatacaaagccatttttaatattagcattattatattaaaatatataaacaggtggaagcccaggcaatggtattctgtcagtaccactgaatatctgtattcagatatataatgatgatctacagatattcagtggtactgacagaactgaagttcctaagatttagggatatatgaggtagttaccctcatcatgcccctaaaacctcttatacaattgaacatgcttattatactctttttcaagtctgactttttctctcatattcaccatgacaaggtaacaaaacaaygtaattgccagaaacctcctgatttccttcttcttcctcctcctcttctttctcctcctcttcctctagttcttcctctttctcttctttctctaccttctcttctccatcttcctcagactcatctgtcatttcttcctcttcctcctcctcttcctcaaacccatcttcattatctaatttaaacagtgcttggcgcttctggcgctcctcaaaccttcggagtttcattgcttcttgcagtttagcttttaacacctgaagcttttcacctgaacagaaatatgtagaaatgcttta

SEQ ID NO: 159257 - DNA, 601 bp, Human
acaggcatgagccaccctgcccggcccaaaaaggaaagttttttaatacttaacaatcgtatcatcacctgttttccctaggcagaaaacagtactacggaacaagggcaagaggcccttctacaaatgccttcttctacaaagaacgaaaataactcagaaaggcctctacctccctaagaatttactccaggcctcaatctagccaaggttaggactgctttttaatctgctagagaaacctaaataaacaacaaagataaaatttcctacgaatacaaagccatttttaatattagcrttattatattaaaatatataaacaggtggaagcccaggcaatggtattctgtcagtaccactgaatatctgtattcagatatataatgatgatctacagatattcagtggtactgacagaactgaagttcctaagatttagggatatatgaggtagttaccctcatcatgcccctaaaacctcttatacaattgaacatgcttattatactctttttcaagtctgactttttctctcatattcaccatgacaaggtaacaaaacaatgtaattgccagaaacctcctgatttccttcttc

SEQ ID NO: 159258 - DNA, 601 bp, Human
atcagtctaagattgcaggctgactactgatctcaaaccaagcacagactgagacaggctgtatagctcagccattgctttctttctcctttacccaaaattaaataataactcaagttgctgggcatggtggctcatgcctgtaatcccagcactttgggaggccacaacgatgggaggatcacttgaggccaggagttcgagaccagtctggtcaacatagtgagaccctcatctcaaaaaaatttaaataaataaataaaataaaataaaataaagtgatcccagcatacaaaaaggraagtttttttttttttttctttttttgagatgcagtcttgctctgtcgctcaggctagagtatagtggcacaatcttggctcactgcaaccttcactgcccaagttcaagcaattctcctgcctgagtagctgggattacaggtgtgtgccaccacacacagctaatttttgtatttttagtagagatggattttcacgatgttggctaggctgttctcaaactcctgacctcaggtgatccacctacctcagccttccaaagtgctaggattacaggcatgagccaccctgcccggccc

SEQ ID NO: 159259 - DNA, 601 bp, Human
ttctatagttctgtagtgttaagtacattcatattgttaagcaatctccagaactcttttcagcttgcaaaactaaaactctatacccattacactctccatttccttataacctcagtctctggcaaccaccattctaccttctgtctctatgcatttgactactctaagtatctcatgtaagtggactcatacagtatttgtcttttggtgactggcttatttcttttagcataacattctaaggttcatccatgttgtagcaagtgtcagaacttctttttttttgagacagggtctygctctgatgcccagagtgcagtggcacaatcatggctcaatgcagcattgacctcccaggctcaagcaattctcccacctcagccccctgaatagctggtactgccggcacacgcctagctaattttagtattttttttatagggatggggttttgccatattatccaggctggtctcaaactcctgagctcaagtgatgcgcccacctcagccacccaaagtgttgggattacacgtgtgagccaccatgcccagccagaatttccattttaagttgaatattcctttgcatatatacc

SEQ ID NO: 159260 - DNA, 601 bp, Human
agactatgatgtcagattaacaaggttcccaaccaacctgttgagcacttcctggtctgatggcttcaaaaggatttctgagcaaagactttgattcctgaataaccatagggcgactggctggaaagaaaagacagagaggcctattctgggaaaagctgattagaattacttttaaatctaaacaagctaagaaatcttgtaactaaatcaatatgctaaagccatgggaactctgttctatataatggtgactttcaaactataataattggctccaagaagagacacaactaagttcaacagtaatcatttaagaaaaacagaagtggtcagtgtagggaatagtgaagagcttcatttctggagttaaatattcctggattcaaatcctacctctaacacttaggtatacaatcctgggcaactagagaaagccagaattaactactctgagccttagaacataaagtaaaaccagccacatatactcatgaatacagtctctactgcccaatagtctaagatctaagtacactgtctcccaccacctctgtgaagcctctttaagacagtattagacacaagcttatgattaagc

SEQ ID NO: 159261 - DNA, 601 bp, Human
gttgaggaaggaggatgctgaagcccaggagttcaagggtacagtgagctatgattgtgccactgcactctaacctgggcaacagaatgagactgtctctaaaaaataagttttttaaacaaagagctataatagaaggtaccatttatgtaaactcaattatcctcttcacctgagctgaacccaaaccacttggtaagttaacttgatcaattcactaggactgagaagccagtgaggggacaattgcagcagcttctcagtttagacccagagggtttccctgggatggagataaccagaaaatgaaatgctcctcaaggttagacaggcactgacccaagaatgagcattcaagctggacagcaaatcttcccttcaaggcattaagatttattgaaaaactacatacatattaaaacatctttatacacattttccccattataagattacaagtatacaaacataagtattgtcaaagtcaacatcttgagtattagaaaactgtagaaaaccggccgggtgcggtggctcatgcctataatcccagcactttgggaggccgagacgggtggatcacctcaggtcaggagttcaa

SEQ ID NO: 159262 - DNA, 601 bp, Human
gcgtgatctcggctcactgcaacctctgcctcccaggttcaagcaattctcttgtctcagcctcccaagtagctgggactacaggcacctgccaccaccaagcctggctgatttttgtatttttagtagagacggggtttcaccttgttggtcagtctggtctccaactcctgaccttaggtgatccagctgcctcagcctcccaaagtgctgagattacaggcataagccaccacgcccagcccagaaaccattttctccctggatttctcaggcactaattttcttttttttttctttyttttttttttttttagagttgggatttcaccatgtttcccaggctggtctcgaactcctgagttcaagcaatgcacccacctcagtctcctaaagtgctggcgtgagccaccggacctggctgaattttcttatcctcagttgtcaattccaattgtcttttctatctctcctcaaaagacatgtagggaaacaagagggaagaaatatctagccttcctgctcagttctcttttgcccagcaagggctactttgccttgggaactgtttagagagttcaaagaaagaggcaaaaacatg

SEQ ID NO: 159263 - DNA, 601 bp, Human
acattaaagtaacacatcatgatgacagacccaaaagaatgggaaacctaaggctgggtgtggtggctcatgcctataatcccagcactttgggagcctgaggtagctggatcacttgaggtcaggagttcgagatcagcctggccaacatggtgaaaccccgtctctactaaaaatacaaaaattagctgggcactaaaaacacaaaaattagccagatgtggtggtgcacacctgtaaccccagctacttgggaggctgaggcaggagaattgattgcccgggaggccgaggttgcagygagccaagatcacgtcactgcactccagcctgggtgacagagtaagaatccatattaaaaaaaaaaaaaaaaaaaaaaaagaacaagaaactcaaacagaggtaacctaattaagaaaggagtggtaatggtcagagaaggcttctctgaagaagttaggcttaagctaacaccttccccgtctctatcaaaaatacaaaaattagccgggtgtggtggtgcgtgcctgtaaccccagccccttgggaggctgaggcagaattgcttgaacgggggagacaaaggttgcagtgagctgag

SEQ ID NO: 159264 - DNA, 601 bp, Human
cagagtgccccctcccacttgtaatgttttgcctcaagcttgcccttcctcttcctcgtaaggaagtagactacattacgggaggccttaagtagccttaaattcaggcaagcatcgttctttgagttggttgcacccaaactcaatctcactctctcaaagctttctggccaggttttcctcacacacccatagaaacagatgcagacaaaaaaaaaaaaaaaaaaaaaaaaaaaaaaagcgcatagcaaaacctgtctccaggatggcccccagcagggagttggggagcttagcctaraagtaactgacaggtgatgggaatgtagtaaatgtttgctggatgagttaatggctgctaacaaaaggtagtatgcttgctgctgtcactcctcttcccagaccctttcctccttcttgtagtcacatccatctggctccaattcccagaagaatctcttagaaatctttggggatgaggggacagaatgaagacaggtaagcaaagatgctaaaacctgtaaataaacaatgctgggtggtggtggtgggggtgcggtttcaagaagtcaaattgtgacaaaaggaaatttgctctcgc

SEQ ID NO: 159265 - DNA, 601 bp, Human
tatattgggcctggtgtggtggctcacacctgtaatcccagcactttgggaggccgaggcaggcggatcacttgaggctgggaattcgagacaagcttggccaacatgatgaaaccccgtttctactaaaaatacaaaaattagacaggcatggtggtgcgcgtctgtaatcccagctattcaggaggctgaagcaggagaatcgcttgaacccaagaggcagagattgcagtgagccaagatcgtgccactgcactccagcctgggcgatagagtaagaccctgtctcaaaaaaaaaaaattaaaataaaataaataaagcctatatcgtgctctgcagggcagcaccccagcctggaatagctgagtcatcaattccattgttctaaaaagctagttattcctttttttttttttttttttgagatggagtctctctctgtcacccaggctagagtgcagtggcatagtcttggctcactacaacctccacgtcctgggttcaagcaattctcctgcctcaacctcctgagtagctgggactacaggtgcccgccacctggtgaatgtttgtatttttagtagaggcaggatttcacca

SEQ ID NO: 159266 - DNA, 601 bp, Human
ccttccagacacagagcgtcttttcttttttgcctctttcatgtactgtgatgagaaactctgcagtacataatacacaaaaccctgagatcttaccttactgacttcccgcagcattcccttggcccgtgagggacttgaacaaatggtggctgttctccttgacctatgtcctcacccatgaggtgcacttactcaaactctacatggtataaaaacttactcttcctgcatgccttcggtatttatcaccctgtcctttgtatatatatgtgtgtgtgtgtgtgtgtgtgtgtgtgtrtatatatatatatatttcctgaacagtatgtttctcaggtgttgtaagctctaatggaagggagagtttggtcgctgtaattcttcttgagcactgcctagcacagtgtcagatacaattaagggcttaaccaatgctgcttgataatggataaaagactattagactcaacgggacttttacagctttgggattttaagccattgttttcagttcaacatattccagaacacaatatattgtcgttgcctttggaaggtctgttaaggggattgaattaggcttggttatttggcggga

SEQ ID NO: 159267 - DNA, 601 bp, Human
gagacagacaaaaggtgctggcttctgttccttccagacacagagcgtcttttcttttttgcctctttcatgtactgtgatgagaaactctgcagtacataatacacaaaaccctgagatcttaccttactgacttcccgcagcattcccttggcccgtgagggacttgaacaaatggtggctgttctccttgacctatgtcctcacccatgaggtgcacttactcaaactctacatggtataaaaacttactcttcctgcatgccttcggtatttatcaccctgtcctttgtatatataggtgtgtgtgtgtgtgtgtgtgtgtgtgtatatatatatatatatttcctgaacagtatgtttctcaggtgttgtaagctctaatggaagggagagtttggtcgctgtaattcttcttgagcactgcctagcacagtgtcagatacaattaagggcttaaccaatgctgcttgataatggataaaagactattagactcaacgggacttttacagctttgggattttaagccattgttttcagttcaacatattccagaacacaatatattgtcgttgcctttggaaggtctgttaagggg

SEQ ID NO: 159268 - DNA, 601 bp, Human
ttggaaggtctttggatagcattagtacaattcacacaagaattcactgattcacactttgctcaatagagaatatcaggcagacacctggtatatagattgggtgcaatcaatatttcttacattgaatggagtttcatttctaactggggagacaccaggattgcagaagagtgggcaccaggtgcagccctgtcctatgtggcatgcaggtctcccctgagtgtaggaaggcctgtcttaggagagagatccaggcttgccccaacccaggttgcaagtggctgctaggggtaggggmaggagaacaggagcagcatatcctctcttgagactgggggcacaaggcaaattctttcagttctcaaaggtttattttcctgtttgttcaatggagagagtaatatctgacctgcctatttcagagctgttctcagtataaaagaaaatcaatacaaatggaactctaagaaaaaataagtcagtccataaatagaagatattaggaagcatttcccttcacactaataggtaagatgaaacatggagtttcttcccacgtctcactgggagtaggaggtctgcttgctggggtggagtt

SEQ ID NO: 159269 - DNA, 601 bp, Human
tctgggaaagctgtgttcttcacacagggcctgccatcaacagtggctaaggcttcggccccttcctgacactacaactgactttgttccttggtgttgcctgttattaggtctgcatccccaatgatgtcatggcccttggcttctggtcttatgctcctgttgccctctgggcaccttgctttggtgcacagaccaagttgcagagtggtaagaaatacctaatctttcctttgttacggagagggctatggccctgagtgtgtgtttgccttttgcggctcccattttgaaaagagayggaatgttttactttcaataagctgaggcctataaaatgcttttaatatccaactgctcccatggtggagaaaacatacttattagttttggggtatttctagtttggaaggtctttggatagcattagtacaattcacacaagaattcactgattcacactttgctcaatagagaatatcaggcagacacctggtatatagattgggtgcaatcaatatttcttacattgaatggagtttcatttctaactggggagacaccaggattgcagaagagtgggcaccaggtgcagccctgt

SEQ ID NO: 159270 - DNA, 601 bp, Human
gtcatttaacttccctgagctacaattctctattagttaaaggagcaaaataacaaccacctcatagggttgttgggaggattaattgggtcaagttaggtaaaggctcaggatcctacagagtccacaataagtgttaaactactgtctgtctccagctctctcagaagtaaaactcatctctctggatggctttactgaattgaactgctcagaattcctgagacactgtctaacttacgcataagcattgcctctgttctctacagcggggcctgcaacaaacactgccaagcaggasagcacagatatgaatgaaggggatttcccatctcctcctttctcaggcctggcagtcactgaaacccatgctcatgagaaggcagaccagcgtggagaactggtgatgcctgctcatcaaagatgcagcaaaggcctccttggaataaatagtgtccagtcttataataatgctaattcattctagagggctaagagcggcctgggagctgctctgatgactagaagcctcaggatgcaagtgcccccgaggaccatcctttacacgtgaaatcttgtagccacgactactagcgactgg

SEQ ID NO: 159271 - DNA, 601 bp, Human
actgaccagagttcacatctcagcagctctctcactaatgagctgaaccactttccacaggtcatttaacttccctgagctacaattctctattagttaaaggagcaaaataacaaccacctcatagggttgttgggaggattaattgggtcaagttaggtaaaggctcaggatcctacagagtccacaataagtgttaaactactgtctgtctccagctctctcagaagtaaaactcatctctctggatggctttactgaattgaactgctcagaattcctgagacactgtctaacttaygcataagcattgcctctgttctctacagcggggcctgcaacaaacactgccaagcaggagagcacagatatgaatgaaggggatttcccatctcctcctttctcaggcctggcagtcactgaaacccatgctcatgagaaggcagaccagcgtggagaactggtgatgcctgctcatcaaagatgcagcaaaggcctccttggaataaatagtgtccagtcttataataatgctaattcattctagagggctaagagcggcctgggagctgctctgatgactagaagcctcaggatgcaa

SEQ ID NO: 159272 - DNA, 601 bp, Human
agaggctggcttcaccatgtgcttttctagttcacatagctgaaaaacctatatgctctattgcttccctggagatttgtgcccttcaggttttcctaggatgtctgagaaaaatgatctgggatgttcaggaagcaagtgtgctatacgacagtatttctcaacatccattcatgggtcacctccatccaaaccagtgactgctggctgaatggcaatctctggggttgactgtgaggaatttgaatgttcaacacactccctgattattcctcacgccaaagttggagaatctctggartagcagaaagaacgcgaacctcgggggaagactgaccagagttcacatctcagcagctctctcactaatgagctgaaccactttccacaggtcatttaacttccctgagctacaattctctattagttaaaggagcaaaataacaaccacctcatagggttgttgggaggattaattgggtcaagttaggtaaaggctcaggatcctacagagtccacaataagtgttaaactactgtctgtctccagctctctcagaagtaaaactcatctctctggatggctttactgaattgaactg

SEQ ID NO: 159273 - DNA, 601 bp, Human
tactatagctttatattaagtcttgaaaacaggtagtgtaaattttccacttcattctttttcaagattctggttattccaggtcctttcatgtccatttaaactctggttacatcatctgaaactctagtcttttttttttttttttttttcagcattttctctctgagatattgacctgtcattgactttactgacctttctttttttctttttttctttttttttttttgcatccactatagtattaagcccatccagttaatttttctttttggtatattttatttttcagttctaraattccatttggttcctttaattgttgcaatttatctgctaaggtcatcttactttacttacatctattcatcttactttaaatcctccaacatatttatttataatagctgctttaaattctctatctactaattccaacatttgtgtcatctctgagttcatttctattgatcttttttgttctggttatgagtcacattttcctgcttctttttctgtcttataatttttattacatgctgggcattgtaagtgcaatattgataatttgaattattaatatgttcctttatggtgg

SEQ ID NO: 159274 - DNA, 601 bp, Human
ctctaagtttgcaaaaacattgtcctaaatttccttctagaagacttatcgttttaactttacattcaggttaacattatttacagttacatcatttgattcatctcattttttgtgtatggtgtgagacacaggtcacagttcattttttttcatgactgtcatttgttccatcaccatttgttgagaggatactcctttcttcgttaacctgccctggtgcctttgctgaggatcaactgaccgtatatgtagatttcttccagaacgtgctattctgtaccactgatatatttgtctrtccttatatgtatatcacatggacttgattactatagctttatattaagtcttgaaaacaggtagtgtaaattttccacttcattctttttcaagattctggttattccaggtcctttcatgtccatttaaactctggttacatcatctgaaactctagtcttttttttttttttttttttcagcattttctctctgagatattgacctgtcattgactttactgacctttctttttttctttttttctttttttttttttgcatccactatagtattaagcccatccagttaatttttc

SEQ ID NO: 159275 - DNA, 459 bp, Human
acatatatatattccccagtatttttcttccttcatttctttaatggtatcttttgatgagaagtttttgatttttataaagtccaatttgctaaatatattatttatggttagtcctttgtgtcctgtctaaaaaatactctaagtttgcaaaaacawtgtcctaaatttccttctagaagacttatcgttttaactttacattcaggttaacattatttacagttacatcatttgattcatctcattttttgtgtatggtgtgagacacaggtcacagttcattttttttcatgactgtcatttgttccatcaccatttgttgagaggatactcctttcttcgttaacctgccctggtgcctttgctgaggatcaactgaccgtatatgtagatttcttccagaacgtgctattctgtaccactgatatatttgtctatccttatatgtatatcaca

SEQ ID NO: 159276 - DNA, 457 bp, Human
acatatatatattccccagtatttttcttccttcatttctttaatggtatcttttgatgagaagtttttgatttttataaagtccaatttgctaaatatattatttatggttagtcctttgtgtcctgtctaaaaaatactctaagtttgcaaaaamattgtcctaaatttccttctagaagacttatcgttttaactttacattcaggttaacattatttacagttacatcatttgattcatctcattttttgtgtatggtgtgagacacaggtcacagttcattttttttcatgactgtcatttgttccatcaccatttgttgagaggatactcctttcttcgttaacctgccctggtgcctttgctgaggatcaactgaccgtatatgtagatttcttccagaacgtgctattctgtaccactgatatatttgtctatccttatatgtatatca

SEQ ID NO: 159277 - DNA, 601 bp, Human
ccagagctggcctgcatgctaaatgagaatataataaatgccaccatatactgaaccatccaccatgtgccaggagtgaactaggccatgttacagacatgctctcaatatttactacaattctgcatgatcgatgttttctctgtttcacacatgaagaaacagagtcaagagaggtaaaaatatctagtcaatgtcccacagctaggaagtagcaagaaggggctacaaattatcaccctggttattttatcattatgttttaaagttattaatatctaccacagtcctgcattgccgttttttttttgtttttatttatttatttattattattatactttaagttttagggtacatgtgcacaatgtgcaggttagttacatatgtatacatgtgccatgctggtgtgccgcacccactaactcgtcatctagcattaggtatatctcccaatgctatccctccccgctcctcccaccccacaacagtccccagagtgtgatgttccccttcctgtgtccatgtgttctcattgttcaattcccacctatgagtgagaatatgcggtgtttggttttttgttcttgcgatagtttac

SEQ ID NO: 159278 - DNA, 601 bp, Human; identical to SEQ ID NO: 33198

SEQ ID NO: 159279 - DNA, 601 bp, Human; identical to SEQ ID NO: 33199

SEQ ID NO: 159280 - DNA, 601 bp, Human; identical to SEQ ID NO: 33200

SEQ ID NO: 159281 - DNA, 601 bp, Human; identical to SEQ ID NO: 33201

SEQ ID NO: 159282 - DNA, 601 bp, Human; identical to SEQ ID NO: 33202

SEQ ID NO: 159283 - DNA, 601 bp, Human; identical to SEQ ID NO: 33203

SEQ ID NO: 159284 - DNA, 601 bp, Human; identical to SEQ ID NO: 33204

SEQ ID NO: 159285 - DNA, 601 bp, Human; identical to SEQ ID NO: 33205

SEQ ID NO: 159286 - DNA, 601 bp, Human; identical to SEQ ID NO: 33206

SEQ ID NO: 159287 - DNA, 601 bp, Human; identical to SEQ ID NO: 33207

SEQ ID NO: 159288 - DNA, 601 bp, Human; identical to SEQ ID NO: 33208

SEQ ID NO: 159289 - DNA, 601 bp, Human; identical to SEQ ID NO: 33209

SEQ ID NO: 159290 - DNA, 601 bp, Human; identical to SEQ ID NO: 33210

SEQ ID NO: 159291 - DNA, 601 bp, Human; identical to SEQ ID NO: 33211

SEQ ID NO: 159292 - DNA, 601 bp, Human
aactgaactgaaagtctgttcctgaggatgaatgaactcgaggagaagcttgtaaagcacctgttacatgtggagtcttaatatgaaaaactcactggagctctgtggttccttggttcccgggcataggaaagctcatagatttcatcctcagtgtagtaaagatccagggataactgcagatcaaagcagaacagggttcattgctaagatgctgtttgcctctcccacagctgatggttctttcttggattttccttgccagtagtttactcttttaggttctaaacagtttgttttyaaaagtcacaaaacaggtataacacctactattgcaatagggcaagcattaattctcattgaaatgtttttaattttggacatatctcaggatgccctctttttaactatgatttaaatctaagcctctatatagagcttaggccaaaggccttgtctggacagatgactaatacatcacttgttctctctcaaagcagacagatgatctgaaaggatggtgtgtatagtctgagactattaaatttgagtccagcaataaaatccagtttaaatggtaagacatattaattgctattaa

SEQ ID NO: 159293 - DNA, 601 bp, Human; identical to SEQ ID NO: 33212

SEQ ID NO: 159294 - DNA, 601 bp, Human; identical to SEQ ID NO: 33213

SEQ ID NO: 159295 - DNA, 601 bp, Human; identical to SEQ ID NO: 33214

SEQ ID NO: 159296 - DNA, 577 bp, Human; identical to SEQ ID NO: 33215

SEQ ID NO: 159297 - DNA, 517 bp, Human
aacctatttggctcttagcatatactcttgcattgtttctaaactgctctatatttgtatattatcttccccctaactagaactactccatgaagacagagacagtctattctgcttctttgcactttagatctggggcatctcaaacatactcaaagtcatttccttattgtactgttgtttgcattttaatgtaagtgaatttgctagtttatttcttgaatgttgaatgttttgtctcagtcctaggattttccttgtatgatttggaattttaatctgcaagctccacttgagtggkagtttgccccccgcccttcctttctacatttagccttctgtttctagaattttgacaattacctgctacctggcccctcagggttcctcagactaggacctggtcttaaattaatggcttggggttcctctcctggagaaaaattggggctatcatagacagtcactcagctagtagaactctgtctgtggctaagtctgcttcctgctgctaagt

SEQ ID NO: 159298 - DNA, 601 bp, Human
gcttcttatattaaactggcactaacctaataagcactggatttttgctgaagacctatatgttctttagttagtcaaggtgatcagtgttttgacatgctggctaaccagccagcccagagatcagggcctagtatagcactatgaagccttgtgccccaaccgtccccaacaagcccttcatgttacccttttttaaatagctcctcattttatcatacagacaggcacctgtcatttaagactctctagactgtctcatttttctacttcatctcttacctaaatcgccttaacacctttttttttttcccactatcccaatagtactaaagctgttctgcccttggccttttgctcctactgtacatcctatctggaatgtgctctgtcctcctcccataacttaattctacccttccttcaagacttagctgaaattccaccttctccataaagtcccaacagccccagtacagcgatctctctgctatgtcctcctgtcatttgctgtcactgcaacctatttggctcttagcatatactcttgcattgtttctaaactgctctatatttgtatattatcttccccctaactaga

SEQ ID NO: 159299 - DNA, 601 bp, Human
actaacttctcttaggaagatgcttaggtaaccatgatgatcctaaaccataaccctgatgaacatgttaaagagacctctagggaaggaggatttaggcaagttcattttagttccatctagaaaaggagtggtatcagcacagtaaagctaaccagtagatactgtggtttttctctgtgagcctactaaacagggctttgggcactggcaccagcactctgaaatgccaccacctgtgtggtgatagggagccctgtatagcctgtgctacttgtgtaatgtgaaccaaggcccccastgggttgtgagaaagctggaatcaatcatcctttcttccttccctccctctcttcctccctgtttctccctccctgtttctcccctcctccttttttgttttagactgcttgtaatcagcctgatctgaatcttcagtccacatgctctttcctggtttggccccacttctctaagatagtctgaaaaaaaggaaaatgaaaaggaaggtacctgttccagttcttggtaggtaggcagtctgaggtgacggagctcctcctttgattttatgagggagtctttattctcccacttgaca

SEQ ID NO: 159300 - DNA, 601 bp, Human
cccttatcacaggaacacaaaactaaaagtcaatctctattctacctccttctaccctccttgctttattttctcattggtaaaatggagaacacgtccagcattcagcacttttaagatagcaatggtactgtaattttacattaaagcaataagcaacaaaatactacataaatgtaaaatattatttttaacaacaaattattttaaaaggttttaaatgcttcacatcattaattaactaaagtatcaatcaagactttggtctttgtatattttatttttaagagctttgtaatayataattttcattctatattttatatatctaaaatctaagtattgatattaataataaaaaagtacaacctgtttagttgatcctgtgaaagaaattgatctagtttatatctcttcaaataccaaggcagatcttaagctgcaaaaaaagatgagaaccacttctgcatttggaatgtttctggtgagtttatatcctgaatgccagagaaggaggtggagattaatttgggggcttggcttcatgaagtccatgatgcaatagttaatgtagatgtaaatgcatacctgcagctgcagt

SEQ ID NO: 159301 - DNA, 601 bp, Human
aaagatctatttcagttagaaattgtcaattttttattctgagtatgtaggtcagttgttcagaaataaacatcaaaaaagttgttaaaattgtgacttataaattcaattaaactcagaaagtgtttttccttcccgctctccttcctctctttcttcctttctttctgcatactcccctcctgcatcttccaacctgccttttatccagcaaatactccctatgtgaatgcctacccttttcctaggccctgtagtcagtgctagaatactatggtggatatagatacatagggttctyatagtccctactttcttagatttacctgtatgagggcaaagtgacttttgtacatgtttctatcccaatctccagcactatgacacaaagtagatgttcagaaatatttgttaagttcaattattagatcaagaagctctctagtttctactaagtaaggattcacagatttaaaaggcaatatatgtcaatgacctacatattaattatttaccaaggactttggatttctgtcatatttatctgaagtttcttacatgaaagtaatgcccctatttgcaagaccccttatcacaggaa

SEQ ID NO: 159302 - DNA, 601 bp, Human
atccccattttctcaaaagatctatttcagttagaaattgtcaattttttattctgagtatgtaggtcagttgttcagaaataaacatcaaaaaagttgttaaaattgtgacttataaattcaattaaactcagaaagtgtttttccttcccgctctccttcctctctttcttcctttctttctgcatactcccctcctgcatcttccaacctgccttttatccagcaaatactccctatgtgaatgcctacccttttcctaggccctgtagtcagtgctagaatactatggtggatataratacatagggttcttatagtccctactttcttagatttacctgtatgagggcaaagtgacttttgtacatgtttctatcccaatctccagcactatgacacaaagtagatgttcagaaatatttgttaagttcaattattagatcaagaagctctctagtttctactaagtaaggattcacagatttaaaaggcaatatatgtcaatgacctacatattaattatttaccaaggactttggatttctgtcatatttatctgaagtttcttacatgaaagtaatgcccctatttgcaagac

SEQ ID NO: 159303 - DNA, 601 bp, Human
tgagaggcaaagtaggtggcatgtaataaaatatcttttctcattctattccttttggtaaattgtctcatattacaatgtatggatttacttcctatgtgatccccattttctcaaaagatctatttcagttagaaattgtcaattttttattctgagtatgtaggtcagttgttcagaaataaacatcaaaaaagttgttaaaattgtgacttataaattcaattaaactcagaaagtgtttttccttcccgctctccttcctctctttcttcctttctttctgcatactcccctcctkcatcttccaacctgccttttatccagcaaatactccctatgtgaatgcctacccttttcctaggccctgtagtcagtgctagaatactatggtggatatagatacatagggttcttatagtccctactttcttagatttacctgtatgagggcaaagtgacttttgtacatgtttctatcccaatctccagcactatgacacaaagtagatgttcagaaatatttgttaagttcaattattagatcaagaagctctctagtttctactaagtaaggattcacagatttaaaaggcaatat

SEQ ID NO: 159304 - DNA, 601 bp, Human
tctgtgacctttaaaattacttttttccccattcgatcaataaggtagtggatactcccattgaatgacttggctaaaaatgataaggttaagcaagatggttatcatttcctaattcatctcctgatcccatgacaatctatttcatgttcaaggttactaacagaatttttaattaggcatactttctttcattagctttcaaattcctttagtatcttgttttttcaactgccaaacttagcttatttcaagtttctgacatagcttcccaacacattttgtctttcctgacattagyctttctagatcttcctcctgttcacatttgcccaaaaacctgcctgataagttcttctacacacataaattgccccagcccttaggacaatctcaacttttaaaaaaccttcctctacatcatatcagatgtaatgtcaccaaaaatatgagatttctatttccaaaatgcatattagccttatcaataaatcacttgttccccaagccttctccttagtctcagaaaatagatctttcactagaagaaatgtgtataaaatgcaccacgatttgtcctgcctattggtttgcttactca

SEQ ID NO: 159305 - DNA, 601 bp, Human
gtttttaaccttattagaaagatgtctaacacataaaagaataggaaagcacaagtgattatgaagtaaaatgcttaaaactaaataaaaatgtggatatattcaattatatttattccgtgataaataaaaaccacagaaccttcaatttctttcaaaattgctggggcatataaaaagacaaagaggtccagaattacagttattttagcaaattatccaattatgtatatgtcaaataacaataaagatcattacatttgattattattgccgggtatctaagtcagagatttttgayttcctgaatatgtatcatttttttaaataaaccaaatgcttggtgaatgtatttaaaagaaaagatgaaattaattacactgtaatggttatatcaaagaaatggaatcttgagagtataaaggattcctctgtgacctttaaaattacttttttccccattcgatcaataaggtagtggatactcccattgaatgacttggctaaaaatgataaggttaagcaagatggttatcatttcctaattcatctcctgatcccatgacaatctatttcatgttcaaggttactaacagaattt

SEQ ID NO: 159306 - DNA, 601 bp, Human
aacctctgctttatactttgtatgtacttaacaatatttcaccattaacaactatgtatataacgggaccctcctacatacctagcacttcttagttgttgcacatatggggcaaaaacatagtaaagttgcatatcaaatagttttggtacatagagagtttttaaccttattagaaagatgtctaacacataaaagaataggaaagcacaagtgattatgaagtaaaatgcttaaaactaaataaaaatgtggatatattcaattatatttattccgtgataaataaaaaccacagaamcttcaatttctttcaaaattgctggggcatataaaaagacaaagaggtccagaattacagttattttagcaaattatccaattatgtatatgtcaaataacaataaagatcattacatttgattattattgccgggtatctaagtcagagatttttgatttcctgaatatgtatcatttttttaaataaaccaaatgcttggtgaatgtatttaaaagaaaagatgaaattaattacactgtaatggttatatcaaagaaatggaatcttgagagtataaaggattcctctgtgaccttt

SEQ ID NO: 159307 - DNA, 601 bp, Human
tgaacaccttaatatttaccatttacagtgtgtttgttatttttaggtgaaaaaagaacaacaaagagatttaccagatttagggtaggtggcaatgacaagatcatctggtcttgcctggaacgcttccacattatcccaatatttgacaaaatctttatacattagaatcccatggacttcttcaaacttttcataatagtcaagttcagaattcattgtggtacactgaaaaaaaacctctgctttatactttgtatgtacttaacaatatttcaccattaacaactatgtatataasgggaccctcctacatacctagcacttcttagttgttgcacatatggggcaaaaacatagtaaagttgcatatcaaatagttttggtacatagagagtttttaaccttattagaaagatgtctaacacataaaagaataggaaagcacaagtgattatgaagtaaaatgcttaaaactaaataaaaatgtggatatattcaattatatttattccgtgataaataaaaaccacagaaccttcaatttctttcaaaattgctggggcatataaaaagacaaagaggtccagaattacagtta

SEQ ID NO: 159308 - DNA, 601 bp, Human
atgccagatgaataagcaagagagattgaatctagaatagctcacgggtttcctcttcagatgacaggtattgtgctgccatttattccaatagggaagaaaataaagaagcagatttagagtcaagataactaagggcggccgggcgcggtggctcacgcctgtaatcccagcactttgggaggccgaggcgggtggatcacgaggtcaggagatcgagaccatcctggctaacatggtgaaaacccgtctctactaaaaaatacaaaaaaattagccaggtgcagtggcgggcgcctgyagtcccagctactcgggaggctgaggaaggagaatggcaggaacccaggaggcggagtttgcagtgagcagagatcgcgccactgcactccagcctgggagacagagcgagactccgtctcaaaaaaaaaaaaaaaaaaaaaaaaaagataactaagggcatacttagtgtgtttggctttatttttaagtggtaaatggaacaaccagatgaagaaatatgaattcggactagtctaatttctaaaagtctacagttgtaaaactccagaactatgcttaaaaatggagttttgtagat

SEQ ID NO: 159309 - DNA, 601 bp, Human
cacactgatacatcattcaaatatcagctgagatgttgctcctggatgccttccctacccccagtgtctgagtttgaattctctctcttacttgacctatgatactttttgtcttgtctgttaacctgtcctttttctgaaatggactaggtgtccatgaagacaaggcttgcatgtgtcttactcttatgtccctaacacataataggcactcaatacatagttattatatgacagttatctgacctatccttttatggttcatttgcatgcctaacagcaccaagcacagtattttgcraagggaggatattcaatacaattagtaataacaacaaatacaaaagtagctaacatttgttgtttacaatatgctaggaattaggtgaagcactttataagcattatcatgtaatccttataacaattccatgaaaaagatgttattattatctttcttctacagatgtaaaaacttaggcttagggagtctaactggactttttagaaccacatctggcaaaagacagagttggaattaaaatatagactctctgacaatattgactgtatttattccacatttgttaagtgtctatag

SEQ ID NO: 159310 - DNA, 601 bp, Human
ttgaagaacagaattggtggtctcagacttcatgttttccctgtattttgaggtcatgtataatattatttttaaagagcaaaactgacagtgtaaaccgtcagcttaatatgtctattactcctcattaccattaaaatgtcagagtccaaacatcttaacttgactttcaatatttcttataatccgttcctagctaatctgcctttacttatttagccaatatgtacacttaatcttccagccaagctgaactgattttagatgccccctcagatcatctctgaattgtcatcacacygatacatcattcaaatatcagctgagatgttgctcctggatgccttccctacccccagtgtctgagtttgaattctctctcttacttgacctatgatactttttgtcttgtctgttaacctgtcctttttctgaaatggactaggtgtccatgaagacaaggcttgcatgtgtcttactcttatgtccctaacacataataggcactcaatacatagttattatatgacagttatctgacctatccttttatggttcatttgcatgcctaacagcaccaagcacagtattttgcaaaggg

SEQ ID NO: 159311 - DNA, 601 bp, Human
tctttactaatgagacagcccttatgcatggaatgacttcagcaggacgtatatcgtctatctaggattgctaatgataaaaacaaactaacctggcaatctttgatttttgtctgtagatctccaggaaatgtcaaatatgccatgtaacggattacaaaatggaaatatttaatgactgggatatatcccctttttgttagtgatgactgcaaataatactataagatcttgaagaacagcactggtgagagaaaggtcttgaagaacagaattggtggtctcagacttcatgttttcyctgtattttgaggtcatgtataatattatttttaaagagcaaaactgacagtgtaaaccgtcagcttaatatgtctattactcctcattaccattaaaatgtcagagtccaaacatcttaacttgactttcaatatttcttataatccgttcctagctaatctgcctttacttatttagccaatatgtacacttaatcttccagccaagctgaactgattttagatgccccctcagatcatctctgaattgtcatcacactgatacatcattcaaatatcagctgagatgttgctcctgg

SEQ ID NO: 159312 - DNA, 601 bp, Human
aatgtaaatgacaagttaatgggtgcaggataccaacatggcacatgtatacatatgtaacaaacctgcacattgtgcacatgtaccctaaaacttgaagtataattaaaaaaagacccctattctattcctatgatacttaactaactaatctatacctctcctatctgatgctatttctaagcttgtggccattcccttgctttaactgaagatttgaacacctgcctcatggtttcactctccattcaaattcttttatcattctgtgtaattttattgttggtgtgtgtgatctacytgattctctaagttcatgtagtcattgatcattacttctatgttacttcagacttttgtaaccacttttgtaaccaaatactgaatcttgccttcaccataaaggtttcacttttgaagaattatcctgagccataatcttttcttccaaaaaatcccgcttcttccttcttccccatcagttattccacatacctctcctacaatcaaaccaatggctcaaatccgttggcctcagttatttatattatctactagcctgttactttttgtcactttcttctctttatcacttacagtt

SEQ ID NO: 159313 - DNA, 601 bp, Human
gcggggagggacagcattagaagatatacctaatgtaaatgacaagttaatgggtgcaggataccaacatggcacatgtatacatatgtaacaaacctgcacattgtgcacatgtaccctaaaacttgaagtataattaaaaaaagacccctattctattcctatgatacttaactaactaatctatacctctcctatctgatgctatttctaagcttgtggccattcccttgctttaactgaagatttgaacacctgcctcatggtttcactctccattcaaattcttttatcattctgygtaattttattgttggtgtgtgtgatctacttgattctctaagttcatgtagtcattgatcattacttctatgttacttcagacttttgtaaccacttttgtaaccaaatactgaatcttgccttcaccataaaggtttcacttttgaagaattatcctgagccataatcttttcttccaaaaaatcccgcttcttccttcttccccatcagttattccacatacctctcctacaatcaaaccaatggctcaaatccgttggcctcagttatttatattatctactagcctgttactttt

SEQ ID NO: 159314 - DNA, 601 bp, Human
cacatgaaaaaatgctcagcatcactggccatcagagaaatgcaaatcaaaaccataatgagataccgtctcacaccagttagaatggtgatcattaaaaagtcaggaaacaacaggtgctggagaggatgtggagaaataggaacacttttacactgttgatgggactgtaaactagttcaaccattgtggaagtcagtatggcgatccctcagggatctagaactagaaataccatttgacccagccatcccattactgggtatatacccaaaggattataaatcatgctactataaasacacatgaacacgtatgtttattgtggcactattcacaatagcaaagacttggaaccaacccaaatatccaacaatgatagactggattaagaaaatgtggcacatatacagcatagaatactatgcagccataaaaaagaatgagttcatgtcctttgtagggacatggatgaaactggaaaccatcattctcagcaaactatctcaagaacaaaaaaccaaacacctcatgttctcactcataggtgggaagtgaacaatgagaacacctggacacaagaaggggaacatcacacact

SEQ ID NO: 159315 - DNA, 601 bp, Human
gctgtctcttcctttttctttctcttgcctcactcatagtaaaaatgtttcataaaatataaagctgacaaaataatataatgttgtgtgagtcaaaaggttctgctttgcctgaagtcattgtatgcctcctctgttctttgactccattagggaatttttccttacagaaaatgttctacagtgaaatttatagtgatcttatttctccctttgcagtgatgcaaaattatatttctctgccctgcagtggaggtcttgacaatcttaagacatatgtattactcattatgctttagcaaaaattttcccaaaatgtagcaacaaacacaaagcacatataccttatttgtcttgagtcaatattatcatctgtggatatgaaaacacattattatttttctttataattgttactacatgatcagaatggccttctttagaatactagactatcctgcaccctttcttcctcaaatctaaacactttagtaaaagtgtttaataaaaacgaaaaattttccagaatatctgctcaagtaactcttaacaaatttgagaaacctggttaaaatattcagattgcactctgggtagaatg

SEQ ID NO: 159316 - DNA, 601 bp, Human
aaattagattttagaaatgatgtaatataaccaaatgctgtctcttcctttttctttctcttgcctcactcatagtaaaaatgtttcataaaatataaagctgacaaaataatataatgttgtgtgagtcaaaaggttctgctttgcctgaagtcattgtatgcctcctctgttctttgactccattagggaatttttccttacagaaaatgttctacagtgaaatttatagtgatcttatttctccctttgcagtgatgcaaaattatatttctctgccctgcagtggaggtcttgacartcttaagacatatgtattactcattatgctttagcaaaaattttcccaaaatgtagcaacaaacacaaagcacatataccttatttgtcttgagtcaatattatcatctgtggatatgaaaacacattattatttttctttataattgttactacatgatcagaatggccttctttagaatactagactatcctgcaccctttcttcctcaaatctaaacactttagtaaaagtgtttaataaaaacgaaaaattttccagaatatctgctcaagtaactcttaacaaatttgagaaacc

SEQ ID NO: 159317 - DNA, 601 bp, Human
gaaactatcagtggtctgatagtcataagaatatagttctggtctcaaatttaccatttacaaactaggtttggcaactaaaactagtaactatatgagtatttattacactattagtttacatgggaaggaatgttctcgtaggtacccttagtgtcattctcactccaggaaattagattttagaaatgatgtaatataaccaaatgctgtctcttcctttttctttctcttgcctcactcatagtaaaaatgtttcataaaatataaagctgacaaaataatataatgttgtgtgagkcaaaaggttctgctttgcctgaagtcattgtatgcctcctctgttctttgactccattagggaatttttccttacagaaaatgttctacagtgaaatttatagtgatcttatttctccctttgcagtgatgcaaaattatatttctctgccctgcagtggaggtcttgacaatcttaagacatatgtattactcattatgctttagcaaaaattttcccaaaatgtagcaacaaacacaaagcacatataccttatttgtcttgagtcaatattatcatctgtggatatgaaaacacatt

SEQ ID NO: 159318 - DNA, 601 bp, Human
tgagacattatcactgtatcttatataccaaaaacatttttattttttaaatgctaatacttagtaagaaccattacttttcatcaaatagcctatttatctcactgtgctacattctatagaatttccttagctccatcttttacttcaataattcactatgtagccatgtctaatctattattgaacccatctcttaatttttcatatttttttagttatttttagaaattgtatttggctattttttttcaaatctgctctgtcaattttaatagtttttgtttctttgtaatttttmaaatttcatcttttatttatttaaacatattaagcatggttattttataggacctatctaacaattgcaacatctctacatttgcagaccagttaattgcttgcccatgttgattccttgtgtgtgaatgtgtgtgtgtgtgtgcctatgtgtgtgtgttattgattcatgaagtcaagttctttcaaattttttctttgaaatttttgagacttgtggtttaaaatgtatttattttcagaatatttttatttgctagcttcaaatctatgctaaagtatctgtattattttggtcctt

SEQ ID NO: 159319 - DNA, 601 bp, Human
aaattatgagatatatgtatatatctcatttaaagaggaaaactatatacagcacctattacctactacttaacttatgaaatagaacattcacagttttcttagtttttttttcttttgagttcccttcacctctactcccatcccacataaacaaaacaatcaaaaaaaaaaaaaaaagaaaagaaaaggaaaaaaactgctaatttcaaattattatcttctctactttataggtttcaaacttaggtatgaatctctagacaacatatagtttgattttacctagctgatgtgtatwtttagtgtacttcctttcattataatataatatctaattgtaatacaataaaatacattatatatggattctttggtatatatatctgggttgttttcaatttttgcagttattaagaatgctactatgaaaattattgaatatctaacctaatgtacacaagtcagagtttttctagagtatatgtctaagagtagaatttcagggtcttaaactatgtgcatgtttgcctttgctagataatgacaagttgtttccagtgtttgtatctttctacactacaatcaacagtgtgttact

SEQ ID NO: 159320 - DNA, 601 bp, Human
aaataggcatctcacatgtatgtgtatatatatataatatatacacaaaatcttattttatatatacagacatatgtgtatatatatagtgataatgtcttgatttctttctactggatacattgtagaaacaaataaaaattaatttgtacattcttagccttattaattcaaatatagaggaaacctaaacatggctattattgaccaaaatcgggagtaagtagacatggacaatttgaaatggaggaagagagttggagtaactatttaattttgtttgtgtgtatttcaaattcamtgtcattaatagtctaattacagaacacagtattggataatataataaactgtagatcatgactgcttttcttattcaaatttgatctagtgttaaattctataaatacataatttaatttataaaatattatttatgattttattttaaataaatgctcaccaaaaacactctaaaattactgaaataccataaaggattttaaaggttattcaaatatatgaataagacatggatatcaattgcttttttggtgatagtaaaggataagaaaatagagaaaatttctcacctcttaat

SEQ ID NO: 159321 - DNA, 601 bp, Human
ggtgatgaatacctcatttaccttgatgtgattattacgcatggtggcctatataaaaatatgtcatgtaccccataaatatatacacctactatgtacccataaaaattaaaaattgaaattaaaaaaagatgatgcttcaagacacaagaaaaaagattatatgtatatatgggtgcaaaataggcatctcacatgtatgtgtatatatatataatatatacacaaaatcttattttatatatacagacatatgtgtatatatatagtgataatgtcttgatttctttctactggatayattgtagaaacaaataaaaattaatttgtacattcttagccttattaattcaaatatagaggaaacctaaacatggctattattgaccaaaatcgggagtaagtagacatggacaatttgaaatggaggaagagagttggagtaactatttaattttgtttgtgtgtatttcaaattcactgtcattaatagtctaattacagaacacagtattggataatataataaactgtagatcatgactgcttttcttattcaaatttgatctagtgttaaattctataaatacataatttaatt

SEQ ID NO: 159322 - DNA, 601 bp, Human
gatccctgttctgttttgtttttttccccagtggcaggtttgttattttacaaattccctgactctcactgacagtatggttcaaagagcaagatttgattctattctgtttgtttctgcttcctcatatataaatagactggtgtcccagtgctctgaatatctgaatatcttacatgcctttaaatttgttaactggctatatctcatcaggctatgtctccccccaaatagaatttttttctccttatatgttgatattttttgctaaacagagctatatttgaatttctattttttkccacttacccttgaaaggtgtttgccacttgttaaaaaatgttgacaaactattctaaacttatttcttcaactcaaaaagagagaggaataaaatctttctgcggaatttctggttagaacttaaaggaactatatgatacatgttgtaacactgaggcacataggcttggtaaattacagctagtagagtgtgatactatttccaatgctgagattgaggagtctgctagttattttaacataatatgatgcatataataaataatcaacaggtaattgcaatgtaatagaagtgtaa

SEQ ID NO: 159323 - DNA, 601 bp, Human
tctaaactttcccactgaaataacccaaaaaccagaagacagaacatgtgtatcctaaaaaaatcagataggttctgagggtacagcagcaagtcaccgtttgcaagcaagacaactgttttaagtcctctgtaacatttatatgtagaattttgaaaaaggaaacatataatcaaaagagtacataattaaaatatagtttgagaactgaatctcttttcagtggatccctgttctgttttgtttttttccccagtggcaggtttgttattttacaaattccctgactctcactgacagwatggttcaaagagcaagatttgattctattctgtttgtttctgcttcctcatatataaatagactggtgtcccagtgctctgaatatctgaatatcttacatgcctttaaatttgttaactggctatatctcatcaggctatgtctccccccaaatagaatttttttctccttatatgttgatattttttgctaaacagagctatatttgaatttctattttttgccacttacccttgaaaggtgtttgccacttgttaaaaaatgttgacaaactattctaaacttatttcttcaactc

SEQ ID NO: 159324 - DNA, 601 bp, Human
ctgttttgctttttaacatacttccaacactcaccttgcagaaggaattcatcttttttttttttcttttttttttggagacagagtctcgctctgtcacccaggctggaatgcagtgcagctatctctgctcactgcaagctccacctcccaggttcacaccattctcctgcctcagcctcccgagtagctgggactacaggcgcccgccaccatgcctggctaattttttgtattttcagtagagacagggtttcactgtgttagccaggatggtctcgatctcctgacctcatgatcygcccgtctcggcctcccaaagtgctgggattacaggtgtgagccaccgcgcccagcccaccttcttttttaaactattcaagagttcacttgccctcttgctcaaggagctctaaactttcccactgaaataacccaaaaaccagaagacagaacatgtgtatcctaaaaaaatcagataggttctgagggtacagcagcaagtcaccgtttgcaagcaagacaactgttttaagtcctctgtaacatttatatgtagaattttgaaaaaggaaacatataatcaaaagagtacataatt

SEQ ID NO: 159325 - DNA, 601 bp, Human; identical to SEQ ID NO: 85777

SEQ ID NO: 159326 - DNA, 601 bp, Human; identical to SEQ ID NO: 85778

SEQ ID NO: 159327 - DNA, 601 bp, Human; identical to SEQ ID NO: 85779

SEQ ID NO: 159328 - DNA, 601 bp, Human; identical to SEQ ID NO: 85780

SEQ ID NO: 159329 - DNA, 601 bp, Human; identical to SEQ ID NO: 85781

SEQ ID NO: 159330 - DNA, 601 bp, Human; identical to SEQ ID NO: 85782

SEQ ID NO: 159331 - DNA, 601 bp, Human; identical to SEQ ID NO: 85783

SEQ ID NO: 159332 - DNA, 601 bp, Human; identical to SEQ ID NO: 85784

SEQ ID NO: 159333 - DNA, 601 bp, Human; identical to SEQ ID NO: 85785

SEQ ID NO: 159334 - DNA, 601 bp, Human; identical to SEQ ID NO: 85786

SEQ ID NO: 159335 - DNA, 601 bp, Human; identical to SEQ ID NO: 152030

SEQ ID NO: 159336 - DNA, 601 bp, Human; identical to SEQ ID NO: 152031

SEQ ID NO: 159337 - DNA, 601 bp, Human; identical to SEQ ID NO: 152032

SEQ ID NO: 159338 - DNA, 601 bp, Human; identical to SEQ ID NO: 152033

SEQ ID NO: 159339 - DNA, 601 bp, Human; identical to SEQ ID NO: 152034

SEQ ID NO: 159340 - DNA, 601 bp, Human; identical to SEQ ID NO: 152035

SEQ ID NO: 159341 - DNA, 601 bp, Human; identical to SEQ ID NO: 152036

SEQ ID NO: 159342 - DNA, 601 bp, Human; identical to SEQ ID NO: 152037

SEQ ID NO: 159343 - DNA, 601 bp, Human; identical to SEQ ID NO: 152038

SEQ ID NO: 159344 - DNA, 601 bp, Human; identical to SEQ ID NO: 152039

SEQ ID NO: 159345 - DNA, 601 bp, Human; identical to SEQ ID NO: 152040

SEQ ID NO: 159346 - DNA, 601 bp, Human; identical to SEQ ID NO: 152041

SEQ ID NO: 159347 - DNA, 601 bp, Human; identical to SEQ ID NO: 152042

SEQ ID NO: 159348 - DNA, 601 bp, Human; identical to SEQ ID NO: 152043

SEQ ID NO: 159349 - DNA, 601 bp, Human; identical to SEQ ID NO: 38520

SEQ ID NO: 159350 - DNA, 601 bp, Human; identical to SEQ ID NO: 38521

SEQ ID NO: 159351 - DNA, 601 bp, Human; identical to SEQ ID NO: 38522

SEQ ID NO: 159352 - DNA, 601 bp, Human; identical to SEQ ID NO: 38523

SEQ ID NO: 159353 - DNA, 601 bp, Human; identical to SEQ ID NO: 38524

SEQ ID NO: 159354 - DNA, 601 bp, Human; identical to SEQ ID NO: 38525

SEQ ID NO: 159355 - DNA, 601 bp, Human; identical to SEQ ID NO: 152050

SEQ ID NO: 159356 - DNA, 601 bp, Human; identical to SEQ ID NO: 152051

SEQ ID NO: 159357 - DNA, 601 bp, Human; identical to SEQ ID NO: 152052

SEQ ID NO: 159358 - DNA, 601 bp, Human; identical to SEQ ID NO: 152053

SEQ ID NO: 159359 - DNA, 601 bp, Human; identical to SEQ ID NO: 152054

SEQ ID NO: 159360 - DNA, 601 bp, Human; identical to SEQ ID NO: 152055

SEQ ID NO: 159361 - DNA, 601 bp, Human; identical to SEQ ID NO: 152056

SEQ ID NO: 159362 - DNA, 601 bp, Human; identical to SEQ ID NO: 152057

SEQ ID NO: 159363 - DNA, 601 bp, Human; identical to SEQ ID NO: 152058

SEQ ID NO: 159364 - DNA, 601 bp, Human; identical to SEQ ID NO: 152059

SEQ ID NO: 159365 - DNA, 601 bp, Human; identical to SEQ ID NO: 152060

SEQ ID NO: 159366 - DNA, 601 bp, Human; identical to SEQ ID NO: 152061

SEQ ID NO: 159367 - DNA, 601 bp, Human; identical to SEQ ID NO: 152062

SEQ ID NO: 159368 - DNA, 601 bp, Human; identical to SEQ ID NO: 152063

SEQ ID NO: 159369 - DNA, 601 bp, Human; identical to SEQ ID NO: 152064

SEQ ID NO: 159370 - DNA, 601 bp, Human; identical to SEQ ID NO: 152065

SEQ ID NO: 159371 - DNA, 601 bp, Human; identical to SEQ ID NO: 152066

SEQ ID NO: 159372 - DNA, 601 bp, Human; identical to SEQ ID NO: 152067

SEQ ID NO: 159373 - DNA, 601 bp, Human; identical to SEQ ID NO: 152068

SEQ ID NO: 159374 - DNA, 601 bp, Human; identical to SEQ ID NO: 152069

SEQ ID NO: 159375 - DNA, 601 bp, Human; identical to SEQ ID NO: 152070

SEQ ID NO: 159376 - DNA, 601 bp, Human; identical to SEQ ID NO: 152071

SEQ ID NO: 159377 - DNA, 601 bp, Human; identical to SEQ ID NO: 152072

SEQ ID NO: 159378 - DNA, 601 bp, Human; identical to SEQ ID NO: 152073

SEQ ID NO: 159379 - DNA, 601 bp, Human; identical to SEQ ID NO: 152074

SEQ ID NO: 159380 - DNA, 601 bp, Human; identical to SEQ ID NO: 152075

SEQ ID NO: 159381 - DNA, 601 bp, Human; identical to SEQ ID NO: 152076

SEQ ID NO: 159382 - DNA, 601 bp, Human; identical to SEQ ID NO: 152077

SEQ ID NO: 159383 - DNA, 601 bp, Human; identical to SEQ ID NO: 152078

SEQ ID NO: 159384 - DNA, 601 bp, Human; identical to SEQ ID NO: 152079

SEQ ID NO: 159385 - DNA, 601 bp, Human; identical to SEQ ID NO: 152080

SEQ ID NO: 159386 - DNA, 601 bp, Human; identical to SEQ ID NO: 152081

SEQ ID NO: 159387 - DNA, 601 bp, Human; identical to SEQ ID NO: 119373

SEQ ID NO: 159388 - DNA, 601 bp, Human; identical to SEQ ID NO: 152083

SEQ ID NO: 159389 - DNA, 601 bp, Human; identical to SEQ ID NO: 152084

SEQ ID NO: 159390 - DNA, 601 bp, Human; identical to SEQ ID NO: 152085

SEQ ID NO: 159391 - DNA, 601 bp, Human; identical to SEQ ID NO: 152086

SEQ ID NO: 159392 - DNA, 601 bp, Human; identical to SEQ ID NO: 152087

SEQ ID NO: 159393 - DNA, 601 bp, Human; identical to SEQ ID NO: 152088

SEQ ID NO: 159394 - DNA, 601 bp, Human; identical to SEQ ID NO: 152089

SEQ ID NO: 159395 - DNA, 601 bp, Human; identical to SEQ ID NO: 152090

SEQ ID NO: 159396 - DNA, 601 bp, Human; identical to SEQ ID NO: 152091

SEQ ID NO: 159397 - DNA, 601 bp, Human; identical to SEQ ID NO: 152092

SEQ ID NO: 159398 - DNA, 601 bp, Human; identical to SEQ ID NO: 152093

SEQ ID NO: 159399 - DNA, 601 bp, Human; identical to SEQ ID NO: 30766

SEQ ID NO: 159400 - DNA, 601 bp, Human; identical to SEQ ID NO: 30767

SEQ ID NO: 159401 - DNA, 601 bp, Human; identical to SEQ ID NO: 30768

SEQ ID NO: 159402 - DNA, 601 bp, Human; identical to SEQ ID NO: 30769

SEQ ID NO: 159403 - DNA, 601 bp, Human; identical to SEQ ID NO: 30770

SEQ ID NO: 159404 - DNA, 601 bp, Human; identical to SEQ ID NO: 30771

SEQ ID NO: 159405 - DNA, 601 bp, Human; identical to SEQ ID NO: 30772

SEQ ID NO: 159406 - DNA, 601 bp, Human; identical to SEQ ID NO: 30773

SEQ ID NO: 159407 - DNA, 601 bp, Human; identical to SEQ ID NO: 30774

SEQ ID NO: 159408 - DNA, 601 bp, Human; identical to SEQ ID NO: 152030

SEQ ID NO: 159409 - DNA, 601 bp, Human; identical to SEQ ID NO: 152031

SEQ ID NO: 159410 - DNA, 601 bp, Human; identical to SEQ ID NO: 152032

SEQ ID NO: 159411 - DNA, 601 bp, Human; identical to SEQ ID NO: 152033

SEQ ID NO: 159412 - DNA, 601 bp, Human; identical to SEQ ID NO: 152034

SEQ ID NO: 159413 - DNA, 601 bp, Human; identical to SEQ ID NO: 152035

SEQ ID NO: 159414 - DNA, 601 bp, Human; identical to SEQ ID NO: 152036

SEQ ID NO: 159415 - DNA, 601 bp, Human; identical to SEQ ID NO: 152037

SEQ ID NO: 159416 - DNA, 601 bp, Human; identical to SEQ ID NO: 152038

SEQ ID NO: 159417 - DNA, 601 bp, Human; identical to SEQ ID NO: 152039

SEQ ID NO: 159418 - DNA, 601 bp, Human; identical to SEQ ID NO: 152040

SEQ ID NO: 159419 - DNA, 601 bp, Human; identical to SEQ ID NO: 152041

SEQ ID NO: 159420 - DNA, 601 bp, Human; identical to SEQ ID NO: 152042

SEQ ID NO: 159421 - DNA, 601 bp, Human; identical to SEQ ID NO: 152043

SEQ ID NO: 159422 - DNA, 601 bp, Human; identical to SEQ ID NO: 38520

SEQ ID NO: 159423 - DNA, 601 bp, Human; identical to SEQ ID NO: 38521

SEQ ID NO: 159424 - DNA, 601 bp, Human; identical to SEQ ID NO: 38522

SEQ ID NO: 159425 - DNA, 601 bp, Human; identical to SEQ ID NO: 38523

SEQ ID NO: 159426 - DNA, 601 bp, Human; identical to SEQ ID NO: 38524

SEQ ID NO: 159427 - DNA, 601 bp, Human; identical to SEQ ID NO: 38525

SEQ ID NO: 159428 - DNA, 601 bp, Human; identical to SEQ ID NO: 152050

SEQ ID NO: 159429 - DNA, 601 bp, Human; identical to SEQ ID NO: 152051

SEQ ID NO: 159430 - DNA, 601 bp, Human; identical to SEQ ID NO: 152052

SEQ ID NO: 159431 - DNA, 601 bp, Human; identical to SEQ ID NO: 152053

SEQ ID NO: 159432 - DNA, 601 bp, Human; identical to SEQ ID NO: 152054

SEQ ID NO: 159433 - DNA, 601 bp, Human; identical to SEQ ID NO: 152055

SEQ ID NO: 159434 - DNA, 601 bp, Human; identical to SEQ ID NO: 152056

SEQ ID NO: 159435 - DNA, 601 bp, Human; identical to SEQ ID NO: 152057

SEQ ID NO: 159436 - DNA, 601 bp, Human; identical to SEQ ID NO: 152058

SEQ ID NO: 159437 - DNA, 601 bp, Human; identical to SEQ ID NO: 152059

SEQ ID NO: 159438 - DNA, 601 bp, Human; identical to SEQ ID NO: 152060

SEQ ID NO: 159439 - DNA, 601 bp, Human; identical to SEQ ID NO: 152061

SEQ ID NO: 159440 - DNA, 601 bp, Human; identical to SEQ ID NO: 152062

SEQ ID NO: 159441 - DNA, 601 bp, Human; identical to SEQ ID NO: 152063

SEQ ID NO: 159442 - DNA, 601 bp, Human; identical to SEQ ID NO: 152064

SEQ ID NO: 159443 - DNA, 601 bp, Human; identical to SEQ ID NO: 152065

SEQ ID NO: 159444 - DNA, 601 bp, Human; identical to SEQ ID NO: 152066

SEQ ID NO: 159445 - DNA, 601 bp, Human; identical to SEQ ID NO: 152067

SEQ ID NO: 159446 - DNA, 601 bp, Human; identical to SEQ ID NO: 152068

SEQ ID NO: 159447 - DNA, 601 bp, Human; identical to SEQ ID NO: 152069

SEQ ID NO: 159448 - DNA, 601 bp, Human; identical to SEQ ID NO: 152070

SEQ ID NO: 159449 - DNA, 601 bp, Human; identical to SEQ ID NO: 152071

SEQ ID NO: 159450 - DNA, 601 bp, Human; identical to SEQ ID NO: 152072

SEQ ID NO: 159451 - DNA, 601 bp, Human; identical to SEQ ID NO: 152073

SEQ ID NO: 159452 - DNA, 601 bp, Human; identical to SEQ ID NO: 152074

SEQ ID NO: 159453 - DNA, 601 bp, Human; identical to SEQ ID NO: 152075

SEQ ID NO: 159454 - DNA, 601 bp, Human; identical to SEQ ID NO: 152076

SEQ ID NO: 159455 - DNA, 601 bp, Human; identical to SEQ ID NO: 152077

SEQ ID NO: 159456 - DNA, 601 bp, Human; identical to SEQ ID NO: 152078

SEQ ID NO: 159457 - DNA, 601 bp, Human; identical to SEQ ID NO: 152079

SEQ ID NO: 159458 - DNA, 601 bp, Human; identical to SEQ ID NO: 152080

SEQ ID NO: 159459 - DNA, 601 bp, Human; identical to SEQ ID NO: 152081

SEQ ID NO: 159460 - DNA, 601 bp, Human; identical to SEQ ID NO: 119373

SEQ ID NO: 159461 - DNA, 601 bp, Human; identical to SEQ ID NO: 152083

SEQ ID NO: 159462 - DNA, 601 bp, Human; identical to SEQ ID NO: 152084

SEQ ID NO: 159463 - DNA, 601 bp, Human; identical to SEQ ID NO: 152085

SEQ ID NO: 159464 - DNA, 601 bp, Human; identical to SEQ ID NO: 152086

SEQ ID NO: 159465 - DNA, 601 bp, Human; identical to SEQ ID NO: 152087

SEQ ID NO: 159466 - DNA, 601 bp, Human; identical to SEQ ID NO: 152088

SEQ ID NO: 159467 - DNA, 601 bp, Human; identical to SEQ ID NO: 152089

SEQ ID NO: 159468 - DNA, 601 bp, Human; identical to SEQ ID NO: 152090

SEQ ID NO: 159469 - DNA, 601 bp, Human; identical to SEQ ID NO: 152091

SEQ ID NO: 159470 - DNA, 601 bp, Human; identical to SEQ ID NO: 152092

SEQ ID NO: 159471 - DNA, 601 bp, Human; identical to SEQ ID NO: 152093

SEQ ID NO: 159472 - DNA, 601 bp, Human; identical to SEQ ID NO: 30766

SEQ ID NO: 159473 - DNA, 601 bp, Human; identical to SEQ ID NO: 30767

SEQ ID NO: 159474 - DNA, 601 bp, Human; identical to SEQ ID NO: 30768

SEQ ID NO: 159475 - DNA, 601 bp, Human; identical to SEQ ID NO: 30769

SEQ ID NO: 159476 - DNA, 601 bp, Human; identical to SEQ ID NO: 30770

SEQ ID NO: 159477 - DNA, 601 bp, Human; identical to SEQ ID NO: 30771

SEQ ID NO: 159478 - DNA, 601 bp, Human; identical to SEQ ID NO: 30772

SEQ ID NO: 159479 - DNA, 601 bp, Human; identical to SEQ ID NO: 30773

SEQ ID NO: 159480 - DNA, 601 bp, Human; identical to SEQ ID NO: 30774

SEQ ID NO: 159481 - DNA, 601 bp, Human; identical to SEQ ID NO: 152030

SEQ ID NO: 159482 - DNA, 601 bp, Human; identical to SEQ ID NO: 152031

SEQ ID NO: 159483 - DNA, 601 bp, Human; identical to SEQ ID NO: 152032

SEQ ID NO: 159484 - DNA, 601 bp, Human; identical to SEQ ID NO: 152033

SEQ ID NO: 159485 - DNA, 601 bp, Human; identical to SEQ ID NO: 152034

SEQ ID NO: 159486 - DNA, 601 bp, Human; identical to SEQ ID NO: 152035

SEQ ID NO: 159487 - DNA, 601 bp, Human; identical to SEQ ID NO: 152036

SEQ ID NO: 159488 - DNA, 601 bp, Human; identical to SEQ ID NO: 152037

SEQ ID NO: 159489 - DNA, 601 bp, Human; identical to SEQ ID NO: 152038

SEQ ID NO: 159490 - DNA, 601 bp, Human; identical to SEQ ID NO: 152039

SEQ ID NO: 159491 - DNA, 601 bp, Human; identical to SEQ ID NO: 152040

SEQ ID NO: 159492 - DNA, 601 bp, Human; identical to SEQ ID NO: 152041

SEQ ID NO: 159493 - DNA, 601 bp, Human; identical to SEQ ID NO: 152042

SEQ ID NO: 159494 - DNA, 601 bp, Human; identical to SEQ ID NO: 152043

SEQ ID NO: 159495 - DNA, 601 bp, Human; identical to SEQ ID NO: 38520

SEQ ID NO: 159496 - DNA, 601 bp, Human; identical to SEQ ID NO: 38521

SEQ ID NO: 159497 - DNA, 601 bp, Human; identical to SEQ ID NO: 38522

SEQ ID NO: 159498 - DNA, 601 bp, Human; identical to SEQ ID NO: 38523

SEQ ID NO: 159499 - DNA, 601 bp, Human; identical to SEQ ID NO: 38524

SEQ ID NO: 159500 - DNA, 601 bp, Human; identical to SEQ ID NO: 38525

SEQ ID NO: 159501 - DNA, 601 bp, Human; identical to SEQ ID NO: 152050

SEQ ID NO: 159502 - DNA, 601 bp, Human; identical to SEQ ID NO: 152051

SEQ ID NO: 159503 - DNA, 601 bp, Human; identical to SEQ ID NO: 152052

SEQ ID NO: 159504 - DNA, 601 bp, Human; identical to SEQ ID NO: 152053

SEQ ID NO: 159505 - DNA, 601 bp, Human; identical to SEQ ID NO: 152054

SEQ ID NO: 159506 - DNA, 601 bp, Human; identical to SEQ ID NO: 152055

SEQ ID NO: 159507 - DNA, 601 bp, Human; identical to SEQ ID NO: 152056

SEQ ID NO: 159508 - DNA, 601 bp, Human; identical to SEQ ID NO: 152057

SEQ ID NO: 159509 - DNA, 601 bp, Human; identical to SEQ ID NO: 152058

SEQ ID NO: 159510 - DNA, 601 bp, Human; identical to SEQ ID NO: 152059

SEQ ID NO: 159511 - DNA, 601 bp, Human; identical to SEQ ID NO: 152060

SEQ ID NO: 159512 - DNA, 601 bp, Human; identical to SEQ ID NO: 152061

SEQ ID NO: 159513 - DNA, 601 bp, Human; identical to SEQ ID NO: 152062

SEQ ID NO: 159514 - DNA, 601 bp, Human; identical to SEQ ID NO: 152063

SEQ ID NO: 159515 - DNA, 601 bp, Human; identical to SEQ ID NO: 152064

SEQ ID NO: 159516 - DNA, 601 bp, Human; identical to SEQ ID NO: 152065

SEQ ID NO: 159517 - DNA, 601 bp, Human; identical to SEQ ID NO: 152066

SEQ ID NO: 159518 - DNA, 601 bp, Human; identical to SEQ ID NO: 152067

SEQ ID NO: 159519 - DNA, 601 bp, Human; identical to SEQ ID NO: 152068

SEQ ID NO: 159520 - DNA, 601 bp, Human; identical to SEQ ID NO: 152069

SEQ ID NO: 159521 - DNA, 601 bp, Human; identical to SEQ ID NO: 152070

SEQ ID NO: 159522 - DNA, 601 bp, Human; identical to SEQ ID NO: 152071

SEQ ID NO: 159523 - DNA, 601 bp, Human; identical to SEQ ID NO: 152072

SEQ ID NO: 159524 - DNA, 601 bp, Human; identical to SEQ ID NO: 152073

SEQ ID NO: 159525 - DNA, 601 bp, Human; identical to SEQ ID NO: 152074

SEQ ID NO: 159526 - DNA, 601 bp, Human; identical to SEQ ID NO: 152075

SEQ ID NO: 159527 - DNA, 601 bp, Human; identical to SEQ ID NO: 152076

SEQ ID NO: 159528 - DNA, 601 bp, Human; identical to SEQ ID NO: 152077

SEQ ID NO: 159529 - DNA, 601 bp, Human; identical to SEQ ID NO: 152078

SEQ ID NO: 159530 - DNA, 601 bp, Human; identical to SEQ ID NO: 152079

SEQ ID NO: 159531 - DNA, 601 bp, Human; identical to SEQ ID NO: 152080

SEQ ID NO: 159532 - DNA, 601 bp, Human; identical to SEQ ID NO: 152081

SEQ ID NO: 159533 - DNA, 601 bp, Human; identical to SEQ ID NO: 119373

SEQ ID NO: 159534 - DNA, 601 bp, Human; identical to SEQ ID NO: 152083

SEQ ID NO: 159535 - DNA, 601 bp, Human; identical to SEQ ID NO: 152084

SEQ ID NO: 159536 - DNA, 601 bp, Human; identical to SEQ ID NO: 152085

SEQ ID NO: 159537 - DNA, 601 bp, Human; identical to SEQ ID NO: 152086

SEQ ID NO: 159538 - DNA, 601 bp, Human; identical to SEQ ID NO: 152087

SEQ ID NO: 159539 - DNA, 601 bp, Human; identical to SEQ ID NO: 152088

SEQ ID NO: 159540 - DNA, 601 bp, Human; identical to SEQ ID NO: 152089

SEQ ID NO: 159541 - DNA, 601 bp, Human; identical to SEQ ID NO: 152090

SEQ ID NO: 159542 - DNA, 601 bp, Human; identical to SEQ ID NO: 152091

SEQ ID NO: 159543 - DNA, 601 bp, Human; identical to SEQ ID NO: 152092

SEQ ID NO: 159544 - DNA, 601 bp, Human; identical to SEQ ID NO: 152093

SEQ ID NO: 159545 - DNA, 601 bp, Human; identical to SEQ ID NO: 30766

SEQ ID NO: 159546 - DNA, 601 bp, Human; identical to SEQ ID NO: 30767

SEQ ID NO: 159547 - DNA, 601 bp, Human; identical to SEQ ID NO: 30768

SEQ ID NO: 159548 - DNA, 601 bp, Human; identical to SEQ ID NO: 30769

SEQ ID NO: 159549 - DNA, 601 bp, Human; identical to SEQ ID NO: 30770

SEQ ID NO: 159550 - DNA, 601 bp, Human; identical to SEQ ID NO: 30771

SEQ ID NO: 159551 - DNA, 601 bp, Human; identical to SEQ ID NO: 30772

SEQ ID NO: 159552 - DNA, 601 bp, Human; identical to SEQ ID NO: 30773

SEQ ID NO: 159553 - DNA, 601 bp, Human; identical to SEQ ID NO: 30774

SEQ ID NO: 159554 - DNA, 601 bp, Human; identical to SEQ ID NO: 152030

SEQ ID NO: 159555 - DNA, 601 bp, Human; identical to SEQ ID NO: 152031

SEQ ID NO: 159556 - DNA, 601 bp, Human; identical to SEQ ID NO: 152032

SEQ ID NO: 159557 - DNA, 601 bp, Human; identical to SEQ ID NO: 152033

SEQ ID NO: 159558 - DNA, 601 bp, Human; identical to SEQ ID NO: 152034

SEQ ID NO: 159559 - DNA, 601 bp, Human; identical to SEQ ID NO: 152035

SEQ ID NO: 159560 - DNA, 601 bp, Human; identical to SEQ ID NO: 152036

SEQ ID NO: 159561 - DNA, 601 bp, Human; identical to SEQ ID NO: 152037

SEQ ID NO: 159562 - DNA, 601 bp, Human; identical to SEQ ID NO: 152038

SEQ ID NO: 159563 - DNA, 601 bp, Human; identical to SEQ ID NO: 152039

SEQ ID NO: 159564 - DNA, 601 bp, Human; identical to SEQ ID NO: 152040

SEQ ID NO: 159565 - DNA, 601 bp, Human; identical to SEQ ID NO: 152041

SEQ ID NO: 159566 - DNA, 601 bp, Human; identical to SEQ ID NO: 152042

SEQ ID NO: 159567 - DNA, 601 bp, Human; identical to SEQ ID NO: 152043

SEQ ID NO: 159568 - DNA, 601 bp, Human; identical to SEQ ID NO: 38520

SEQ ID NO: 159569 - DNA, 601 bp, Human; identical to SEQ ID NO: 38521

SEQ ID NO: 159570 - DNA, 601 bp, Human; identical to SEQ ID NO: 38522

SEQ ID NO: 159571 - DNA, 601 bp, Human; identical to SEQ ID NO: 38523

SEQ ID NO: 159572 - DNA, 601 bp, Human; identical to SEQ ID NO: 38524

SEQ ID NO: 159573 - DNA, 601 bp, Human; identical to SEQ ID NO: 38525

SEQ ID NO: 159574 - DNA, 601 bp, Human; identical to SEQ ID NO: 152050

SEQ ID NO: 159575 - DNA, 601 bp, Human; identical to SEQ ID NO: 152051

SEQ ID NO: 159576 - DNA, 601 bp, Human; identical to SEQ ID NO: 152052

SEQ ID NO: 159577 - DNA, 601 bp, Human; identical to SEQ ID NO: 152053

SEQ ID NO: 159578 - DNA, 601 bp, Human; identical to SEQ ID NO: 152054

SEQ ID NO: 159579 - DNA, 601 bp, Human; identical to SEQ ID NO: 152055

SEQ ID NO: 159580 - DNA, 601 bp, Human; identical to SEQ ID NO: 152056

SEQ ID NO: 159581 - DNA, 601 bp, Human; identical to SEQ ID NO: 152057

SEQ ID NO: 159582 - DNA, 601 bp, Human; identical to SEQ ID NO: 152058

SEQ ID NO: 159583 - DNA, 601 bp, Human; identical to SEQ ID NO: 152059

SEQ ID NO: 159584 - DNA, 601 bp, Human; identical to SEQ ID NO: 152060

SEQ ID NO: 159585 - DNA, 601 bp, Human; identical to SEQ ID NO: 152061

SEQ ID NO: 159586 - DNA, 601 bp, Human; identical to SEQ ID NO: 152062

SEQ ID NO: 159587 - DNA, 601 bp, Human; identical to SEQ ID NO: 152063

SEQ ID NO: 159588 - DNA, 601 bp, Human; identical to SEQ ID NO: 152064

SEQ ID NO: 159589 - DNA, 601 bp, Human; identical to SEQ ID NO: 152065

SEQ ID NO: 159590 - DNA, 601 bp, Human; identical to SEQ ID NO: 152066

SEQ ID NO: 159591 - DNA, 601 bp, Human; identical to SEQ ID NO: 152067

SEQ ID NO: 159592 - DNA, 601 bp, Human; identical to SEQ ID NO: 152068

SEQ ID NO: 159593 - DNA, 601 bp, Human; identical to SEQ ID NO: 152069

SEQ ID NO: 159594 - DNA, 601 bp, Human; identical to SEQ ID NO: 152070

SEQ ID NO: 159595 - DNA, 601 bp, Human; identical to SEQ ID NO: 152071

SEQ ID NO: 159596 - DNA, 601 bp, Human; identical to SEQ ID NO: 152072

SEQ ID NO: 159597 - DNA, 601 bp, Human; identical to SEQ ID NO: 152073

SEQ ID NO: 159598 - DNA, 601 bp, Human; identical to SEQ ID NO: 152074

SEQ ID NO: 159599 - DNA, 601 bp, Human; identical to SEQ ID NO: 152075

SEQ ID NO: 159600 - DNA, 601 bp, Human; identical to SEQ ID NO: 152076

SEQ ID NO: 159601 - DNA, 601 bp, Human; identical to SEQ ID NO: 152077

SEQ ID NO: 159602 - DNA, 601 bp, Human; identical to SEQ ID NO: 152078

SEQ ID NO: 159603 - DNA, 601 bp, Human; identical to SEQ ID NO: 152079

SEQ ID NO: 159604 - DNA, 601 bp, Human; identical to SEQ ID NO: 152080

SEQ ID NO: 159605 - DNA, 601 bp, Human; identical to SEQ ID NO: 152081

SEQ ID NO: 159606 - DNA, 601 bp, Human; identical to SEQ ID NO: 119373

SEQ ID NO: 159607 - DNA, 601 bp, Human; identical to SEQ ID NO: 152083

SEQ ID NO: 159608 - DNA, 601 bp, Human; identical to SEQ ID NO: 152084

SEQ ID NO: 159609 - DNA, 601 bp, Human; identical to SEQ ID NO: 152085

SEQ ID NO: 159610 - DNA, 601 bp, Human; identical to SEQ ID NO: 152086

SEQ ID NO: 159611 - DNA, 601 bp, Human; identical to SEQ ID NO: 152087

SEQ ID NO: 159612 - DNA, 601 bp, Human; identical to SEQ ID NO: 152088

SEQ ID NO: 159613 - DNA, 601 bp, Human; identical to SEQ ID NO: 152089

SEQ ID NO: 159614 - DNA, 601 bp, Human; identical to SEQ ID NO: 152090

SEQ ID NO: 159615 - DNA, 601 bp, Human; identical to SEQ ID NO: 152091

SEQ ID NO: 159616 - DNA, 601 bp, Human; identical to SEQ ID NO: 152092

SEQ ID NO: 159617 - DNA, 601 bp, Human; identical to SEQ ID NO: 152093

SEQ ID NO: 159618 - DNA, 601 bp, Human; identical to SEQ ID NO: 30766

SEQ ID NO: 159619 - DNA, 601 bp, Human; identical to SEQ ID NO: 30767

SEQ ID NO: 159620 - DNA, 601 bp, Human; identical to SEQ ID NO: 30768

SEQ ID NO: 159621 - DNA, 601 bp, Human; identical to SEQ ID NO: 30769

SEQ ID NO: 159622 - DNA, 601 bp, Human; identical to SEQ ID NO: 30770

SEQ ID NO: 159623 - DNA, 601 bp, Human; identical to SEQ ID NO: 30771

SEQ ID NO: 159624 - DNA, 601 bp, Human; identical to SEQ ID NO: 30772

SEQ ID NO: 159625 - DNA, 601 bp, Human; identical to SEQ ID NO: 30773

SEQ ID NO: 159626 - DNA, 601 bp, Human; identical to SEQ ID NO: 30774

SEQ ID NO: 159627 - DNA, 601 bp, Human
caggtgcggtggctcacgcctgtaatcccagcactttaggaggctgaggcaggcagatcacgaggtcaggagatcgaaaccatcctggctaacacggtgaaaccccgcctctactaaaaataacaaaaaaaattagctgggcgctgtggcgggcacctgtagtcccacctactcgggaggctgaggcaggagaatggcgtgaacccaggaggtggagcttgcagtgagctgagattgcgccactgcactccagcctgggcgacaaaacaagactctgtctcaaaaaaaaaaaaaaaaaaaaggctgaaacgagccagtgtataaggagcagctatgtggtattttagagattaccatgtatagattgttgttaattgtgataagaggaactgtaaatgacggctcaaagttgaaatgcttggatgatagagagcatttacaggaaacagcttctgtgatatgattccaccagctgtagcatattaggggagaggatcagggctgcagggactgtatagtgtagatgttagctaggagtgtattctttgggaccctagacttctgtgttcaaacctcctgccttccacttgctacgtttgtg

SEQ ID NO: 159628 - DNA, 601 bp, Human
tgtaatcccagcactttaggaggctgaggcaggcagatcacgaggtcaggagatcgaaaccatcctggctaacacggtgaaaccccgcctctactaaaaataacaaaaaaaattagctgggcgctgtggcgggcacctgtagtcccacctactcgggaggctgaggcaggagaatggcgtgaacccaggaggtggagcttgcagtgagctgagattgcgccactgcactccagcctgggcgacaaaacaagactctgtctcaaaaaaaaaaaaaaaaaaaaggctgaaacgagccagtgtrtaaggagcagctatgtggtattttagagattaccatgtatagattgttgttaattgtgataagaggaactgtaaatgacggctcaaagttgaaatgcttggatgatagagagcatttacaggaaacagcttctgtgatatgattccaccagctgtagcatattaggggagaggatcagggctgcagggactgtatagtgtagatgttagctaggagtgtattctttgggaccctagacttctgtgttcaaacctcctgccttccacttgctacgtttgtgatcttggacaagttacttcc

SEQ ID NO: 159629 - DNA, 601 bp, Human
gcttctgtgatatgattccaccagctgtagcatattaggggagaggatcagggctgcagggactgtatagtgtagatgttagctaggagtgtattctttgggaccctagacttctgtgttcaaacctcctgccttccacttgctacgtttgtgatcttggacaagttacttccttataggattattgtaaagattaagttaattgacatgtgcaaaaaacttggcatgtagtaggtgctcagtaaatgcttgctattacttttttattattattattttaagctgtgacaaaccacagcarctgtaattactctggtttgatgttcttaaccttagttcctcgttcaggaatgacttactgctctatttggtttgtagatgcagtaaataagaatgtaattacgtgattgaaaggctgtgttggagtattaacttcctaaactcaatgaagacaggggttgtcctttgtaaaaattgtgataatcatgatggagcagatttggagtaatctcaatgattcgtccgcactatacaccaaaagcataaatagggactgcccaagtaggggatagtgcccttccaacctttatctggagaaatc

SEQ ID NO: 159630 - DNA, 601 bp, Human
taggagtgtattctttgggaccctagacttctgtgttcaaacctcctgccttccacttgctacgtttgtgatcttggacaagttacttccttataggattattgtaaagattaagttaattgacatgtgcaaaaaacttggcatgtagtaggtgctcagtaaatgcttgctattacttttttattattattattttaagctgtgacaaaccacagcagctgtaattactctggtttgatgttcttaaccttagttcctcgttcaggaatgacttactgctctatttggtttgtagatgcartaaataagaatgtaattacgtgattgaaaggctgtgttggagtattaacttcctaaactcaatgaagacaggggttgtcctttgtaaaaattgtgataatcatgatggagcagatttggagtaatctcaatgattcgtccgcactatacaccaaaagcataaatagggactgcccaagtaggggatagtgcccttccaacctttatctggagaaatcaagacagcctgtgagagtattcatcgccccaaggatactgttgctctttaccttgttatgaaactttgatatatattaataat

SEQ ID NO: 159631 - DNA, 601 bp, Human
catgtagtaggtgctcagtaaatgcttgctattacttttttattattattattttaagctgtgacaaaccacagcagctgtaattactctggtttgatgttcttaaccttagttcctcgttcaggaatgacttactgctctatttggtttgtagatgcagtaaataagaatgtaattacgtgattgaaaggctgtgttggagtattaacttcctaaactcaatgaagacaggggttgtcctttgtaaaaattgtgataatcatgatggagcagatttggagtaatctcaatgattcgtccrcactatacaccaaaagcataaatagggactgcccaagtaggggatagtgcccttccaacctttatctggagaaatcaagacagcctgtgagagtattcatcgccccaaggatactgttgctctttaccttgttatgaaactttgatatatattaataatcttcaacctttcagccctctgttggagaatataattacattcttaaacctcccttttataattgtcttatttaagactcatcttctcccatcatgtatctttaagttatgtttctgctcttaaactatatgaagtttggag

SEQ ID NO: 159632 - DNA, 601 bp, Human
aacctctccatccctggctcaggtgatcctcccatttcagcctcccaagtagctaggactacaggggcgtaccacccacctggctaatttttctgtttttagtagagacggggtttttctgttgtctgggctggagttaatcagtttttctaattgatgatatctcttcatcagcagtaaactccctcttattaattctggagttgtgacctgttattaattctggattgtgattcatttctttgggtacagcaggcaatgggagaccaaggctaaggaagagagcaacttgcccatccayatccacacagctgggtggggaaacgtagctgcagcacatgatgtagcttcacatagatcataacatccattcttagatttgctcctctgtttaatatacgagatttaggatgtggatgggtcattggtgaccttagcttgagcttttttgatgctgtgatggaggtgaaagccagactggcatgggttgaggcgtgggaggtgaggaaacagatggtgagcatagtcagctctcccaaagtttggttgtgttgtaaagaggaagaaggagtggctcctgggagttgtttgtttatttaaa

SEQ ID NO: 159633 - DNA, 601 bp, Human
gtgattcatttctttgggtacagcaggcaatgggagaccaaggctaaggaagagagcaacttgcccatccacatccacacagctgggtggggaaacgtagctgcagcacatgatgtagcttcacatagatcataacatccattcttagatttgctcctctgtttaatatacgagatttaggatgtggatgggtcattggtgaccttagcttgagcttttttgatgctgtgatggaggtgaaagccagactggcatgggttgaggcgtgggaggtgaggaaacagatggtgagcatagtcarctctcccaaagtttggttgtgttgtaaagaggaagaaggagtggctcctgggagttgtttgtttatttaaaggtagaaaagattttaactttaaatattgttaagggatccagttaaggaagtatattcctaaatcttagttgtatatgaatgtgtgtaagacatacaaatgggcatttatcatatggacatctgtgtgtccatatgatacataaattgctttttcttccatatgatccttttattctaattttgatgtgttcagaaaaaccattctcatcatgaggattactgtgaaac

SEQ ID NO: 159634 - DNA, 601 bp, Human
tgggagaccaaggctaaggaagagagcaacttgcccatccacatccacacagctgggtggggaaacgtagctgcagcacatgatgtagcttcacatagatcataacatccattcttagatttgctcctctgtttaatatacgagatttaggatgtggatgggtcattggtgaccttagcttgagcttttttgatgctgtgatggaggtgaaagccagactggcatgggttgaggcgtgggaggtgaggaaacagatggtgagcatagtcagctctcccaaagtttggttgtgttgtaaagmggaagaaggagtggctcctgggagttgtttgtttatttaaaggtagaaaagattttaactttaaatattgttaagggatccagttaaggaagtatattcctaaatcttagttgtatatgaatgtgtgtaagacatacaaatgggcatttatcatatggacatctgtgtgtccatatgatacataaattgctttttcttccatatgatccttttattctaattttgatgtgttcagaaaaaccattctcatcatgaggattactgtgaaacttgaaaaatataaaaaacatctctaaattg

SEQ ID NO: 159635 - DNA, 601 bp, Human
ccctcgtgacctaatcacttcttaaaggctccactcttacaccatcacagtggcaattaatttgcagcagagttttggtagggacattcaaaccatcgcaggcagttaccattgttcaggtgagagatattggtggcctggactagtggtgacagtagaaatagagcaaagaaaatgaatttccaacctggttagaagatgaagccaacaaaaccttgtgatggagcgagtaagagcatgggaaagaggattgataagcttgactctccgatttctgactcacccagctgggtggatggtscctattttttaagatgggaatgtgggaagaggactacatggagtggtggagggaggaagttgatctgagttgggacttggatgtgtggagtttggtctgcctttgagcattcagttggacatgtgaaatgggaagtggccagttgtatgagcctgatgttcataagagaggtctgggcttaagataggaatttgggagtcagcagagtctaggtgggaatgggaagcctggtgagacggtatacagagggagaggcaggaggcctgggcctgagaaccctccaggccttttctggctggg

SEQ ID NO: 159636 - DNA, 601 bp, Human
gggtcaggttgtaggtttgctaacagcaagctgagggagtctccttgtgcccacttctaatttctgagtgaagtaggaggccactccattggttgtgagtaaagaggacggcagcagaacagcgatgattgggaggggagagttgggccattgagggtggagaaatgtgcagtagccatcgtggagagtgagaggtgaccaaattactgggcagcatttcaggtttcattcgtggtgggtaattggggctctgtaggcctgccaacctgccctgttgtcagaggtctgcttaggcggagayaggtgaaaaggggacgctagtacaatctaagtttgggattttgccagaagttaagactaaaggtcagagagagtccaggctattgattgcgtgtcatctgataatagtcctgctgatgggatctaccctggaaaatgaggaaaaaggaaagccgagaggttggccatctcaaggtttgacaggacaaagacaggttctactgggagcaattgagagggtcagctggaaggagagaagaggaaggagctggaagttccccagttccatatagggacaagagtcagtgtgaccagcctcacc

SEQ ID NO: 159637 - DNA, 601 bp, Human
ccccaccctgctccagtctccctcatttccagcctggaaattgttgctaattgccccattggcagttgggaaggcaacgcctgttaagatgtggagcaataaagtggagcaggtatgctgtgccgtatgcccctcttcctgcaccgtcctccttctgtcatcgttgagtggctcaggagtgctggccctctaacagactgcctgggcgtggatcctgactgcagagtagcacttctggctgtgacgtgggcagatggcttaacctccctgtgctcagattcctcacctgtaaaacagttaatggatgattagagtgttcctgcctccctgggttgtggtgaggactgaatgagcacctgccactaggaggcaatcagtgagtcagctatcatcattattattattagggttccactcattctccttttcccttggcattgcttgatcccacggagatcccactagagattttgctttaatactgacttgttttaaaataagagcaagagaactgacatttattgaccacctgctgtgtgccagctgccgccttagtcaccaccaagacctctctcatggcggtgtcaagagaattatctgc

SEQ ID NO: 159638 - DNA, 601 bp, Human
tgatgttttgtcctcatagcactgatcacagtccttaaaagccacttttagcccctgcagctacttttctgcagccactgaagcactttctcctcggctcttctccatcccttaaagcaaaattggcaaaccggtagcctcagggctaggcagcttgcaaaccagtcttatttaagccataatattttttaaatatatttttattgatacatatagctgtacatatttttgaggtgcattgataattggatgctttcatatagtcaaatcagggtagctgggatatccatcactttaaatrtttattttttctttatattaggaacatttgaattattctttcctagctattttgaaatgtacagttggttaatgttaactgtagtcatcctactgatctaacgaacaccagatcttattttttctatttaacataattttaaaacaattgaaggtgtttgaattacaatcagaggtttcacttaaaatctggatttcgacctctggaaaaatcagaacaactagcacctgtgagctgagggactctaaagattccagtcagctggagctgaggagctgccgcaccccttcctgtactggg

SEQ ID NO: 159639 - DNA, 601 bp, Human
cttgcaaaccagtcttatttaagccataatattttttaaatatatttttattgatacatatagctgtacatatttttgaggtgcattgataattggatgctttcatatagtcaaatcagggtagctgggatatccatcactttaaatatttattttttctttatattaggaacatttgaattattctttcctagctattttgaaatgtacagttggttaatgttaactgtagtcatcctactgatctaacgaacaccagatcttattttttctatttaacataattttaaaacaattgaacgtgtttgaattacaatcagaggtttcacttaaaatctggatttcgacctctggaaaaatcagaacaactagcacctgtgagctgagggactctaaagattccagtcagctggagctgaggagctgccgcaccccttcctgtactgggtggagagggggtcctgtcattctttgatcttacacccaccgtgttttttcttgacatttcccgtctggcctccatgggcctttgtagttggtgtaacttttgtgtttggtttgttttatgggttttttttgtttgttttttttttttttgaga

SEQ ID NO: 159640 - DNA, 601 bp, Human
gtgtttgaattacaatcagaggtttcacttaaaatctggatttcgacctctggaaaaatcagaacaactagcacctgtgagctgagggactctaaagattccagtcagctggagctgaggagctgccgcaccccttcctgtactgggtggagagggggtcctgtcattctttgatcttacacccaccgtgttttttcttgacatttcccgtctggcctccatgggcctttgtagttggtgtaacttttgtgtttggtttgttttatgggttttttttgtttgttttttttttttttgagamagtctcactatgtcacccaggctgaagtgcagtggcaccatctcggctcactgcaattactgcttcccgggttcaagcgattctcctgcctcagcctcctgagtagctggggttacaggtgtgtggtaccacgccctgctaattttcatatttttagtagagatggggtttcaccatgttggtcaggctggtctcaaactcctgacctcgtgatctgcctgcctcggcctcccaaaatgctgggattacaggcatgagccaccgcgcctggcctatagtggcatttcaaaacagattgtt

SEQ ID NO: 159641 - DNA, 601 bp, Human
agcacctgtgagctgagggactctaaagattccagtcagctggagctgaggagctgccgcaccccttcctgtactgggtggagagggggtcctgtcattctttgatcttacacccaccgtgttttttcttgacatttcccgtctggcctccatgggcctttgtagttggtgtaacttttgtgtttggtttgttttatgggttttttttgtttgttttttttttttttgagaaagtctcactatgtcacccaggctgaagtgcagtggcaccatctcggctcactgcaattactgcttcccrggttcaagcgattctcctgcctcagcctcctgagtagctggggttacaggtgtgtggtaccacgccctgctaattttcatatttttagtagagatggggtttcaccatgttggtcaggctggtctcaaactcctgacctcgtgatctgcctgcctcggcctcccaaaatgctgggattacaggcatgagccaccgcgcctggcctatagtggcatttcaaaacagattgttttagagctcacagcccagcaccaatgctagcgaagacctcattgctttagataggtttaggacttaaac

SEQ ID NO: 159642 - DNA, 601 bp, Human
taacttttgtgtttggtttgttttatgggttttttttgtttgttttttttttttttgagaaagtctcactatgtcacccaggctgaagtgcagtggcaccatctcggctcactgcaattactgcttcccgggttcaagcgattctcctgcctcagcctcctgagtagctggggttacaggtgtgtggtaccacgccctgctaattttcatatttttagtagagatggggtttcaccatgttggtcaggctggtctcaaactcctgacctcgtgatctgcctgcctcggcctcccaaaatgytgggattacaggcatgagccaccgcgcctggcctatagtggcatttcaaaacagattgttttagagctcacagcccagcaccaatgctagcgaagacctcattgctttagataggtttaggacttaaacttgactctaacaaggtaatggtgattggaaggaaaacctacatttgagtttgggcagcagcacccctctggcatgtcacagtgacatatcttgtcacccaagcagagccttggcattatagatacaggtttctaaaagctgatagcttggctgccagcctcatgggctgga

SEQ ID NO: 159643 - DNA, 601 bp, Human
ctggggttacaggtgtgtggtaccacgccctgctaattttcatatttttagtagagatggggtttcaccatgttggtcaggctggtctcaaactcctgacctcgtgatctgcctgcctcggcctcccaaaatgctgggattacaggcatgagccaccgcgcctggcctatagtggcatttcaaaacagattgttttagagctcacagcccagcaccaatgctagcgaagacctcattgctttagataggtttaggacttaaacttgactctaacaaggtaatggtgattggaaggaaaacytacatttgagtttgggcagcagcacccctctggcatgtcacagtgacatatcttgtcacccaagcagagccttggcattatagatacaggtttctaaaagctgatagcttggctgccagcctcatgggctggatcacccacaacttcatgggcctcttctagtggaagctggagcatttccttggtgaattcttttccctgaggggcaagatccatgccacacagctctctgaccctgtgtgtcacaacccttatggtccatgagcaaaatggttgctagtagtcatttgggcatttctc

SEQ ID NO: 159644 - DNA, 601 bp, Human
agctgcaaataatgaagactgactgtatttagagtcacaagtaactttgttataaattaccttttactgaagaagaagcaagagtagagaagttaaggtgacttgtccagtaatatacaggtagtacgagaaacaggactataacttgggtttcttaattcctggcccaccattcttgtacttttgctcaggacctactccttaggtttctgattaccccaaagaacatttattctcttttttgtttattttgagtcagggtctcactctgttgcccaggctgtagtgcagtgccttgatmatagctcactagagcctctaactcctgggctcaaacagtcctcctgcctcagcctcccaagtagttgggattataggcatgagccaccacacctggctcaaagaacatttattcttgacctcagtgggcagtccacatcaatgaataaagtttaataaaatttaaaaatatgttgaagtgatccacagcttgccaatactttctagaacaggaatggtgaccagattctgtattctgattgctgtgtagaagaggtgtctgaagaggtgtacagctttctcgagaaagagtactgtgatt

SEQ ID NO: 159645 - DNA, 601 bp, Human
atttagagtcacaagtaactttgttataaattaccttttactgaagaagaagcaagagtagagaagttaaggtgacttgtccagtaatatacaggtagtacgagaaacaggactataacttgggtttcttaattcctggcccaccattcttgtacttttgctcaggacctactccttaggtttctgattaccccaaagaacatttattctcttttttgtttattttgagtcagggtctcactctgttgcccaggctgtagtgcagtgccttgataatagctcactagagcctctaactccygggctcaaacagtcctcctgcctcagcctcccaagtagttgggattataggcatgagccaccacacctggctcaaagaacatttattcttgacctcagtgggcagtccacatcaatgaataaagtttaataaaatttaaaaatatgttgaagtgatccacagcttgccaatactttctagaacaggaatggtgaccagattctgtattctgattgctgtgtagaagaggtgtctgaagaggtgtacagctttctcgagaaagagtactgtgattgattggttttatctaccaaggcacag

SEQ ID NO: 159646 - DNA, 601 bp, Human
attttagttgttctctccgcatgttaaggttttcttttgaagggagtgctgataatgtaattgacgttctaagaacagtggctgacatgcattgagctcttagcctgtagtgggccctgtgtgcttcattcaccgtaccgtgtgtagtcccctcgacagccctctgaggtacttactcttgtcctcattttagaatcaaggaaaccaaggcttagggaatgaagtgaccagcctagtccaaggtaggctgcagtgcagtggcgcgatcgtggctcactgcaaagtcaagtgattctccccrggctcaagtgattctcccacctcagcctctcaagtagctgggaccacaggcttgcacaaccacacccagataattttatttttatattttttgtagagacagggtttcaccaagttgcccaggctggtctagaactcctaagctcaagtgatcctcccgcctaggcctcccaaagtttggggattacaaacatgagccactgcacccagtgggtttctaggacttcttgactctgtgtctgtgttcttaaccaggggtcatcagctttggcccatgagccaaatctggcctactgtctgc

SEQ ID NO: 159647 - DNA, 601 bp, Human
ccctgttcgatttctgctgccaggaatggtttggcacagatagtaccatctgcttgtctgagaacaggatcaggacaggtgtagccaaggatccaaatattaagtcctgaaagtattaacattatgaggggagggctccatgctagataaacctttcttaaagctcccttgaaaacccactagggaattgggaaactgaccacatcgaaacgtatattttctgattaatctgggtgagatcacgttggagtgttatatgtcatgagataattgtctgtattattcattttaggtttttcartcagtatgaaaattcagaagtttggccttttttttttttttttttttttttgagacatagtcttgctctgtcgcctaggctggagtgcagtggtgcaatctcggctcgctgcaaactccacctcacaggttcaagcagttcttgttcctcatcctcccgagtagctgggactacaggtgtgtgccaccactcctggactatttttatatttttaatagagatggggttttaccatgttggccaggctggtcttgaactcgtgacctcaagtgagccaccctgcctggctggaagtttggc

SEQ ID NO: 159648 - DNA, 601 bp, Human
ccgcatggaaaaccaagtggtgagtgacagcacttacgtgctaggggcaagacatcattgctctctgaactctatcatgtgtgaccttggtgcctgtgaagaatcactagcattttaaagctaccccttcttcctgtggattctctgtactgtgcttttgttcttgctttaaaaatcagagaaactaaagggttttgaaatttgtgttcagaatttgtttggagactgtcaaaggaatttatttccttttaaatatgttatccttttggctggaatttttctttctttctttctttctttytttttttttcttttttctttttttttggagagagggtcttgttctgttatccaagctggagcgcagtgacaggatcatggctcactgcaggcttgaccttcccagctcaagcaatcttcccacctcaacctcccaagtagctgggactacaggcatgtgccaccacacccagctaatttttttattttctatagagacagagtttcaccatgttgcccaggttggtctcgaactcctgggttcaagaattcctgctgcctcagccttccaaagtgctgaaattataggcgttaaccaccg

SEQ ID NO: 159649 - DNA, 601 bp, Human
gtattcatttactcaaggaaagcacaaaagaaaaaattgccaccaagaatggtgttgtgtctcagggtgagcacggagttgccttctacttacttctgctgtcgagagtcctaaggaaggtgctcagaatcccccggcccaccctctgtgtctgttatcatctttgcctttgtaactctctagggaaaggaccaggtttttactgtaacccttattaagctgtgatcagtcaataaatattaatatttaaatacactgtaataagcatagctgtgcagatataaaaccaagtctctctgasctgcataaaagtgcttccactttagcccattttctgtacagcagccaaagtgatctcttaaaagcgtgaattagagcatgacccctgctcaaacccctttggtaattccccatcctgtgccattctgactgaaatccatgccctgtcctcatagcttatacctctctttctcttttttgctacacagtgcacaggtgccctttctggttattgaacggctgtgcttgtttctccctcagtgcctttgcacttactgtcccttccctgcctctgaaccccttgtatcttcaggtctctcag

SEQ ID NO: 159650 - DNA, 601 bp, Human
tccactttagcccattttctgtacagcagccaaagtgatctcttaaaagcgtgaattagagcatgacccctgctcaaacccctttggtaattccccatcctgtgccattctgactgaaatccatgccctgtcctcatagcttatacctctctttctcttttttgctacacagtgcacaggtgccctttctggttattgaacggctgtgcttgtttctccctcagtgcctttgcacttactgtcccttccctgcctctgaaccccttgtatcttcaggtctctcagttcagactgagagagrcttctctgatcaacttctgtagctcctcatcatatctgtcccattatcttttatttttttccatagtacttacaatacctgaaattactgaagggttctgttcacttgttcctgcactgaagcctaggctgccctgctcaccaccatattcccaacacctagaatggtgcctggcacacgcagcagacattgagcaaatacattttttgaatgaatggggaaaaaacgttattgctagaacataattttgtagaaacgcagtaacttgaagttctgctctaacaaagagaaaataatttg

SEQ ID NO: 159651 - DNA, 601 bp, Human
cactgaagcctaggctgccctgctcaccaccatattcccaacacctagaatggtgcctggcacacgcagcagacattgagcaaatacattttttgaatgaatggggaaaaaacgttattgctagaacataattttgtagaaacgcagtaacttgaagttctgctctaacaaagagaaaataatttgctgttagcatgttgctgtggattttgtggccaatacttggtgcatcctgtgagactttcccaggaacatgggaatcagattgcctgggagaagcaaaccccagacctgcaaatartgggtcagaacggaagtgtgctgttacctttaaaaagagcaagtgggctgggtgccatggcacacacctgtattcccagttacttgggaggttgaggcaagaggatcacttgaggccaggagtttgaggctgcagtgtgtctgtgaatagcctctgtgctccagcctaggcaacaaaacaagaccccctctctaaataaataaacaccccatctctaaatcagtcagtcaatcttaaaggagcaaatgacttccagttctcaggactaggctctaaagaaagaacaggtccttcagaaga

SEQ ID NO: 159652 - DNA, 601 bp, Human
catctttttttttgagaatgagtctcgccatcttgcccaggctgtagtgcagtggtgagatcttggctcactgcaacctctgcctctgcctcccaggttcaagtgattcccctgcctcagcctcccgagtagctgggaccacaggctcacaccaccacgtctggctaattttgtattttttagtagaaacggagtttcaccatgttggccaggctgatctcgaactcctgacctcaggtgatccacccgtctcggcctcccaaagtaatgggattacaggcgtgagccaccacgcccaacsaggatctttgttttagacagcaatatgttccaaatgcctggaactgtgccggacacatacacactcagtttgttgattgaatgaatcttaccgccccaccatcccccatgctccctatttaactggacagagaacagggatgtggggaggccttatctcagactcctcccattttttccccattattcttagcatgtgacttctatccttagggtcatcttatggctcaggatcctgtcattttgttccaggtaggaagaaagaggaagagataggactgaagaactctgccagctgagt

SEQ ID NO: 159653 - DNA, 601 bp, Human
gtagaaacggagtttcaccatgttggccaggctgatctcgaactcctgacctcaggtgatccacccgtctcggcctcccaaagtaatgggattacaggcgtgagccaccacgcccaaccaggatctttgttttagacagcaatatgttccaaatgcctggaactgtgccggacacatacacactcagtttgttgattgaatgaatcttaccgccccaccatcccccatgctccctatttaactggacagagaacagggatgtggggaggccttatctcagactcctcccattttttccccrttattcttagcatgtgacttctatccttagggtcatcttatggctcaggatcctgtcattttgttccaggtaggaagaaagaggaagagataggactgaagaactctgccagctgagtcaccccccttctaaagaggagtcttctggagcttgttgccaaccctgataacttatgcttacccctcattggctataacttcatcacatgatcaccctttctgcaagaaaggctgagaaatgtaggcacattccctcccaaaacaaaattcaggatctgttaggaaggatatgagttagaga

SEQ ID NO: 159654 - DNA, 601 bp, Human
tctgccagctgagtcaccccccttctaaagaggagtcttctggagcttgttgccaaccctgataacttatgcttacccctcattggctataacttcatcacatgatcaccctttctgcaagaaaggctgagaaatgtaggcacattccctcccaaaacaaaattcaggatctgttaggaaggatatgagttagagaactggcagtgcctgccacagagtgttctccagctggctagggagggaatggcagcaaggtttctcctatgtgagcctattcaaggtggccctcttattttgcttyggggcagagtctgaaacagatagggtctggtgcctaatcagtagtggtggtgatatcccagggaagagcagaaccagtggtttttaagtagattctttgtacctctcaaaggtttgatttgatttaattatcaaacactttcacagcatgcttgaaacttagatacaatggacttagtagtggttatcacaacatccagaaaagcctcttctgagacctatccaaggctgtcatgtcagcaggggaagcagtccacagttactgggtggagtcttcctgctttggggcctctactgggat

SEQ ID NO: 159655 - DNA, 601 bp, Human
tgcaggctccagagccctcgctgttattcatcatgctgaattcacttctacaagggaacattttttctctgatgttcttttttttttttttgagacggagtctcgctctgtcgcccaggctggagtgcagtggcacaatctcggctcactgcaagctccgcctcctgggttcacgccattctcctgcctcagcctcccgagtagctgggactacaggagcccgccactacgcctggctaattttttttttttgtatttttagtagagatggtgtttcaccgcgctagccaggatggtctcsatctcctgacctcgtgatctgcccacctcggcttcccaaagtgctgggattacaggtgtgagccaccgtgcccagccttctctgatgttcttaaaacaccctgcccagtcagcctcccattttctctgctcttgacagacatgttactttcctgcttactgtgtagtaacaacagtggtccaagtgtgatggcacctcgcatttggccccaagggaagggagtcgattgggagtggtgaggactgaggcaacagggtatcagctgagttcatgccctggctgaagagggcagcttcacct

SEQ ID NO: 159656 - DNA, 601 bp, Human
caggagaattgcttgaacctgggaggcggaggttgcagtgagccaagatcgtgtcactgcactccaacctgggcaacagagtgagactctctcaaaaaaaaaaaaaaagtataataaatacataaactagccgggcgcagtggctcatgcctgtcatcccagcactttgggaggccgaggtgggtggatcacctgaggctgggagttcaagactagcctgaccaacatggagaaaccctatctctgctaaaaatacaaaaaattagctgggcgtggtggctcatgcctgtaatcccagctrctcaggaggctgagacaggagaattgcttgaacctgggaggcggaggctgtagtgagctgggattgctccattgcactccagcctgggcaacaagagtgaaactccgtctcaaataataaataaaaaataaataaataacaaactaataacatagtggtttattaccaattattatgtactatacagaactgcatgtgctattcttttatatgactggtagcacagtaggtttgttcacaccagcatcaccacgaatataagtaataagttgtgctgtgacataatgacggctatgatgt

SEQ ID NO: 159657 - DNA, 601 bp, Human
tcacgcttgtaatcccagcactttgcgatgccaaggtggtagatcacttgaactcaggagttcaagaccagcctaggcaacatagagaaacctcatctctactaaaactacaaaaattagccgggcgtggtgaggaggcgggaggattgcttgagccaaggaggtggaggttgcagtaagctgggatggtgccattgcactccagcctgggcaagacagcaaaactctgtctcaaaaaaaaaaaaaagtaatgtttacttctaaatatctggtcaagaactgtttactttacgtaagctcyttcccagagctagttttctgcggcggggggagtaagagatactgaacctcttctacttaaacagttaacattttacagaataatttcataaaagtttagtaaatccttaactatcacattggaaatctcatgccagattctgggtttacagtgtgagaaggcgaagcagcagaaggcatgtcatttaccaaggctcgttggtccccgaggctaaggcacaagagaaagctccatttgttctgccaggaactctggctggataaaatcgagctcctgcctccaagttgggggtggtgggga

SEQ ID NO: 159658 - DNA, 601 bp, Human
cgagctcctgcctccaagttgggggtggtggggagggccctgggccgagccactgggacttaggaaggaagagagtagtataagccagtggggttttagtgttccacaaagggaacctcaaaagcagaacagatgctgcctaagtttccagatttcaaggaagttgtcctccattgacacaatcagatttggccttggggagaacttatttgcaccctttgccttctgaaatgtaactccccataatctccttttcctctcttcctttgtttttcctgaaaatgcccacgtgtgttttgtrtatttggatgtgtgtgtagggactgatgacggagcccaggaggtggtgaaggacatcttggaagatgtagtcacatctgccattaaaggtaagaaccaaggacaacccagcctttcctcttccctcattcctccaaaaagtcctcagcaaaatattttagtggtggagtttcctcttccctgccctaagaactggtggagctcatggaaactgaatcttcccacgtctgcccatcttttatatgggattcaaaaatgacttgtttttactgactgattttagtctcatttgggttgggtt

SEQ ID NO: 159659 - DNA, 601 bp, Human
gacatcttggaagatgtagtcacatctgccattaaaggtaagaaccaaggacaacccagcctttcctcttccctcattcctccaaaaagtcctcagcaaaatattttagtggtggagtttcctcttccctgccctaagaactggtggagctcatggaaactgaatcttcccacgtctgcccatcttttatatgggattcaaaaatgacttgtttttactgactgattttagtctcatttgggttgggtttaggaaacatagtctgggccaggcgcggtggctcatgcctgtaatcccagcwctttgggaggccaaggcgggcggttcacgaggtcaggagttcaagaccagcccagccaatatggtgaaaccctgtctactaaaaatacaaaaagtagccgggcgtggtggcgcacgcctgtagtcccagctattcgggaggctgaggcaggagaattgcttgaacctggatggtggaggttgcagtgagccgagaacgcaccactgcacttcagcctgggtgacagagcgagactccatctcaaaaaaaagacacatagtctgactgtgttaggcttagatgctccacatagagatgcca

SEQ ID NO: 159660 - DNA, 601 bp, Human
atattttagtggtggagtttcctcttccctgccctaagaactggtggagctcatggaaactgaatcttcccacgtctgcccatcttttatatgggattcaaaaatgacttgtttttactgactgattttagtctcatttgggttgggtttaggaaacatagtctgggccaggcgcggtggctcatgcctgtaatcccagctctttgggaggccaaggcgggcggttcacgaggtcaggagttcaagaccagcccagccaatatggtgaaaccctgtctactaaaaatacaaaaagtagccrggcgtggtggcgcacgcctgtagtcccagctattcgggaggctgaggcaggagaattgcttgaacctggatggtggaggttgcagtgagccgagaacgcaccactgcacttcagcctgggtgacagagcgagactccatctcaaaaaaaagacacatagtctgactgtgttaggcttagatgctccacatagagatgccaagggccattccatatgccttgtagattaggggatgtccaggtttttctaggagtgggctggagccctgagatccatgtccattggagctgagttttcatg

SEQ ID NO: 159661 - DNA, 601 bp, Human
tcaaaaatgacttgtttttactgactgattttagtctcatttgggttgggtttaggaaacatagtctgggccaggcgcggtggctcatgcctgtaatcccagctctttgggaggccaaggcgggcggttcacgaggtcaggagttcaagaccagcccagccaatatggtgaaaccctgtctactaaaaatacaaaaagtagccgggcgtggtggcgcacgcctgtagtcccagctattcgggaggctgaggcaggagaattgcttgaacctggatggtggaggttgcagtgagccgagaaygcaccactgcacttcagcctgggtgacagagcgagactccatctcaaaaaaaagacacatagtctgactgtgttaggcttagatgctccacatagagatgccaagggccattccatatgccttgtagattaggggatgtccaggtttttctaggagtgggctggagccctgagatccatgtccattggagctgagttttcatggccagccattgatgtgtcaaggggacagtccacatgtcagcaggtatcaggtgtacagggaagctttgttttgttaggcttcattcataagtgcctc

SEQ ID NO: 159662 - DNA, 601 bp, Human
ccaggcgcggtggctcatgcctgtaatcccagctctttgggaggccaaggcgggcggttcacgaggtcaggagttcaagaccagcccagccaatatggtgaaaccctgtctactaaaaatacaaaaagtagccgggcgtggtggcgcacgcctgtagtcccagctattcgggaggctgaggcaggagaattgcttgaacctggatggtggaggttgcagtgagccgagaacgcaccactgcacttcagcctgggtgacagagcgagactccatctcaaaaaaaagacacatagtctgactstgttaggcttagatgctccacatagagatgccaagggccattccatatgccttgtagattaggggatgtccaggtttttctaggagtgggctggagccctgagatccatgtccattggagctgagttttcatggccagccattgatgtgtcaaggggacagtccacatgtcagcaggtatcaggtgtacagggaagctttgttttgttaggcttcattcataagtgcctcatggtatggtttcagtggaattaaacttgtatggctcagaatgactgttagatgatcttttttctttgtt

SEQ ID NO: 159663 - DNA, 601 bp, Human
cccaggagttgatgaaaactcacagaccaacgggatagccgatgacaggcagtccttgtcgtcagcagataatctggtatgttggtgatcatcctctgtggacttattgccatttttactttttcaaaagatgcagaattaagtctttcctcaaaagaagcaactaaaataagcaagccctgttcctttattagtcacacagtcctgggctgatattctttgtattagcaggttcagttcttagaacgtgctaatgttgcttggtatataacatcattattaaaccctgtttactcagacwtctaatacttaaatttcttgccacttttcttctctctcaaaatagtatacattcattatagaaaaataaaatatatagttacccgtctttccttctctgtattgaaaagtcagtatgactgtattgaaagccatccataacccatagattgcccttgttaacatcttacttaaatccatctagatttttctccatctcacgtatttttccacttaaatagaataatacagtatgtatcctgtgttgcaacctgctttttaaacaatttatattatgaacattctctcaggcccatagata

SEQ ID NO: 159664 - DNA, 601 bp, Human
ggacttattgccatttttactttttcaaaagatgcagaattaagtctttcctcaaaagaagcaactaaaataagcaagccctgttcctttattagtcacacagtcctgggctgatattctttgtattagcaggttcagttcttagaacgtgctaatgttgcttggtatataacatcattattaaaccctgtttactcagacttctaatacttaaatttcttgccacttttcttctctctcaaaatagtatacattcattatagaaaaataaaatatatagttacccgtctttccttctctrtattgaaaagtcagtatgactgtattgaaagccatccataacccatagattgcccttgttaacatcttacttaaatccatctagatttttctccatctcacgtatttttccacttaaatagaataatacagtatgtatcctgtgttgcaacctgctttttaaacaatttatattatgaacattctctcaggcccatagatatgtctgccacattatatttttaaatagccttactgttctcttaaaagttgctttaaaattaaatataaacattcaaaataggaagtaatatgatgtgag

SEQ ID NO: 159665 - DNA, 601 bp, Human
caagccctgttcctttattagtcacacagtcctgggctgatattctttgtattagcaggttcagttcttagaacgtgctaatgttgcttggtatataacatcattattaaaccctgtttactcagacttctaatacttaaatttcttgccacttttcttctctctcaaaatagtatacattcattatagaaaaataaaatatatagttacccgtctttccttctctgtattgaaaagtcagtatgactgtattgaaagccatccataacccatagattgcccttgttaacatcttacttawatccatctagatttttctccatctcacgtatttttccacttaaatagaataatacagtatgtatcctgtgttgcaacctgctttttaaacaatttatattatgaacattctctcaggcccatagatatgtctgccacattatatttttaaatagccttactgttctcttaaaagttgctttaaaattaaatataaacattcaaaataggaagtaatatgatgtgagtgtccctctagaccccattttctttgtctttttaccagtgtttctcaatctttttcattattgccccttcctcc

SEQ ID NO: 159666 - DNA, 601 bp, Human
caggcccatagatatgtctgccacattatatttttaaatagccttactgttctcttaaaagttgctttaaaattaaatataaacattcaaaataggaagtaatatgatgtgagtgtccctctagaccccattttctttgtctttttaccagtgtttctcaatctttttcattattgccccttcctccaagaaaactttgtagacattttttcctaatcatcattccccattaagttgtaatgccagcaataaactggatatccatatgctacatgtatatctgtgctttatacataaaaakaataagggtttgttgttcttgttgtttgtttgagacacagtctcactctcacctaggctagagtgcagtggtgtgatctcgactcactgcagccttcacttcctgggctcaaatgatcctgccacttcagccccctgagtatctgggactacaggcatgcaccaccatacctggctaattttttattattatttgtagagacatggtctcactatattgcccagggtgatcttgaactaggctcaagcaatctgcccacctcagcttcccaaagtgctgggtttacaggcttgagccact

SEQ ID NO: 159667 - DNA, 601 bp, Human
gtgagtgtccctctagaccccattttctttgtctttttaccagtgtttctcaatctttttcattattgccccttcctccaagaaaactttgtagacattttttcctaatcatcattccccattaagttgtaatgccagcaataaactggatatccatatgctacatgtatatctgtgctttatacataaaaataataagggtttgttgttcttgttgtttgtttgagacacagtctcactctcacctaggctagagtgcagtggtgtgatctcgactcactgcagccttcacttcctgggmtcaaatgatcctgccacttcagccccctgagtatctgggactacaggcatgcaccaccatacctggctaattttttattattatttgtagagacatggtctcactatattgcccagggtgatcttgaactaggctcaagcaatctgcccacctcagcttcccaaagtgctgggtttacaggcttgagccactgtatccaaccagaataatgtttttttccccccttgaggatgcgcttaaatctatacaagggactcgtgttatatgctaagctgcaatttgctttgtttactcaacact

SEQ ID NO: 159668 - DNA, 601 bp, Human
gttgtagaattgctgtgatggcttctccatagctcctattttgtcatatccttccctcccccacatccctcatctctctattaaatagaagaatttgaatttccaagagataattacatttctaatttttgataagagttagcttttgttttgtcctctccctttttattttttgagatacggtctcactatgttccccagattggagtgcaatggtgccatcatggcttactgcagccttgacctcctcggctcagtggatcctcctgcctcagcctctggagtagctgggactacaggygggtgccaccacacccagctgatgtttgtttctgatcctaggaatcggatgcacaaggacatcaagtggctgccaggttctcccacgttctgcagaaggatgccttccttgtgttccgctccctgtgcaagctgtccatgaaaccccttggtgaaggccctccagacccaaagtaagcagacagcagttcttggccaccttcagtccaatgatccagcagcacatggtactgtgtttcacacttcccttgttccaagaagtttcagtgtcatgtctctttgtcagtgtaagtgcaggaac

SEQ ID NO: 159669 - DNA, 601 bp, Human
tgaaaatgcagatagaggtacggattccaaagttttttcatttcattatttactattattattagtcattaattataatactcaatattgagaatgctgctaatattacactaagcattaggaaaatggttcatgaaaatgtttcatatcttaccatcctggaactcagaagtgggcaggggcagggagggtaaatggcatattcatcggctggcaccccagtaaatcagaactttttgaatgagtaagagaatatctttttataaaaagttactgcccccagcctgggcgccatggctcacgcctgtaatcccagcactttgggaagctgaggcgggcggatcatgaggtcaggagatcgagaccatcctggctaacatggtgaaaccccgtctctactaaaaatacaaaaaattagccaggcgtggtggcaggcgcctgtagtcccagctactcgggaggctgaggcaggagaatggcatgaacccgggaggcggagcttgcagtgagccaagattgcaccactgcactccagcctgggcaacagggcgagactccatctcaaaaaaaaaaagttactgcccccggatcttatgtgcct

SEQ ID NO: 159670 - DNA, 601 bp, Human
aactgttaattagtgtcctcctttgtctttatgtcatataggtctttttcaaagagattttcctgaacattttagaaacatcaacaagttcttttgagcacaggtggatggtcattcagactctgacgaggatctgtgcaggtatttccacctggggacactcatccactggacttctgatgctttaatttgccacagctcagattaagacttctaacccctccttttagagttttaaaggattggcaataaaaggctaattctaacctagtcctgccccacctctccttttttagaggaygaccaacttaggctggtttgccaaggacttcctggttttagcactaaaagtctcatgtcccagaaaccccctaatctcgtcaaactgggacacttggttacgttacctacaagctgagtactgttaatcacaggacctaagatactggtgctgccaatttttgattgggtgctacggtaaatgtggatttaccttacactatacaattgtgtggcctcaaagtaagcatcctgcttgtctggcatcaaatgtaattttgtaagagtgacacaactttaagaggtgggtcaggcaattgtt

SEQ ID NO: 159671 - DNA, 601 bp, Human
gtaggtttctgaatgaactggtcagagggtctccgagctccctggaattgtgtgtagaattttggtatatgggcatttttcctaaaagatggtcatagttgtcattagaatcacagagatctatgctgtccgagttgctgttttgaatctaaaatatttgcaatttttttagatgatctgcaactcatattcaacttgttatttaagaatgctgtttatttttgaaaatcagtatttttatttacttaaagggtgagccttaaaattgaatgcatttgtgggtatttaggggatacgttgyatccagagtcacttacagcataattcaaggttcttttctcctttttttcagtcactggttgagaccttgttatttattatttgagtgtgaatttttttttttttttttttttttttttgagacagaatctcactctgtcacccaggctggagtgcagtggcgcgatctcagctcactgcaacctccacctcccaggttcaagtgattctcctgcctcagcctcctgagtggcagggattacaggtgcctgccaccacacccggctgatttgagatggggtttcaccatattgtccaggct

SEQ ID NO: 159672 - DNA, 601 bp, Human
tttctttaagaatgttgaatattggccctcactctcttctggcttgtagagtttctgctgagagatccgctattagtctgatgggcttcccatagtgggtaacccgacctttctctctggctgcccttaacattttttccttcatttcaaccttggtgaatctgacaattatatgtcttggggttgctcttctctaggagtatctttgtggtgttctctgtatttcctgaatttgaaagttggcctgccttgctaggttggggaagttctcctggataatatcctgcagagtgttttccarcttggttccattctccctgtcactttcaggcataccaatcaaacgtagatttggtcttttcacatagtcccatatttcttggaggctttgttcgtttctttttattcttttttctgtaaacttctcttctcactttatttcattaatttgatcttcagtcactgataccctttcttccacttgatcaaatctgctattgaagcttgtgcatgcgtcatgtagttctcatgccatggttttcagctccaccaggtcatttaaggtcttctctacactgtttattctagttagccattcgtc

SEQ ID NO: 159673 - DNA, 601 bp, Human
ggggttgctcttctctaggagtatctttgtggtgttctctgtatttcctgaatttgaaagttggcctgccttgctaggttggggaagttctcctggataatatcctgcagagtgttttccaacttggttccattctccctgtcactttcaggcataccaatcaaacgtagatttggtcttttcacatagtcccatatttcttggaggctttgttcgtttctttttattcttttttctgtaaacttctcttctcactttatttcattaatttgatcttcagtcactgataccctttcttccmcttgatcaaatctgctattgaagcttgtgcatgcgtcatgtagttctcatgccatggttttcagctccaccaggtcatttaaggtcttctctacactgtttattctagttagccattcgtctaatcttttttcaaggttcttagcttccttgcgatgggttcgaacatcctcctttagcttggagaagtttgttattagtgactttctgaagcctacttctgtcagcttgtcaaagtcatttccatccatctttgttctgttgctggggaggagctgcaatcctttggaggaaaagaggt

SEQ ID NO: 159674 - DNA, 601 bp, Human
cttggaggctttgttcgtttctttttattcttttttctgtaaacttctcttctcactttatttcattaatttgatcttcagtcactgataccctttcttccacttgatcaaatctgctattgaagcttgtgcatgcgtcatgtagttctcatgccatggttttcagctccaccaggtcatttaaggtcttctctacactgtttattctagttagccattcgtctaatcttttttcaaggttcttagcttccttgcgatgggttcgaacatcctcctttagcttggagaagtttgttattastgactttctgaagcctacttctgtcagcttgtcaaagtcatttccatccatctttgttctgttgctggggaggagctgcaatcctttggaggaaaagaggtgctctggtttttagaattttcagcttttctgctctggtgtctccccatctttgtggttttatctatctttggtctttgatgctggtgacctacagatggggttttggtgtggatgtcattttatttgttgatgttgctattcctttctgtttgtagctttccttctaacagtcaggtccctcagctgcaggtctgtggg

SEQ ID NO: 159675 - DNA, 601 bp, Human
agctccaccaggtcatttaaggtcttctctacactgtttattctagttagccattcgtctaatcttttttcaaggttcttagcttccttgcgatgggttcgaacatcctcctttagcttggagaagtttgttattagtgactttctgaagcctacttctgtcagcttgtcaaagtcatttccatccatctttgttctgttgctggggaggagctgcaatcctttggaggaaaagaggtgctctggtttttagaattttcagcttttctgctctggtgtctccccatctttgtggttttatmtatctttggtctttgatgctggtgacctacagatggggttttggtgtggatgtcattttatttgttgatgttgctattcctttctgtttgtagctttccttctaacagtcaggtccctcagctgcaggtctgtgggagtttgctggaggtccactccagaccctgtttgcctgggtatcaccagcagaggctgcagaacagcaaatattgcagaacagcaaatattgctgcctgatccttcctctggaagcatcgtcccagaggggcacccgcctgtatgaggtgtcagtcggccctttc

SEQ ID NO: 159676 - DNA, 601 bp, Human
ctggaagcatcgtcccagaggggcacccgcctgtatgaggtgtcagtcggccctttctgggaggtgtctcccagttaggctacatgggggtcagggtcccacttgaggaggcaggctgttctcagagctcaaacaccatgctgggagaaccactgctgagagctgtcagacagggatgtttaagtctgcagaagtttctgctgccttttgttcagctatgccctgcccccagaggtagggtctatagaggcagcagcccttgcagagctgtggtgggctctgcccagttcgagcttcaccrgcactttgtttacctactcaagcctcagcaatggcagacacccctccccctgccaggctgctgcctcacaggtcaatctcagactgctgagccagcagtgagcaaggctccgtgggcgtgggacctgctgagccaggcacaggatataatctcctggtgtgccatttgctaagaccattggagaagtgcagtatttgggcaggagtgtcccgattttccaggtacagtctgtcatggcttcccttggctaggaatggaaaatcctccgaccccttacgcttcccgggtaaagcgatgccc

SEQ ID NO: 159677 - DNA, 601 bp, Human
agtgcagtatttgggcaggagtgtcccgattttccaggtacagtctgtcatggcttcccttggctaggaatggaaaatcctccgaccccttacgcttcccgggtaaagcgatgccccgccctgcttcagctcaccctacgtgggctgcacccactgtccaaccagtcccagtgagatgaaccaggtacctcagttggaaatgcagaaatcaccgtcttctgcgtcgatcacactgggagctgcagaccggagctgttcctatttggccatcttgggacggaatcttacttgttttatttaygtatatatttttctgaaccattttgaaagtaattggtagccatcatgagaccttaactgaatctctttgaaaaataaaggacattctcccatataaccacagcaccatcatcacaatcattggcaaatctttatgtttctttccagtcttttacacacatcaacacatacacaatcatatattccaacttgtaaatgattagttaacttagtaagttcaacttaagagttgaaattacagtactcacttattaactgacatgtttgatcttctcatttctactgccgccactccacctcc

SEQ ID NO: 159678 - DNA, 601 bp, Human
ttgctatcctccagattttgaaataagcaacttgtgtcccatctctgcttgaaacaggttcaacaagaaacccaagagggggatccagtttctccaggagcagggcatgctgggaacgtcagttgaagacatagcccaattcctgcaccaggaggagcgcctggattccgtaaggcttgggggtgtagcacttgcatgtgagttctgtcaggtgattgtgagcccttaccagttttaacctcgagattgtctggccctaagtacattgtctgttgtccacccccgggttatacattgtctrttgtccacccccgggttacagcagtcctgtgtatcccgttggctagtgttgcagaaagctctttgatgggaataaactagcctcccagcaggtggctgcatatttgctggaagagagtcagagctggaagtgttccttgactgctagaaagttcttacggctgcctgtctgcaactaacctccttagtgtgccccgtcattctctccattttaagtctcttgtgccccctcctcttccttcatccatgcaggacaggctgcttctggaatgggtgggtgggtgggcaggtcagggagttc

SEQ ID NO: 159679 - DNA, 601 bp, Human
ttgtctcagccctgcggacattcctagaaggtttccgcctacctggagaagcccaaaagattgaccgattaatggagaagtttgccgcaagatacatagaatgcaaccaagggtgagcgccgattttgagtcccttccagatcatctgtttgcctgcctcagaacgctaattctaatttggttggggtttaatctttgtatatctgtgccaagcaactgaagcttttgtttaccgtgtgccaggcactgtgctaagggattatttcacataagacctcacagcaacctgtttatgtccctrttctacagacaaaaagattgaggaccagagaggttaacttgcccaagatcacacagctaaagcccatgctgttagcaactataaaagagtagtttcataagttgagaggagacaattgggcacctcttccctaatcaaaaacagttcccctgatttaatatatggggtagatctcaaggattttggtttttctttaattgcatactgatgagcaggttacagaaatagctacataactaataaaaaccaccaaagtacatgattttatctggggaccttttttgatgggcggttcgtgat

SEQ ID NO: 159680 - DNA, 601 bp, Human
tttaattgcatactgatgagcaggttacagaaatagctacataactaataaaaaccaccaaagtacatgattttatctggggaccttttttgatgggcggttcgtgattttgtaagaagtggaaataggaaggggaacaaaccattattaaatacctcctgtgtgtgggccatgccatgggttttacatgcatttaatttaattaatggcaagcccaggaatagtatccctgttttacagatgaggaaattgagaatctgagagattgagcaacctgtccaaaattaatcagctagtaagkagcagagccagggttgaatatggatttctctaactcagaagctcatgttcgggctggatgcagtagctcttgcctgtaatcccagcactttgggaggccgggacgggcagatcacttggggtcaggagttcgagaccagcctggccaatatggtgaaatcccgtctcttccaaaaatacaaaaaaaaattagctgggtaatcccagctgctcagaggctgaggcaggagaattgcttcaacctgggaggcagaggctacagtgagccgagaccacaccactgcacaccagcctggatgac

SEQ ID NO: 159681 - DNA, 601 bp, Human
agatcacttggggtcaggagttcgagaccagcctggccaatatggtgaaatcccgtctcttccaaaaatacaaaaaaaaattagctgggtaatcccagctgctcagaggctgaggcaggagaattgcttcaacctgggaggcagaggctacagtgagccgagaccacaccactgcacaccagcctggatgacagaggcagactctgtctcaaaaaaaaaaactcatgttctctccactgaacattaaattagaaatatgtctgaatatgctgtgaccatgatgtggaaattgttcagtggraactattttttttgagacagggtcttgctctcttgcccaggttgaagtacagtggggtgatcacagatcactgcagcctggatctcctgggctcaatcagtcctcccacctcagcctcctgaactgctgggactacaggtgcatgccactgtgcctggctaattttttgtataatatttctgcagagatagagtttcaccgtgttgcccagtctggtcttgaactcctagcctcaagggatcctcctgcctcagcctcccaaagtgggggatttacaaatgtgagctaccacacctgatt

SEQ ID NO: 159682 - DNA, 601 bp, Human
caaagaagcctcaatttttattatttatttatttatttttgagacagtctcgctctgtcacccaggctggagtgcagtgtcacaatctcagctcactgcaacctccacctcccgggttcaggcaattctcctgcctcagtctcccgaatagctgggattatgggcacccgctgccacgcccagctaatttttgtatttttagtagagattgggtttcaccatgttggccaggctggtctcgaactcctgacctcaggtgatccacccatctcggcctcccaaagtgctgggattacaggcytgagccaccacgccctgccaaagaagctaaaatttgatacagattgttaatgagctttttctacactctgggttgctaagtcttgttcagtgatgatgaaagcgtaaaaactcttgcctcatttggaatcaaggggagtagtcggctgcttttctcgtgaagtgtgtctctgttagcattgtaccttccaaaccgcatcaccatgaatattgatgtctcgaatttttttctccaggcaaactctgtttgctagtgctgacactgcttatgtcctagcgtattcaattattatgctgacta

SEQ ID NO: 159683 - DNA, 601 bp, Human
atgttggccaggctggtctcgaactcctgacctcaggtgatccacccatctcggcctcccaaagtgctgggattacaggcctgagccaccacgccctgccaaagaagctaaaatttgatacagattgttaatgagctttttctacactctgggttgctaagtcttgttcagtgatgatgaaagcgtaaaaactcttgcctcatttggaatcaaggggagtagtcggctgcttttctcgtgaagtgtgtctctgttagcattgtaccttccaaaccgcatcaccatgaatattgatgtctcraatttttttctccaggcaaactctgtttgctagtgctgacactgcttatgtcctagcgtattcaattattatgctgactacagacttgcacagtcctcaggtaaagcactttaatgatttacatgttgtattagctaaataagtggctttacttgggcaattggatgttttttaaatggtttttaattttttttaattacaggtaaaaaataaaatgacgaaagagcagtatattaaaatgaatcggggtatcaatgatagtaaagatctgccagaagagtatctctcaagcatctatga

SEQ ID NO: 159684 - DNA, 601 bp, Human
gaaatgtgattgaattaattattgtgattatgttgggacttttataatgtcactgtcttgctagatttctgatgaggagcaagaaggaatttaaaattagtaatctgagaactaaattactcccaaaaagtgttctttaaaacttttctttaattcagattgtgtccgccttgattagaattctattagttatggcccctggggagctgtcagtttcactgtttgagaagcagcaaagggtagtggtttagagtgtggctctagagccacactgccttagatcaagtcccagctcctctamttagtaattgtatgaccctgggcaagtgacttaccccctctgcctcatttttcccatctgtaaaatggtaataataatatttgtaatggactcacgagatggttgggaggatttaggagttaatcattgtgcatcttttgaaacagtgtatggcatgtagccagccctcagtgactgctagccacacctatcatgctcttactttacagatgtagctagtgaaaagcagcggcggctgctgtacaacttagagatggagcaaatggctaaaacagccaaagctctgatggaggctgtgag

SEQ ID NO: 159685 - DNA, 601 bp, Human
agagatactggtgggttgtgctcttttagatttggcaaaacttagaaattatcagaaattttcagttaatcaagactcttagcaagctacttacttatgcctactgacaagaaatccgtagctttgtgatgacagctcgttaggggcaaaaatggagatacggattaaaactgtctttaagaatgggtaggctgggcacagtggctcacgcctgtaatcccagcactttgggaggccaaggcaggcagatcacctgaagttgggagttcgagaccagcctaaccaacatggagaaaccccrtctctactaaaaatataaaattagccgggtgtggtggtacatgcctataatcccagctactcgggaggctgaggcaggagaccggcttgaacccaggaggtggaggttgcggtgagccgagatcgcgccattttactccagcctgggtgacaagaacgaaactccatctcaaagaaaataataataataataataggtagggtccaagcttcttgactggatttgacaaagcagacttcgtgttcatctgcctaacttgcctgctttggtgcttaaaaatactatttcctttttaacatc

SEQ ID NO: 159686 - DNA, 601 bp, Human
cagtttttattataatttcgcatatttccaactcttccctggagaaacaagtagttcaatgcaatatgaatatgtctgtaaacctttgaaacttgaaaagttcaagcaaataaatgaaatgtaattctgaaactgttacgaaattaggaggttgacaatcccatgcatcactttgtaagtcagaagttgcaccccatttatttttaaaaactcaatcttctgttcctattcattttacagttagacattttcttttataccaagaccacaagctttgacgttagaccatctaggtttcaaraccccactctgccacctctccaaccatgtgacattggctcagctaaagtctctctgagacaccaattcatttcctcatttgtaaacttgagaaaacagacctgcctggcagaattgttgcagatgtcaatttgtgtgacagtcttagtattcaacagacatagtggaacatgggacaggtgagtttgactgaagtcaattagaaaggagagagctgcttctcaaacatgtggcagtgcatagatacctctgcaagatgttccaaaagcaagagggcattagcatggaataactgttgtgc

SEQ ID NO: 159687 - DNA, 601 bp, Human
gggaattcctggcatgaggtacgtgtctctttgaattgccttttctcagttaggatgactcctggcttccttttattcattgttgatctcatttggtcagttctgtttttcttgaagtcaaatcactgtacctcatgtatctggaagtcaccctctctggggctgtgaaaggcgggggcgagttcaggcgcaccagctcacagtgagcacccttgcacccagcagccagtgtcccccatgaagtgtacttctgttgttgcaactttctttccatattagtgccatttttttttttttttttagtccttatgtacctcttgggagcttgggagctcctgtgatcaatgtgtaattttaagacaaagccaggagcctgattagaaatggttgatagtcacaatgagctgttagggagagtgccagtgaattcacatgtttttaaaacagtattctaagattctcacccaaggatatagttacttatgtgtacaacaatgtatttaaaaggatatttgttgcagttttagttgttctagggaaaagtttgggttaaaaagagctagatgtcccaacaatataagagattgctactttttttaaa

SEQ ID NO: 159688 - DNA, 601 bp, Human
aagaagaaagcaatttataagtaaagatactcggcagtgctcagtggtatagtggagtcctggactctgggactgagttgtaaggtcagcgtaaaaagcaacactgaagttcagtcagaagttcccatgaaaattccttagggtttccctggaggtctgtgtgccattccttggtaagtttcatgtagccagtgtttcctctgacagaagttgggaccagtttctgtttctacagctgagcttcaggtaggagggcccgtgtgcagatctgcattctcaagcaccagaggcacccctcagkaccaggagatccagcctcatctcccactgcatgcctgatgtagagcatattctcattccttcagttaaaccaattaacgattgccaacaactttaagtgccagggacttaagtgttcagcagtgaacaagacagagttaatgccctcttggcacctaaggcaggaaacaaacaaatagatatatggtataatgccaaaaagtggtaagcactaagaaaaaaaaagtatgagcaggacatggtaatgggaaggtacgatctcacaagaaagatctctttgagagggacacacatgtctgag

SEQ ID NO: 159689 - DNA, 601 bp, Human
agctgggaattgaaggagtgagccatggggagacaacattccaggcataaggaacagtgagtgccaaggccctgaggtgggacaagagatgacaagttaaaggagcaacagtgaggccaatgaggctggtgtcttgtcgtctcacgaggagggtggaaaaaggaggtgggggtgactaaatgatgtgcctattaagtgacatggtgggaggaatccgccgccccagtcaaatgctttttctctctttattgagagcttactaaatttgcataaacatctatatggcataactccattgaaycaacttttttttaatgactaacttaagattacagtgccctttttctagctgtaaggtaggaactcatttcttcatgccttctttctcttagatcttgaaatgcatcagccagctggagctcgctcagctgataggaaccggtgtgaagacgcgctacctgtctggatctgggcgtgaaagagaagggagcctgaagggccacacattggcaggagaagagttcatgggccttggcctcggtaagacaccaggccccacagctaacagtcacggatttgcaagctaacggggatgaaaccc

SEQ ID NO: 159690 - DNA, 601 bp, Human
gggcaaacagatgtgccaagtcatattctgagcactcagtttatatattttaactcatttaatgctcaaaacaatccaatgagaacagggactgttatattccccattttgcaattgagaaaactgaggcacggagtgaaaagatatgagcagcatcatactgcaaaggagtggcagaggtaggattcaagccctaagccatccaactacggagtgtaggcttctaggtcccatttagtgagtggaatagtacagtgtcatggttaaaagtatggactctggaaaaatggggaattgtaayagcacccacttcttagggttctcgtgaggatgagtgtaatgaaagtctgtgaagcacaccaagcattcagcaggtgtgagccattaatgttctaggagctctggattaatatcaattgattcaaatttgttttcctaaatataggcctttaatactataaaaatgtaaaagattatagagaaaggtagatggttggtagaaacaagaaagcttatactaaggatatattttaaatgcccaatgccaaaacaaaactttaattttatcatcagtgggtttttgtttcttttttgaacttgc

SEQ ID NO: 159691 - DNA, 601 bp, Human
tttaggattaaaagcctacccatgctcacgcctgtaatcccagcactttgggaggtcaaggcaggcagatcactagatcaggaaatcgagaccattttggctaacacagtgaaaccccgttctactaaaaaatacaaaaaattagtcaggcgtggtggtgggcacctgtagtcccagctactctggaggctgaggcaggagaatggcgtgaacccaggaggcagagcttgcagtgagcggagatggtgccactgcactctagcctaggcgacagagtgagactccatctgcaaaaaaaaaacgcctacccatgctcatgcctgtaatcccagcactttgggaggcaggtggatcacaaggtcaggaaatcgagaccatcctggccaacatggtgaaaccatgtctctactaaaatacaaaaaaaaagaaattaactgggcatggtgacgcatgccagtaatcccagctactcgggaggctgaggcaggggaatatcttgaacccaggaggcagaggttgtagtgggccgagatcgcgccattgcactccagcctagcaacagaacgagactccgtctaaaaaaaaaaaaaaaaaagcctac

SEQ ID NO: 159692 - DNA, 601 bp, Human
tggtgggcacctgtagtcccagctactctggaggctgaggcaggagaatggcgtgaacccaggaggcagagcttgcagtgagcggagatggtgccactgcactctagcctaggcgacagagtgagactccatctgcaaaaaaaaaacgcctacccatgctcatgcctgtaatcccagcactttgggaggcaggtggatcacaaggtcaggaaatcgagaccatcctggccaacatggtgaaaccatgtctctactaaaatacaaaaaaaaagaaattaactgggcatggtgacgcatgccwgtaatcccagctactcgggaggctgaggcaggggaatatcttgaacccaggaggcagaggttgtagtgggccgagatcgcgccattgcactccagcctagcaacagaacgagactccgtctaaaaaaaaaaaaaaaaaagcctacccatgaatgagagttggctgagttgacagtttccttttttttttttctcccctcaaaacttttccattatttctctttactcaaaacttgacctaaaaatccaggagagatatttcccataaagaagcttcgtacttattagcaatcactctccg

SEQ ID NO: 159693 - DNA, 601 bp, Human
gacaactgttgggaataaaccagactgaacttcttcctcgttaccagaagttttattatatacatacagacatatgcacacatgttgaataaataaaatgtcagatatgtgttttatcacggccaaaaaactgggaacaaagcaatcaaaagaaatgtatgtggccgggcgtcatggctcacgcctgtaatcccagcactttgggaggctgaggcaggtggatcacaggtcaggagatcgagaccgtcctggctaacatggtgaaaccccatctctactaaaaatacaaaagtttagcccrgcgtggtggcgagcgcctgtagtcccagctactcaggaggctgaggcagaagaatggcgtgaacccgggaggcagagcttgcagtgagctgagatcgtgccactgccctccagcctgggcgacagagcgagactccgtcttaaaaaaaaaaaaaaaaaaaaaagaaatgtatgtatgtatgtatctgtgatgtcatttgcctcttaagggaaaggtaataataacagcttcctaccaaaacacatttcatgatctcaagaaaattttctcaaacctggtggtgaagagttataataccaa

SEQ ID NO: 159694 - DNA, 601 bp, Human
actgggaacaaagcaatcaaaagaaatgtatgtggccgggcgtcatggctcacgcctgtaatcccagcactttgggaggctgaggcaggtggatcacaggtcaggagatcgagaccgtcctggctaacatggtgaaaccccatctctactaaaaatacaaaagtttagcccggcgtggtggcgagcgcctgtagtcccagctactcaggaggctgaggcagaagaatggcgtgaacccgggaggcagagcttgcagtgagctgagatcgtgccactgccctccagcctgggcgacagagcragactccgtcttaaaaaaaaaaaaaaaaaaaaaagaaatgtatgtatgtatgtatctgtgatgtcatttgcctcttaagggaaaggtaataataacagcttcctaccaaaacacatttcatgatctcaagaaaattttctcaaacctggtggtgaagagttataataccaatgcttaaaaatagtgttagtaaaaaaacaatccagaaattctgtacattgaatagaggaaaatcttaaaaagtagtctaccattggggtatagaataatcaatggggtgctggtaaatgatttgtagca

SEQ ID NO: 159695 - DNA, 601 bp, Human
tgtggccgggcgtcatggctcacgcctgtaatcccagcactttgggaggctgaggcaggtggatcacaggtcaggagatcgagaccgtcctggctaacatggtgaaaccccatctctactaaaaatacaaaagtttagcccggcgtggtggcgagcgcctgtagtcccagctactcaggaggctgaggcagaagaatggcgtgaacccgggaggcagagcttgcagtgagctgagatcgtgccactgccctccagcctgggcgacagagcgagactccgtcttaaaaaaaaaaaaaaaaamaaaagaaatgtatgtatgtatgtatctgtgatgtcatttgcctcttaagggaaaggtaataataacagcttcctaccaaaacacatttcatgatctcaagaaaattttctcaaacctggtggtgaagagttataataccaatgcttaaaaatagtgttagtaaaaaaacaatccagaaattctgtacattgaatagaggaaaatcttaaaaagtagtctaccattggggtatagaataatcaatggggtgctggtaaatgatttgtagcatctgccagtttctgtgtgtaaacaccctgc

SEQ ID NO: 159696 - DNA, 601 bp, Human
tttacacaaaaattacagctaaaacatctttggccaccctcccccacacatctggccctccccaaagctaattattcttactagtttgttgtatatctttccagacatttttgtattcatgtgcatatgtatgtactcatagaaatattacagataatattgtcttggtttgtttcgctttttaaaaaaattatacatagcattttgtaacttgtttcttccacttagcaaggaatcataaagatttaaccatgttagcatatgtagatttgttctcttttaagaaattgtaataaaatayacataacaggccgggcacagtagctcactcctgaatcccagcagtttgggaagctgaggcaggcagatcatctgaggtcaggagttcgagactaacctggccaacaaatacaaaattagccaaatacaaaaattagcagggcgcggtagtggacgcctgtaatcccagctacacgggaggctgaggcaggagactatctcgaacccggggggtggaggttgcagtgagcagagatcgtgccattgcacaccagtctgggtgacgagcaaagctctgtctcaaaaataaaataaataaaat

SEQ ID NO: 159697 - DNA, 601 bp, Human
cagtttgggaagctgaggcaggcagatcatctgaggtcaggagttcgagactaacctggccaacaaatacaaaattagccaaatacaaaaattagcagggcgcggtagtggacgcctgtaatcccagctacacgggaggctgaggcaggagactatctcgaacccggggggtggaggttgcagtgagcagagatcgtgccattgcacaccagtctgggtgacgagcaaagctctgtctcaaaaataaaataaataaaataagattaaaaaaatagaataaccatcttaacaattttaagtrtgcggttcagtagtgttaggtacactcacattgttgggcaacagatctcaaggacccttttcatcttgcaaaactaaaactgcatacccattaaacagtaactcccactttcaccctcctgaccacaggcaaccaccattctactctgtgcccctaggaacttgactactatgggtacctcatataagtagaatcatgctgtgtttgtccttttgtgactgccttatttcattcagcatagtaatgtcttcaaggttcatctgtgttgtagcgtgtatcagaatttccatccttttcaag

SEQ ID NO: 159698 - DNA, 601 bp, Human
ctcaccctgtaattccagcactttgggaggccaaggcaggtggatcacctgaggtcaggagttcgagaccagcttggccaacatggtgaaaccccatctctactaaaaatacaaaaatcagccggcaggcacctgtaatcccagctacttgggaggttgaggcaggagaattgcttgaaccggggagatggaggttgcagtgagccgagatcacaccactgcactccagtctgggcgacagagccagactccatcttagaaaataataataataataataaaatgaaatttaaaaaagcaraaagtagcacattttaaatgcatatttaattaactatgcaatactgatttcgtcattacacttaaaataaaactggacagatcatagccaagaaatagcattttcttttctccttaggtgtgttttccctgaatgtttgttttgaaggtaggctgtccatctttgctgttgagagacccacgtcggtcattattacactatacctgtttcacatcagttcctgttcttgttcaggttggctgcaaccctaatgaagatgtggctatctttgctgttgactcattaaggcaactctccatg

SEQ ID NO: 159699 - DNA, 601 bp, Human
gggagatggaggttgcagtgagccgagatcacaccactgcactccagtctgggcgacagagccagactccatcttagaaaataataataataataataaaatgaaatttaaaaaagcagaaagtagcacattttaaatgcatatttaattaactatgcaatactgatttcgtcattacacttaaaataaaactggacagatcatagccaagaaatagcattttcttttctccttaggtgtgttttccctgaatgtttgttttgaaggtaggctgtccatctttgctgttgagagacccacrtcggtcattattacactatacctgtttcacatcagttcctgttcttgttcaggttggctgcaaccctaatgaagatgtggctatctttgctgttgactcattaaggcaactctccatgaagtttcttgagaagggtgaattagccaacttccgtttccagaaagattttctgaggccctttgagcatattatgaagaaaaacaggtatgtgttttgctctggaagacgcttggtcaaattccccgttggggctcccagaagccctcctaacactaaccacatgattaatttttttcctcc

SEQ ID NO: 159700 - DNA, 601 bp, Human
agaggtcaggataccgggccctgtgaagcagccgtactgttcatttattcactcggcctggacttattgagacttgccatctgctaggtactataaagaagacattttaaaatcctgtgtttggccgggcgcggtggctcatgcctgtaatcccaacactttgggaggccgagtcaggtggatcacctgagcaggagttcaagaccagcctggccaacatggtgaaaccccgtctctactaaaactacaaaagttagccgggcgtggtggtgggcgcctgtaatcccagctactcaggagrctgaggcaggagaatcgcttgaacccgggaggtggaggttatagtgagccaagatcacaccattgcactccagcctgggcaacaagagcgaaatgctgtctcaaaaaaaataaataaaaatgaaataaaataaaatccctgttttcattcagccttaaatagttgcacctgggtgtgatgggcatacaggagttcattatatattactctacttttctctgtgttttaaactttccataataaaatttaaaaacaaatctctgtttaattccaatagaaaaacaaataaatatcagtggt

SEQ ID NO: 159701 - DNA, 601 bp, Human
tttggtaagggcacccttaggaaaaggcctgaaggaagtcaggaataatctgagagtggccatatgctgccttggcatgagaattatgaacagggaagagcaaaagcaaaaggcccgtagcaggtagtgcttggcataggtggggaggccagtgtggcttgaatggagggaacaaggcaggtagtagaaggtgaagtccctcccagtggtggcagggtgcctagctcacataggagctgtcggccattgtcagcactttggtttgctctctgtgaaagatggaagccgttggaggtttttktttttttttttgacggagtctctcctgacctcatgatccgcccacctgggcctcccaaagtgctgggattacaggcacgagctaccgtggccggcctgccattggaggattttaagcagagaagtgaaatgatctgacattttaaaggatcaccctgcatttatccatggaaaatgaggagcagtaggatgaggtaggaggccattgtagttgtccaggtttggaccaaggtgggagcagtggcagtgatggattagattctgtgcacatttggaaagggaatcttacaccatgtgctga

SEQ ID NO: 159702 - DNA, 601 bp, Human
gagaattatgaacagggaagagcaaaagcaaaaggcccgtagcaggtagtgcttggcataggtggggaggccagtgtggcttgaatggagggaacaaggcaggtagtagaaggtgaagtccctcccagtggtggcagggtgcctagctcacataggagctgtcggccattgtcagcactttggtttgctctctgtgaaagatggaagccgttggaggtttttgtttttttttttgacggagtctctcctgacctcatgatccgcccacctgggcctcccaaagtgctgggattacaggcaygagctaccgtggccggcctgccattggaggattttaagcagagaagtgaaatgatctgacattttaaaggatcaccctgcatttatccatggaaaatgaggagcagtaggatgaggtaggaggccattgtagttgtccaggtttggaccaaggtgggagcagtggcagtgatggattagattctgtgcacatttggaaagggaatcttacaccatgtgctgatgaattggccatggagcataaaggaagagatgtcaaggatgacttttggacctaattcctcttgtctgctattcccct

SEQ ID NO: 159703 - DNA, 601 bp, Human
attctgtgcacatttggaaagggaatcttacaccatgtgctgatgaattggccatggagcataaaggaagagatgtcaaggatgacttttggacctaattcctcttgtctgctattcccctaaaaagtgtacttcagatcagcctggatctttttttttttttttttgagacggagttttgctctttttgccgaggctggagtgcaatggtatgatctcagcttactgcaacctttgcctctttggttcaaacaattctcctgcctcagcctcccaagtagctgggattacaggcatgcaycaccatgcccagctaattttgtatttttggtagagatggggtttcaccatgctggtcaggctggtctcaaacccctgacctcaagtgatccacctgccttggcctcccaaagtgctgggattacaggcgtgagccgccacacctggtgttgcttttttttttttttttttttttttaagaaaatgggagctcccaagctggatgccagagcaggctgttagggtagtgaataaaagggtaccagaaaagtttccttgacatgtctctctttctcctagtgtctgtatgtctgctttattg

SEQ ID NO: 159704 - DNA, 601 bp, Human
agcaggctgttagggtagtgaataaaagggtaccagaaaagtttccttgacatgtctctctttctcctagtgtctgtatgtctgctttattgctcattttaagagaaccaaaattaaacccagagtctggcatcaccctttactttagcaaatacacaaaagtattttcctacctttaggaacaccattgagagtgcctgaggagactgagtcctcacatggccaagccacgtgtgcaagcctaattgcacggaagccctcaactcctaactccaggccttccctgcctatcctattccctgaaaaggggcagagtgagtttagaatcacatgttgccaggcactctcagatactgttggtggaactgtaacttaactgtaacatttctaaaagcattttggtgataagtgtcaagaatcctgatatttttatgcccctttgactcagtaattccacacttctgtaattctccaaagcagttaatgtgaaatatagtaaagcgttatatgtcacagaaaatagttttctagaaaaaaacaaactatctaaataaacaagtgttaaagtaaatgttggtaccggtacaacatgggatattgt

SEQ ID NO: 159705 - DNA, 601 bp, Human
caacaagttgctttattctccatggggagacaaccatgaattcatttttattatatattggaagttacttatgttgtgtagtcagtcctttgttatctgcaggtgacatgtttactttgtgaactttcagctaatttttaactgttttgactttctccttgccttctctaaatggcctttcctgttattggttagtgtgagcctggaagacaaacatgaatgtcattctaagccagataaaatttgaaagtcatgagcctgggaggcagaggttgcaatgagtcgaggtcgctctactgcmttccagcctgggcaacagagcaagaccttgtttcaaaaaaaaaaaaaaaattgaaagtcaaacctgtagtcccaaggccactgtactgacttttaaagatagtactatcgaagcagtaggcttatatagctttccttcttgctatttgtgagataataaggttcctccataattgtatgtcttaacaggttgagagacaattgcagctgttccagaaaatcagccattttctctgtcttcaggttttactttataataatttaggtaaacattgcaccttaaactatatatgtatactcc

SEQ ID NO: 159706 - DNA, 601 bp, Human
caaccttgagtttattgtttcgtgattgcaggatggtggttgtagctctatgcagcatgctaggtttggaatggaagtgagaggaaacggggcagagcccaaatgtggattgctgtgtgctataagaaatgtttaagtgctgcttctaagggatgagctatgttcatttctcttcccattctccaaagtacagacgatatggccgtcccattctttcctcaggtctcccaccatccgggacatggcgatccgctgcattgcccagatggtgaactcccaggcggccaacatccgctcaggytggaagaacatctttgccgtgttccaccaggcagcctctgatcatgatgggaacattgtggagctggccttccagaccacttgccacattgtcagtaagtggctctgttccctccctactaatgtcccacctgcaagtctagaagagtgtcacttgctgtctattttactacctacaggggcttccctaccttggctctactgtgatatagtaatgtgccaggccgtgttgtaagcgcttgatgagtattaatcttgatcttaactctgttttgactttctccttgccttctctaaatgg

SEQ ID NO: 159707 - DNA, 601 bp, Human
tccgctgcattgcccagatggtgaactcccaggcggccaacatccgctcaggttggaagaacatctttgccgtgttccaccaggcagcctctgatcatgatgggaacattgtggagctggccttccagaccacttgccacattgtcagtaagtggctctgttccctccctactaatgtcccacctgcaagtctagaagagtgtcacttgctgtctattttactacctacaggggcttccctaccttggctctactgtgatatagtaatgtgccaggccgtgttgtaagcgcttgatgagtrttaatcttgatcttaactctgttttgactttctccttgccttctctaaatggcctttcctgttatcagtcagttggggtccagcagataaacgtgaatgttatttcaagccagatgaaatttgaaagtcaaatcaatcccaaggccactctaatgactatgaaagaattacagtcaatcctcattattggtggattccgtgtgtatactcactaaaatgtatatacattaataactccacaaccagtactcatggtgcttttgtggtcatttgccaacatgtgcatgcacagaagagcaa

SEQ ID NO: 159708 - DNA, 601 bp, Human
tccaccaggcagcctctgatcatgatgggaacattgtggagctggccttccagaccacttgccacattgtcagtaagtggctctgttccctccctactaatgtcccacctgcaagtctagaagagtgtcacttgctgtctattttactacctacaggggcttccctaccttggctctactgtgatatagtaatgtgccaggccgtgttgtaagcgcttgatgagtattaatcttgatcttaactctgttttgactttctccttgccttctctaaatggcctttcctgttatcagtcagttkgggtccagcagataaacgtgaatgttatttcaagccagatgaaatttgaaagtcaaatcaatcccaaggccactctaatgactatgaaagaattacagtcaatcctcattattggtggattccgtgtgtatactcactaaaatgtatatacattaataactccacaaccagtactcatggtgcttttgtggtcatttgccaacatgtgcatgcacagaagagcaaaaacttgagtcacccaaggcgcacgttcccagttgtggtggaagaaggtggcaccctgccttcttgtttgagctg

SEQ ID NO: 159709 - DNA, 601 bp, Human
atcctcattattggtggattccgtgtgtatactcactaaaatgtatatacattaataactccacaaccagtactcatggtgcttttgtggtcatttgccaacatgtgcatgcacagaagagcaaaaacttgagtcacccaaggcgcacgttcccagttgtggtggaagaaggtggcaccctgccttcttgtttgagctgtcatgacataaacaagtgtgcttaatgtggcctatcgagtgccatgtttttttacattttcgtgctttttgttggtgatttcactgtttaaaatgccccccmaagcatagtgctgaatgctgggtagtattctacgtgcagaaaggctgtgatgtgtcttatggaaaaaatatgtgtgttagatgagcttccttcaggcatgagttacagtgctatattggctgtgagttcggtgttaatgaatcaacaatatgtattaaataaggtgtcttttcaacaggaacacacatacaacaaggttatgtcttgatcagctgatgaaaatgttctgaccagagacttgcaggaatctagttccttatctccatattttccctaagagccatggttcagtattcttga

SEQ ID NO: 159710 - DNA, 601 bp, Human
cactaaaatgtatatacattaataactccacaaccagtactcatggtgcttttgtggtcatttgccaacatgtgcatgcacagaagagcaaaaacttgagtcacccaaggcgcacgttcccagttgtggtggaagaaggtggcaccctgccttcttgtttgagctgtcatgacataaacaagtgtgcttaatgtggcctatcgagtgccatgtttttttacattttcgtgctttttgttggtgatttcactgtttaaaatgcccccccaagcatagtgctgaatgctgggtagtattctaygtgcagaaaggctgtgatgtgtcttatggaaaaaatatgtgtgttagatgagcttccttcaggcatgagttacagtgctatattggctgtgagttcggtgttaatgaatcaacaatatgtattaaataaggtgtcttttcaacaggaacacacatacaacaaggttatgtcttgatcagctgatgaaaatgttctgaccagagacttgcaggaatctagttccttatctccatattttccctaagagccatggttcagtattcttgaattcagtgtttatggcaactttatagaatgtaa

SEQ ID NO: 159711 - DNA, 601 bp, Human
gtgatttcactgtttaaaatgcccccccaagcatagtgctgaatgctgggtagtattctacgtgcagaaaggctgtgatgtgtcttatggaaaaaatatgtgtgttagatgagcttccttcaggcatgagttacagtgctatattggctgtgagttcggtgttaatgaatcaacaatatgtattaaataaggtgtcttttcaacaggaacacacatacaacaaggttatgtcttgatcagctgatgaaaatgttctgaccagagacttgcaggaatctagttccttatctccatattttcyctaagagccatggttcagtattcttgaattcagtgtttatggcaactttatagaatgtaactatcaggaataatgagaacagactatctcattatttcccccatgttactaaagaggaaattgaggcacagaaaaataaatacaacaacttgcctgaggacacacagtttcgatgtagtggaaccaggacttgcactcgggcagtcgagcccagagttagtttagtgtccccctcctctggactgaccaggagtcctgggttctgcctgcgagcacgtaacaagatgtttacttcatctc

SEQ ID NO: 159712 - DNA, 601 bp, Human
ttacttcatctctatggaaatttttaggcatcgagttatctttgcacatagttggcgttcaataaatgaatgaattgatatttgggcctttacatcattgcttgagcgcaggaagactgtctagcccaagctgtacccagtgcattcattcctgagtaatttaataagaaaaactgtcttccaaagatactgacatgcttttcttagattttcacagttaattatctctgatgtatgtgtgtgtgtgtgtgtgtgcacgcacgtgcattttttcatccccatttctaaatcctggtcttaygaaaaatgtgccttgtgttcccccagcaactattttccagcaccattttcctgcagccatcgattcctttcaggatgctgtgaagtgcttatcagagttcgcctgcaacgccgctttccctgacacgagcatggaagcgattcggctcatccgcttctgtggcaaatacgtctctgagaggcctcgggttcgtttttccccaccttactcagatgggcagtgaagggaaaaggtcatggagcagaaattcttgctcctaacaaagagctttccagctactcttttagaaatgtgtgtttg

SEQ ID NO: 159713 - DNA, 601 bp, Human
atttcaaaatgctgccatgacagggagttaggccttttcattatttggtatatgtgaaattctgtattttattcatactgaatctatggtattctacaaattgtttttgtagaagttagttgtattttagcttttgtattttggcaaagctcaagaagctagacgtttctatttgaaagaaaacaaacctcccttgtaggaaatggcattatgtctttgtaatgtgcctgagaaatcatatttaaaaatcaccttttgttttctcctgaaaatgatggggtttttgtttgtttgtttgttgtgtttgatgtgtctcatctttctaaagaggcctatttggtttaaatgacagagtcccaaaacactgaaatagggtgaaaacaagtccatctaaactatgatgtcctgtgtagatctctacttaagtttcctttacagaaagagctataaacctgtaaggtgatatgtctcatctcttacaacagctcactaagatgtgatgataatgggagccaatgttgattgagcacttagtacttgttgggcaccattctaggtattttctgtatgttgattcatttagtccccatgtcagacctat

SEQ ID NO: 159714 - DNA, 601 bp, Human
agagtctgggtccgaggctggttccccatcttattcgaactctcctgcatcattaatagatgcaagttagatgtacgaacaaggtaaccatgttcccgtgcggtggccccttacatcactgaaatgaacctcagtcacttgctcacctgaccccactctcttctctgttgttctcttctccaccattctctcttctgtgcctgactttgtttcctccaggggactcacagtcatgtttgagatcatgaagagctatggccacacctttgaaaagcactggtggcaggacctgttcagaatygtgtttcggatttttgacaatatgaaactccctgagcaactgtcagaggtaggtgataactacagcactgccctaggtatgatggagaggaaagcctttctggccggtatttgcctctgggggctgcatcatcgtctacccagagttcttaaatactgagcaacttaaggttttaaaaatggaaacacctttctgatactctcctaccagtatcagctagtcctgagtgactctccccatgttcagaagaatgagaggaaatacatctctgtggtctgctgcttggccctcaggcattgc

SEQ ID NO: 159715 - DNA, 601 bp, Human
aggtcttctcattttaatttgttttagtcattgctaatttgataagccaactgtatcacattgaaaaagtgtttcaaactgctagtgaggtggcatattttctctcataggattgatcattcttaagaattgccttttatgaattcttttatgaattactcttagctcatctactggattattcatctttctcctattgatttatgcatttttaaatatataaataatgtagcatatgcatacatgagttgcagatgatttgcccactttattatttccttttcattttggaaaatttagsttttaagtaaccaaatctatgcgttttttatttatttttttattccacttctggcttccacttttggcatcattaccataattttataaagatccctctgtatatcctctgtacatatgaatgtattaacatttttaagacgtattcttgatacatatcaccaaattgctttctacaacagttttgccaggagtgtacaagaatgcccatctcactgcagggagaatagcttttaagtgtcatctttttgttttcccagaaatctgagtggatgacaacaacctgcaatcacgcacttta

SEQ ID NO: 159716 - DNA, 601 bp, Human
ccatattttaaacggttctttgagagcagtcttttcagtggctgcatagtattataatttctttacttctcccttatcggactctcaggttagttctaggctttcaacattgtaaatagtgctttggcgtaactgtgcttgtttgttgccctcctaaattaatagtgctttcctcttcaccaaagaagtggtagttcttactttttgtgtgagtccacataaagaagttttaattcagatctcacttttaaatactttggtttacagagaggagttgaattaacttttattcctaagtgaytctaagaccattagattttaaaaagcatttgggatacagcaactgtcttctgctgttaaatttttttattttttattttattttatttttctcgagacagagtctcgctctgtccccaggctggagtgcagcagtgcgatctcggctcactgcaacctccacctcctgggttcaagcgattctcatgcctcagcctcccgccaagtagctgggattacaggtgcccgccaccatgtccagctaatttttgtatttttagcagagatggggtttcgccatgttgaccaggctggtcttgaa

SEQ ID NO: 159717 - DNA, 601 bp, Human
agggtagaccatacgcaagtaaggccactttttaatttgttttaaataagtaacatgtttatgtgattcatatattcagaaggcacaaaagggtaaacatgataagccttcttctgccctgtgcctcagtctgccagttctctgtagcagccaaggttacctgtttctctgtacctttccagagtcattttatccatgtgcaggcaagtacatgcacatatacattcatatacatacatatatagtacatacgaattttctccttttaccagttatggaatagtacattccatatacattsacatatacattcacacacatacatatatagtacatatgaattttctccttttaccagttatggaatagtatgccttattcttttttcagttaatatattttagagatcattcaaaatcagtacataaggagctttcacgttgttttatacgattgtctattattccagtttgtagacatgcatttattgcttaattgagttgctcttaacagacatttatattacttataatcttttgctgttaggagcaatactgcattgaataacccaatacatatgtcatttgtgaatttatgtaat

SEQ ID NO: 159718 - DNA, 601 bp, Human
tttttattggtttggaggagctcttatgtactagaaatcctttttctgatatgagtttcaaattatttttgccaaattgtctcttaatgttgcttatgatgtgttttactgtcatttaaaaaaataagtttaacagctgtcatgtaccaggcactgtactgtgtgttccatgtgtattgtttcatgtaatcctcatagtagcctttgaagaggtactgtcttacgtttgagggaactggggcttagacagatcatagaacttgacaacatgtagtagagtggggattcagacacatttttsgcagcctgaggaatgggaacttgtgaaggttgttctggtcctttgaaagttgtgtgccccattgtttgcctttatagcagtcccaccctgtcctcaacatgctaggccatagctgttaacattgaagttaacttctgaagcagcacatttgaccaaaacagtgtgcggtcacctttttctttagaaggaataaaagtagtcacccttgaaattcattaaagaggtatcgtgttgggactggcatgctgtctttcactaactgctgcagccagcttctctccaatgcccagtgatagaatg

SEQ ID NO: 159719 - DNA, 601 bp, Human
tgttggggccgggcgcggtggctcacacctgtaatcctaacactttgggaggctgaggcgggcagatcatgaggtcaggagttcaagaccagcctggccaacatagtgaaaccccatctctattaaaactacaaaaaaaattagccgggcatggtgccgggtgcctgtagtcccagctacttgggaggaggcaggagaattgcttgaacctgaaggcggaggttgcagtaagcaaagatcacgccactgcacttcagcctgggtgacacagcgagactctgtctcaaaaaaaaaaaaaaaagaattgttggcgaggcacagtggctcatgcctgtaatcccagcactttgggctgaggcaggcagatcacctgaggtcaggagtttgagaccagcctggctaagatggcgaaaccccatctctcctaaaattacaaaaaactagctgacacagtggcgcacacctgtaatcccagctaccagctacttgggaggctgaggcgggagaatcacttgaacccgggaggcagaggttgcagtgagctgagatcatgccactgcactccagccagggtgacaaagcgagactccgtctcaaaaaa

SEQ ID NO: 159720 - DNA, 601 bp, Human
gggcagatcatgaggtcaggagttcaagaccagcctggccaacatagtgaaaccccatctctattaaaactacaaaaaaaattagccgggcatggtgccgggtgcctgtagtcccagctacttgggaggaggcaggagaattgcttgaacctgaaggcggaggttgcagtaagcaaagatcacgccactgcacttcagcctgggtgacacagcgagactctgtctcaaaaaaaaaaaaaaaagaattgttggcgaggcacagtggctcatgcctgtaatcccagcactttgggctgaggcrggcagatcacctgaggtcaggagtttgagaccagcctggctaagatggcgaaaccccatctctcctaaaattacaaaaaactagctgacacagtggcgcacacctgtaatcccagctaccagctacttgggaggctgaggcgggagaatcacttgaacccgggaggcagaggttgcagtgagctgagatcatgccactgcactccagccagggtgacaaagcgagactccgtctcaaaaaaaaaaaaaaaaaaaaaatgttaactagtcaaaggttgttaaccactaagaggaataaaag

SEQ ID NO: 159721 - DNA, 601 bp, Human
ggtgacaaagcgagactccgtctcaaaaaaaaaaaaaaaaaaaaaatgttaactagtcaaaggttgttaaccactaagaggaataaaagaccactcttaagggatacagaagtagaaaatgcagaaagcaacaaaactgagcttcttggccaggcaagcaatggctcacacctgtaatcctagcactttgggaggccgaggcaggcagatcgcttgatattgtggcacaggagttcaagaccagcctgggcaacatgaggaaatcccatctctatttaaaaaacaacaacaacaacaacacaaaaaaaaaacccacaagcttctggcctcttcagaggggctggctactgcaggaacctgaaacgtcctctggttagggcacagtccagtggtggtctttaggagtagcccactgggtggcagagaaacttgctggaggacacagaacctgcatagctgattccctcactttcttcaggtctttgctcaaatgtcacatttttatagagacttttcccaactagtttgcttaaacgtgcagtcctaccctgacactttctatccctgtctctacctatcatcaatatttaatatataatat

SEQ ID NO: 159722 - DNA, 601 bp, Human
tgacaaagcgagactccgtctcaaaaaaaaaaaaaaaaaaaaaatgttaactagtcaaaggttgttaaccactaagaggaataaaagaccactcttaagggatacagaagtagaaaatgcagaaagcaacaaaactgagcttcttggccaggcaagcaatggctcacacctgtaatcctagcactttgggaggccgaggcaggcagatcgcttgatattgtggcacaggagttcaagaccagcctgggcaacatgaggaaatcccatctctatttaaaaaacaacaacaacaacaacaaacaaaaaaaacccacaagcttctggcctcttcagaggggctggctactgcaggaacctgaaacgtcctctggttagggcacagtccagtggtggtctttaggagtagcccactgggtggcagagaaacttgctggaggacacagaacctgcatagctgattccctcactttcttcaggtctttgctcaaatgtcacatttttatagagacttttcccaactagtttgcttaaacgtgcagtcctaccctgacactttctatccctgtctctacctatcatcaatatttaatatataatattc

SEQ ID NO: 159723 - DNA, 601 bp, Human
acaaagcgagactccgtctcaaaaaaaaaaaaaaaaaaaaaatgttaactagtcaaaggttgttaaccactaagaggaataaaagaccactcttaagggatacagaagtagaaaatgcagaaagcaacaaaactgagcttcttggccaggcaagcaatggctcacacctgtaatcctagcactttgggaggccgaggcaggcagatcgcttgatattgtggcacaggagttcaagaccagcctgggcaacatgaggaaatcccatctctatttaaaaaacaacaacaacaacaacaaaaacaaaaaacccacaagcttctggcctcttcagaggggctggctactgcaggaacctgaaacgtcctctggttagggcacagtccagtggtggtctttaggagtagcccactgggtggcagagaaacttgctggaggacacagaacctgcatagctgattccctcactttcttcaggtctttgctcaaatgtcacatttttatagagacttttcccaactagtttgcttaaacgtgcagtcctaccctgacactttctatccctgtctctacctatcatcaatatttaatatataatattctt

SEQ ID NO: 159724 - DNA, 601 bp, Human
aaagcgagactccgtctcaaaaaaaaaaaaaaaaaaaaaatgttaactagtcaaaggttgttaaccactaagaggaataaaagaccactcttaagggatacagaagtagaaaatgcagaaagcaacaaaactgagcttcttggccaggcaagcaatggctcacacctgtaatcctagcactttgggaggccgaggcaggcagatcgcttgatattgtggcacaggagttcaagaccagcctgggcaacatgaggaaatcccatctctatttaaaaaacaacaacaacaacaacaaaaaaacaaaacccacaagcttctggcctcttcagaggggctggctactgcaggaacctgaaacgtcctctggttagggcacagtccagtggtggtctttaggagtagcccactgggtggcagagaaacttgctggaggacacagaacctgcatagctgattccctcactttcttcaggtctttgctcaaatgtcacatttttatagagacttttcccaactagtttgcttaaacgtgcagtcctaccctgacactttctatccctgtctctacctatcatcaatatttaatatataatattcttaa

SEQ ID NO: 159725 - DNA, 601 bp, Human
gactccgtctcaaaaaaaaaaaaaaaaaaaaaatgttaactagtcaaaggttgttaaccactaagaggaataaaagaccactcttaagggatacagaagtagaaaatgcagaaagcaacaaaactgagcttcttggccaggcaagcaatggctcacacctgtaatcctagcactttgggaggccgaggcaggcagatcgcttgatattgtggcacaggagttcaagaccagcctgggcaacatgaggaaatcccatctctatttaaaaaacaacaacaacaacaacaaaaaaaaaaaacccacaagcttctggcctcttcagaggggctggctactgcaggaacctgaaacgtcctctggttagggcacagtccagtggtggtctttaggagtagcccactgggtggcagagaaacttgctggaggacacagaacctgcatagctgattccctcactttcttcaggtctttgctcaaatgtcacatttttatagagacttttcccaactagtttgcttaaacgtgcagtcctaccctgacactttctatccctgtctctacctatcatcaatatttaatatataatattcttaaaatattt

SEQ ID NO: 159726 - DNA, 601 bp, Human
catttttatagagacttttcccaactagtttgcttaaacgtgcagtcctaccctgacactttctatccctgtctctacctatcatcaatatttaatatataatattcttaaaatatttcatttattgtctgtcaacaccatgggagcagagatttttttttgtccagtttattcattgctgtgccacaacatcaagaattgtgccttgactgggtgtggtggctcatgctgtaatcccagcactttgggaggctgaagtgggagcatcacttgaaaccaggagttcaggaccagcctggasaacgtagtgagaccccatctcttaaaaaaataaatcatgccttgcacatagtaggagctcagtggatatttcttcagtattggctgaatcattattagggttaatctttatcatctaacatagatcagaaactgtttgccagcctcctcatcaagtgtgtggtccagttggaattgatacagaccattgacaacattgtgttctaccctgcgacgagcaaaaaggaggatgcagagcacatggttgccgcccaggtaagaacaggaggcctcaggaagagcatccctgtccatagggagg

SEQ ID NO: 159727 - DNA, 601 bp, Human
aaaccaggagttcaggaccagcctggagaacgtagtgagaccccatctcttaaaaaaataaatcatgccttgcacatagtaggagctcagtggatatttcttcagtattggctgaatcattattagggttaatctttatcatctaacatagatcagaaactgtttgccagcctcctcatcaagtgtgtggtccagttggaattgatacagaccattgacaacattgtgttctaccctgcgacgagcaaaaaggaggatgcagagcacatggttgccgcccaggtaagaacaggaggcctcrggaagagcatccctgtccatagggaggttgctttgatgtagtggtgtgcggaagccagcttgtactggctttccagagcctgtcatgctcatctctttccaacctcacattcagtgatggcatgttgatgcttaaaattggccttgatgggagttatttacatcagagaaaaacagcaaacactaaacatcagggcttcattttttttatgtatataccccagagagtgagtttatgagcataccactgctcagatgccaccccactagtgttagttatcacaggaactattccccacaa

SEQ ID NO: 159728 - DNA, 601 bp, Human
gaggcctcaggaagagcatccctgtccatagggaggttgctttgatgtagtggtgtgcggaagccagcttgtactggctttccagagcctgtcatgctcatctctttccaacctcacattcagtgatggcatgttgatgcttaaaattggccttgatgggagttatttacatcagagaaaaacagcaaacactaaacatcagggcttcattttttttatgtatataccccagagagtgagtttatgagcataccactgctcagatgccaccccactagtgttagttatcacaggaactatwccccacaattgatatacagttttttttctggtttttttttttttgtttttttttttgtttttttgagacggagtctcgctctgtcgcccaggctggagtgcagtggcgcgatctcggctcactgcaagctccgcctcctgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggc

SEQ ID NO: 159729 - DNA, 601 bp, Human
tgctttgatgtagtggtgtgcggaagccagcttgtactggctttccagagcctgtcatgctcatctctttccaacctcacattcagtgatggcatgttgatgcttaaaattggccttgatgggagttatttacatcagagaaaaacagcaaacactaaacatcagggcttcattttttttatgtatataccccagagagtgagtttatgagcataccactgctcagatgccaccccactagtgttagttatcacaggaactattccccacaattgatatacagttttttttctggtttttwtttttttgtttttttttttgtttttttgagacggagtctcgctctgtcgcccaggctggagtgcagtggcgcgatctcggctcactgcaagctccgcctcctgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgc

SEQ ID NO: 159730 - DNA, 601 bp, Human
cttaaaattggccttgatgggagttatttacatcagagaaaaacagcaaacactaaacatcagggcttcattttttttatgtatataccccagagagtgagtttatgagcataccactgctcagatgccaccccactagtgttagttatcacaggaactattccccacaattgatatacagttttttttctggtttttttttttttgtttttttttttgtttttttgagacggagtctcgctctgtcgcccaggctggagtgcagtggcgcgatctcggctcactgcaagctccgcctccygggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctgatatacagtttaatcacaaataagtgaggaggaaaagatatatataaagatcccagtttttccttcaagaatttcgctttttttgttttcta

SEQ ID NO: 159731 - DNA, 601 bp, Human
catcccagtacatggtagattctcagtacgtatttgataaaaagacaaattgaggccggatgcggtggtccatgcctgtaatcccaacactttgggaggctgaggcaggcctcagccaagatcacttgaggccaggagttcgagaccagcctggccaacatggcgaaaccccatctctactaaaaatataaaaattagccaggtgtggtggtgcaaacccataatcccagctacttgggaggccgaggcaggagaatcgcttgtacccggaaggcggaggttgcggtgagccgagattgcrccactgcactccagcctgagtgacagagcaagactccatctggaaaaaaaaaaaaaaaagacaaattgaaagttggagaattgaattgatctagcaagtcaaaacattttatgggctgggtgcggtggctcacgcctgtaatcccagcactctgggaggctaaggcaggcggattgcttgagcccaggagttcaagaccagcctgggcaacatagcaaaaccccatctccacccaaaaaaaagtatatgaaaattagctgggcattgtagcacacaccatactcaggaggctgaggtggg

SEQ ID NO: 159732 - DNA, 601 bp, Human
atgcggtggtccatgcctgtaatcccaacactttgggaggctgaggcaggcctcagccaagatcacttgaggccaggagttcgagaccagcctggccaacatggcgaaaccccatctctactaaaaatataaaaattagccaggtgtggtggtgcaaacccataatcccagctacttgggaggccgaggcaggagaatcgcttgtacccggaaggcggaggttgcggtgagccgagattgcgccactgcactccagcctgagtgacagagcaagactccatctggaaaaaaaaaaaaaaaagacaaattgaaagttggagaattgaattgatctagcaagtcaaaacattttatgggctgggtgcggtggctcacgcctgtaatcccagcactctgggaggctaaggcaggcggattgcttgagcccaggagttcaagaccagcctgggcaacatagcaaaaccccatctccacccaaaaaaaagtatatgaaaattagctgggcattgtagcacacaccatactcaggaggctgaggtgggagaatcacttgagcctaggaggtggaggttgcagtgagccaagattgcatactgcactg

SEQ ID NO: 159733 - DNA, 601 bp, Human
ggcaggcctcagccaagatcacttgaggccaggagttcgagaccagcctggccaacatggcgaaaccccatctctactaaaaatataaaaattagccaggtgtggtggtgcaaacccataatcccagctacttgggaggccgaggcaggagaatcgcttgtacccggaaggcggaggttgcggtgagccgagattgcgccactgcactccagcctgagtgacagagcaagactccatctggaaaaaaaaaaaaaaaagacaaattgaaagttggagaattgaattgatctagcaagtcaaracattttatgggctgggtgcggtggctcacgcctgtaatcccagcactctgggaggctaaggcaggcggattgcttgagcccaggagttcaagaccagcctgggcaacatagcaaaaccccatctccacccaaaaaaaagtatatgaaaattagctgggcattgtagcacacaccatactcaggaggctgaggtgggagaatcacttgagcctaggaggtggaggttgcagtgagccaagattgcatactgcactgcagcctgggtgacagggggagaccttgtctcaagaaaaaaaaaa

SEQ ID NO: 159734 - DNA, 601 bp, Human
ttgggtttacaggcacatgccaccatgcctgactaatttttatatttttagtagaaacagggtttcaccatgttggcctagctggtcttgaactcctgacctcaagtaatccactcatcttagcctcccaaagttctaggattacaggcatgagccactgcacctggccttgttatcattactttttgtccccaaatatttattttaacccacaattaaagaatgtcatttttctctacagccttaaaatatccagctcttttatgcctttgcctgtaataagattttgtttgtgagagtsgtttgcatatctcttaagctgattggtactagtttgtttttaagaatgtgttcttttttttttattatttatttttttattttttggagatggagtctcactctgttgctaggctggagtgcagtggcgtgatcttggctcactgcaacctctagcctcctgggttcaagcgattctcctgcctcagcctcccaagtagctggaactacaggcacgcaccaccacgccagtggtctcactctcttgacctcatgatccacctgccttggcctcccaaagtgctgggattacaggcgtgag

SEQ ID NO: 159735 - DNA, 601 bp, Human
gtttgaggatcctgtttcgaatgtatgttgatgagaaccgcagggattcctgggaagaaatacagcagagacttttaacgtaagaaaattagtttctgattagatttctatctgctatatacaaaatgcatcacagcaatactgtggattgaaaagagtaagagaaaaatacatgctgacactctgacaaatttttttttctttctatttggtgactctcccatttcacttttcttaatgccctgaagagggcagagcctcatctgtttcactgttaagcccttgcttgagcccaggagtkgaagggtgctgtgagctatgcatagaaacatggacagtgaaaagtgctccgagcggtcagcaggctggatggaagtcctgactgtggctagagccctgtggccttaggcaggttactatccctcttgggaccaggtcctctttagaattgttgtcagcaataacatcccatcattccttctttccaagaagagtgtaattgaaatcatataaccaggatgtgcctacaaaattatctagaaatccaccaatggggagagagtggaatactgatgaggaagccccagccagaaaagtaggt

SEQ ID NO: 159736 - DNA, 601 bp, Human
tggaatactgatgaggaagccccagccagaaaagtaggtctttgtcactcagcttcctgggcatcagcaagattctgatgcctgagctttcttttcttcctctaaggtataaaaacagtaacacacagtgctggcaaatgtgtggtaagaatgcactctcctgcgtagctagttggagtgtataatggcatgatctttctggaaagtaggtgagactatataccaggagccctaaagtgttcattctctgtgactcagtaattccactgttatggaatctgcttcagaaaatattttagamataggaaccaggaataccacatggaatattcactgcagacttatcaggagaaaaaattttaagcagctcaactgtggaatgaataactaagctgtaatatgtcctaaattatgatattatgaaacatagtcattaaaagtgaattttttttttttttgagacggagtcttgctctgtcgcccaggctggagtgcagtggtgcaatctcagctcactgcaaggtccacttcctgggttcaaccaattctcctgcctcggcctcctgagtagccaggattacaggcgcgtgccaccatacct

SEQ ID NO: 159737 - DNA, 601 bp, Human
accaggagccctaaagtgttcattctctgtgactcagtaattccactgttatggaatctgcttcagaaaatattttagaaataggaaccaggaataccacatggaatattcactgcagacttatcaggagaaaaaattttaagcagctcaactgtggaatgaataactaagctgtaatatgtcctaaattatgatattatgaaacatagtcattaaaagtgaattttttttttttttgagacggagtcttgctctgtcgcccaggctggagtgcagtggtgcaatctcagctcactgcaasgtccacttcctgggttcaaccaattctcctgcctcggcctcctgagtagccaggattacaggcgcgtgccaccatacctggctggttttttgtatttttagtggagatggggtttcaccatgttggtcaggctagtctcaaactcctgacctcaggtgatctgccgacctccgcctcccaaagtgctgggattacaggcatgagccaccgtgcccagcctaaaagtgaaatttttttttttttttttttttttgagacagagtcttgctctgtcactcaggctggagtgcagtggcgtga

SEQ ID NO: 159738 - DNA, 601 bp, Human
actgcagacttatcaggagaaaaaattttaagcagctcaactgtggaatgaataactaagctgtaatatgtcctaaattatgatattatgaaacatagtcattaaaagtgaattttttttttttttgagacggagtcttgctctgtcgcccaggctggagtgcagtggtgcaatctcagctcactgcaaggtccacttcctgggttcaaccaattctcctgcctcggcctcctgagtagccaggattacaggcgcgtgccaccatacctggctggttttttgtatttttagtggagatggsgtttcaccatgttggtcaggctagtctcaaactcctgacctcaggtgatctgccgacctccgcctcccaaagtgctgggattacaggcatgagccaccgtgcccagcctaaaagtgaaatttttttttttttttttttttttgagacagagtcttgctctgtcactcaggctggagtgcagtggcgtgatcttggctcactgccacctctgcctcccgggttcaagtgattcttctgcatcagcctcccgagtagctgggactacaggcgtgtgccatcacacacctggctaatttttgt

SEQ ID NO: 159739 - DNA, 601 bp, Human
ggtttcaccatgttggtcaggctagtctcaaactcctgacctcaggtgatctgccgacctccgcctcccaaagtgctgggattacaggcatgagccaccgtgcccagcctaaaagtgaaatttttttttttttttttttttttgagacagagtcttgctctgtcactcaggctggagtgcagtggcgtgatcttggctcactgccacctctgcctcccgggttcaagtgattcttctgcatcagcctcccgagtagctgggactacaggcgtgtgccatcacacacctggctaatttttgygtttttagtagagacaaagtttcacgatattggccaggatggtcttgaactcctgacctcgtgatccccccacctcggcctcccaaagtgcagggatgggcgtgagccactgcgcccggcctaaaagtgaaatttttaagaaataattttacttaatgtgggaactttttcataatacaataatttttaccccaaaaaaagctgcaaaagtgtttttacttggaattttcagcaattggggcattttatttgtttttttagagtcagggtcttgctatgttgcctaggctggtctcgaac

SEQ ID NO: 159740 - DNA, 601 bp, Human
gtttcaccatgttggtcaggctagtctcaaactcctgacctcaggtgatctgccgacctccgcctcccaaagtgctgggattacaggcatgagccaccgtgcccagcctaaaagtgaaatttttttttttttttttttttttgagacagagtcttgctctgtcactcaggctggagtgcagtggcgtgatcttggctcactgccacctctgcctcccgggttcaagtgattcttctgcatcagcctcccgagtagctgggactacaggcgtgtgccatcacacacctggctaatttttgtrtttttagtagagacaaagtttcacgatattggccaggatggtcttgaactcctgacctcgtgatccccccacctcggcctcccaaagtgcagggatgggcgtgagccactgcgcccggcctaaaagtgaaatttttaagaaataattttacttaatgtgggaactttttcataatacaataatttttaccccaaaaaaagctgcaaaagtgtttttacttggaattttcagcaattggggcattttatttgtttttttagagtcagggtcttgctatgttgcctaggctggtctcgaact

SEQ ID NO: 159741 - DNA, 601 bp, Human
agacaaagtttcacgatattggccaggatggtcttgaactcctgacctcgtgatccccccacctcggcctcccaaagtgcagggatgggcgtgagccactgcgcccggcctaaaagtgaaatttttaagaaataattttacttaatgtgggaactttttcataatacaataatttttaccccaaaaaaagctgcaaaagtgtttttacttggaattttcagcaattggggcattttatttgtttttttagagtcagggtcttgctatgttgcctaggctggtctcgaactcctgggcttaygagctcttcctgcctcagcctcctgagtagctgggactacaggcgagcaatttttcttttgaaatcttagcaaaaaaaaaaaaaactggaaggaaatatgccaaaatattgtcatgtatcccttagaatgatgtagctatttttctttataatttttttcataattttttacatatatcagttaccttacaatgagaataacaagtcataaagtgaaaaaagaattaattaattaaaggaggcaccaatggctcatttcagcttaagcccaaaagacaaatacctacagtctcataaagt

SEQ ID NO: 159742 - DNA, 601 bp, Human
tttacttaatgtgggaactttttcataatacaataatttttaccccaaaaaaagctgcaaaagtgtttttacttggaattttcagcaattggggcattttatttgtttttttagagtcagggtcttgctatgttgcctaggctggtctcgaactcctgggcttacgagctcttcctgcctcagcctcctgagtagctgggactacaggcgagcaatttttcttttgaaatcttagcaaaaaaaaaaaaaactggaaggaaatatgccaaaatattgtcatgtatcccttagaatgatgtarctatttttctttataatttttttcataattttttacatatatcagttaccttacaatgagaataacaagtcataaagtgaaaaaagaattaattaattaaaggaggcaccaatggctcatttcagcttaagcccaaaagacaaatacctacagtctcataaagtttctctaaaggagatatgtagggccgggcgcggtgggtcacatctgtaatcccagcactttgggaggccgagccaggtggatcacaaggtcaggagtttgagaccagcctggccaacatggccctgtctctactaa

SEQ ID NO: 159743 - DNA, 601 bp, Human
tttaaaaaagcaattaaatgtgattgtgaggagagaaaggcagttatataattatgagtaataagctcttgtgctacagacattgattgagttcagccctagccatgtgccaggactgagccaagttatgacttaacatatttacttcatttaatcctcacaacaaccccttgagtttggactttttttttttttttttttttttttttttgagatagtctcactctatcgcccaggctggagtgcagtggtgcaatctcagtttactgcaacctccacctcctgagttcaagtgattctygtgcctcagccacctgagtagctggaattacagatacgcaccaccacacccagctaatttttctatttttagtagaaatgggggtttgctacattggccgggctgtctcgaactcctggcttcaagtgatctgcttgcgttggcctcccagagtgctgggattataggcatgagtcactgcacctggccaggcaattttttatctccattttatagctgaagaaactaaggctcagtgatttgcccaagatagcacagccagagtgggtgctcaatagttattgcagtggctgggctcag

SEQ ID NO: 159744 - DNA, 601 bp, Human
actgcacctggccaggcaattttttatctccattttatagctgaagaaactaaggctcagtgatttgcccaagatagcacagccagagtgggtgctcaatagttattgcagtggctgggctcagaggctcaggctcacatctataatcccagcactttgggaagccaaggcagacagattgctgagcccaggagttcaagaccagcctgggcaacgtggtgaaaccccatctctactaaaaatcaaaaaaattagccaggcatggtggcgcaagcatgtagtgttagctgcttcagaggcrgaggtgggaggatcagcttgagcccgaggaggtcaaggctacagtgaaccttgatcacaccactgcactccagcctgggccgcagagcaagaccctgtctcaaaaaaaaaaaagtaattaaaaaaaacatgttaaaataattttaaaaatagcacaagaatgaatagttctcccctgaatgtgagatgttaatcaattgtttgatatgcctccccctctctaattcttctagtgtttgcagtgaagctcttgcctatttcatcactgtgaattctgagagccatcgggaggcctggacaa

SEQ ID NO: 159745 - DNA, 601 bp, Human
ttgatatgcctccccctctctaattcttctagtgtttgcagtgaagctcttgcctatttcatcactgtgaattctgagagccatcgggaggcctggacaagtctcttgttgttacttctaactaaaaccctcaaaataaatgatgaaaaggtatgaacaagtaaactctgaccaattttcactaggacataaagtttgggttggctttttactcaagagtttgcagtaactattttctcagttctcccaaggatggttacgtgactagcaccattctagatgcattggagagaagttaatycgttatggacaatgggtgccacaggatattagggctttttgcctggaagaacagtagttgagaacggctgaagtgtagacctcatgtgttgctgttaggaatggtatggtgagtttcagtgcaggaagagagggttaagattgtgaagcaccagttttgacctaggaacctgctttacaaaataaaagagctgttgacttttggcagcaagactatccaaatttaattaaagttaaatataactgaaagaagctttaatttgcaaggtttcttcaacttctttttttttttttgagacag

SEQ ID NO: 159746 - DNA, 601 bp, Human
gatatgcctccccctctctaattcttctagtgtttgcagtgaagctcttgcctatttcatcactgtgaattctgagagccatcgggaggcctggacaagtctcttgttgttacttctaactaaaaccctcaaaataaatgatgaaaaggtatgaacaagtaaactctgaccaattttcactaggacataaagtttgggttggctttttactcaagagtttgcagtaactattttctcagttctcccaaggatggttacgtgactagcaccattctagatgcattggagagaagttaatccrttatggacaatgggtgccacaggatattagggctttttgcctggaagaacagtagttgagaacggctgaagtgtagacctcatgtgttgctgttaggaatggtatggtgagtttcagtgcaggaagagagggttaagattgtgaagcaccagttttgacctaggaacctgctttacaaaataaaagagctgttgacttttggcagcaagactatccaaatttaattaaagttaaatataactgaaagaagctttaatttgcaaggtttcttcaacttctttttttttttttgagacagag

SEQ ID NO: 159747 - DNA, 601 bp, Human
ctctgggcgagagcggaatgtgggcccggggttcgggtggtgcgctcaggcaaggtcttcggcttccctagggagcgcttgccgcgcctcgcggcatcctaggtctctggcccaggtgcggcgaccccagggcctgtgagggctgagggcaactgaggcgcggcctaacgcgagcctgcggattgcccgccctttcctctccatcacggcgctgattggctgcgccgccgcctctccgctcgggaaggccgctccttattggtcgcgctcgcatgtccattctctgcgacggtggctgctrgccgcgcgagctgggtgtgcggcggcgaggcctgcccgggcggggactgcgggcgcgtggagctgcggctgcctcgcgtcgtcccttgccctaactctagtgaagcccccgaactcacccttctctaacctctgtacttgtatccctgactgtaaaacgggcatcgtgatctcactttgctgaattgtttgtgagaattctagtcggtacacccgggacatagaaatcccctgtaacgcgggttgggggagggttccctcgttttgggagaaacgctgtgctgtggtggttcggagcata

SEQ ID NO: 159748 - DNA, 601 bp, Human
ggaatgtgggcccggggttcgggtggtgcgctcaggcaaggtcttcggcttccctagggagcgcttgccgcgcctcgcggcatcctaggtctctggcccaggtgcggcgaccccagggcctgtgagggctgagggcaactgaggcgcggcctaacgcgagcctgcggattgcccgccctttcctctccatcacggcgctgattggctgcgccgccgcctctccgctcgggaaggccgctccttattggtcgcgctcgcatgtccattctctgcgacggtggctgctagccgcgcgagctgrgtgtgcggcggcgaggcctgcccgggcggggactgcgggcgcgtggagctgcggctgcctcgcgtcgtcccttgccctaactctagtgaagcccccgaactcacccttctctaacctctgtacttgtatccctgactgtaaaacgggcatcgtgatctcactttgctgaattgtttgtgagaattctagtcggtacacccgggacatagaaatcccctgtaacgcgggttgggggagggttccctcgttttgggagaaacgctgtgctgtggtggttcggagcatagactttggaattag

SEQ ID NO: 159749 - DNA, 601 bp, Human
ttgccctaactctagtgaagcccccgaactcacccttctctaacctctgtacttgtatccctgactgtaaaacgggcatcgtgatctcactttgctgaattgtttgtgagaattctagtcggtacacccgggacatagaaatcccctgtaacgcgggttgggggagggttccctcgttttgggagaaacgctgtgctgtggtggttcggagcatagactttggaattagatcgcctgggttcattccagacgtagcctctcgttaggggtgtaacttgaggctggtcacctcatctcactkagcctccatttccttagctgcaaaatggggttaataacagaatctacctcggaaagtggctttgaggatgcgctgagttatttaccgtggtttacaaaggttccctgggagctgacggttgtttattcatctctcccacccatctttctccttagccagtgtggctttctgtttcttccatattccagggttattccgatttaaaattatttgcacatgccttttgtttgctggggaagtaccaacatttttgcaaggcaggccgcctctcccaagtttccctcaccttaggcctcccct

SEQ ID NO: 159750 - DNA, 601 bp, Human
atggctctccatcaacatcacctggttttagttacttcatagcatttactaacacttacttattgcttacttgttatctttctcaactgctagaatgtaagctgtttgagagcaaggaccttgtctgtcttgcttacttctctctccctggtgggtgccatcccacctgtgcttgccacatggtagatgcacaagtattattcttccttggaggcacagaaggggaccctttagtcttggattccaccaattgctctttttctcaccttgggcccacatagtcatatctttggcctttctytgtgtgtgtctctctctttttttttttttttttgacatgctttcagaggatcctaatggacctcgtctctccgctcctacaaccctttatctttcacttcttaccatcagtgcaagggaagtctctctccccttctgattacttctgctggttggggtctgggacaggattggatggatgcaagagcagtgctctagttttggaattaatttgtttctttattcatttaataactttattgagcatccacttaatctctgggaatatagtgaaaaaacaaaaatggacaaggtcccttcc

SEQ ID NO: 159751 - DNA, 601 bp, Human
gaaagcagagggtaggttgaggtgttgggatatgttcttcatgtgtgggtgccagatagttttcattcattggatctctttccctcttcccaaatgtaaggcctcgggaatggttctctaatgtgttgaggacatatctaagaaaaaggcagacatcttggatcagcttatgtcacagatgtctgtgagatggctttggaaaacaaagcttttattccagaaatctccacctgtaattgagggcctgtgggaagatgctagacttaggtctggccattcattcaacaagaagaacttggaratttagatgtctgccataactgatttattgtgatgcttttttaagtttcttaattgtgtattggtagagatttccaaagatagttacgtggagaaagaaaagtatcaccccctcatttaaaggtgataaaaatgaattcttatcttctccctcccttttttttttggagacaccatctcactgtgttgcctgggctgacctgggctcagtctatcctcctacctcagcctcccgagtagctaggactacaggcgtgcaccaccacactcaactaatttttattttttttttgtagagatg

SEQ ID NO: 159752 - DNA, 601 bp, Human
attccagaaatctccacctgtaattgagggcctgtgggaagatgctagacttaggtctggccattcattcaacaagaagaacttggagatttagatgtctgccataactgatttattgtgatgcttttttaagtttcttaattgtgtattggtagagatttccaaagatagttacgtggagaaagaaaagtatcaccccctcatttaaaggtgataaaaatgaattcttatcttctccctcccttttttttttggagacaccatctcactgtgttgcctgggctgacctgggctcagtctrtcctcctacctcagcctcccgagtagctaggactacaggcgtgcaccaccacactcaactaatttttattttttttttgtagagatggcaccatgttgcccaggttggtctcaaactcctggactcaaccaatctgcttaccttggccccccaaagagctgggattacaggcatgagccaccctacttggccaaaatgaatgttttgtttctagtttgagtcatttttagatcagtaacactttttgcatttatatattgctaatatttcagagtgtcaaagtacctttacttgtggttg

SEQ ID NO: 159753 - DNA, 601 bp, Human
gaacttggagatttagatgtctgccataactgatttattgtgatgcttttttaagtttcttaattgtgtattggtagagatttccaaagatagttacgtggagaaagaaaagtatcaccccctcatttaaaggtgataaaaatgaattcttatcttctccctcccttttttttttggagacaccatctcactgtgttgcctgggctgacctgggctcagtctatcctcctacctcagcctcccgagtagctaggactacaggcgtgcaccaccacactcaactaatttttatttttttttkgtagagatggcaccatgttgcccaggttggtctcaaactcctggactcaaccaatctgcttaccttggccccccaaagagctgggattacaggcatgagccaccctacttggccaaaatgaatgttttgtttctagtttgagtcatttttagatcagtaacactttttgcatttatatattgctaatatttcagagtgtcaaagtacctttacttgtggttgcataagataattagagcttgatcttgttgataattatgaatacctgtaaaatgttctctaaaagtccctgatttctct

SEQ ID NO: 159754 - DNA, 601 bp, Human
caattctcctgtctcagcctcctgagtagctgggattacaggcgcatgccaccacgcccggctaatttttttttttttgtatttttagtagagacggggtttcatcacattggtcaggctggtctcgaactcctgacctcagatgatccgcctgcttcggcctcccaaagtgctgggattacagacgtaagccaccgcgcccggcctgagcccagctaatttttaaaattttttgtagagacaggatctcactattgttgccaagtctggtcttgaacggtccttggggtcaagtgatcgycccatctccacctcccaaagtgctgggattacagaagtgagccaccttgctcagcctgttgtggttttagaatctagaaggttgtgtccacctctttctgtttgacacagtcaaccaaccaaaataaagatgaagaataatatttttgatggaaacatcaaaggtatctagctttttaaaatagtacaacaaatatataacgggtgctcatcactattgtaaggctctagggagagagcagtgaacaaagcacaaagtccctactatcagtggagtttacaatctagtgaagagagaagc

SEQ ID NO: 159755 - DNA, 601 bp, Human
agataggatggtgcagcaaggcatctctgaaaaaaagatgacatttgaaaagagtccttccaggccgggcacggtggctcatgcctgtaatcccagcactttgggaggctgaggcggcagatcacctgaggtcaagagtttgagattagcctggccaacacggtgaaaccgcatctttactgtaagtataaaactcagccgggcgtggtggcacgcacctgtagtcccagctacttgggaggttgaggcaggagaattgcttgaacctgggaggcggggactgcggtgagctgagatcacrccactgcactccagcctgggtgacagagcaaagacccctgtctccaaaaaaaacaagagtcctgaatgagaatgaagtgggcagtgcaaaccttgtagctttccgtgggcagagctctgcaggcagaaggaatggtaagtacagaaccctgaaacaaaagtaaaatcactggcatgtttgaacaggtaatacaggataaattttatcttttttcagagacagagtcttactctgttgcccagattggaatgcaatggcatgatcatagctcactgcagccttaaaattctgagcttaacc

SEQ ID NO: 159756 - DNA, 601 bp, Human
aaaaaaaacaagagtcctgaatgagaatgaagtgggcagtgcaaaccttgtagctttccgtgggcagagctctgcaggcagaaggaatggtaagtacagaaccctgaaacaaaagtaaaatcactggcatgtttgaacaggtaatacaggataaattttatcttttttcagagacagagtcttactctgttgcccagattggaatgcaatggcatgatcatagctcactgcagccttaaaattctgagcttaaccagtccttctgcctcagcctccagagcagctgagactacaagtgctygccaccatgcctggctaatttttatttattgtagagacagggtctcactatgttgcccacgctggtcttgaaatcctagcctcaagtgatccttccgcctcggccttccaaagcgctgggattacaggcatgagccattctgccaggccagaacaaatctaaaaattcactttcttgaagtacttttgaataaacaaatttaattgtggcagttaagttggtcatttgttcatctgacattcatgcaactgagttcccacattatgttggggctgctaatgattgatctgaagggatagt

SEQ ID NO: 159757 - DNA, 601 bp, Human
tcctctactccactttcattacatttttacccacttaagaaaaccttcatgacttccccatacattaaatcatggcactcttcagccaagtatggaggaacctatatgatctggtcttgatctcctagcccactattctctcttcccatctctgttactttgctctcacaattcattttggcagatgcgccctcatcctactttgcctattcagatacacatatttttcaaggttcagctcaaggctcaggctctgggaaactcttggatggccacataaccccgtgactcccttcttaaytttctaacgtttaaggtgctgtctttgtgattcatttggcacttcagaggacagatgtttcagaatttgggattttttttggatgcatgtactgtggattatacaacatccccagtggggcttggggtagcaccctgtaatcaaacgtattgatatttctttagtgaaacaaatttgcatactaagtgagataaatctatgttgatagcctcaggcagttcaggctggttttgctgccaagtgagtttgccacaaacttgttaaaaaacaaacttttaagtttttttatttttggatttc

SEQ ID NO: 159758 - DNA, 601 bp, Human
ggcacaatcttggttcactgcagcttctgcctccaggttcaagcgattctcctgcctcagccacccaagtaactgggattacaggtgcatgccaccatgcccggctgattttgtatttttagtagagacgggattcaccatgctggccaggctggtctcaaactcctgacctcaggtgatccacccccctcagcctcccaaagtgctgggattacaggcgtgagcaaccgcgcccagcctaaaatagctttattgaagtacaatttacatactataagatttatccattttaagtgaactstttgggaaatgttagtaaatttatgtagattatgcatgtgtcaccacagtccaattttagaacactctgtcacccccaaaaagttccctcagtttgcacctaattttatcgtctcaccaacaagttggagaccataaagctcaattgataagattcccaggatttgtgatctgttggtaatcatgcacatctgacacttgtactctgtgtatgtgctgtttctgtgtgttttttcattttccttttaattgagtgggttcagactcctttttttcccatttttaatggacaaaattgtat

SEQ ID NO: 159759 - DNA, 601 bp, Human
ttttaatttgtcatctgttagatgtgaagttttttggtcagttataagcatattatgtgatttagttttgtttaagctttaaatatgaaaacttctagaatcataatcttagctgtcatcttctgaactctagaatttatctccctagatgcaaattcttagcactttgtagtatttgcgattacatgttgtacatgaaggaatttcttgtttctttaatctcagaactttatgtgggatatttatttgctgtttaaaattttaatttctcgttgtggggcctttttttttttttttttttaagacaggtcttgctccatcacccaagttggagtgcagtggcaccatctcagctcactgcaacctctgcccccaggctcaagacatcttcccacctcagccttccgagtagctgggactgaaggcacccactaccatgcctggctaattttttgggttggttggttggtttgttttgagacggagttttgctcttatcgcccaggctgcagtgctatggtgcgatctcagctcactgaaacctttgcctcccgggttcaagcgattctcctgcctcagcctcccaagtagctgagattac

SEQ ID NO: 159760 - DNA, 601 bp, Human
acaacagatggatgactttcagagagaataacccataatataaacggatttctttaaatgtaaatcactttttccgtaagtgaccagttatccaaaccttattttatattttagatcctatagcaatggaactcagcgatgcaaatctgcaaacactaacagaatatttaaagaaaacacttgatcctgatcctgccatccgacgtccaggtaaagaaaataaacgttttttggttgattaattccttcaggacaggtgagagaaacctatgtattatctgcctccttataaatatatttwaaaaaattcatacttgggttctcaagcgtagtttataagtgttacagctgctataccatggtgtgttgtttcttttttgagtaaaatagcttttatttggcatcttctgggattaaaaagtactagttttcggataaaaagtactgacatgtttagaatgctttgtctttgaccttttccaaaatacccacttaaaacatgcctgctttaggccggatgcggtggctcacacctgtaatcccagcactttgggaggctgaggcaggcggatcacgaggtcaggagatggagaccatcctg

SEQ ID NO: 159761 - DNA, 601 bp, Human
tgctataccatggtgtgttgtttcttttttgagtaaaatagcttttatttggcatcttctgggattaaaaagtactagttttcggataaaaagtactgacatgtttagaatgctttgtctttgaccttttccaaaatacccacttaaaacatgcctgctttaggccggatgcggtggctcacacctgtaatcccagcactttgggaggctgaggcaggcggatcacgaggtcaggagatggagaccatcctggctaacacggtgaaaccccgtctctactaaaagtacaaaaaattagccrggcgtggtggcgggtgcctgtggtcccagctactcaggaggctgagtcaggagaatggcgtgaaccccggaggcagagcttgcagtgagccgagattgcgccactgcactccagcctgggcgacagagcaagactccgtctcaaaaaaaaaaaaaagcctgctttagagataaaataattagggcatagaaaggagagtaattgcctaaaaagtgattaagtgaatgaagccaagtaatcagttactgtctcttaattttaattttctattgggtttgatttaactaatatattttaaga

SEQ ID NO: 159762 - DNA, 601 bp, Human
tgattaagtggcaagtactttttggaactagctaattttggggattcagactagttttgcaagatcagatttccagttttgcttgaaaaataaggatatttatatgaagtgccctcatttttaaatgttagcaagtaacttcaaaagattttggggccgggtgcggtggctcacgcttgtaatcccagcactttgggaggccgaggtgggcagatcacgagggcaggagatcgagaccatcgtggctaatatggtgaaaccccttctctactaaaaaatacaaaaacttagctgggtgtgrtggcacacacctgtagtcccagctgctcaagaggctgaggcaggagaattgcttgaacctgggaggtggaggttgcagtgagttgagattgcgccactgcactccagcctgggtgacagagcgagacgtagtcccaaaaaaaaaaatattttgaaacacagccagggttggtggtcacgcctttaatcccagtaatttgggaggccaaggcaggaagatcccttgagtccaggagttcgagaccagcctgggcaacaaagcaagaccctgtctctacaaaaaatttaaaaattagccaag

SEQ ID NO: 159763 - DNA, 601 bp, Human
ggtcggagctgcagtgagttatgatcatgtcagtgcactctagcctgggtgacagagggaaatcttgtcttaaaaaaaaaaaaaaaaaggccaggtgcatttgctcacgcctgtaatcccagcattttgggaagccaaggcaggcggatcatgaggtcaagagatctagaccatcctggccaatgtggtgaaaccctgtctctactaaaaatacaaaaattagctgggcgtggtggtgcacggctgtagtcccagatacttgggaggctgaggcaggagaattgcttgaatccaggaagcrgaggttgcagttaaccgaggccactgcactccagcctggtgacagagcaagactccgtctcaaaagaaaaaaaaaaattggacaggcacatttgctcacgcctgtaatcccagcactttgggaagcccaggagggcagatcacctgaggtcaggagtttgagaccagcctggccaacatggtgaaaccctgtctttactaaaaatacaaacattagccaggcatggtagcatgtgcctgtaaccccagctacttgggaggctgaggtgcaagaatcgcttgaacccaggaggtgaaggtt

SEQ ID NO: 159764 - DNA, 601 bp, Human
cccgggtccacgccattctcctgcctcagcctcctgagtagctgggactacaggcgcccgccaccatgcctacctaattatttgtatttttagtagagacagggtttcaccgtgttagccaggatggtctccatctcctgacctcgtgatccacccgcctcagcctcccaaagtgctgggattacaggcatgagccaccgtgcccggtggaaaaattattattattatttatttatttatttatttatttatttatttttgagacagagtctcactcttgcccaggctggagtgcagtggygccatcttggctcactgcaagctccacctcccgggttcaccccattgttgtgcctcagcctcccgagtagctgggactacaggcgcccgccaccacacccggctaattttttgtatttttagtagagacgggtgtttcaccaggttagtcaggatggtctcgatttcctgaccttgtgatccactcgtctcggcctcccatagtgctgggattacaggtgtgagccaccgcacccggcaattattttttttttaataatgtgtgaggcaagagttctgttgctttatgtattcaggacag

SEQ ID NO: 159765 - DNA, 601 bp, Human
gggtttcaccgtgttagccaggatggtctccatctcctgacctcgtgatccacccgcctcagcctcccaaagtgctgggattacaggcatgagccaccgtgcccggtggaaaaattattattattatttatttatttatttatttatttatttatttttgagacagagtctcactcttgcccaggctggagtgcagtggcgccatcttggctcactgcaagctccacctcccgggttcaccccattgttgtgcctcagcctcccgagtagctgggactacaggcgcccgccaccacacccrgctaattttttgtatttttagtagagacgggtgtttcaccaggttagtcaggatggtctcgatttcctgaccttgtgatccactcgtctcggcctcccatagtgctgggattacaggtgtgagccaccgcacccggcaattattttttttttaataatgtgtgaggcaagagttctgttgctttatgtattcaggacagagtataaaaataatctggtatttctgggaagttaggaacatagcatttctcagggatcgagactgactgactagactgactcaactagaccttttgagact

SEQ ID NO: 159766 - DNA, 601 bp, Human
actagactgactcaactagaccttttgagactccttgagtgcgcagaaacatatgcatgtgaatattgtgataagttgaaagaaatgaacacagaaaggaacagactcaaactcacttcctggatattgattacaatttaggaaagagacttggcaatttatatgggcttttcctcaaatcatggatgtagtgtgttgccctgtacaaaatgctggctactaagtggaggaaacaaattgttctgtactcatataaaaccatagtatgtcccctcctgaaaaacatttttcagtttaacartcttcatccttcaagaaagacatgataagcacaaagcaaggagagtttgaaaatatcagtgaaactcttgggactcagtcagaaagagggaaggtgttaaatgatacatgaaattaatttttcaaaaaatattggaatattgggtgttgccctatgaagccaaaggtagaaaaaaattaagagaaatactgtactgccatcacatgtgatcattaacctaggaaatttatcccagaatgtaatctgggttgaaaatctattggtaaattttttggataaattcattgctggtattaagaa

SEQ ID NO: 159767 - DNA, 601 bp, Human
tcccagaatgtaatctgggttgaaaatctattggtaaattttttggataaattcattgctggtattaagaagtttttaggtttttttttagttcgacaagaaagcttagggctggtaaggtaaaataaggactgcactaaaactttcagtagtgaagcctagctgtgtgatcttgaacaagttacttaaccttagtgccttggttttttaaatgctatctacttttctgggtaatagtgacaactaaatgaaattttataattttacatatataatatatatgtaaatcgttggacccatwtggctaataataatatattaggatgaattgactcatttgctcttcatcactagcctataaaagaaatattactactaatagtactaataatactcctttctgaaataagacctgggtatatgaagtcttgaagccacttaatctgcctgggaagcagcttctcttgcagatgagatgatcatccaattaggccactgtataggtttgtgagaatcatgtgagttaattgatggtaaagttatttgaaaactgaagcattatataagtttaatgtaacatatataatccacttaatagata

SEQ ID NO: 159768 - DNA, 601 bp, Human
agaaatattactactaatagtactaataatactcctttctgaaataagacctgggtatatgaagtcttgaagccacttaatctgcctgggaagcagcttctcttgcagatgagatgatcatccaattaggccactgtataggtttgtgagaatcatgtgagttaattgatggtaaagttatttgaaaactgaagcattatataagtttaatgtaacatatataatccacttaatagataagaaaagtgaggccctgtagacccacaaataacctaatcttttctctttttttgattttttwttatatatatatatttgatatatataaggtggaaagatttttatcttagtcttttaacatgaaaattcttttacagctgagaaatttcttgaatctgttgaaggaaatcagaattatccactgttgcttttgacattactggagaagtcccaggataatgttatcaaagtatgtgcttcagtaacattcaaaaactatattaaaaggaactggagaattgtaagtattttgtgaatacataatttaataccctgtatgtttataaggtttatataagcagtgttcttcaaagataaggca

SEQ ID NO: 159769 - DNA, 601 bp, Human
agcctgtgccactgggcctggccagtaaaacctgttaatcgcatttagaataataaagaattggaaacaacctaaataccaagtggcagatgaattgtttaataagagcatataaagatagttttgtgtaatatatttttatatatgcacagattgggaagacgtagttcagaatattaacactggactttttagtgccattatgaacagttcaaaaatacatactttaacctattttccacaatctcttaagtgactgtattatttaaaagccaaggctgggcatggtggctcacgcctrtaatcccagcactttgagaggccgaggcgggcggatcacgaggtcaggagatcgagaccaccatggctaacgtggtgaaaccccgtctctactaaaaatacaaaaaacaaaaacaaaattagccgggcgtggtggcaggcacctatagtcccagctacttgggaggctgaggcaggagaatggtgtgaacccaggaggtggagcttgcagcgagccgagattgtgccactgcgctccagcctggacgacagagcaagactccgtctcaaaaaaataaataagtaaaatatgaatagtctc

SEQ ID NO: 159770 - DNA, 601 bp, Human
cagctacttgggaggctgaggcaggagaatggtgtgaacccaggaggtggagcttgcagcgagccgagattgtgccactgcgctccagcctggacgacagagcaagactccgtctcaaaaaaataaataagtaaaatatgaatagtctcagcttagtgcaaggctgtttcactaagatcagcatgctgggtttatgatgcactaaaaccatgttgctaaattcctttccaaggccactattgaactctgcagtacccatgcaaatgatgcctctgccctgaggattctgttttcttccctsatcctgatctcaaaattgttctatagtttaaactttcaggtaagttcatttgatttcttgcttttggttcttactctttgattttaaatagagttttctttctgtttgataaagacttctttgccagcattgatttttctgaaagaaaaggttttttctgactctatttatctatagtgttctgttctacagtagttctttcagatgctaatgagatgtttcatggaaaaaagcagtattctcttatatctagtaggttagcaaaaccccacatcctaactcactcttggagagtcaccc

SEQ ID NO: 159771 - DNA, 601 bp, Human
gttctttcagatgctaatgagatgtttcatggaaaaaagcagtattctcttatatctagtaggttagcaaaaccccacatcctaactcactcttggagagtcaccctgtacactgttttactggtggcattaagaagctagatttctgaggccttcctctttcgttcatttatatgggtattaacatttggggaatcatgttttggttaggggttgctgtccagcttatacaaaatgacttttattggaagccatatgagggagacaaaagacttgaagtaccagactttgaaaggggtargaactagtagtatttcagaggaaacatagccacagggctatagcagggaatgcctagttaccctgttgctactgagatagtggcctccaatcattctttctgttcttaatcattaattcaagattcaggaccaagaaaggggtgttaattggtacaaactgttgctatactgcgatgcaaggagggcctagcccattcattgtttgtagccagtacctggacttatcttcacaacatgaataaactcatagtggtagggaaagcattccccaaaaggaaattgggttgttttagctagaa

SEQ ID NO: 159772 - DNA, 601 bp, Human
atgcaaggagggcctagcccattcattgtttgtagccagtacctggacttatcttcacaacatgaataaactcatagtggtagggaaagcattccccaaaaggaaattgggttgttttagctagaataggagatgaacagcccaaaaggacatgtcccacatcagtgttcagctggatagcagtttgagaagttcttacttaaatgagtactactatttttgcttacaccttttgaattctgagaagtcaggtttaatgaagctcttgagaacttgtctggcagggagaccaaggaaagargcataatctaccctcaggggacttgtaccctcattaagaaggcagtactatgccacaagaaatcagtaactaaaagacaattagtttatctgccttggtggtcatcttacaataaacgtagttcagaaaagaaaggggatgtattagtatgcactgagcttgagctttgtaaggaaagtcttcatatagtcttagctgaaccttgaaggaagatttagattaggatgagaactagaggtggcatcatttatagcatacaaacagaggcagaagtcagaatgctttatgcagctgccagat

SEQ ID NO: 159773 - DNA, 601 bp, Human
atactgtaataatatttgattctatttgatgttacatgtttggtgtgtgtagtatacagaattactcttatcatgggcttggcttaagccatagtgtacatataaggctgtttcattacattattgaaagtaggtctttaaagtagtgacattatggatatttcatgaaataaaattatttttcattgaagatactaagaaaacttaaaactctataatggtagcccctttttaaaaatcatctggctaggcatggtggttcacacctgtaatcccagcactttgggcggccaaggtggggaggatcccttgagcccaggagttcaagaccagccttggcaatgtaaggagacccccatcactacaaaaaataaaaataaaattagccagatgtgttggctcatgctaatggtcacagctactcagaaggcttagttgtgaggatcccttgaccttgagcccaggagggcaaggctgcaatgagctgtgaccatgccactgcactccagcctgggagacagagggagacctcgtctcagaaaaagaaaaaattatccacagctcgagaaagagagaaaatggtaaaagattgtaatttgta

SEQ ID NO: 159774 - DNA, 601 bp, Human
tgtagctctcataaaataattatttcagtccaatgggagggaaaaacactccttcagaaaacaaaacttttcttcacacaaaagtcacaaggaaattttttggatagaattcttacaaggacctttttgcccagttaaccatgtgctaccttgtgctactatttatgccttaagtaatcagtgtgagggagttttggttttggctttggtttttgttcttactctgatgtcttcccttgtctcactctgtcaccaaggctggagtgcagtggcatgatcatgacttactgcagcttcgacstccctgggctcaagtgatcctcccacctcagcctcccaagtagcagggactatgggtatgcaccaccatgcccagctgattttttttattttgggggcttgctgtgttgcccaggctagactcaaaactcctgggcttggcccgtcgcagtggcccacgcctataatcccagcactttgggaggccgaggccatcctggctaacacggtgaaaccccgtctctactaaaaaaaaaaaatacaaaaattagccgggcgtgatggcgggtgcctgtagtcccagctacttgggaggctgagg

SEQ ID NO: 159775 - DNA, 601 bp, Human
ctggctttatttatttatatatttatttgagacaggggtctcgctctgtcacccaggctggagtgcagtgatgcaatcttggctcactgcaaccttagcctcccaggctcaagtgatcctcctacctcagtcttctgagtagctgggaccacaggcacacatcaccatgcctggctaatttcttgtatttttggtagagacagggtttcaccatgttgttcagggtagtctcaaactcttgagctcaagcagtccacccgctttagcctcccaaagtgctgggattgcatttctgagccayctcgcccagaaatagctgtttttaaacaatcgacttgagaatagaaatgataactttataaatacaaggttgaagcccacttagtttgtgcttaaggttaaactatagtgctaagagcctatatttataaaatgtatgtccttgttctaacagttgtgaagaacaagtaatgaaggtgggagggattgtgttttttgttttggggacagggtctcactgtgtcacccaggctggagtgcagtagcacagttatggcttactgcaacctcaacttcccaggctcaagtcattgtcccatcc

SEQ ID NO: 159776 - DNA, 601 bp, Human
taactttataaatacaaggttgaagcccacttagtttgtgcttaaggttaaactatagtgctaagagcctatatttataaaatgtatgtccttgttctaacagttgtgaagaacaagtaatgaaggtgggagggattgtgttttttgttttggggacagggtctcactgtgtcacccaggctggagtgcagtagcacagttatggcttactgcaacctcaacttcccaggctcaagtcattgtcccatcccggcctcctgagtagctgggactacagacgtgcaccaccatgctcagctarttttttattttttataaagatgggggtcttcctatgttgcacaggctggtctcaaactcctagcttcaaacaatccttctgcctcagcctctcaaagtgctgggattacaggcatgagccaccatgccaggccaagattttgttttatatcaaaatagttattagatcagtggttttcaaattacatctggaacaaaataaggaaattaaggacaatatagcgtgagattttatttcctgttgtgttttcataaaaatatgtttaaaggataaatcttctggctgggtgtggtggcccat

SEQ ID NO: 159777 - DNA, 601 bp, Human
gggattacaggcatgagccaccatgccaggccaagattttgttttatatcaaaatagttattagatcagtggttttcaaattacatctggaacaaaataaggaaattaaggacaatatagcgtgagattttatttcctgttgtgttttcataaaaatatgtttaaaggataaatcttctggctgggtgtggtggcccatacctttaatcccaacactttgggaggctgaggtgggaggaacacttgagcccaggagttaaagaccagcctggccaaaatggcaaaaccttatctctacaakaaataaattagttgggtatggtggcatgggcctgtggtcccaggtactcaagcagcttaggtgggagttttgcttgagctcaggaggtggaggctgcagtgagacatgatcatacaactgcagtgtgtgtgtgtgtgtgtgtgtgtgtgtgtgtgtgtgtgtgtgtgtagactttttttttttttttaatttatatgataaaaatagagatgagatctcgctgtgttgaccaggctggtctcaaactcctgggctcaagcgatcctcccatttcagcctcccaaagtgctaggttacacg

SEQ ID NO: 159778 - DNA, 601 bp, Human
ttctctttctagtaaatgggagaagtgggattgagaataagagtgttttttcagcgggctttcattgagaactgttgtctttcttcaacttgtcttaaaaagctcttatatgacctgaatgaaaatatcaaaagttgaatcatttgtctgttcttacatagtatttatcaaaattctgtgattctgtgacctctttagtttcattttgattttgtatttcttgggggcgggaatgtttttttcattgtttgtgttgctgatagctattgggtggccctttgtttttcgttcttttttttcygttttacaatcgtagccaaattattccaggcaatttgttttcttataaattggatcagcttgttggtggttgttttttttccccataatatattttcttttcatttcatagatattgatactagacgcagggctgcttgtgatctggtacgaggattatgcaagttttttgagggacctgtgacaggaatcttctctggttatgttaattccatgctgcaggaatacgcaaaaaatccatctgtcaactggaaacacaaagatgcagccatctacctagtgacatctttggcatcaaaag

SEQ ID NO: 159779 - DNA, 601 bp, Human
agacatcagtgacacccacacaagtcaaaaagaaataacgtctctgataatagagcttactctgccagataacctattctgattaagatttatataatctctgaagatggctttatgttgatgtattgagcacttaagtttcttatagaccagaaaattgatagatggccacacttgttaccttagctgagacccgctgtatcaaatatgcttaacttaaacttagctgttctttaattgaggaaagtttctttattgtctattagtatagtcttattttacatttttatatttttgagayggagtctcactttgtcaccaggctggagtgcaatggcgtgatctcagctcactgcaacctccacctcccgagttcgagcgactctcctgcctcagcgtcccaagtaactgggattacaagtgtgcactaccacacctggctaatttttgtatttttagtagagacaaggtttcaccatattggtcaggatggtctcaaattcctgacctcgtgtgatcctcacacctcagcctcccagagtgctgggatacaggtgtgagtcaccgtgcctagacagtatagtcttattttatattttat

SEQ ID NO: 159780 - DNA, 601 bp, Human
ttatgtaccaccttctcatctactgtgcagtcattttatatccacatctaacaaaattaacaatgatttctttataacttagaattttagaccatgcttaattttcctcagatgtctttttgcaataatagtaatagaattgggatctagataatgtccacacattgcttacagttgattgtgtcttaagtctcttaatttacaatagagaggtccttctctgccactttttgtttgagatggagtctcattctgtcacccaggctggagtgcagtggcaccatcttggctcactgcaacytctacctcctgggttcacgtgattctcctgtctcagcctcccaaatagctaggattacaggcacctgccaccacacctagctaattttttgtattttcagtagatccggggtttccccatgttgaccaggctggtctcaaactcctgacctcaggtgatctgttcacctcggcctcccaaagtgctgggactacaggtgtgagccactgcacccaactgccttcctttccttttatttatttatttaaaaaaaatttttttttatttttttgagacggatctcactctgtcacccaggct

SEQ ID NO: 159781 - DNA, 601 bp, Human
ggactacaggtgtgagccactgcacccaactgccttcctttccttttatttatttatttaaaaaaaatttttttttatttttttgagacggatctcactctgtcacccaggctggaatgcagtggcctgatctcagatcactgtaacctctgccttccgggttcaagtgattctcctgcctcggcctccctagtagctgggattacaggcatctgccaccacgcctggctgattttttgtatttttagtagtgatggggtttccccatgttggccaagctggtctcaaactcctgacctcwggtgatccaccagccttggcctcccaaagtgctgggattacagctgtgagccactgcacctggcctctaccctttcttatgcttgttgttggagaaaacactcatttatcttagagactttctcacattttacttttggctgattgcaccttgaatctctcagtattcaaggggtattggttccaggacgcctgaatatcccaaaattgatgaatacttaggtcccacatttgggcctgcggaatcctcatatatgaaaagccagccttccacatacagattttacatcccaggaatact

SEQ ID NO: 159782 - DNA, 601 bp, Human
gcctcctgagtagctgggattacacgtgcctgccaccatacccagctaatttttgtcttgttagaagagacagggtttcaccatgttggccagactggtctcaaactcctgacctcaggtgatccacccctgcctcggtctccgaaagtgctgggattataggcgtgagctaccacgcccggcccatttctttattttttgaaacagggtctcgttctgtcgcccaggctggagtgcagtgacatgaccacagctcactgcagccttgaactcctgggctcaagcagtcctcccactttcrgcctcccgagtagctggaacccaggcacgtgccaccacacccagccatattgcattacttttaaaaaatcaattgagaaaaattatagagaatacctgcttccccagttagagtatgttggaattttgccaatcttaaatggtatctcattgcagttttaatttacgtttgttttattttgagttcagttaagcatctttccacttgaagggtccattttcatttcttttcggtgaactgtgaattcatcttcttttgcccatttttctatctgattattggtcttaatttttagagaac

SEQ ID NO: 159783 - DNA, 601 bp, Human
ccacagctcactgcagccttgaactcctgggctcaagcagtcctcccactttcagcctcccgagtagctggaacccaggcacgtgccaccacacccagccatattgcattacttttaaaaaatcaattgagaaaaattatagagaatacctgcttccccagttagagtatgttggaattttgccaatcttaaatggtatctcattgcagttttaatttacgtttgttttattttgagttcagttaagcatctttccacttgaagggtccattttcatttcttttcggtgaactgtgaattyatcttcttttgcccatttttctatctgattattggtcttaatttttagagaacgtgtagtttttcttctgattctgaatgcctaggtcactttaattgtactgagaaaaaaatcaaaacttgcactcatcttatttctttgatgtctttgcccagtaacaatggtgccatcttgcaaaatattttaaacacacaagcaggaataaaacaatatgatgattactgaaataatcctcacaaatcttaaaactccaggccatatttatgtatacatacatatacaatggaggtattccaggtg

SEQ ID NO: 159784 - DNA, 601 bp, Human
ttaattttttttttttagatggagtcttgctctgttgcccaggttcaagccatgctttttttatactttcactatgtgtttatgtttctgcagaaattatttagtatgctgtaggttttaatttttttttagatggagtcttgctctgttacccaggttcaagccattctcctgcctcagcctcccaagtagctgggactgcaggtgcccaccaccacgcccagcaattttttggtagagacagggttttgccatcttggccaggctggtcttgaactcctgacctcaggtgatccacccrccttggcctcccaaagtgctgggattacagtcgtgattcaccacgcctggcctaggttttaaatttttgtttgtataaatgacatcatactatgggtttcatttttctgttttttgttacttgtttgttttgagacggagtcttcgctctgtcgctcagtgcagtaacacaatcaagtcatgcagtggcacgatcttggctcactgcaagcttcacctcctgggttcatgccattctcctgcctcagcctcgcgatagctgggactacaggctaccgccaccatgcccggctaatttttt

SEQ ID NO: 159785 - DNA, 601 bp, Human
agcctcccgagtagctgggactacaggcgcatgccaccacgtctggctaattttttgtatttttagtagaggtttcaccatgttagccaggatggtcttgatctcatgacctcgtgatctacccacctcggcctcccaaagtgctgggattacaggcgtgagccgccactgcgcccggcctaacatcatttttgagttattcatttagtgcctaaagcgatccagctacctcagcctctcaagttgctgggactacaggaattcactaccatgcccagctaattttttatttaattttttyttaatagagatgaggtctcactatgttgcccaggctggtcttgagctcctgggcttaagcaattgttctaccttggcttcctgaagtattgggattatagacaggaatgaaccaccacacccaggaggcttttctagtttagactaatgaatgtttcaaatttagaggtttttaatgaagattgttctcgtatttgttgctttttgggggtgggaagagaacaaaaaatgagacacaaaaaggttaaataactttttcaagaaatatctgctagtgatgattcttaagtttggtgaaatc

SEQ ID NO: 159786 - DNA, 601 bp, Human
gcctaacaatgccactctgtgagtattttattctaaagttttttagcctggggtaggggctgtactgtgctggtcaaagatatctgaatgttttcataatttcactagtgggaaaacaaatgtctgctttctattcctttatactctgtttcattctaaaagcatttgaggctgcttactaaaataggtgcattatgacaatacaatttaataaactggagccaaggaaagtaactgagataaagttaataaacagaaatgtgtgtcaaaggatcctatatagtagtccaagaaactccarattttatttggagtctcttagcagccagggcaaagagggaaacttgggaagttaaaattttcacagggtctatgagataaaagttaaagcagagaatactgtacaatagtagtagtagtgttctcagcaacaatcatgtaacagttattttcatgtggctatttgcgtaaggtcacttatttctgagatatgacctaaccgaatgaaagtaattcactggggaccaagaaaataggtcttctggcctgaaccaggatgaaatgtagaggaatggatggtctgcatgtctttcaggccact

SEQ ID NO: 159787 - DNA, 601 bp, Human
ttagcctggggtaggggctgtactgtgctggtcaaagatatctgaatgttttcataatttcactagtgggaaaacaaatgtctgctttctattcctttatactctgtttcattctaaaagcatttgaggctgcttactaaaataggtgcattatgacaatacaatttaataaactggagccaaggaaagtaactgagataaagttaataaacagaaatgtgtgtcaaaggatcctatatagtagtccaagaaactccaaattttatttggagtctcttagcagccagggcaaagagggaarcttgggaagttaaaattttcacagggtctatgagataaaagttaaagcagagaatactgtacaatagtagtagtagtgttctcagcaacaatcatgtaacagttattttcatgtggctatttgcgtaaggtcacttatttctgagatatgacctaaccgaatgaaagtaattcactggggaccaagaaaataggtcttctggcctgaaccaggatgaaatgtagaggaatggatggtctgcatgtctttcaggccactattcaacagtattatttcttgaaatgagctttgggtaagaga

SEQ ID NO: 159788 - DNA, 601 bp, Human
cagtattatttcttgaaatgagctttgggtaagagatggaaaacagttctaggttctttccttcatcaagaacttgaagtacagatactctcagtggccaattaagggtagaaaggacatcctttgaggtgagtcaagccagtacctatcttcaggcccagaatttatgcagaaaacagttctgaatcttggctccacctccaaaaacaaaataaatgacagagtcccctgagattctgagttctttctcagtggtaatagatataaaccagggacaactgtttcaacttcagatgttgtygggtttagctggctttttggttcagttgtgtttggttctcgatgtgccttcttaggagcctaacatgagcacatgtaaaaaaattattttcctaaactgtctatcaattgtcagtggtgggagatggctcagttttatgctgagaagggtgacatagtggttgccaagggtaatctgcagtgacaagctcaagagttggtagtgactgaaagctgttttttcatctatagctttacagctgcagaaatcgcaccgtttgttgagattctgctaacaaaccttttcaaagctctcacactt

SEQ ID NO: 159789 - DNA, 601 bp, Human
atgaaccagataatgtttaccaagtagtaagttagtttagatatttcaaaatgaaaaacattatcttgtttactactaacaataatttttttttttttttttttttttttttttttgagatggagccttgctctgttgcccaggctgaagtgcagtggcttgatctcagctcactgccacctctccctcctgggttcaagcgattctcctgcctcagcctcccgagtaactgggattacaggtgcactccaccatgcccggttaatttttgtatttttagtagagacagggttttgccatrttggccaggctggtctcaaactcctgacctcaaatatctgcccgcctcagcctcccaaagtgctgggattagaggccactgcacctggccaacagtaatcttaatttgatatggaacttctcattacagaaaatgtagcaaagcccttttttccttccctagattgagtttctttaaggcaaagaagagatcatgcaacgtttattaactgcatgctcacctaggtaggggtgaaatgtgggtgcctgtggtagactctgcacaaatcgtgtcttcttacgtactgccaaggacacaggc

SEQ ID NO: 159790 - DNA, 601 bp, Human
tgcatgctcacctaggtaggggtgaaatgtgggtgcctgtggtagactctgcacaaatcgtgtcttcttacgtactgccaaggacacaggcagctgtatccatccacaggctggtgtatccatccaccaggcactacattagttgagtgtcctggtgccagctctgaatttagagatagtctcagtgtttttcactgttgcatcccaaaagcctagcacattgggttgtaggaagcacttttcagagaaactccctgatcttttcagtctggatcagaaatcctagagtggatgtgtgtawctgggtgtatgtttccaacactatccttcccccaacaatgatgtataattgtgtaattattgttgtttaatgtcctttttttttttttttttttttttgagatggagtttcactcttgttgcccaggctggagtgcaatggcacaatctcagctcactgcagcctcactctcctgggttcaagcgattcgcctgcctcagcctcccgagtagctaggattacaggcgtgtgctaccatgcccagctaattttgtatttttagtagagacagggtttctgcatgttggtcaggctggtctt

SEQ ID NO: 159791 - DNA, 601 bp, Human
acatgatgtgcagagttcaggaggcaagagcagatagctttctgtcctttatgcttggcatgtatttggggctctgcttagtaaacatttattttagaaatgttatttgtggaaagagagcttttatacatttttagctgacaaatttatttttctcccatgcttcctatttttaacccatttatggtcttttgagcaatatttttgcaatttggactctgtggctttacatgtatttttagaatttttttaggctcctaatctctttttttgagggaggtggataggcagttttctcttmagtttcctgtagtttgtgatcatgtttcctttaggctagggctaaacattttctgatgctggtttctttttctttttcttttttttttttttttttgagagagagagggagtctcgctctgtctcccaggctggagtgcagtggcatgatcttggctcactgcaacctccacttcccaggttcaagcgattctcaagcctcagcctcccgagtagctgggactacagacgtgcaccacatacctggctaattttgctatttttaatggagatgggttttgccatgttagccaggttggtc

SEQ ID NO: 159792 - DNA, 601 bp, Human
catgtatttttagaatttttttaggctcctaatctctttttttgagggaggtggataggcagttttctcttcagtttcctgtagtttgtgatcatgtttcctttaggctagggctaaacattttctgatgctggtttctttttctttttcttttttttttttttttttgagagagagagggagtctcgctctgtctcccaggctggagtgcagtggcatgatcttggctcactgcaacctccacttcccaggttcaagcgattctcaagcctcagcctcccgagtagctgggactacagaygtgcaccacatacctggctaattttgctatttttaatggagatgggttttgccatgttagccaggttggtctcagactctagcctcaagtgatccgccagcctcggcctcccaaagtgctggggttacaggtgtgagccaccaagcatggcctctgctactgatttctaagagaaagagaccccaaacagttctctctcagactcacctgctccattcatgtcagctcactgtttcttcctcttagtcaacctctttaattattttttaaaccttgagccttctagaaatactcagtatt

SEQ ID NO: 159793 - DNA, 601 bp, Human
gttggagggattttggagaacagagtgattattattcaaccgagttagggctaagggtctttggactacttagggccttgagggatggagcggggagggaacccaagtctccgcctcccatatgtattaccatctcatgttctgattgagttagatttgtatgctagtagccttccaagaacttgtttaaagaaaaatggggttttgttgcttaaaaagaacataaaaaactactcatttgggggattatcagtaagtagacatagacattgaggcccacagaagttaaggctagtggcaytactaggacttagtatttcttctctgcgagggcacgtgggcttaagacaagttacagctctgggatctgaggtttgtataagcaactctgtaactctgaagtatttttttcatggtggactttgggccatttaaaaaaaaattcaaatgaacaagcactagggtataattggtgtttttttcttaattttgatttttaaaaaataagatggcctctattttaaatgtgttttataaaggttaggtgtggattattagcataattaggttttttttttttaatttcagaacccaagcaaac

SEQ ID NO: 159794 - DNA, 601 bp, Human
ttagaattgccataccctttgagccatatttccacttcaaagaattggttctattaacgcataaactgaggattttgcatcatttagaattacggaaaacttcacttctagcatgtttgcaacaacatagaatgattggccgaattattttaaatagccattagcatttatgtacctgcaggtatgtaagcaaagacagttgggaagcttataacccaaaaatgttaaaactagttgtttctgggtggtgggatgattccttttttccctccttgctcctctctcttttttttttttttttctttttttttttgagactggccaggtgtaatttttaaagaaaaaagcagagagggccaggaatggtggctcacgcctgtaatcctagcactttgggaggctgaggcaggtggatcacctgaggtcaggagttcgagatcagcctggccaacacaatgaaaccccatctctactaaaaatacaaaaatttgccgggcgtggtggtgggcacctgtaatcccacctactcagggggctgaggcaggcaaattgcttgaacccaggaggtggaggttgtagtgagctgagatcacaccgttcc

SEQ ID NO: 159795 - DNA, 601 bp, Human
cccaaagtgctgggattacaagtgtgagcctggacacagttatttttttttaattgcagcatactcagaaattaatagatcatggcataaacctaataatgactgtatagttgcattttgtcagcacttattatagagttcttacatgttacctgataaaatatatatttttcaagccagacacagtggtttatgcctgtagttctagtgctttgggaggccagggctgcagtgagctattacagtgccactgcaatccagcctgggcaacagagcgaggtcccgtttcttaaaaaacatrtatgtgtgtggcgtgtgtatatatatgtatatatattttttcattgtattattacggagactttcaaacatatatagaaagagcataatgaagcctgcatgtgcccagcttcaataattaccaatatcttgccagttttgtttcgtttctccttttattctctgtattgagcaagtcttagacatcatacgtttcacgcgtaagtaccttattctacatcattaaccagtaaggactttttaattaaccacaataccactatcacacctaataatagtaattccttatggatcttttctt

SEQ ID NO: 159796 - DNA, 601 bp, Human
tggtgattaatgacttgactggctgctcttcccagagctgtggcagctctcccgtagaagatggggtttgtattggcgcaccaagatctccaacagccagtgtgtgtttcccatctcttgtaggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttytccttttgaacttgtcacgaattccatcttgtaaaggatattaaatgttgctttaacctgaaccttgagcaaattagttggtttgtgtgatcatacagttatgtgggtggcttctagtttgcaacttcaagggacaagtattaatagttcagtgtatggcgttggtttgtgttgagcgtttgcacggtttggataatcttaaattttgacggacactgtggagactttctgttactaaatccttttgttttgaagctgttgctatttgtatttctcttgtcctttatattttttgtctgt

SEQ ID NO: 159797 - DNA, 601 bp, Human
tcgtacaatttgacagtgataatccctacttattttcaggcagcgttgtaatggtagaatgccggttttaaagtaatgtttgtatggtacttgtgcaattgacattattatatatttaaagattatctttataatcaaataatattcatttgagtgtcaaatatgtgtttggtatattggagaaatttcctttatggtccctgaatgaaaacatttgtctaatctgcatcactttctgctgaaagagcctgacaaatagtaggcaaatgtggattgatctagatatctgtctctgcctatctatgtatcccttcttccatacaactagaagtctgggattcatggagaggtcagagaagaagagtttcccataatatcccaactggagatgatatagttaactatttgggacatcctctcttcagaaggcattatggtagaaggtttggcaagaagccacttcttttgctcgatattagctctttgatttacttacccgttgattacagtaactgcatgagactactgacactgaacattgcttaaatacttgctgctgtcctataggaatgggttggatggaaaaattccatagaggagt

SEQ ID NO: 159798 - DNA, 601 bp, Human
tttggttacctgtccctgcatctaaaggatcaacagccataaaacaagaacaaaacaaaacaacacccccagaacttagtgacttgaataacaataatttgttatttatcgtgatcttgtaatctgggctactttcggctgcttgactcctcctaggctgctggagatgagacattcaagaaagcatcttccttcacatgtctagaacatcagcttggatagctggaaagctcatggctggccaagcatccatctctccgtatgtgacccctatacatgactaacttggactttacataaygttggcctcaagtagttgtatcatttaactaattattgactttcaggatcccccatagcttatctcgttatggcatcaaactcagactttaagtctctaaactggatctccagatgaggatgatatttctctgatgtagtttcttgagtgcagcaacctgtagctaaaaagataggttatctgtgaccttccccttgtcccaacatacaatggtaaaacaaaaataggacaattgctttaaaaaaataccatttcaaaacaagacaatagaaggcatataacagttgctagtccatagca

SEQ ID NO: 159799 - DNA, 601 bp, Human
agagctcagaaaagttgccagaccaaagatttttaaaaatcaataacatttttcaatagtaaataaagcattagctaacataacacaacagtaaaacaaaccagcaacacaaccttccccagtaggagcacgcttgctgcaattaaatatggtttatttgaggattgtctggatggctcaacatcagaaaatctatcaaaataatcttaaggatataggaaaagttagtgtcaagttctgagaagaataaaaatagattggattttccaaaactgactaaagtatatctatgaaaaatctrtagtaaacaacaaatttaatacagggctcagaaaaacattttttgttttacattttgggagacgatgaggatgccagtgttggcacaactattcagtaaagtgatgaagacaaaaataataatcaccattcatttgtattgagtgtttacctatgtgccaagcagtataaaagcaaaagtggtggattagccattggtgcaaggagatggtgaaactcccatcttcctactcctccaaggtagaggtgataattgaactacagtgagccaggatgaaatggagttgtcacagaaaattgt

SEQ ID NO: 159800 - DNA, 601 bp, Human
aaaaccctccaaagaaatccgacatcttagactacaaaaaatgcagccatcttgggaaacctgtagcaagtacacccagcagaaagggtcaaaatcttaaagattgtgacaaatctgtaatcccacagaagggatgaggcatgccaagtgtttgatgtctacaaaaaccattttccttagacaaaagctgaaaggcataggagaagtaatataaagcagaaaaaatgaaaagcaaaaattataaagaagacaagaatggcaatctatttataataatagttttgataacaaccatttagawaagaatagttaatgaggccagtgaaagaggagataaagtactaaaacggactattctcctattgtgaggacaggatctctgttagctctgtctcagataatttgtacagcccaagtggagaaggaagaaccagcagtgctataaaagataagttctgctgtccaatctagggagaaaaaagcaaccacattgaccacattagagctcaggagtccaaacactgctagttgccaaataaactttattaatagagacgacctcccccttagcagttttataagcactattgcttttttatat

SEQ ID NO: 159801 - DNA, 601 bp, Human
cagtgcgagaatggactaatacagacatctttgtcaccagctgctaggaattttcagctccactataatcttatgggaccacctcattgtatatgcagtatgtcattgactgaaacttcattatggggcgtgtgactttaaagccacagaaataaatccaagcatctggcttcttactggtaaagtgaatatatacatttcattttcactttcagttataatttctaattaacactctcagatagaattctgtagcatgtatactagatcaagataaacagtagaataagtaaaggacttyaaggaaattgaaacattttataagaactccaagaggaaaaaggcagtttatttttccatcatttttagtatgagaaaataaaataaatataaattcaaagaaaaaacacggaaatcatgctctttgacagtcattatttataaactgaaacttaccccttaacttcataaacttcctagaaattattgtttcttggaatttttttttttttttgagacagagtcttgctgtgttgcccaggctggagtgcagtggtgcgatctcggctcactgcaagctccgcctcccgggttcaagcca

SEQ ID NO: 159802 - DNA, 601 bp, Human
aagatagaatatgggagctcctgaacagctgaacttgtggaagcttgcagaaaggtgaagaagaactcatccacgtgcgggtgggtggcacatcccatttacacaggaatggaagtgcttgtgctcaggaccctttagacctcaccctatgcatctcttcatctgactgtttatttgtatttttaaaaatatcctttataataaagttgtaaatgtatttctctgaattatgtgagccagcctaacaaattaatcaaacccaaggaccgggctgtgggaactctgatttataactgatcgrttagaagcccaggcaaaataacctggggcttgtgggaactgagcctccaacctgtgtgatctgatgctgtctccaggtagatagtgtcaggatgctatttccaggtagagagttgggtgtccactgcagaactgattgcttgcttgttggttaggagaaatccccacaaacttggtcacagaagttttctgtattgattgttgtggtgtgagagtagagaaaaaactgtttttccacccagcacctatggtttaattcatacctttttttttcactctgtatgccacttactttaaaaaa

SEQ ID NO: 159803 - DNA, 601 bp, Human
tcttccttttttctctttgccttcccacccactagctgatatgccaacttgcatcacatcctttttctcctaagggcaacctcctgtttagcctccattgacaaatcatatttccattctctaccatggtagaaactcaatttagaccaactttcattttcatgattgaagccttaggaaagctagacaatagggatttacaaacaggagattacactggtttattctaagaggagcctaacttcgtgctaaaaacgtgaatgcaagacaggctgcctagtttcttgttctgggctgtcayttactagatgtgtcactttaggtaaataatgtaatttcttttttcctcagatttgtcatcttaatggcaatctgttacaacaactttataagaaagggattattttatcatcattttatgatgataatttaaatgtcatttaaaatgatgacaaaatagtccctttcttaaaaagttgctgtaacaaaaaattagttaagaacctaaaatagtaactgaaaagtaataaatatttggtatctgttagctaataccaaatattaggaggctaaatgaaaaatgtaaagttggaaatgcagg

SEQ ID NO: 159804 - DNA, 601 bp, Human
atttagaaagttttaaggaattaaggcaggaagggataggctaactctactgttttgtacaaatgcagtcaggtttatgatcaacaccgccctcatctataaagctgctaatctaagagccttgaagggaaaagataaacaccagctgccagtcttttgcttttacaagacaacctggacaatgagaagccctattctgcatttgttttatcagtgctttgtcaggaggtaccttgcaagtaaaattcttttgattttggacaatgcccttggccacccagaactccatgaattcaagatygaaggtgtctaagttgtctacttgatcccaaacacaacttctctaattcagcctctagatcaaggggtcataaggactttaaactcattacacatggtactttatggaagggattgtcagtgacatgaaagagagccctgatagaaaggacatcatgaaagtctggaaggatcacacaattgaaaatgtcgttgttattgaacaagccatgaaggccattagcccaaagcaataaattcctactggagaaaactgtccagatgttgtgcgtgacttcacaggatttatgacagagccaat

SEQ ID NO: 159805 - DNA, 601 bp, Human
ttatcaataaggcttctggtcaacagtaggctattagttttgggggagtcaaaacttacaggtagatttttgtctttgccggggatcagtgccccagcccgagttgttcaaggagctgtacttgcagttgtaggagtgaggtaccagttttcttgctggctgtcaacaggggctgctcaccactcctggaagctacctgtgctccttctcatgtggctcactcacttcaaaccagcaatggcatgttgaaaccttcttatgatttgagtctttctggctttcccttctcctaccagccagmtaaagttctctgcttttaagggcttgtatgattagattagtcaccccttctatgtaaaatctctctatgttaaggttaactatgccatgtaacatgaaacaatcacaggagtgatacgttgtcacatgcacagttagtgtgagatattctgtgggagaaggggcataattctgcttaccatatcatattgctcaaaacagtaattggcagagttagaggtcaagcctgggtttggttgaactccagagctttgtctctataccacattcatcagagggcctaattttatctgtggtgata

SEQ ID NO: 159806 - DNA, 601 bp, Human
atgattagattagtcaccccttctatgtaaaatctctctatgttaaggttaactatgccatgtaacatgaaacaatcacaggagtgatacgttgtcacatgcacagttagtgtgagatattctgtgggagaaggggcataattctgcttaccatatcatattgctcaaaacagtaattggcagagttagaggtcaagcctgggtttggttgaactccagagctttgtctctataccacattcatcagagggcctaattttatctgtggtgatatggaaaccagtcttagtcctatatagcyaggctatgttggtcccatatgctgctataaatatattgcctcagaggtctccagcacagttttacatgcacactggtcctgtaaaataggagatccagatggtcagaaatgcatacgttaggttttgttatgccccatatatttctgtgatttgcacttgtgtttattagtttattctgccctattttattacaagctttgatttctactttctaccctttctcccttctgcttaccttatgaacgtacttaaaaaacttggttaactaagagtcaggcttattgcagtttcttttggaa

SEQ ID NO: 159807 - DNA, 601 bp, Human
ccactatacaagaacctatactactatatatttgcaatgatgctttaatgcaggggaaaacagctgtttatctgtttttcttttggttttattttctttttaccttgccatcctgtcagtacgtggcttcataaagctgtaggattctgatagggaaactaccgattccatgtgctttggaagccaatgtgctgattatctagcttgatagcagtattttattatagctggagggaaagtgtggctatgtttgtgagaggcaggaaggcaaatgccaccaataacgtgtccagaagtgagmtatcccctgtgttttatgcacttcattctactgaatgaatattgtatcactgttttcatttttttgtttgaatatcagagacttttccaatggttctgtttctgtcgaacacttgatggaaagccctgttgtaaagcttccttcatggagatggctttatgtcttggctataaagtaaagttccataaatttgatcagaaattgtctttatgggttgccaccctgtgtgctattaaaagctcagaacctgggtgttagttttcactcagagctgtgcttgccttttgtatttggcaagtg

SEQ ID NO: 159808 - DNA, 601 bp, Human
atatttctactggaaaactaagaaaaaattttttcccaaaggcaattattttgcaaggcctttttaccctattataagactttcttttcagttaataacccaaagtgtctcttcagatgcttaagtcaagtcgttaattggcttgactaagtggttgttggtgcagaaagcttattctctccgttggttgtatataactcacagacattaaatgacccactttgttgttcctaaggcaaagaatcattattttctttcggcagtatactgtggacttttaattcacaaacttatagctcasgttgaagtaatttctgctgagaagtgatttttctaaacaattgtttaatggttttgatttggagtaaacattagatgcaacttttgagctagtatactctactgtagagatcattaatgtaaccttttgtttttgtagcgtgcctgtctcccttcaaaaattgtttattctaaactgtgatcttttttctaaagatttgtttaaagttaacaaggtaagtataaccattaagttcacatataaatgattaatacacaaatattcagctttgttctctgcataaatatctacctctcctta

SEQ ID NO: 159809 - DNA, 601 bp, Human
atgctcttttggcttgatctctttggaactcatggttttagaccattgcattatatatctctagttctgccatctcttgagcttctaatttacatattcatctgtctgccagagtccttttgttgatatcccaccagcctcccaaacttaacatgtacaacactgagttaactttccctcagatcagtcctgtcttgtttacagtttcaactagtggccccactgtgtccggaattgatgggttcttggtctcactgacttcaagaatgaagccgcggaccctcgcggtgagtgttacagytcttaaggtggcgcatctggagtttgttccttctgatgttcggatgtgttcggagtttcttccttctggtgggttcgtggtctcgctggctcaggagtgaagctacagaccttcgcggtgagtgttacagctcttaaggtggcgcatctggagttgttcgttcctcccggtgggctcatgggctcactggcttcaggagtgaagctgcagaccttcgcggtgagtgttacagctcataaaagcagtgtggacccaaagagtgagcagtaacaagattaattgcaaagagcaaaagaacaa

SEQ ID NO: 159810 - DNA, 601 bp, Human
tggtgcattcacaaacactgagctagacacagggtgctgattggtgtgtttacaaaccttgagctagatacagagtgccgattggtgtatttacaatccctgagctagacataaagcttctccaaggccccaccagactcaggagctcagctggcttcacccagtggatcccacactggggctgcaggtggagctgcctgccagtcctgctccgtgcgcctacactcctcagcccttgggtggtcgatgggactgggcgccgtggagcagggggcggtgctcatcggggaggctcgggccwcacaggagcccatggagggggtgggaggctcaggcatggcaggctgcaggtcccgagccctgccctgcaggaaggcagctaaggcccggcgagaaatcgagcacagcgctggtgggctggcactgctgggggatccagtacaccctctgcagccgctggccccggtgctaagtccctcattgcccggggccagcacggccagccgtctgctccgactgcgtggcccaccaagcccatgcccacacggaactccagctggcccgcaagcgccgcacgcaggcccggttcccgctcgcacct

SEQ ID NO: 159811 - DNA, 601 bp, Human
tgatataaagatactacctgagactgggtaatttataaacataagaggtttagttgacttgcagttctggggaagcaggcaccttcttcacaaagtggcaggagcgatagaacatgcaggagaaactgccaattttaaaccatcatatctcatgagaattccatcactatcatgagaacagcatgggggaaattgcccctatgatccaatcacctcacaccagattcctccctcaacatgtggggattacaattcaagatgagatttgagtggggacacaaagccaaacattatcattctkcccatagcactgcccaaatctcatgtccttttccattttgaaaccaatcacaccttcccaacactcccccaatgtgtgaactcattctggaattaacccaaaagtccaagtccaaagtctcatctgagacaagataagtcccttctgcctatgagcctgtaaaatcaaaaacaagttagttatttccaagataaaatgggggttcaggcattgggtaaatgttcccattccaaatgggagaatttggacaaaacgaaggggccacaggttccatgcaagtccaaaatccaacagggcaat

SEQ ID NO: 159812 - DNA, 601 bp, Human
gctggagctggagtggctggaacacagggtgccatgtcccgaggctgcacaaaggagttgggccctgggcctggcccacaaaactgtttttattttcctaggcctccaggcctgtaatgggtgtggctgccttgaagatctctgaaatgcctggagacatttcctgcattgtcttggcaattaacttttggctgtttgttacttaggcaaatttctgcaggcttgaatttctccacagaaagtgggtttttcttttctaccaaatggtcaggctgcagattttccaaacttttatgctttktttcccctttaaacataagttcaatttcaaactatctctgtgagagcacataaatacactttcaggaaaagccaggtcacctcttaatgctttgctgtttagaaatttcttctgccggataccctaaatcaactctctcaagttcaaagttgcacagatctttaggtccggggaaaaatgccaccagtgtctaaagtgacctttactccagttcccaacaagttcttcatctccatcgaagatcatctcagcttggacttcattgtccatatcactatcagcattttggtcaaaattata

SEQ ID NO: 159813 - DNA, 601 bp, Human
ctggactattaaatgtaataaaatagctgggcattattaagggttggttctcttgaggttagagatcatgaattgaaagtgagcttcaccattcaatatatggtatttctccaggtacagtctgatgcaggggtaaggtcacagcaggcagagaggtgagcttaaccaggtcagatactttatcaagtaatttcaatgaaggaaaaaagaggcagtgctgttgaatctggttgcaagggaggtggtacatgcttatatttaagatcatggaaggcctgcaatagaaataactggagaagcycagggctcaattcttagaccgtctttttcctccttcctttgctaggtgatctcatccagccttgaggccctgcaaatcatcaataggcaggtgtatttcaaatttataactccagcctggacctctatcctgaaatacagcccccttctcaacatcttgataaaattggatatctaagaggcatgagactttcaaaaaactctggacttttcccacagacctggtacttccatggtttcacccatcttaatagatggcagccctgctcttttggtatctcaagccaaaaccttcagagcc

SEQ ID NO: 159814 - DNA, 601 bp, Human
tttcacgaggctccctaaatttgttccagctcttggtagcattaaggccttctcctgtggcctggattttcagattccttagtggggatatgtgctcaaaggtagaatctccccgtctcatactctgggaacttttattttttttcctatctcatggagtaggctgcagcctatcacttctttcaaaaggtctgtggatttttccagttttcccagtgggagaggcatgctaacactgcctcctatctgctatcttgaaaaaaaaaaaaaaaaaaggtgtatagatcattcacttccttgsttaagtttatttctaggtattcgatttttttaattttttgtagccattgtaaataggatccctttttgatttccattttagctaattcattattggtgtatagaaatgctggtgatttttaaatgttgtttttctgtcctgcaactttactgaatttgttaattttaaaagttttttgatgaattctttagggtttttaatatataaagttttatcatctgcaaactgggacaatttgacttcctcctttccaatttggatgccttttatttatctggcctaattgtcctgggtaagatt

SEQ ID NO: 159815 - DNA, 601 bp, Human
cttggtagcattaaggccttctcctgtggcctggattttcagattccttagtggggatatgtgctcaaaggtagaatctccccgtctcatactctgggaacttttattttttttcctatctcatggagtaggctgcagcctatcacttctttcaaaaggtctgtggatttttccagttttcccagtgggagaggcatgctaacactgcctcctatctgctatcttgaaaaaaaaaaaaaaaaaaggtgtatagatcattcacttccttggttaagtttatttctaggtattcgattttttwaattttttgtagccattgtaaataggatccctttttgatttccattttagctaattcattattggtgtatagaaatgctggtgatttttaaatgttgtttttctgtcctgcaactttactgaatttgttaattttaaaagttttttgatgaattctttagggtttttaatatataaagttttatcatctgcaaactgggacaatttgacttcctcctttccaatttggatgccttttatttatctggcctaattgtcctgggtaagatttccagtactatgttgaatagaagtcatggat

SEQ ID NO: 159816 - DNA, 601 bp, Human
ggatatgatttccttctttttatgactgcatagtattccaaggtgtatatataccacattttaaaaaattcagtctactgttaatgtggaattactgcagggcctcagcaatggagacagttattggcccctggggcaggataccctctattagtgggtctggtatcaagaaaccattgagctgtataatcttaggtcttaggggtgggaggtgttcaagagccagtgttaatggacattctcagagagttttaacttttatccatgtgcattatccattatattgtttagtacttctcayttgagttctactttttctctattcttgttactacagtcatatttacttggcatatcttttttttgtaatttttaagcatttcgtatcattttatttttgtttcatttcttataaactcattttaaaatttatctctgtgtctactttttaactaatgttagtatccatctcttagtaaggaaatatagtttatttacatctttgcttgcatgagtgaatgattactggtatgtttagacttactactgccacattgttttttctgtatatttttactgcactttcttttttttcttctct

SEQ ID NO: 159817 - DNA, 601 bp, Human
tttcattgtttacaaaagtagcttcgtaaggcctaattaagaattatatcacccatggcattgctcaatcccaagtcaatattttttttttttgaaaaatgtggattcaaggataccacaactaaaagggatgtagggaatttaagaggctttggatgaaatgatgaagattacggtaaagttttataaaaaatttgaagcactgagataatatagacaaagggaataattataaaatgagagtgataaggaaggtttgctttaaataaaccaatcaatgagtgatttagatcatatgtarcaggaatattagatttgatatgttcttgtggacaaaaaggtatttctattggatacacctttgtatcttgcttaatacctaaataagtgttagctttttctttctatgagttatagacaatacattttaaagcagccattttttatatttcagaaacatttgaaaagtataataatttaattctttgtgtttatggaacttaattcagtgaatatttatgtcatgggttgtggcagattttggttttttgtggaagaggtcaccatgtatatactattttgaagggcagaaaatagttgt

SEQ ID NO: 159818 - DNA, 601 bp, Human; identical to SEQ ID NO: 19602

SEQ ID NO: 159819 - DNA, 601 bp, Human; identical to SEQ ID NO: 19603

SEQ ID NO: 159820 - DNA, 601 bp, Human; identical to SEQ ID NO: 19604

SEQ ID NO: 159821 - DNA, 601 bp, Human; identical to SEQ ID NO: 19605

SEQ ID NO: 159822 - DNA, 601 bp, Human; identical to SEQ ID NO: 19606

SEQ ID NO: 159823 - DNA, 601 bp, Human; identical to SEQ ID NO: 19607

SEQ ID NO: 159824 - DNA, 601 bp, Human; identical to SEQ ID NO: 19608

SEQ ID NO: 159825 - DNA, 601 bp, Human; identical to SEQ ID NO: 19609

SEQ ID NO: 159826 - DNA, 601 bp, Human; identical to SEQ ID NO: 19610

SEQ ID NO: 159827 - DNA, 601 bp, Human; identical to SEQ ID NO: 19611

SEQ ID NO: 159828 - DNA, 601 bp, Human; identical to SEQ ID NO: 19612

SEQ ID NO: 159829 - DNA, 601 bp, Human; identical to SEQ ID NO: 19613

SEQ ID NO: 159830 - DNA, 601 bp, Human; identical to SEQ ID NO: 19614

SEQ ID NO: 159831 - DNA, 601 bp, Human; identical to SEQ ID NO: 19615

SEQ ID NO: 159832 - DNA, 601 bp, Human
ctgctctcctgactcaggggctggcctcgatcaactaaaaactctaatatctcaaattcttcacctgttaaaatagagatagcatctcttctacctccatcataaggctattttgaagaatgaggattcacagaaggattaagtacaaagcaccatgccatgtaagatattcttattggaagacagctttacggaagtggaaggactatgaaatttgcagggagactcacctgggttcaagtcctatctgtaaccctagcagctgttcatttgttcctctgacaagggaggaagatcattmcattgtagggtggtggggattaaataacactgcacgtggaaagcacctggcacacactatacagagtgaatgttagtgccctattataagcaaggtttttctgcaaaaaaaaaagttgcccttttcagctttggcctcagtcctatatacaaagatcctagaattcagtttgcacaagggcttttcaaagataagtgcatagcaacacaatcacattattcagaaaatattatgtttcagaactgcaactagtctattaacctcaaaacaaaacagaatgtgcttagtttcatggaaaag

SEQ ID NO: 159833 - DNA, 601 bp, Human
tataaaaatttctaggtattaaatactaacaccaagtagaaagaaaaagttctggacgcctgctctcctgactcaggggctggcctcgatcaactaaaaactctaatatctcaaattcttcacctgttaaaatagagatagcatctcttctacctccatcataaggctattttgaagaatgaggattcacagaaggattaagtacaaagcaccatgccatgtaagatattcttattggaagacagctttacggaagtggaaggactatgaaatttgcagggagactcacctgggttcaagycctatctgtaaccctagcagctgttcatttgttcctctgacaagggaggaagatcattacattgtagggtggtggggattaaataacactgcacgtggaaagcacctggcacacactatacagagtgaatgttagtgccctattataagcaaggtttttctgcaaaaaaaaaagttgcccttttcagctttggcctcagtcctatatacaaagatcctagaattcagtttgcacaagggcttttcaaagataagtgcatagcaacacaatcacattattcagaaaatattatgtttcaga

SEQ ID NO: 159834 - DNA, 601 bp, Human
ctgctttgcagttccacctttcacataagtcaagtgaacatatgtgtttgcttctagagtctcaattgcattctactggcttatttgtctagctatagacaccaatcctaacacaaatattacaactctcttaactcctgctccaaatttgttcttcctcctcaaatttatcttgactatttctgatcctttacatttccatataagttttagaaatcagcctgtcaatatccacacacacacaaaaaaacctgctgggattttgattgggatggccctgaatatatacattaatttaggragaaatgatacctttaaaatatctttatctttagaattttgtaatctatgaatttccgatattcctctatttctttagtttctcaatttatctaaagaatgttgagatgtattatgttattttctctgtagaggtctttacatatcccatgattatcatcccagaatacgtaatgtttcttgaggctattttaaatgtactttttcttttctttaattttatttcttaacgttttgtagagatgaggtcttgctatattgatcagactggtcttgaactcttggccccaagagatcctcc

SEQ ID NO: 159835 - DNA, 601 bp, Human
tgctccataagtttatacaaataaaataatttaaaaataccaccatctccccaccctactgctttgcagttccacctttcacataagtcaagtgaacatatgtgtttgcttctagagtctcaattgcattctactggcttatttgtctagctatagacaccaatcctaacacaaatattacaactctcttaactcctgctccaaatttgttcttcctcctcaaatttatcttgactatttctgatcctttacatttccatataagttttagaaatcagcctgtcaatatccacacacacamaaaaaaacctgctgggattttgattgggatggccctgaatatatacattaatttaggaagaaatgatacctttaaaatatctttatctttagaattttgtaatctatgaatttccgatattcctctatttctttagtttctcaatttatctaaagaatgttgagatgtattatgttattttctctgtagaggtctttacatatcccatgattatcatcccagaatacgtaatgtttcttgaggctattttaaatgtactttttcttttctttaattttatttcttaacgttttgtagaga

SEQ ID NO: 159836 - DNA, 601 bp, Human
tgatgctgatttttacacatggtgtaagatagaggtcacagttcattgtttcatatgttcatctacttgacagcaaccttcactaaaaataccaccctgtagtaccccatgttctctcacttataaatgggagctatgtaatgtgtacacatgggcctacactgtggactgatagacattgaagactgaggaaggtgggagggggcctgaagatgagaaattacttaatgagtacaatgtacataattccagtgatggatacactaaaagccctgacttcactgcacaatatatcctgtayctacacttgtgctccataagtttatacaaataaaataatttaaaaataccaccatctccccaccctactgctttgcagttccacctttcacataagtcaagtgaacatatgtgtttgcttctagagtctcaattgcattctactggcttatttgtctagctatagacaccaatcctaacacaaatattacaactctcttaactcctgctccaaatttgttcttcctcctcaaatttatcttgactatttctgatcctttacatttccatataagttttagaaatcagcctgtcaatatcc

SEQ ID NO: 159837 - DNA, 601 bp, Human
gtgttaagaaacctttgctttgcttatttgctatttggatatcctctttgtgaaacagtctgttcgagtcttttacacatattaaaaatggaactgtccttcttcaattttaggagtttttaatacatcatagatatgagtattctgacagatacgttgcgaatatattctcccactcttgttgcttgtcttttcactctgttacctttagattaacagttttcattttagcagtcaatttcaggtttttcctttatgattagtcccttttgtgtcattttaaagaaatctttgtcaacayataccaagatcatgaagatacattcccatgttaacttccagaagtttgttttatctttcacatttagagctaaaaatcaagctgatgctgatttttacacatggtgtaagatagaggtcacagttcattgtttcatatgttcatctacttgacagcaaccttcactaaaaataccaccctgtagtaccccatgttctctcacttataaatgggagctatgtaatgtgtacacatgggcctacactgtggactgatagacattgaagactgaggaaggtgggagggggcctgaagatgaga

SEQ ID NO: 159838 - DNA, 601 bp, Human
gccaatgtataccgcatcaacttactgtaggaaagtgttccaattgcccagaagtctcaccaacacctggtatcattcatttatctgctgagtatatagtggtatctcattgtgattttaattcgcacttccctaattactcatgggtgttaagaaacctttgctttgcttatttgctatttggatatcctctttgtgaaacagtctgttcgagtcttttacacatattaaaaatggaactgtccttcttcaattttaggagtttttaatacatcatagatatgagtattctgacagataygttgcgaatatattctcccactcttgttgcttgtcttttcactctgttacctttagattaacagttttcattttagcagtcaatttcaggtttttcctttatgattagtcccttttgtgtcattttaaagaaatctttgtcaacatataccaagatcatgaagatacattcccatgttaacttccagaagtttgttttatctttcacatttagagctaaaaatcaagctgatgctgatttttacacatggtgtaagatagaggtcacagttcattgtttcatatgttcatctacttgaca

SEQ ID NO: 159839 - DNA, 601 bp, Human
ctataggtagctataactcattaccataattgtatacttcatgaaataacatgccacaattatctgttctactgttaataaacatctgtatttctggtttagagttataaataactctaaacattttctgtgcatgtcttttggtacacgcatatacacatttttgttgggtggaacctgtgagtagaattatcaggtaatagggtattctcatcttcagtagatactgccagtcttccaacaatgttttgccaatgtataccgcatcaacttactgtaggaaagtgttccaattgcccaraagtctcaccaacacctggtatcattcatttatctgctgagtatatagtggtatctcattgtgattttaattcgcacttccctaattactcatgggtgttaagaaacctttgctttgcttatttgctatttggatatcctctttgtgaaacagtctgttcgagtcttttacacatattaaaaatggaactgtccttcttcaattttaggagtttttaatacatcatagatatgagtattctgacagatacgttgcgaatatattctcccactcttgttgcttgtcttttcactctgttac

SEQ ID NO: 159840 - DNA, 601 bp, Human
tgttgggattacaagcatgagccaccacgccaggccaactctacattttaaatgtttataaaataggaacacacactagaaaaaaaaagggacaaaatgggacattctctcaacattctgtcactgttttgctttcccttaaaatggtaatatttttctagaaaatatataatccttataaaaggtgctaaataaacagaaagtcaactcctccagcaagtacaatgtacagaaatcaccactgctaacagttgggatatatcttttagggcttaggcagatataagcatgcatatttccrcatagatggaaaaagatataaatatgtttgatattgcccatttaacaggtcttatatatctttccatagcaacacagataatgctagctttaccattttaaaagctacagagtattccattctgggtatgtaccataattattcacccaatctcctattaatgaacatctaggctgttaccattatagcatgaataataaattaataagaaataaaatagttctgattttgtggaagactattccagaaagcgtatgtgtcaggcaataaatctatttgagagagtttttgctgtgacag

SEQ ID NO: 159841 - DNA, 601 bp, Human
aaacagacaaaagatttagattaaatatagatgaaaaggaattgatgaaaaaagattataattcacccgagtcccatagtggaactgtcatgttttattttagaaggtaattagagtcagtgggcggtaaaacatttcagatactaaataacttaataacacattcttatataccatgtcccaaaaaggtcaattttcaacacttttttttttaatacgaaagctccactggatgatttaaaaccaaacagaaccaaaaaaatcaagaatgagtagcctgtggaagaacagccaaaaaaargacacaaatagtgttaagactagaataatcttaacctctatatattttccctaagctctgtgatgctacattacattcataacttaatgtttttttaaaaaaatgatagaataaaacgttacaatttcatttctaaaactctagagaaaattgtaatagttttaacaatgacaaatgaagatagcatatttcctatttatggtaccagaaagacattttacattttaaatggaccaaactccagctggaacagaggttaaaatattaaggaatggccaatagaatctgggtagggaagtc

SEQ ID NO: 159842 - DNA, 601 bp, Human
acgcacacacgtgcacaaccacatgcacacaatttccaaacctctatggtaggggaaagaaggcaggaataaaaatacacaaaatagtaagaaagatagtgtgaccaatgcctctaatattatatatgggctggggcgcagtggctcatgcctgcaatcccagcactttgggatgcccagacaggcggatcacttgaggccaggagttcaagaccagcctgggcaacagagcaaaaccccatctctacaaaaaaaaaatgttaaaaattagccaagtgtggtgacatgtgcctgtagttcyaggatcacttaagaccaggaatttgagccatgatcacacgaccacattccggcgtgggtgatggagtgagatcttatctctaaaaaaaaaaataaaaattttaaaaatttacatatgaattagattaagacagaattgtttaccaaattccagaatattataatataggcttaggacaaataaaaagaagtataacttcatacaaggtgaaatgcatgtattggtctagggcatcatagagactaaatgcagatagattgtaaaagattatataaatggcagactcttcatagcttaaac

SEQ ID NO: 159843 - DNA, 601 bp, Human
tgacatcggtatctcttgtaattaatactatttattcctttccttttttcctaagctgaattcttccatttctagtctattaactacccccctacacacataccccacaacacacacgcacacacgtgcacaaccacatgcacacaatttccaaacctctatggtaggggaaagaaggcaggaataaaaatacacaaaatagtaagaaagatagtgtgaccaatgcctctaatattatatatgggctggggcgcagtggctcatgcctgcaatcccagcactttgggatgcccagacaggmggatcacttgaggccaggagttcaagaccagcctgggcaacagagcaaaaccccatctctacaaaaaaaaaatgttaaaaattagccaagtgtggtgacatgtgcctgtagttccaggatcacttaagaccaggaatttgagccatgatcacacgaccacattccggcgtgggtgatggagtgagatcttatctctaaaaaaaaaaataaaaattttaaaaatttacatatgaattagattaagacagaattgtttaccaaattccagaatattataatataggcttaggacaaataaaa

SEQ ID NO: 159844 - DNA, 601 bp, Human
gaactcatctatgtgccattttactaagtctcctatgtaagagtctgaataggaagctgtcttttgaattcagtgccataaaaaacttggcctcccctgaggaactggcatgctccttcctttctaaggaagttatgaaatttaacatgctttaccttctgctttagctgcaaagaacttgggcaaattcgacgtatgtgtgacatcggtatctcttgtaattaatactatttattcctttccttttttcctaagctgaattcttccatttctagtctattaactacccccctacacacayaccccacaacacacacgcacacacgtgcacaaccacatgcacacaatttccaaacctctatggtaggggaaagaaggcaggaataaaaatacacaaaatagtaagaaagatagtgtgaccaatgcctctaatattatatatgggctggggcgcagtggctcatgcctgcaatcccagcactttgggatgcccagacaggcggatcacttgaggccaggagttcaagaccagcctgggcaacagagcaaaaccccatctctacaaaaaaaaaatgttaaaaattagccaagtgtggtgaca

SEQ ID NO: 159845 - DNA, 601 bp, Human
acaaacaatctcaataggataattttccttaaagtttcatgaacacattccatattccaaagagtaagagggaggagaagacagaagggttacctctttctgagtaggagagtaggatagccatattctggacaggctgtatgcctgaagtccccaagtaccaagtgcatgtactctgctctggtctaaggatgaaaaccagtccactggcagtgcctgtttccgaggaattggaaaggagagtctgcagtccagaagaaacattgtcatgaataggaagtcgaccaaaacataaattacygagctgatccagtgtgcatgtcctattccaaatcttcccaaaacaaatagaaaaaaaaaaccttccttaaataaccagggaattcttttcatctctatgttcacatgcccacacatatacatggaaaaagcattcttgaaaaatatacgattgtcttagttaaggctgctataacaaagtaccacaggtaaggtggttataaacaacagaaatttattttcgcaattctagagtctggtggttcatgatagcggtgccaacacagtcgggttctgatgaaagctgtcttataggctgaag

SEQ ID NO: 159846 - DNA, 601 bp, Human
cgcctctcatggcctctgttcagatcctcatttctcattttgtgctgagtcctgactctgctgcgccctctccaatccatccccacactacttctagagttagctttctaagagatgaaatggactacaccattcctctgcttaaaaactctatgcctccttagaacctacctcgaaataaagtacaaacctcaaattgtatgcaaggccctccacactccagctgcagccacactcacaacgtgccattctccaaatcatttttcttcatgacgtcgagcttactgcttctgcttagaayaactaaactgttaaggactatgtcttgccttaactattactgcttctccaagggctccctaaatgtttttcgaatgaataaacatgttctcctagtcactacctgagctttcagtcatcgtgctaattctcttactataaaatatttctgattataggctgggcgcagtggctcatgcctgcaatcccagcactttgggaggctgaggcgggcgaatcacaaggtcaggagttcgagaccagcctggccaacatggtgaaacgccatctctactaaaaatacaaaaaattagctgggcct

SEQ ID NO: 159847 - DNA, 601 bp, Human
agctttctctcaccaactggggaagaattagttcctcctttaaaaaggcaagctaaatttctttatcaatttttagagtaatttgctgtaagagtctcctccagtggtggcaactgaggaaggtttcatttgtatttattcaaggctgacaaccacagtctttttcttgattcttgaactgccccaaatttggcagtgcaagccccttcaaacaggctcctgaatctctttgacataccctcattagtctttgagggtttccccacattctggtacaaaatattcttttaactaaaagttwaaaagtaacctacaaaaagcctattatacaagttcttatattcttcataaaaataataatagtattaaaatgtcatatctaataaagcaactaataaactttactaacagagcttcttattttgtgaataagcacaatgacgctgtctagaaaaactccacccatcaaccattagactgaaggatgacctcatatattatattgctgttaggcacttttcaagacataaagataaaatcctgccctccacaaaaatgatctattgcagtgagtctcaaaatttaatatgcataaaaatca

SEQ ID NO: 159848 - DNA, 601 bp, Human
aacatcttttctagcttttctccttcttacccaagatcaaaccaagttccatgcatggtgtttacggccaatctcagtaatccagagcagtctgtcccacctttctctcccagctacccaatgactgtagaagatgtgaagtcagtattctcataaagtattccacaattttgtgtctaacttattcttttatcccccatatttcctgtaaatagggaatccaatggactaaattcaggttagacattttttgctagaatataccacaggtgatggtgataatgtcagactgcactacatragcacgtaatacaggctgatccattttcagtgaaactagctttgcccacctggaataggtggagactataaggtcactccatgttaaagtggttctccttttacaatgagaattaatctaaggatgctacttagacaccctagaaatatcctgttccccaaaaacctttcacctgctgatccttgctggaattatttcattgagggtcacaaaatggtgatcatctaattctattatttcttctacatatattagccagcactcttctgcaaagagctttctctcaccaactggggaaga

SEQ ID NO: 159849 - DNA, 601 bp, Human
gtgagccaccatgtccggcccacaaatgctattttataataaagtgtttaattgcttatgtaatttattgaatacagtacactgtaaaatgttagctattacccgtgtggttaagcaggagcgatggctcactgccactgctcagcgttgcaagagtatcatactgtatattgctagctcaggaaattatcaaaactaaaatcaaaagatcataagtcaaaccatcataagtcagggaccatctgtataagaatattctcctatataacaataccttagctcacctacgaaaatgaataayttcttattagctaataaatgatccagattttccctaatgtcttttttttttttttttttttttgagacagggtctcactctgtcgcccaggctacagtgcagtggcgtgatctcagcttactgcaacttctcccaggctcaagcgatcctcccacctcagcctcctcaatatctgggactacaggcacgcaccaccacgcctggaactttttggtttttttagtggctgtgaggttttgccacgttgcccaggctggtctcaaactcctgagctcaagtgatctgccctccttagcctcc

SEQ ID NO: 159850 - DNA, 601 bp, Human
caatgaaaagtttaaaccagacagaaaagttgaatgaataacacaataaatagactatatactgcctaatatcaacaattgttaatattttacatttgcttctctatcactagtttctccccaactctacttttttcctgctgaaagtaagttacagatatcatgacatttcacttctaaacacttcactgtgcatgtcctaccacagtgtttctcaaatttaacgtgcttgtgaatcgcagggggcagtcttgttaaaaggtagatctgattcttaggtcagcgtggtactagcaattgwgcctttctagaaagctctcagatgatgccaatgctatgcaaacacctaccacactctgagtaacaagttactcagtacagatgtaagtctaagtacagacttacaagggggttacatcaggataaacccatcgtaaagtcaaaatgcatttaatgtacctcacccaccaaacattatggctttaccctagcctaccttaaatgtgctcagaacacttacattagattcagttgaacaaaatcatctaacacaaaggctattttatttttttattattattattattattattgagacgga

SEQ ID NO: 159851 - DNA, 601 bp, Human
cctgggcaaaggtctggtaaagttcaacaaactgttaatattactcccaagttacaatgaaaagtttaaaccagacagaaaagttgaatgaataacacaataaatagactatatactgcctaatatcaacaattgttaatattttacatttgcttctctatcactagtttctccccaactctacttttttcctgctgaaagtaagttacagatatcatgacatttcacttctaaacacttcactgtgcatgtcctaccacagtgtttctcaaatttaacgtgcttgtgaatcgcagggggyagtcttgttaaaaggtagatctgattcttaggtcagcgtggtactagcaattgtgcctttctagaaagctctcagatgatgccaatgctatgcaaacacctaccacactctgagtaacaagttactcagtacagatgtaagtctaagtacagacttacaagggggttacatcaggataaacccatcgtaaagtcaaaatgcatttaatgtacctcacccaccaaacattatggctttaccctagcctaccttaaatgtgctcagaacacttacattagattcagttgaacaaaatcatct

SEQ ID NO: 159852 - DNA, 601 bp, Human
ggaactgtatttctcttgtgcactgctctttcctcagtgtacagcccaatgcctaacacagaggatgtgtccaatgttagccacagactaacgcagacagtctgttaacatctcgcagacagtacccacttatttttgtctaacagtctctgaaacaagaaaatattacatgaggttttgttatgtagtagtagttcttttttttttttttttttttttgagacggagtctcgctctgtcgcccaggccggactgcggactgcagtggcgcaatctcggctcactgcaagctccgcttccsgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccagtagttcttaacttcagaaattccattgtaaactataaaatagaagaaacaaatgctttatagaaccataatacctatgttcctactaatttg

SEQ ID NO: 159853 - DNA, 601 bp, Human
atgggaactgtatttctcttgtgcactgctctttcctcagtgtacagcccaatgcctaacacagaggatgtgtccaatgttagccacagactaacgcagacagtctgttaacatctcgcagacagtacccacttatttttgtctaacagtctctgaaacaagaaaatattacatgaggttttgttatgtagtagtagttcttttttttttttttttttttttgagacggagtctcgctctgtcgcccaggccggactgcggactgcagtggcgcaatctcggctcactgcaagctccgctycccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccagtagttcttaacttcagaaattccattgtaaactataaaatagaagaaacaaatgctttatagaaccataatacctatgttcctactaat

SEQ ID NO: 159854 - DNA, 601 bp, Human
tttttttaatagtttaaggaaaatgcgatataaacaatgtataaatgctagttacgaccatgaaaaaagttttttcacctctgctagactataaacaaggatgggaactgtatttctcttgtgcactgctctttcctcagtgtacagcccaatgcctaacacagaggatgtgtccaatgttagccacagactaacgcagacagtctgttaacatctcgcagacagtacccacttatttttgtctaacagtctctgaaacaagaaaatattacatgaggttttgttatgtagtagtagttcttttttttttttttttttttttgagacggagtctcgctctgtcgcccaggccggactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccg

SEQ ID NO: 159855 - DNA, 601 bp, Human
tatctgcaaggccaaaggagaatttgtaaaagtttaaagccacatactcacctagggaagcacaactaccctctcctgcctcaaagctgcaagcgtatgtgtgagcaggaatgtaggcagcagatgtatttagaaacgggtcccaaacaatgacattgtatatgacaccttgtcccgggagggaggagaaggaaacacttgtcttatcattagctgttagggtaaccacctgaagccaaaaataacacatgattagtgtttaggggatttttttaagctattctgtgataatcccacctaygtgtaatattaaatggtatattcataaattataattcttgcttaaaatatacaccaacccatttaatatggtcaaaaggccatcttacatggtttgtatgtgctaatgtaaacaagctctcacacaaaatgcttccaaaggttttttttaatagtttaaggaaaatgcgatataaacaatgtataaatgctagttacgaccatgaaaaaagttttttcacctctgctagactataaacaaggatgggaactgtatttctcttgtgcactgctctttcctcagtgtacagcccaatgccta

SEQ ID NO: 159856 - DNA, 601 bp, Human
acgtaggggctcaaaaggtatgtgttgaatgaatgagaactagacaaaagcattatctgcaaggccaaaggagaatttgtaaaagtttaaagccacatactcacctagggaagcacaactaccctctcctgcctcaaagctgcaagcgtatgtgtgagcaggaatgtaggcagcagatgtatttagaaacgggtcccaaacaatgacattgtatatgacaccttgtcccgggagggaggagaaggaaacacttgtcttatcattagctgttagggtaaccacctgaagccaaaaataacayatgattagtgtttaggggatttttttaagctattctgtgataatcccacctacgtgtaatattaaatggtatattcataaattataattcttgcttaaaatatacaccaacccatttaatatggtcaaaaggccatcttacatggtttgtatgtgctaatgtaaacaagctctcacacaaaatgcttccaaaggttttttttaatagtttaaggaaaatgcgatataaacaatgtataaatgctagttacgaccatgaaaaaagttttttcacctctgctagactataaacaaggatggg

SEQ ID NO: 159857 - DNA, 601 bp, Human
tcttgcctccgtcttttctcaaaaagcagccagtgatctcattaaaatatcttagatcatggcaccatttgctcaaaaccttccaatgcctttccctttcattcagaatagaagcaaaatcccatactacagtctacaaggccacacacaggctgcctgcccctgcacctctcacctcacctctacttcctttgccctcctcgttctcctgcaacccctgtcatcactgcagttcttcacaccctcagacaggctcccaggtgcaggccctcatcctggctgctccctctgcctggtacaygccacacccaggtacgtgcgtggtgcatcaaggactgccctggccatgctatctatctcaaattttcctcttactggcatgtgttatctccctttcctactttatttatcttcttagcactcaccattttctcacgtattacatattttataaatttatcttgtctgtctcatctccctcactataatataagctccagaacaagtatttttgctgttttgtttactgctatgtcccagtgcctagaacagagagtggaataacgtaggggctcaaaaggtatgtgttgaatgaatgaga

SEQ ID NO: 159858 - DNA, 601 bp, Human
agaggttgcagtgggccaagatcatgccactgcactccagattgggcaacaggagtgaaactatgtctcagaaaaaaagaaaagagttatacacaggttttcaactgcacaggagtcggctcccccacaacccctacactgttcaaaggtcaattgcatatagagagagaagaagagagaatgaaaagcaaatagcctaatacattaagctttgaggaatctggatgaagattatacagaaattctttatactatttttgcatattttctgagaaaccatttcaagataaactgctaaatacacacacacacacacacacccctcacaacaccttcactgcccccattctacctaacctagttatctctcccctggattacttcagtggcctcctaaccaatctgcatttctgctcttgcctccgtcttttctcaaaaagcagccagtgatctcattaaaatatcttagatcatggcaccatttgctcaaaaccttccaatgcctttccctttcattcagaatagaagcaaaatcccatactacagtctacaaggccacacacaggctgcctgcccctgcacctctcacctcacctctact

SEQ ID NO: 159859 - DNA, 601 bp, Human
cagaggttgcagtgggccaagatcatgccactgcactccagattgggcaacaggagtgaaactatgtctcagaaaaaaagaaaagagttatacacaggttttcaactgcacaggagtcggctcccccacaacccctacactgttcaaaggtcaattgcatatagagagagaagaagagagaatgaaaagcaaatagcctaatacattaagctttgaggaatctggatgaagattatacagaaattctttatactatttttgcatattttctgagaaaccatttcaagataaactgctaaayacacacacacacacacacacccctcacaacaccttcactgcccccattctacctaacctagttatctctcccctggattacttcagtggcctcctaaccaatctgcatttctgctcttgcctccgtcttttctcaaaaagcagccagtgatctcattaaaatatcttagatcatggcaccatttgctcaaaaccttccaatgcctttccctttcattcagaatagaagcaaaatcccatactacagtctacaaggccacacacaggctgcctgcccctgcacctctcacctcacctctac

SEQ ID NO: 159860 - DNA, 601 bp, Human
aaggcgggtggatcacttgaggccaggagtttgagaccagcctggccaacatggtgaaaccccgactctactaaaaatacaaaaattagccagggatggtggtgtgtgcttgttaatcccagctactcaggaggctgaggcaggagaatcacttgaacctgggaggcagaggttgcagtgggccaagatcatgccactgcactccagattgggcaacaggagtgaaactatgtctcagaaaaaaagaaaagagttatacacaggttttcaactgcacaggagtcggctcccccacaacccytacactgttcaaaggtcaattgcatatagagagagaagaagagagaatgaaaagcaaatagcctaatacattaagctttgaggaatctggatgaagattatacagaaattctttatactatttttgcatattttctgagaaaccatttcaagataaactgctaaatacacacacacacacacacacccctcacaacaccttcactgcccccattctacctaacctagttatctctcccctggattacttcagtggcctcctaaccaatctgcatttctgctcttgcctccgtcttttctc

SEQ ID NO: 159861 - DNA, 601 bp, Human
gtggcttatgcctgtaatcccagcactttgggaggccaaggcgggtggatcacttgaggccaggagtttgagaccagcctggccaacatggtgaaaccccgactctactaaaaatacaaaaattagccagggatggtggtgtgtgcttgttaatcccagctactcaggaggctgaggcaggagaatcacttgaacctgggaggcagaggttgcagtgggccaagatcatgccactgcactccagattgggcaacaggagtgaaactatgtctcagaaaaaaagaaaagagttatacacagrttttcaactgcacaggagtcggctcccccacaacccctacactgttcaaaggtcaattgcatatagagagagaagaagagagaatgaaaagcaaatagcctaatacattaagctttgaggaatctggatgaagattatacagaaattctttatactatttttgcatattttctgagaaaccatttcaagataaactgctaaatacacacacacacacacacacccctcacaacaccttcactgcccccattctacctaacctagttatctctcccctggattacttcagtggcctcctaa

SEQ ID NO: 159862 - DNA, 601 bp, Human
atagtaaatatactttctcttccttatgatttccttaatgacatttacttttctctagctcattttattgtaagactatagtctatgataaatataacatacaaaatatgtgttaatcaagtatttatgtaatcaataaggcttctctggtcaacactaggctaatagtagttaattttggggaagtcaaagttatacacgggtggggtatggtggcttatgcctgtaatcccagcactttgggaggccaaggcgggtggatcacttgaggccaggagtttgagaccagcctggccaacayggtgaaaccccgactctactaaaaatacaaaaattagccagggatggtggtgtgtgcttgttaatcccagctactcaggaggctgaggcaggagaatcacttgaacctgggaggcagaggttgcagtgggccaagatcatgccactgcactccagattgggcaacaggagtgaaactatgtctcagaaaaaaagaaaagagttatacacaggttttcaactgcacaggagtcggctcccccacaacccctacactgttcaaaggtcaattgcatatagagagagaagaagagagaatgaa

SEQ ID NO: 159863 - DNA, 601 bp, Human
gtacgtatctatacatacacagtcggcccctgaacaacacgggtttgaactgcatgggtccacttacatacagactttttttcagtaaaagtcacactgagtgtgcctgcctctcctacctccccttccacctctgccacccctgagacagcaacaacaacccctcctcttcctcctcctgttcctattcaatgtgaagacgatgaagatgaaggcctttatgatgatccactctcacttaatgaatagtaaatatactttctcttccttatgatttccttaatgacatttacttttctcyagctcattttattgtaagactatagtctatgataaatataacatacaaaatatgtgttaatcaagtatttatgtaatcaataaggcttctctggtcaacactaggctaatagtagttaattttggggaagtcaaagttatacacgggtggggtatggtggcttatgcctgtaatcccagcactttgggaggccaaggcgggtggatcacttgaggccaggagtttgagaccagcctggccaacatggtgaaaccccgactctactaaaaatacaaaaattagccagggatggtggtgtgt

SEQ ID NO: 159864 - DNA, 601 bp, Human
ggctggtcttgaactctggagctcaagcaatccgcccatcttgacctcccaatgtgctgggattacaggcgtgagacactgcacccagccaaaaataatttttttttacttataaaggacactattggaacaactagtaaatgtgctaacgtgtgaattaaataactactgtatcagtgttagcttcgtaattttgataattttactatggttatgtaaggaaataaatacagaagtatttaatggcaaaaaggtctttatgtctgcaacttactctcatatggttcagagaagaaaattgtgtgtgtgtgtgtgtgtgtgtgtgtgtgtgtgtgtacgtatctatacatacacagtcggcccctgaacaacacgggtttgaactgcatgggtccacttacatacagactttttttcagtaaaagtcacactgagtgtgcctgcctctcctacctccccttccacctctgccacccctgagacagcaacaacaacccctcctcttcctcctcctgttcctattcaatgtgaagacgatgaagatgaaggcctttatgatgatccactctcacttaatgaatagtaaatatactttctcttc

SEQ ID NO: 159865 - DNA, 601 bp, Human
caggctggtcttgaactctggagctcaagcaatccgcccatcttgacctcccaatgtgctgggattacaggcgtgagacactgcacccagccaaaaataatttttttttacttataaaggacactattggaacaactagtaaatgtgctaacgtgtgaattaaataactactgtatcagtgttagcttcgtaattttgataattttactatggttatgtaaggaaataaatacagaagtatttaatggcaaaaaggtctttatgtctgcaacttactctcatatggttcagagaagaaaattgtgtgtgtgtgtgtgtgtgtgtgtgtgtgtgtgtgtacgtatctatacatacacagtcggcccctgaacaacacgggtttgaactgcatgggtccacttacatacagactttttttcagtaaaagtcacactgagtgtgcctgcctctcctacctccccttccacctctgccacccctgagacagcaacaacaacccctcctcttcctcctcctgttcctattcaatgtgaagacgatgaagatgaaggcctttatgatgatccactctcacttaatgaatagtaaatatactttctct

SEQ ID NO: 159866 - DNA, 601 bp, Human
ggacacatcacttcctttgtattcctgccaaaaaagcataatcaaaatttaattatgaggaaatatcaaagtaacccaaattgaagacattctaaaaaaaataaatattctgtacttctcaaaaaagtcaaggtcttaaaagattaaaattaaaaaaaaaaaaaaagacttgttccagattatacaactataaagagacacatcggttaaatgcaatgtgggatcctaaactgaaccctggacaggggaaaaaaaaatttgttgacggggagacggggtctcactctgttgcccaggctgsagtgcagaagcacaatcacggctcactgcagcctcaaccttcctgggctcaggtgatcttcccaccttagactaccaagtagctggaacgacaggcatgtgccaccgcacccagctaatttttgtattttttgtagagacggagtttcgccatgttgcccaggctggtcttgaactctggagctcaagcaatccgcccatcttgacctcccaatgtgctgggattacaggcgtgagacactgcacccagccaaaaataatttttttttacttataaaggacactattggaacaactagta

SEQ ID NO: 159867 - DNA, 601 bp, Human
tgcttgatatcaaatcaccctcgatatctaatcgagttcttcatcctccaccatccatcccccaggtgatgtctgaccaccctggtctgtcttcagtaagaatccccttaggtcagtgcagacagaatgcccccttgcccctcatgtttcctcttagaaattttccatccactgactcccaccctactgcttggctacaaattcccagtagcccatgttgtactcaagagttgggcccaatctctcttccccactgcaaaattccatcacagtggtccctatgcctattgtaatactaccycccaccttgaataaaatcttcctcactgtgctttaactagtgtcactgattttttttttctttaacagcgggatacggctctagcagaggtagagaaccataatctctcgcttgaacacaactaatagactttcttctttagagcaaagctccttgaaagagctacttgaactttctccagtttctgtgctcccagctcctatttgttcttgaatatgctccagtcaggcgcctaccccacctctccactgcaacagctctcactggtaccaatggcctccatgttgctaaatccaaggg

SEQ ID NO: 159868 - DNA, 601 bp, Human
ccgggtgcagtggctcacgcctataatcccagcactttgggaggccgaggtgggcggatcacttgaggtcaggagtttgagatgagcctggccaacatggtgagaaccccgtctactaaaaatacaaaaattagccaggcctggtggcacatgcctgtagtcccagctactccagaggctgaggcaggagaattgcttgaacccaggaagcagaggttgcagtgagccaaggatcaggccattgcactccagcctggatgtcgcagccagactccatctcaaaaacaaaaaacgaaaaacaaaaaaaaaaaacccagaaagattaaacgaaagataaaaacaccacattgtttatttcagacctgtggttgactatcattctagaatttaatttttacaccaaaaccattaaatttgctgggatgattttctcaaatgaaaatcccgtgaacttttcagcaagtataatcaccaagacagcaaggtcttccaacccaataaaaactaagacacagttagatactcttccataacattagaggggaactaaatcccctatcacaataccaggaaggagggagagaaacaattatacaagtaa

SEQ ID NO: 159869 - DNA, 601 bp, Human
tctcatgctaaaataaaacaaggctgccacaaatcaaaatacataaaatgcctaagagtgctcagaatggagaaaccatgaagacatacagtaaaataagaaacacagacagaagagcagaattcacaggggatataatacctaaatatcagcttttctgagaataaggagcccataagaaagattaaacaacagccgggtgcagtggctcacgcctataatcccagcactttgggaggccgaggtgggcggatcacttgaggtcaggagtttgagatgagcctggccaacatggtgagamccccgtctactaaaaatacaaaaattagccaggcctggtggcacatgcctgtagtcccagctactccagaggctgaggcaggagaattgcttgaacccaggaagcagaggttgcagtgagccaaggatcaggccattgcactccagcctggatgtcgcagccagactccatctcaaaaacaaaaaacgaaaaacaaaaaaaaaaaacccagaaagattaaacgaaagataaaaacaccacattgtttatttcagacctgtggttgactatcattctagaatttaatttttacaccaaaac

SEQ ID NO: 159870 - DNA, 601 bp, Human; identical to SEQ ID NO: 122341

SEQ ID NO: 159871 - DNA, 601 bp, Human; identical to SEQ ID NO: 122340

SEQ ID NO: 159872 - DNA, 601 bp, Human; identical to SEQ ID NO: 122339

SEQ ID NO: 159873 - DNA, 601 bp, Human; identical to SEQ ID NO: 122338

SEQ ID NO: 159874 - DNA, 601 bp, Human; identical to SEQ ID NO: 122337

SEQ ID NO: 159875 - DNA, 601 bp, Human; identical to SEQ ID NO: 122336

SEQ ID NO: 159876 - DNA, 601 bp, Human; identical to SEQ ID NO: 34174

SEQ ID NO: 159877 - DNA, 601 bp, Human; identical to SEQ ID NO: 34175

SEQ ID NO: 159878 - DNA, 601 bp, Human; identical to SEQ ID NO: 34176

SEQ ID NO: 159879 - DNA, 601 bp, Human
tcgcacaaccctaaaaccctcccccttccgagtacacgcagccccccgacccccagggccatctcggatcctaaagctgtctgctctgggcgccccgagagcgaggaggggattcagcgctccaagcctgccccagggtcaccagggaagggacgagggtgtgggagttgaagagttgacaccggcttagtcactaacgagcccgtagcccgcggcggggctgaggcccggggaggcgggaagagcaacaggcgaggggcgcacggcgcgtgaagccatcccggagctggcccgtgacccyggagcaaagtttccaacaaagtttcccgggcctcggtgtccggttgggggtagcgtacccccgatctgccccccccatcccacgctccgacgaacaaaggaggcaccggcctgcgcccccgcttcgcccccagcccgggaacctccaagcacccaccgactcggcgactccgcctacgaagaacagcagcagcgcgaacagacgggcgggggccatggcaccgcggactggagaaggcgcgcaggctgcggcgagtggccccgggcgggcgcgccacccatcttataggcggcctaccgg

SEQ ID NO: 159880 - DNA, 601 bp, Human
gtgggggacagattgccttcaccagtaattcccatgccccccaacttcccagatgagattgcccccctcctcctaagccggctgcgggcatggatagagcttctgctggcccagggacagctatgacggaggccagtggacagtgagaaggaaaggtttccctgggctgattgaggccttctctcccccctacccccttcacctcactcaaggtggatgcttcaattttcttatctgcaattgagaaaaaatgaacacacttcttgcagaaagcagaggctcagctcctggctaagtgttsagtctaaaccattcctctcctctgtcctcgaaaagagcagagtccccaactttctagaaaccctaacgcagtgtcccctcttgccccattccctcagacccttggtgcagtattgggaagagattcagaagggcaggactttgccctaagtcacaagtcaatgacagagctggggccagaactgaggttagggctcagttctccttggtgtgtgaaagagggcctcgcacaaccctaaaaccctcccccttccgagtacacgcagccccccgacccccagggccatctcggatcctaaag

SEQ ID NO: 159881 - DNA, 601 bp, Human
atctgactcacccatttattgtgtattaactgtgtgaccctgggcaagttacttaacctctctagcctcaggaccagtttaagaacagtacacagtaagattgttgttggaattaagctcctggatatacccattagaaagttattagagcaatgtctggccccccgacaaaggcgctccacgtttgcaatcatcatggcatgcctggaattgtgctggaagtattgcctagggtctcattcattcctcaagaagagcctgcaggcagaatcaaccttccgctaagtaaattcagaggaayaggagccccaaggctttcaaagaaattaacattaatggttaaactgcaaggactcactcgctctgaaaactggggctaaagggcacaaagggggcacaaagctcaggctgtgggggacagattgccttcaccagtaattcccatgccccccaacttcccagatgagattgcccccctcctcctaagccggctgcgggcatggatagagcttctgctggcccagggacagctatgacggaggccagtggacagtgagaaggaaaggtttccctgggctgattgaggccttctctcccccct

SEQ ID NO: 159882 - DNA, 601 bp, Human
cgctggatcatctcttcagtccgagccaaccgtgactatgtctgatttttccaaccacaatctagaaaagagggaggggacaggccaaaggggaagccctgtgccccagttacaggcaggaggtctgtgacattagccaggaaggggagagctgaggtcaggatgagacttgacacctatctcaggaagcagctgcccagggctgatgtctcctgcagctgatgggtcacccaggcaggactgacacagtccccttcccccaaactacatccttcagaatgcccccaggacacagctgacwgctcagcaccctgaagcacctgaaggctcagcagcccctgggaggaaactggcatgtgactgggcacacggtgacctcagcaacctcctgggtcctttcctctttttccctgtactgcctaggtggtatcccttcggatgcttccccagttgcttgacccgacacatccttcagggcctagtttagagcactgtgctagaggcagaaggcttgggtcctcagccactaacattttaggcaaggtagcctttggtttaggttaagtcatcacctcactctggccttgtttccttccacctc

SEQ ID NO: 159883 - DNA, 601 bp, Human
gggactcccaaaacaaggctgcctttaattggcctgagagggagtggcaggaaggcagatcagggaatgctcccagctggacaggaagaactggtttagtatagcaagcccagccaaacagaggagaggacagctgggtactgagcctgggttcccttccaaaatatgggggtggtaaggggaatgatggaacagtcgggcgaacaccacccacaatgggagggctactagtcagagatcctggggtcctggatgccctctactaacccaaagtagtaccattttacctctcacatttggraagtgggcataatagaatccccatgtgacaggtctttttgtgaggacaaaatgcaccagatctgtcatataaaaagtactctatcactcctaactgctattagcaaagtccttctccctgggcctcacttttctctacctgcaaaaagaaaaggacacgctggatcatctcttcagtccgagccaaccgtgactatgtctgatttttccaaccacaatctagaaaagagggaggggacaggccaaaggggaagccctgtgccccagttacaggcaggaggtctgtgacattagccaggaa

SEQ ID NO: 159884 - DNA, 601 bp, Human
acttgataggtgataggtgggggacacttccccacaaccgcctgggcctggggccaagtcagtaggctgtgcccctgggtaggaacacctttgggtggaggggactcccaaaacaaggctgcctttaattggcctgagagggagtggcaggaaggcagatcagggaatgctcccagctggacaggaagaactggtttagtatagcaagcccagccaaacagaggagaggacagctgggtactgagcctgggttcccttccaaaatatgggggtggtaaggggaatgatggaacagtcgggsgaacaccacccacaatgggagggctactagtcagagatcctggggtcctggatgccctctactaacccaaagtagtaccattttacctctcacatttggaaagtgggcataatagaatccccatgtgacaggtctttttgtgaggacaaaatgcaccagatctgtcatataaaaagtactctatcactcctaactgctattagcaaagtccttctccctgggcctcacttttctctacctgcaaaaagaaaaggacacgctggatcatctcttcagtccgagccaaccgtgactatgtct

SEQ ID NO: 159885 - DNA, 601 bp, Human
ctttcattttaaggtgggggatgtcagcccagcggggaaagaggcctccccccaacctcacggaaccctccaaatcatggcccaaatattttcgtgggtgtttgataactccctgggctcaagaagtcccaagagctctcactgttcactcaagggtcctagaagcccctaggcttccgcccccacccctactcccatgtaatcaagaagaggacgctgtagaagaccagaaatgtccttaagctaaagtacacttgataggtgataggtgggggacacttccccacaaccgcctgggccyggggccaagtcagtaggctgtgcccctgggtaggaacacctttgggtggaggggactcccaaaacaaggctgcctttaattggcctgagagggagtggcaggaaggcagatcagggaatgctcccagctggacaggaagaactggtttagtatagcaagcccagccaaacagaggagaggacagctgggtactgagcctgggttcccttccaaaatatgggggtggtaaggggaatgatggaacagtcgggcgaacaccacccacaatgggagggctactagtcagagatcctggggtcc

SEQ ID NO: 159886 - DNA, 601 bp, Human
cattcatacaagcatttcctgagtacaaactaggggacaggtatttcacaaaaacaaatagagcagagttcctgccctcggtgtgcggggggagagagggagggattcagcatttggtggagtatgttaattccctcaagttaattccttcaagagagagacctcttttgaatagtaggtacttaagttattaatcaaattgagagatggaaaggactctggaggctaccctgttcaaacctttcattttaaggtgggggatgtcagcccagcggggaaagaggcctccccccaacctcayggaaccctccaaatcatggcccaaatattttcgtgggtgtttgataactccctgggctcaagaagtcccaagagctctcactgttcactcaagggtcctagaagcccctaggcttccgcccccacccctactcccatgtaatcaagaagaggacgctgtagaagaccagaaatgtccttaagctaaagtacacttgataggtgataggtgggggacacttccccacaaccgcctgggcctggggccaagtcagtaggctgtgcccctgggtaggaacacctttgggtggaggggactccc

SEQ ID NO: 159887 - DNA, 601 bp, Human
cacgaatttattcattcatacaagcatttcctgagtacaaactaggggacaggtatttcacaaaaacaaatagagcagagttcctgccctcggtgtgcggggggagagagggagggattcagcatttggtggagtatgttaattccctcaagttaattccttcaagagagagacctcttttgaatagtaggtacttaagttattaatcaaattgagagatggaaaggactctggaggctaccctgttcaaacctttcattttaaggtgggggatgtcagcccagcggggaaagaggcctcyccccaacctcacggaaccctccaaatcatggcccaaatattttcgtgggtgtttgataactccctgggctcaagaagtcccaagagctctcactgttcactcaagggtcctagaagcccctaggcttccgcccccacccctactcccatgtaatcaagaagaggacgctgtagaagaccagaaatgtccttaagctaaagtacacttgataggtgataggtgggggacacttccccacaaccgcctgggcctggggccaagtcagtaggctgtgcccctgggtaggaacacctttgggtg

SEQ ID NO: 159888 - DNA, 601 bp, Human
ggcaatggtccagcctccttattttagagttggggacactgagacccagagacagggcatgtttgctcaaggtcacccagcaacgcagaagtaggacctaaggtatctaccttcaaacccagcaaatttcctcatctggaatattctgaggacactcaaaccagacaccttgccctatcagaaggacctggttctgaccttaggaagccactgcattgttccgagcatcaatttcctgtaaaaatagagaaaatggtacctcgcagtactgggagatactcatactagcaataaataacaktaatgaaccatttagaataaagttacatgcacgaatttattcattcatacaagcatttcctgagtacaaactaggggacaggtatttcacaaaaacaaatagagcagagttcctgccctcggtgtgcggggggagagagggagggattcagcatttggtggagtatgttaattccctcaagttaattccttcaagagagagacctcttttgaatagtaggtacttaagttattaatcaaattgagagatggaaaggactctggaggctaccctgttcaaacctttcattttaaggtgggg

SEQ ID NO: 159889 - DNA, 601 bp, Human
gggacctagtacaaacatgtcctgtatgtcccctcgaggccccggacactgaaacagtgactcccaaaggacaaggtaaaactctgagctcattccaacacccccaccacagagctgtcctattagccaagagtttgaaaggaaatgggtgactcaggcaggctacgctagcatgcagtgactcacagcgctcggtccagccccttaccccaattttaagcattcatttggaaatcacactcgcctgtccagtccgggaggttgaaggacagctaggagccaacttctcccaacagggagmtggggctgggagcccagcctggcttccccagctcctcattcaggcaggctcagcactccaagtccttggaaaagccctctgtttctaggagctggggatggcaggagctgaatgtccccccgccaccccaacttctcttctgagactgggatttgtttagactcttcaccaaggaggccagcaaagggcccctcccctcatcaatgggctctctgggcaggaaggacccttggaaggcaatggtccagcctccttattttagagttggggacactgagacccagagacagggcatgtttg

SEQ ID NO: 159890 - DNA, 601 bp, Human
aggggctgtgaaagtgcgggacctagtacaaacatgtcctgtatgtcccctcgaggccccggacactgaaacagtgactcccaaaggacaaggtaaaactctgagctcattccaacacccccaccacagagctgtcctattagccaagagtttgaaaggaaatgggtgactcaggcaggctacgctagcatgcagtgactcacagcgctcggtccagccccttaccccaattttaagcattcatttggaaatcacactcgcctgtccagtccgggaggttgaaggacagctaggagccaayttctcccaacagggagatggggctgggagcccagcctggcttccccagctcctcattcaggcaggctcagcactccaagtccttggaaaagccctctgtttctaggagctggggatggcaggagctgaatgtccccccgccaccccaacttctcttctgagactgggatttgtttagactcttcaccaaggaggccagcaaagggcccctcccctcatcaatgggctctctgggcaggaaggacccttggaaggcaatggtccagcctccttattttagagttggggacactgagaccca

SEQ ID NO: 159891 - DNA, 601 bp, Human
ccaatgtttcaatgccctctggccagccccaggaagcaaagaggagtcctcacaaacatcagaaaatcctggggtcacaccaaacctgaacagtaccagcttttgctctctgaaaaaatgcaggccagttgcagcctcagttttgccttaaagaggaaaaaagtactacctgctctgcagaggtctaaagcccaattttgaggactggctgcacaatgtacaatgtcaaagtctacatgcaggcaaggggctgtgaaagtgcgggacctagtacaaacatgtcctgtatgtcccctcgaggccccggacactgaaacagtgactcccaaaggacaaggtaaaactctgagctcattccaacacccccaccacagagctgtcctattagccaagagtttgaaaggaaatgggtgactcaggcaggctacgctagcatgcagtgactcacagcgctcggtccagccccttaccccaattttaagcattcatttggaaatcacactcgcctgtccagtccgggaggttgaaggacagctaggagccaacttctcccaacagggagatggggctgggagcccagcctggcttccccagctcctca

SEQ ID NO: 159892 - DNA, 601 bp, Human
gtgtccagagtggtctgatacccttggcaaaccccctgccccctctccctccaggctgcaaactgttcagcatgaggctccagcaaatcccagcaggagaggtggggctgcccagaactggttcttgtttaaacataaacccattcgataattagcaaacagcccacttctaagataaacaaataggagatttggactccaaaagccccaccctagatttctcccttcccacctcccagctgtgggggtagataagggggataagggggatggagaaagctttccaggagacctgggctcwgaatcttcagagataggaccccctggcatgaaggtggcctgggcaaggaagggaactgtcactaagtaacacctcctccctaccaggcatggtactaggtgcctttatttacagccctgtcgtctcctttaagcttcgccacaccggtatcatgatcttcttaacagaccaggaggctggggctcagaggtggagtagcatgactgaattcatgtagccagtaagaggtggacttcgcacgtctggagttaagtctgtgtaacaccaagccaatgtttcaatgccctctggccagcccca

SEQ ID NO: 159893 - DNA, 601 bp, Human
gagatgcagcctgaaggggtgggggccgctgaataggaaggtctgggctgaaggtgggggttgggggaagcaggaggcaagaacaaggctgggaagtgggggagggaggaaggatagctgtagaaaggtcaaagccagaaagaactgctgagatcagagtgaccttttggggagtactgcagccccctgaaaaggataaaaaggtctaaaccccaataactgtaactcttagtttacattttcaacatatgcacagacaccacctccccaaagccaaactctggccgggttaagaaccctygtctaggtgctaataaagccagaactttacaagtttgccaaacagcgatgatgacctttgagtgccacaggtgttttatagaggacactggagttcacatcaacaaagtgacgtattaactgtgtgtgtccctgggtgagcagcagagctaggacgggggctggagttttctgtaccctctttttcagtcacccagccttcagcagatgggaccagagaggccccagtgagatgcaagaatgtgcccaaggtcaccactgtgttagttaatgacaaacaagcccaagaagtcaggcttat

SEQ ID NO: 159894 - DNA, 601 bp, Human
accacctgtcctaagcagacagaggtaaagaccatttttattttccccgaaggtgcaaatgacagtgaccagaaacacctgaaattctacttggggacctgggtccccagggacaaaataaataaataaaaatctagaaggtaaaaagaaactacacaccaatccatggtctggtgctctggtgcctgaatggttaaaccaggtctgggggtgggggtggagtgagggttcaaatgtcgccttcaaggtcgggttactctgaacacaatcactcaggagagagccaggcctggcactgccygcaaccagcttttcaccaagcctcagggcagcccattcccacagcaagaactccaggatcctagggtgccagctagaaatgggggaagggttcaggagcctctggatgtctccctgccaggagctgacccagcacccttgttactaactccctggatgatcgtggacaattcccttctctgagcctcagttttccaatctgtaaaagacaggtctcaaagagacaagcctccctctgtcccagcccagtaaccaagctgggcattgctccgattaccggtggagacagccaggagggggc

SEQ ID NO: 159895 - DNA, 601 bp, Human
ggaggtcgaggctgcagtgagctacgatcgtgccactgcactccagcctgggtgacagaggaagaccctgtctccaaaaaataaaaaatagggcaatgggcctaggtcccacagactctgctggccctgtggctggtggggatctgggattagtgcctgggggtttagagatactacattcttccccagactgttggggagaaagaagggaggggaagtgctcttttgttctacagaaactaacacctgccaacagaaggtatctgattttataacctagcaaacagacaagacaagggaytttgccaaggtcatccaagcagctggcagcggagatggacttagaacctaggtatcctggctcccagactggaattatcttctctccccttccagggtgttggctgcccctaagggtctcagcaaatccacaggcagcagctgtcattacagttatactccccatctagtcttttggctataggcatgaagctacgaaaaggtcctatcccaaccctatccccaaatcctatggcttctatcaccccaggaaaagcatgagtgactaaaaggagtatccactacatgccaagcaccatgc

SEQ ID NO: 159896 - DNA, 601 bp, Human
cttcttccagctcccagtggtgataggaggacacagggaattaaatctctccttgagctctggaagccccctctctgccctgttttggtcccttctccacccatgacctctgacaagagggaaggcaactccaaagtggataagagccatttaggactaggccagcaagacgggaccaagccccgtgggattgtgggcaatcactcttttttgtgtaaaggttgggaaggcaccaacggtcctcctctcctccgccctcttttcagataaagcccattgagtctggggtgactttgaagaaccaggccacccagcagccaggcccagccctgaccagagatggaccccgccctgctcctggctaagaatgtggtctgttctcctcagctcaccccacctttgcccaggcatgtgtgttcgtgtgtatacatgcacaggcaccctctctgggctctcaagtctccttgtatctttgtccctttcatgaacacacaacagaaattaccaactaagtaagacagtggtggctaggcacagtggcttaatcccaacattttgggaggccaaggtgggaggctcacttgagcccaagagtttgaga

SEQ ID NO: 159897 - DNA, 601 bp, Human
ggtcaatctagccgggagaaagaaagaatggtacactttggccagctgttgaccaggtcaaagtcctcaacaggggctgtagttccatcaggagacttgtctcaggctgagagaccttttcccacccctcactgcccccaggagccatggaaggttgtttatgcatccagcctctctttcagtatgtgaaagtgctaagaggtatttcaaaacaacccatgggattagcatgcccactggctgttaggaattacctccgttttacattagagaaatgaaggctatgagcgaaagtggggcrtgaagatcttgcagccaagtcagcagcaaaaccaaggctgaaaccaagatttattcccagttcagccctctttgtgggcacctgttcatccttaacccttcatttttatactcagtttccaaaaaagaaactagtctagtctgaagtcaccccggggctccgcggcacggcctggattcgatcctatttcaaagctctgaaaagatggagtcttcaaaggctgcatttagatgagcccaggatttccctcctacagcaagtcaaggggctgggaagaaacttcttccagctcccagtggt

SEQ ID NO: 159898 - DNA, 601 bp, Human
agaacccaggcttcactgacctggacatttaaccacaaacacataaacacacgcatgaacacatatgtacacggggtcaccagcctgccccaggctccaagggagccctgttaagtaggggggtcaatctagccgggagaaagaaagaatggtacactttggccagctgttgaccaggtcaaagtcctcaacaggggctgtagttccatcaggagacttgtctcaggctgagagaccttttcccacccctcactgcccccaggagccatggaaggttgtttatgcatccagcctctctttsagtatgtgaaagtgctaagaggtatttcaaaacaacccatgggattagcatgcccactggctgttaggaattacctccgttttacattagagaaatgaaggctatgagcgaaagtggggcgtgaagatcttgcagccaagtcagcagcaaaaccaaggctgaaaccaagatttattcccagttcagccctctttgtgggcacctgttcatccttaacccttcatttttatactcagtttccaaaaaagaaactagtctagtctgaagtcaccccggggctccgcggcacggcctggattc

SEQ ID NO: 159899 - DNA, 601 bp, Human
cacacaagcaggaagtagccacactgggccagaacccaggcttcactgacctggacatttaaccacaaacacataaacacacgcatgaacacatatgtacacggggtcaccagcctgccccaggctccaagggagccctgttaagtaggggggtcaatctagccgggagaaagaaagaatggtacactttggccagctgttgaccaggtcaaagtcctcaacaggggctgtagttccatcaggagacttgtctcaggctgagagaccttttcccacccctcactgcccccaggagccatgraaggttgtttatgcatccagcctctctttcagtatgtgaaagtgctaagaggtatttcaaaacaacccatgggattagcatgcccactggctgttaggaattacctccgttttacattagagaaatgaaggctatgagcgaaagtggggcgtgaagatcttgcagccaagtcagcagcaaaaccaaggctgaaaccaagatttattcccagttcagccctctttgtgggcacctgttcatccttaacccttcatttttatactcagtttccaaaaaagaaactagtctagtctgaagtca

SEQ ID NO: 159900 - DNA, 601 bp, Human
ccactccagtacccataatcatcactcagccactaccctgtggagacacagctgatcaggacagagtctcaggtccactcccaccaaaccgcttgccaaaagaaagtgtcaaaggtcccgggcagccctacagtacatcagttaccctgctcccatcctgtagctccaccgagtgggaacaatgtaccctcaagagcacaggaaacatttggatgcccatcacccttcctccagcttctgggctcaggcttctgtttgcccagagaacagcagctctgagcaaagttcattattctactarttaattcaaacactaaagtgcctagtatttgccaggagagttggggtttttcattaagttcaatacaccatgcccctcccgctgaaagacattcccatcttctccagacgccataactgcaggagctgggggtctgcttagaatcacagaatgccaggacccaaggagctcctgtcctcccgtttcacacaacttgaatctgagcccggaacagggcagggacttgcccaaggtcacacagagcgttcgctacataactcaggatagaaagaggtcaggtctctgtttcggacaccccag

SEQ ID NO: 159901 - DNA, 601 bp, Human
tttttgtgtttttgtagagacaagttctcaccatgtggcccaggctggaacttttcctttcaaaaaaaggaaaacactctatgggtcctccttccccactcccaccctgtcctgccacccatcctaccctcaccccacccccaccatgccctgcagaaaagagaagagcttatgaggacacgttcaggctggagctcagaaaacccagagctaccaatgacttcaaagcagcaaacagcttgtccccaggggctctcagggatggaataggttaatccattacttttgtttcccctttttytgagaaggaagaagggcactctaggaaaagtcccacaaaaatccaagtctcaaggcatggtcaccctcctggctggtgaagccaccactccctccagctttgtgcctacgcctgcccaccacaccttccgtacccagatctccagagccagacagctcaaagtcatcagattcctgcccgggccccactacatcctcatcgtctggtagggctccggagaagtatcggccttctaggaggtcctgggggtcgatgacctcagtctctcggatctaagataaagaaaggagacacatcagc

SEQ ID NO: 159902 - DNA, 601 bp, Human
tattttttttttaaaccaaacacacacgtactgagtgcttggtaggtgccaaaacctttaagtcagttcagtccccacaacactgatgtactatctttattattcccattttacagattagaaaactgaagctcagttcacacaggatggaggcttgaactcaggaccatgtgactccaaagctaaaacttgcaaagctaaaacttgcaatcattaacacctctctgcacataggagggacacttattagctgtctggcctagaggccttgggcccttcacccgcccccacccccactgamgcagggacttgttcttggtttcccaactacatctctgcccactcatgccccctcccaccccatccccacttctaagctgctacttttccttttttgttttgagacagggtctcactctgtcacccaggctggagtgcagtagcatgatcttggctcactgcagccccaacctcctaggctcaagggatcgtcccacctcagcctcccaagtagctgggactcctacaggtgcatgccaccacatccagctaatttttgtgtttttgtagagacaagttctcaccatgtggcccaggctgg

SEQ ID NO: 159903 - DNA, 601 bp, Human
gggcaaccagcagccaatgccactgctctacctatggagtagccattcttttattcctttactttcttaataaacttgttattgctttgcaaaaataaaaaagatgtttgctgcagtgttataattttaaaatgttaacaaattataagccatttttccgtcaataaagggaatcaggtaaactattacgcagcctataaaaatgacaagagcattaaattatgcagggaaatactcatgaccagtctaagtgaaaaacgcagttcatagaattatatatatatactttttttttttttttgagagggagtctctgtcgcccaggctggggtgcaatggtgcaatctctgcccactgcaatctctgcctctcaggttcaagcgatcctcctacctcagcctcccaatcaagtagctgggactacaggcgcacgccactgtgccaggctaattttttgtatttttagtagagatagggtttcaccatgttggccaggctggtctcgaactcctgacctcaggtgatctgcccgtcttagcctcccaaagtgctgggattacaggcattagccactgtgcccggcctatatatatacttttct

SEQ ID NO: 159904 - DNA, 601 bp, Human
accaccaaaaacaggatggcaatgaaactgttggtctcactgctcattatatgctaattatactacattagcatgctaagagacactcccatcagtgccatggcaatttacaaatgccctggcaaagtcaggaagttactctatatggtctaaaaaggggagtagcccctagttctgggaattgcccacccctttgttggaaaactcatgaataatctaccccctgcttaacatataatcaagaaataaccataaaaatgggcaaccagcagccaatgccactgctctacctatggagtarccattcttttattcctttactttcttaataaacttgttattgctttgcaaaaataaaaaagatgtttgctgcagtgttataattttaaaatgttaacaaattataagccatttttccgtcaataaagggaatcaggtaaactattacgcagcctataaaaatgacaagagcattaaattatgcagggaaatactcatgaccagtctaagtgaaaaacgcagttcatagaattatatatatatactttttttttttttttgagagggagtctctgtcgcccaggctggggtgcaatggtgc

SEQ ID NO: 159905 - DNA, 601 bp, Human
aggggacagggacattcagccaggcagagaatctggttctgccatattcagctgaaccatatggtcctggagcaggaattggcaacactgtctccacaattatgctgccaaaatccttatccccaacttttttagtatatctgtcccaaatgaaaaatgaatgcacccaagggaacagggaagcaggtgctctcctgcactgctggccactggttattctagagcaaccactctggaagcaatttggcaaaaccttagacatcgcttgccctttaaggtggcagttttgccctggaaactstattgtaaggagctcttcagagactacgtgtaaaagatgcttgctgcagctcctctgcctatgaagtagccattcttttattcctttactgtcttaataaacttgctttcactttactctatggactcaccctgaattctaccttgtgcaagatccaagaaccctctcccttggggtctggatcgggacccctttctggtaacatctttctggagaaccacagaagggatgagacggaggagactcccgaatcaaaggaaatggactgcagcactgattggaggactttggatatcacct

SEQ ID NO: 159906 - DNA, 601 bp, Human
ttcgaaagcttctcagccaaggtcacaaggctgccaagtgatagagtagggggaggggaagctaacccaattcgaaggagcctccagacttacaagggaaattaacttttaatgattaactcccagatgccaaacttatacagtgaaagtcctttgcaaaataaatgagaaagacttaaggcagaagaatgactcaatgcctattttccagaagactttgataggtgctttttcctctccctccaccaggctgcacagtcagagccaccccataaggaaggtgtagtctttcaatgttctrgggcaacctgaataggcaaaaggaaggggcaccaaggagcctcatggctggaggcatccctgcctgcaggtgctctcccccgctgagccccattccaccttcaaggcatcttataagcagcatggggacttacctgccaggacctccgttctctcaaagatgttgctgccctgcacagtgctggacattgacaccttgttggacacatcctcactctcttcaacgggtgagattctcttggggataacctcattctcctctagtttcttgggttcggtggggacttggctcccagaccct

SEQ ID NO: 159907 - DNA, 601 bp, Human
aaggaaactgaggctcatcaagttcgaaagcttctcagccaaggtcacaaggctgccaagtgatagagtagggggaggggaagctaacccaattcgaaggagcctccagacttacaagggaaattaacttttaatgattaactcccagatgccaaacttatacagtgaaagtcctttgcaaaataaatgagaaagacttaaggcagaagaatgactcaatgcctattttccagaagactttgataggtgctttttcctctccctccaccaggctgcacagtcagagccaccccataaggamggtgtagtctttcaatgttctagggcaacctgaataggcaaaaggaaggggcaccaaggagcctcatggctggaggcatccctgcctgcaggtgctctcccccgctgagccccattccaccttcaaggcatcttataagcagcatggggacttacctgccaggacctccgttctctcaaagatgttgctgccctgcacagtgctggacattgacaccttgttggacacatcctcactctcttcaacgggtgagattctcttggggataacctcattctcctctagtttcttgggttcggt

SEQ ID NO: 159908 - DNA, 601 bp, Human
gccaaatcggaatagccctttatagtgtgcaaagttatttcatattttatttttcatggactcattatatcaaccccagaaggtatcactgtacccattttacagataaggaaactgaggctcatcaagttcgaaagcttctcagccaaggtcacaaggctgccaagtgatagagtagggggaggggaagctaacccaattcgaaggagcctccagacttacaagggaaattaacttttaatgattaactcccagatgccaaacttatacagtgaaagtcctttgcaaaataaatgagaargacttaaggcagaagaatgactcaatgcctattttccagaagactttgataggtgctttttcctctccctccaccaggctgcacagtcagagccaccccataaggaaggtgtagtctttcaatgttctagggcaacctgaataggcaaaaggaaggggcaccaaggagcctcatggctggaggcatccctgcctgcaggtgctctcccccgctgagccccattccaccttcaaggcatcttataagcagcatggggacttacctgccaggacctccgttctctcaaagatgttgctgccc

SEQ ID NO: 159909 - DNA, 601 bp, Human
tctttcccccactgtcagttctcttacaaccagacatcctcaccatcaccactgcctgtgccaggcaagctgatgccttatttaagttgacctcatgaccccagttataagaagtgggtcgttggcattttaagtcactgaagaccacagggctagtggtaaggccactcctttttctttttgagacgaagtctcactctgttgcccgagctgagtgcagtggcgtgatctcggcttactgcaacctccacctcccaggttcaagcaattctcctgcctcagcctcctgagtagctgggaytataggcacgtgccaccatgcccggctaatttttgtatttttagtagagatagggtttcactatgttggccaggctggtcttgaactcctgaccttgcccatctcggcctcccaaagtgctgggattacaggcgtgagccaccgcactcggccaaggccactattttaacccacatctgcctgaatctaaagcctaggctctttccaaacaccacgcggactcccctgcaacagtctagcactaactgaaccaggaacaggagaaaaccgtaggctatggaaatccctgtagacatattt

SEQ ID NO: 159910 - DNA, 601 bp, Human
ccacaagcaagcttcacgcgtagaactcattggtgggggctttcttgtagatgggtttcttgcccaggtcatagctgccttcatccttcttcttcatacggtacatgagcagtaggatcaggaagacggcaaagaggatgcccacgatgccacccacaatcagagctggagaggaggagagagaagaggcgggggtgagagctcctcatcaggacctaaggatgaacccctctttcccccactgtcagttctcttacaaccagacatcctcaccatcaccactgcctgtgccaggcaagcygatgccttatttaagttgacctcatgaccccagttataagaagtgggtcgttggcattttaagtcactgaagaccacagggctagtggtaaggccactcctttttctttttgagacgaagtctcactctgttgcccgagctgagtgcagtggcgtgatctcggcttactgcaacctccacctcccaggttcaagcaattctcctgcctcagcctcctgagtagctgggattataggcacgtgccaccatgcccggctaatttttgtatttttagtagagatagggtttcactatgttggc

SEQ ID NO: 159911 - DNA, 601 bp, Human
ataatttttccaaattaaacaccccatgggcagttctgcatgcgcccaaaactaagccacatcctacagatgaagaaactgaggcccagaaaggtgaagtggggaacttaaacccagtcccatatgttccaaagcccttgcttccctctccccagcaggaggagctggctgcagagggaggacctgcttccgctcccctcctcccactggtgagggctgggccccagttcacctgtcaactggagctgggtttcccagggctgaagaaggagcagcaacacgggccagcaaagaaggcctytcatggcgcttggggacagagaatggaggtgtcagagcctggagggaggaaggaaaatagaaaagcaacagtatttacagagctcttattctgggtgataggcacttggagggggaagacagttacaggtttattttactaatctctctatttttgtgtatgtttgaaatgtttcagaattaaaaaattctcatcacagtgggattgctgggaaacacaagagattctttttttttttttttttttttttttttagatagagtcttgctctgtcgtcccggctggagtgcagtggcatga

SEQ ID NO: 159912 - DNA, 601 bp, Human
tgctggcaaccatgtcccccctcagcacactggtccttccctgaggacacacaggactagaatcagtagggaacagatgggcagaagcctccaacaagagagagctggatggggatggggtcagaggcaggcatcaccctcaaatggctttcagaaggaaatgactaatttgagaagggccgtaccaagtgagagggcttagggaaagaataaggcttaaggagcccctgtgagtaggctcagaagaggagacactcaattagacacgtcagtgggctgggacaggactacacaggggcargagtgggtaggaaggtggagaggtgctaagtcgaggtgggcggaataaactcaaaacagatcagaacagatcttgcagcatttgtgggaggagctaagatgataatgggagaagtcatccccatgtgggagggccacgactctttggagcagccgatccctcttagctttgagaatcactggttccgtgtgtgcagggggttggtgctggaatttgacattaagcctgtggtaagctgtggcgggtagggcaagaaattataggttgctccttgttgatggaggctgagcagaagtggtc

SEQ ID NO: 159913 - DNA, 601 bp, Human
gccgggcgcagtggctcacgcctgtaatcccagcactttgggaggccaaggcgggcagatcacttgaggtcaggagttcgagaccagcctagccaacatggtgaaaccccatctccactaaaaatacaaaaaatagctgggtgtggtggccagcacctgtaatcccagctacttgggaggctgacacacaagaatcacttgaacccgggaggcggaggttgcagtgagctaagatcgcaccattgcactccagcttgggcaatagagccagactctgtctcaaaaaaaaaaaaaaaaaaaagagagagaaaagaaaagaagaaaacagaaacaagtttgggaggttgattagagactggcctgaaaacagggagaaagagggcagaaagcacactgaactgtgggctcccaccagggacttatgtgaccccaggcaatacctttctttcttaggcctgtaaagtgatggaggtgtgcttttactgccaaaggcccttccagactcattggtctgatgttggggcaatggagagccaaagaaggttcaggagcagtgagattgcaggacagggatagctgtcatccaaacagctcttgttat

SEQ ID NO: 159914 - DNA, 601 bp, Human
aggaaagagatggaaggagggaatggcacaccctccaatgtcacccccacaacacacacagacattcacaccacagcctaggggccacagcaatggcaaagtcaaggacactccgaatgtgggcaatggggcagaagccaacagaacaccctcccgcccatcactcacggttgcagctcttgccatctgcctgaagttgccgcccctcggggcacaggcagcggtaggagaggccctcgctcacacactggaactcacagccatggtccacgccattgcaaaggtcccggactgaaaggaragacaggtcaggatgagtcaggatggaccccaccagctaagatctcttacccctcccacaaatgtaggagagccctcctcaccctgacagctcctcccatcaggctgcaagtcatggccctctctgcagtggcaccgtggcccaccaggggtgctaacacactcatgctgacagctatggttcccaaagctgcagtagtcaatggctggcaggagggaagaaacagcaagatgttgcctctgattggagccctcggaggccacagtccagggtgtggtgggagggtgggggtgttgctca

SEQ ID NO: 159915 - DNA, 601 bp, Human
gtaacccagtaatttgatttcattattcattaatgtggttctgctcaccatttgaaatacttaggggtaagtcatttgatctttctcctgtagtcattggtgagccacagaaggcttgtgcacaaaggaggaatgtgatcaaatatgtatttttaaattaacattgacagcagagtagaggattgtaggaaagagatggaaggagggaatggcacaccctccaatgtcacccccacaacacacacagacattcacaccacagcctaggggccacagcaatggcaaagtcaaggacactccraatgtgggcaatggggcagaagccaacagaacaccctcccgcccatcactcacggttgcagctcttgccatctgcctgaagttgccgcccctcggggcacaggcagcggtaggagaggccctcgctcacacactggaactcacagccatggtccacgccattgcaaaggtcccggactgaaaggagagacaggtcaggatgagtcaggatggaccccaccagctaagatctcttacccctcccacaaatgtaggagagccctcctcaccctgacagctcctcccatcaggctgcaagtca

SEQ ID NO: 159916 - DNA, 601 bp, Human
agatcatgcagggatcccaaggtaggaatagtgtattcttcctggagttgttaaggaaggctgcatggagatgatggccttctatctgatctttgttatgaactgaatgagtgtgtttcccaaaattcatttattgaaaccctacgcctttatgtgatagtctccggaggtgagatctttggaggttaattaggattagatgaggacatgagggtacagcgcttatgagtaaaattactgtccttgtaagagtctgaagaggtcaggcatggtggctcccagcactttgggaggctgaggygggcagatcacttgaggttaggagttcgagaccagcctggctgagatggcaaaaccccatctccactaaaaatacaaaaattagccaagcatggtggggcacacctgtagtctcagctactccagaggctgtaacaggagaatcagttgagccccagaggcagaggttgcagtgagccgacatcgcgccactgcactccagcccgagaaacagagggagacttagtctcaaaaaaaaaaaaaaaaaaaaaagagtcgaagagggcttgcttcctgtcttcaccatgtgaggacacagcaa

SEQ ID NO: 159917 - DNA, 601 bp, Human
gccaggaaagttgctaggcccaaaatgtggtgtgtgttggcgtggggaggttttcaaaggttttgaaataattaaaacataatcctgttccatgaggacagagcagagcaagtcagacatgctatgtgctctggtcaaggaaagtgctagaagagaagatcatgcagggatcccaaggtaggaatagtgtattcttcctggagttgttaaggaaggctgcatggagatgatggccttctatctgatctttgttatgaactgaatgagtgtgtttcccaaaattcatttattgaaaccctaygcctttatgtgatagtctccggaggtgagatctttggaggttaattaggattagatgaggacatgagggtacagcgcttatgagtaaaattactgtccttgtaagagtctgaagaggtcaggcatggtggctcccagcactttgggaggctgaggcgggcagatcacttgaggttaggagttcgagaccagcctggctgagatggcaaaaccccatctccactaaaaatacaaaaattagccaagcatggtggggcacacctgtagtctcagctactccagaggctgtaacaggagaatc

SEQ ID NO: 159918 - DNA, 601 bp, Human
cgcaaacatttattatataacagacaacatttcctgagtccttcctgtgccaggcagtgtgctaagtaataataattatcaccatcatcatcaccatcaccatcatcatcaccctcatcatcgcccttgacatttattcagtgcttagaacaaaccactctgctaaaagcatctttttttaacaacaatcatagtaatgaccacaataactaccatttattgatcatctactatgtatcaggcacacttctaagcactctaccagtattaacaataataataacaaaaacattatttaccracagcttaccatgtggtaggtactgggtgaagtgcttatatatattctcaatcctcccaataagcttgaatattgtccccattttctatgacctgaggttctgatggataaagtgattgccccagatttcatagctagtactgactgagccaagacatgaagccaggtccatctgactccaaaacccatgctcctgaatgactctacaatgtcacctcccctattctgagccaggaaagttgctaggcccaaaatgtggtgtgtgttggcgtggggaggttttcaaaggttttgaaataa

SEQ ID NO: 159919 - DNA, 601 bp, Human
ggatttcttagactttaatatgcttacaaatcacctgagaatcttgtcgaagtggaaattctgattcattcggtctggagagcaccagaaatgtttcagttctaagaagctaccgggtgaccgccctgccgctggcctgcagaccacatttggagtagcaaagctctgtctagtgagcccaacctctggctataactacaaagtgggcagggagtgaataggaaggggagatatcagaggacgggcaatgagagagaggaggagccccgagagagatgcgctcacctggacagatgctgcytctgaggttctccagcaggtgcgtcatggtgccgaagtccggggcataggacacgtgcagttccgctggctccgaggcgatctcgcgcagctccgcctccaccgccttgcccacgcccacggcgtacatgacgatgcctgcaaggccggggtctcagagggtgccccaggcctcgggaaagctgcctcccagcgtctgacccaaccccagcccactgtgtcccatgccaagcccaccttcctccttggcgcgcgctgcccacaccgagatgtcatcctgggagcggccatccgtgaagac

SEQ ID NO: 159920 - DNA, 601 bp, Human
aacctccactgatttgggggacaggtagcctagtctaggatttcttagactttaatatgcttacaaatcacctgagaatcttgtcgaagtggaaattctgattcattcggtctggagagcaccagaaatgtttcagttctaagaagctaccgggtgaccgccctgccgctggcctgcagaccacatttggagtagcaaagctctgtctagtgagcccaacctctggctataactacaaagtgggcagggagtgaataggaaggggagatatcagaggacgggcaatgagagagaggaggakccccgagagagatgcgctcacctggacagatgctgcctctgaggttctccagcaggtgcgtcatggtgccgaagtccggggcataggacacgtgcagttccgctggctccgaggcgatctcgcgcagctccgcctccaccgccttgcccacgcccacggcgtacatgacgatgcctgcaaggccggggtctcagagggtgccccaggcctcgggaaagctgcctcccagcgtctgacccaaccccagcccactgtgtcccatgccaagcccaccttcctccttggcgcgcgctgcccaca

SEQ ID NO: 159921 - DNA, 601 bp, Human
aaaaaaaaaaggcaaattctccagacccaaaccagccctacttagtctgtttctggagctgcagtctgataaatgggaagaagagtcacatcttaagcctgggctagtgtctaaagtctctagggtaaaagttaccctggagacattccctgtatcacctagagcacagtacactgcatgcgattcaagagtccccttcttcacaggtagagtcagtctctttttcctcagctgagcaccagatgatgaagtagagggattgcacttatgaggtatgttgtccccaataaaaaaaaaaaaagtctttgcatacttaaaatatattcagtcctgccactttgccaagttcataaggttgaattctaacaagttcagggatatatgctgtggctccacttacaaatgctgtctggtgtgccttcaaaaaaatttcccaaattattctgaacctccactgatttgggggacaggtagcctagtctaggatttcttagactttaatatgcttacaaatcacctgagaatcttgtcgaagtggaaattctgattcattcggtctggagagcaccagaaatgtttcagttctaagaagctaccgggt

SEQ ID NO: 159922 - DNA, 601 bp, Human
tatatatactttttttgagacagggtctcactctgtcaccaggctggagtgcagtggtgcaatctcggctcactgcaacctccacctcccaggttcaagcaattctcctgcctcagtgcccaccaccttgcccggctaatttttgtattttttggtaaagacagggtttcaccatgttgccaaggatggtctcgaactcctgatctcaagtgatccagccgcctcggcctcccagagtgctgggattacagatgtgagccactgcgcccagcccccctacatatatctaaaaaaaaaaaaaggcaaattctccagacccaaaccagccctacttagtctgtttctggagctgcagtctgataaatgggaagaagagtcacatcttaagcctgggctagtgtctaaagtctctagggtaaaagttaccctggagacattccctgtatcacctagagcacagtacactgcatgcgattcaagagtccccttcttcacaggtagagtcagtctctttttcctcagctgagcaccagatgatgaagtagagggattgcacttatgaggtatgttgtccccaataaaaaaaaaaaaagtctttgca

SEQ ID NO: 159923 - DNA, 601 bp, Human
tgcatgcatacacaaacacatattatataatatagtatatatagtatattatatatactttttttgagacagggtctcactctgtcaccaggctggagtgcagtggtgcaatctcggctcactgcaacctccacctcccaggttcaagcaattctcctgcctcagtgcccaccaccttgcccggctaatttttgtattttttggtaaagacagggtttcaccatgttgccaaggatggtctcgaactcctgatctcaagtgatccagccgcctcggcctcccagagtgctgggattacagrtgtgagccactgcgcccagcccccctacatatatctaaaaaaaaaaaaaggcaaattctccagacccaaaccagccctacttagtctgtttctggagctgcagtctgataaatgggaagaagagtcacatcttaagcctgggctagtgtctaaagtctctagggtaaaagttaccctggagacattccctgtatcacctagagcacagtacactgcatgcgattcaagagtccccttcttcacaggtagagtcagtctctttttcctcagctgagcaccagatgatgaagtagagggatt

SEQ ID NO: 159924 - DNA, 601 bp, Human
aaggtaggtgtggggtaagtgactcgtccaaagtcacactgcagggcccataagagtcacataggaagagctctgaaagagcccctaatctgaaagagccacaataattagaattggctgagagcggggagggaaggagagttgggggaaggactgtatgtgtatatttgtatatgtatatacatgcacgtgcatgtgcatgcatacacaaacacatattatataatatagtatatatagtatattatatatactttttttgagacagggtctcactctgtcaccaggctggagtgcagtrgtgcaatctcggctcactgcaacctccacctcccaggttcaagcaattctcctgcctcagtgcccaccaccttgcccggctaatttttgtattttttggtaaagacagggtttcaccatgttgccaaggatggtctcgaactcctgatctcaagtgatccagccgcctcggcctcccagagtgctgggattacagatgtgagccactgcgcccagcccccctacatatatctaaaaaaaaaaaaaggcaaattctccagacccaaaccagccctacttagtctgtttctggagctgcagt

SEQ ID NO: 159925 - DNA, 601 bp, Human
acagggaacagtcataccaccaattgataaagagcttcaaccacaaaacccagacttctcttagaactctagaactagaggtaaccttgggcagccagtgcctctcctgttaccgaagagaaaagttaaggtaggtgtggggtaagtgactcgtccaaagtcacactgcagggcccataagagtcacataggaagagctctgaaagagcccctaatctgaaagagccacaataattagaattggctgagagcggggagggaaggagagttgggggaaggactgtatgtgtatatttgtatrtgtatatacatgcacgtgcatgtgcatgcatacacaaacacatattatataatatagtatatatagtatattatatatactttttttgagacagggtctcactctgtcaccaggctggagtgcagtggtgcaatctcggctcactgcaacctccacctcccaggttcaagcaattctcctgcctcagtgcccaccaccttgcccggctaatttttgtattttttggtaaagacagggtttcaccatgttgccaaggatggtctcgaactcctgatctcaagtgatccagccgcctcggcc

SEQ ID NO: 159926 - DNA, 601 bp, Human
catcctggctaacacggtgaaaccccatctctactaaaactagaaaaaattagccgggcgtggtggcatgcgcctgttgtcccagctactcgagaggctgaggcaggagaatcgcttgaacctggcaggcagaggttgcagtaagccgagatcgcaccactgcactccagcctggatgacagagcgagactccatctcaaaaaaaaaaaaaaaaaaaaaaaaaaagattacagggaatgacatagaaaaaaaaaatgctacaataaaagtaccttaggaaaaaaaagaaaaaggattacasgtggtgaaataataagcacaatacctgccatttaacctttgaaaacactgccataatgatttaaaagttgtctcttcatcttagtcttatatgtactatgaacaaactgctggaatccagcaaagacccctaacttcacagatttgtttctctaaacaaagggttggagacagggaacagtcataccaccaattgataaagagcttcaaccacaaaacccagacttctcttagaactctagaactagaggtaaccttgggcagccagtgcctctcctgttaccgaagagaaaagttaagg

SEQ ID NO: 159927 - DNA, 601 bp, Human
tttgggaggctgaggcgggtggatcacgaggtcaggagatcaagaccatcctggctaacacggtgaaaccccatctctactaaaactagaaaaaattagccgggcgtggtggcatgcgcctgttgtcccagctactcgagaggctgaggcaggagaatcgcttgaacctggcaggcagaggttgcagtaagccgagatcgcaccactgcactccagcctggatgacagagcgagactccatctcaaaaaaaaaaaaaaaaaaaaaaaaaaagattacagggaatgacatagaaaaaaaaaatgctacaataaaagtaccttaggaaaaaaaagaaaaaggattacaggtggtgaaataataagcacaatacctgccatttaacctttgaaaacactgccataatgatttaaaagttgtctcttcatcttagtcttatatgtactatgaacaaactgctggaatccagcaaagacccctaacttcacagatttgtttctctaaacaaagggttggagacagggaacagtcataccaccaattgataaagagcttcaaccacaaaacccagacttctcttagaactctagaactagaggtaac

SEQ ID NO: 159928 - DNA, 601 bp, Human
aaaccactgctttatagtgtatttcaactagaccagtgattctcaaagtgtggtccttggaccagcagcatcggcatcgtgtaggaatttatcaaaaatgctaattatcagacaacaccccagacttgctgaattagaaaatctagagttgaagcccagcaatttgtgtttgtttttgttttgttttttgagctctgtctcccaggctggagtgcagtggtgcaatcttggctcactgcaacctctgcctcctgggttcaagtgattctcctgcctcagcctcccgagtagctgggattayaggcatgtgccaccatgccctgctaattttttgtatttttagtagagacggggtttcactgtgttagccaggatggtctcgatcccctgaccttgtgatctgcccacctcggcctcccaaagtgctgggattacagccatgagccatcatgcccagctgcaatttgtgtttttaaaggtccaccaggtgattctggtgtgacctaatttttaggaaccactgatcctgatccaactctatctccccacacatcaacatcttgggggttgggcaggaggccttacaattaaaactggcaca

SEQ ID NO: 159929 - DNA, 601 bp, Human
ggtgccaaaaaggttggaaaccactgctttatagtgtatttcaactagaccagtgattctcaaagtgtggtccttggaccagcagcatcggcatcgtgtaggaatttatcaaaaatgctaattatcagacaacaccccagacttgctgaattagaaaatctagagttgaagcccagcaatttgtgtttgtttttgttttgttttttgagctctgtctcccaggctggagtgcagtggtgcaatcttggctcactgcaacctctgcctcctgggttcaagtgattctcctgcctcagcctcmcgagtagctgggattacaggcatgtgccaccatgccctgctaattttttgtatttttagtagagacggggtttcactgtgttagccaggatggtctcgatcccctgaccttgtgatctgcccacctcggcctcccaaagtgctgggattacagccatgagccatcatgcccagctgcaatttgtgtttttaaaggtccaccaggtgattctggtgtgacctaatttttaggaaccactgatcctgatccaactctatctccccacacatcaacatcttgggggttgggcaggaggcctta

SEQ ID NO: 159930 - DNA, 601 bp, Human
caagccacatgtggctgtttaacacttcaaatatgactggtgctactaaaggactaaaatgtattttattttaatcaattgtaattaaataggtactgcctacctttttgaaaaagcacagatctagaacactgcctggttcaagtaaatactttacagcaggggtccccaatccccaggccatggaccagtaccagcacattacatggaccagtaccagcccatggcctgttaggaactgggccacacagcaggaggtgagcagccagcatgcaagggagcttcatctgtatttatagcygctcctcattgctcctattacaacctgagctcctttcctgtcagatcagtggcattgttagattctcatgggagcacaaaccctattgtaaactgtgcatgtgagggatctaggttgcaggcttcttatgaaaatctaatgcctgatgatctgtcactgtctcccatcacccacggatggcaccatctagctgcaggaaaacaagctgagggctcccactgattatacattatggtgagttgtataattatttcattgtatattacaatgtaataatagaaataaagtgcacaataaatg

SEQ ID NO: 159931 - DNA, 601 bp, Human
tttttatttttttaagaacacaaacaagaaatccaacaaagaactgagcgcagcacgcggcgagggcgtgccggtctagcacgtgccccttccctcaccacccgctatccccctgacgccgcagtccgcctaatggtccgggcgaggccaactcagctcaatgccggaagcccgccagcgcctccgccccgacagcccaagccggacgggcccaggttctgcctggccccggcgcaccgatggcgcgcaaggggcaccgtccgtggtgccgcgccccagcccgggtctgggccgtccgtgrccctcacttctggttggccagctggttctccagatcctccaggcgcgccgtcagctgggccagtgagcggttaaggaggccgttggggttcgccgaggtcccttcactttccctccagcccgcgccaccagccccaaaggatatggttcagcgtcaggctctcgagcgcccccagcgtgcggccctggaactccacgaggctttcgcattcgcatgggctccgaagctctgtccctgcgctgatgccctcctctgcaagccggacacagagggtcagggggatgagaaattgccctagct

SEQ ID NO: 159932 - DNA, 601 bp, Human; identical to SEQ ID NO: 159911

SEQ ID NO: 159933 - DNA, 601 bp, Human; identical to SEQ ID NO: 159912

SEQ ID NO: 159934 - DNA, 601 bp, Human; identical to SEQ ID NO: 159913

SEQ ID NO: 159935 - DNA, 601 bp, Human; identical to SEQ ID NO: 159914

SEQ ID NO: 159936 - DNA, 601 bp, Human; identical to SEQ ID NO: 159915

SEQ ID NO: 159937 - DNA, 601 bp, Human; identical to SEQ ID NO: 159916

SEQ ID NO: 159938 - DNA, 601 bp, Human; identical to SEQ ID NO: 159917

SEQ ID NO: 159939 - DNA, 601 bp, Human; identical to SEQ ID NO: 159918

SEQ ID NO: 159940 - DNA, 601 bp, Human; identical to SEQ ID NO: 159919

SEQ ID NO: 159941 - DNA, 601 bp, Human; identical to SEQ ID NO: 159920

SEQ ID NO: 159942 - DNA, 601 bp, Human; identical to SEQ ID NO: 159921

SEQ ID NO: 159943 - DNA, 601 bp, Human; identical to SEQ ID NO: 159922

SEQ ID NO: 159944 - DNA, 601 bp, Human; identical to SEQ ID NO: 159923

SEQ ID NO: 159945 - DNA, 601 bp, Human; identical to SEQ ID NO: 159924

SEQ ID NO: 159946 - DNA, 601 bp, Human; identical to SEQ ID NO: 159925

SEQ ID NO: 159947 - DNA, 601 bp, Human; identical to SEQ ID NO: 159926

SEQ ID NO: 159948 - DNA, 601 bp, Human; identical to SEQ ID NO: 159927

SEQ ID NO: 159949 - DNA, 601 bp, Human; identical to SEQ ID NO: 159928

SEQ ID NO: 159950 - DNA, 601 bp, Human; identical to SEQ ID NO: 159929

SEQ ID NO: 159951 - DNA, 601 bp, Human; identical to SEQ ID NO: 159930

SEQ ID NO: 159952 - DNA, 601 bp, Human; identical to SEQ ID NO: 159931

SEQ ID NO: 159953 - DNA, 601 bp, Human
aggcctggcccatccagactcccaggtaaccccgaatactcttttttcaggctacagcaggagctgatgaccctcatggtgagtgattaagtgcccagaaccccagccttccatccaattttcagtagcctccttttttccgtcagcttttttgctagacataggggtaatgtaatttgctccctcctgggaaagaagttcatacaccccacctacaccatttcttccagcagtccctcctcccaattccatccccccacacgaagttatctcgaacacttccctgaagtcatacaagacyctccctatccagtgtgtccctacttcctagccccaaccaagctttacccacacccaactccccgcccttcttggtatttctagcctatgaatttggttgctttattttggatcagagtgatgagattaaggggaggctgggcgcggtagctcacaccttataatcccaacactttggggggctaaggtgggcggatcacttgaggtcaggagttcgagaccagcctggccaacattgcaaaaccctgtctctactaaaaatacaaaaattatccaggcatggtggtgcatgcctgtaatt

SEQ ID NO: 159954 - DNA, 601 bp, Human; identical to SEQ ID NO: 26967

SEQ ID NO: 159955 - DNA, 601 bp, Human; identical to SEQ ID NO: 26968

SEQ ID NO: 159956 - DNA, 601 bp, Human; identical to SEQ ID NO: 26969

SEQ ID NO: 159957 - DNA, 601 bp, Human; identical to SEQ ID NO: 26970

SEQ ID NO: 159958 - DNA, 601 bp, Human; identical to SEQ ID NO: 26971

SEQ ID NO: 159959 - DNA, 601 bp, Human
ggggggaacaagtcagaagaatataaataagaaagtaaaaatcacttctaatcttaccacccagagaaccattattaacatactccttccaggcttttcccttatatatttgtgagcatgtacacaaatgtatcttaatgttaaaataggattcttgtggtatttataatctgctttttttccactcagatttcttttgagagcctttccattatctgtttagctctgcatcattttaaaggcctacaaaacatttcattatatggctatactttaattatcccctatggatggtcaaagygatttttaacagaagaatacaggcatctgctgttatgacctgggctaaacaacatttagtagcttggatgaaaaattggtgtttttttaatcttccaaaaaattatttagaagcagtagtgtatatcttgaatctcaaacatagttttaacatctcgtgaataattctaaattcttaacaatgttcattttttaggagctgttggacaaatatcttattcccaatgctacacaaccagaaagtaaggtgttctacttgaaaatgaaaggagattattttaggtatctttctgaagtggca

SEQ ID NO: 159960 - DNA, 601 bp, Human
tgttttaggcatttgatgaagcaattgctgaattggatacgctgaatgaagagtcttataaagacagcactctgatcatgcagttacttagggacaatctcactgtaagtactacttccacagggtttatagtctctttcctattcacctacttaataattcactgttatcttcaagaggggatttgtaccattaaatgtagttacagttttaagttgttaaatttgttataaatgactgctgaagttttgacctttgcaatcatccctgtctgcagtgacacaggaataattttaaactrtcgagtgagataagattatacatactgggccacttacctagggaacttttagtagccctgctttgattatacttcctttctcttgcagctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaagagaatcgtacgtcgactttcgatttttcacagcctcagcctaggaaaaatggttcatgggataaa

SEQ ID NO: 159961 - DNA, 601 bp, Human
agaagaaaaaaaaatagttaaccacttctacttcttgatagagaaagcacactaagaaaataaaagagttataaggaaaacgctgagaggaaggcgagccatgaaaatggcggccgccaaatccggttcccgggagagagggggaggggaagctccgcagcctcgctcacgaggacctgctgcccgccgaaacgctcgccgaggagacgccgtggcccccgaagcagcgtgctttagaaagggaataagaattcccgcctccgcgccccactttcaccccagcggggcagcgtccgccatrtgaaagctccccatcccccacccccagtgaagggaaatggcgccgggaggctgagggtggggaagctgtttgtacgctcaggcctccgctcaagaccccgttcataaaccttaagccccactgctactgaattggtccgatttcctgcctctctcccacggaggcggctggccgacttccactgaggcgccaacggcctcgccatgcccttttcaataactcattgatttcaaacccgttacctccatcgcggactcagtcgcttcagcccgatttcccgcagccgagcgagatgagaga

SEQ ID NO: 159962 - DNA, 601 bp, Human
ggtttctttgtcctacggctcgcattgaacccggcccgacgccctgggtggtgatatcttctctgaaaccgggcccgcaaacccggagcaccccccctccccgctcttcggtgtggcttccgaacgcaatggcgccatttcatcgaggggaaggctgagcgcctttaatgaggtgcgcaggactctaaagatccaagctcacaaaacactccaaatccacctcgaaacgatatgaaaacagcccgagaagaaaaaaaaatagttaaccacttctacttcttgatagagaaagcacactaaraaaataaaagagttataaggaaaacgctgagaggaaggcgagccatgaaaatggcggccgccaaatccggttcccgggagagagggggaggggaagctccgcagcctcgctcacgaggacctgctgcccgccgaaacgctcgccgaggagacgccgtggcccccgaagcagcgtgctttagaaagggaataagaattcccgcctccgcgccccactttcaccccagcggggcagcgtccgccatgtgaaagctccccatcccccacccccagtgaagggaaatggcgccgggaggctgag

SEQ ID NO: 159963 - DNA, 601 bp, Human
tcctctttgtatgcaggaaattaaattcttaaatatgaggtgacctgctggcagagtacctttttcctctccaaaggaacagtttctaaagttttctggggggaaaaaaaaaacttacatcaaatttaaaccatatgttaaactgcatattagttgtgttacaccaaaaaattgcctcagctgatctacacaagtttcaaagtcattaatgcttgatataaatttactcaacattaaattatcttaaattattaattaaaaaaaaaactttctaaggaaaaataaacaaatgtagaccgtrattatcaaaggattattaaagaatctttaccaaaaatttcaaccctacaacctaaaaacgcaaatttctatttttaaacatcagaaaataactcttggttcattacttatgacccaaagtttttatttcactattcaatatctgaaaagtatcatttattttcccttaactgccccctctggtggtgattctaagtatctcagccaaaaaaacacaactttttacaacaaacactaagtttctccatatgactctcagttacgaaaatatttaaagatatgcattagaaataaccttaaa

SEQ ID NO: 159964 - DNA, 601 bp, Human
cttaagccaccaataaagagcttacggaactgttccttttctctctgcaaaggaaaataccatttcaatttttatttacattttcctctttgtatgcaggaaattaaattcttaaatatgaggtgacctgctggcagagtacctttttcctctccaaaggaacagtttctaaagttttctggggggaaaaaaaaaacttacatcaaatttaaaccatatgttaaactgcatattagttgtgttacaccaaaaaattgcctcagctgatctacacaagtttcaaagtcattaatgcttgatmtaaatttactcaacattaaattatcttaaattattaattaaaaaaaaaactttctaaggaaaaataaacaaatgtagaccgtgattatcaaaggattattaaagaatctttaccaaaaatttcaaccctacaacctaaaaacgcaaatttctatttttaaacatcagaaaataactcttggttcattacttatgacccaaagtttttatttcactattcaatatctgaaaagtatcatttattttcccttaactgccccctctggtggtgattctaagtatctcagccaaaaaaacacaa

SEQ ID NO: 159965 - DNA, 601 bp, Human
aaaggctgggcatggttgctcacgcctgtaaccccagcgtttttgggaggccaaggtgggcagttcacgaggtcaggagttcaagaccagcctgaccaacatggggaaaccccgtctctactaaaaatactaaaattagctgggcgtggtggtgcacgccggtaatcccagctactcaggaggctgaggcaggagaatcacttggaccgggaaggcagagattgcagtgagcagagacgcgccactacactccagcctgggtgacagagcaaggctccgtctcaaaaaaaaaaaaaaaaaagaaaccatattaaaaaaaaaaaaaaagcttgtgggctgagtctctaacttgtagttaaatacaagaactcagcttcctctaaaattttaattataaaaagtagaacagtgagatacactatttagtcatgcctattgagtggcaacaccagaaatcaagtctattaccagctcagttttaaatgtcccttgttacaaaatctgtcagtgtgtatcagccttttctgtacgccaatgatatatcacacttcatgtttaatggtagttcacaaccttatctgcagccaggagcacactaaac

SEQ ID NO: 159966 - DNA, 601 bp, Human
cattagccggacatggtggcagcaacctgtagtactagctactctggaggctgaggcaggagaatggcgtgaacccgggaggcagaggttgcagtgagctgagatcacaccactgcactccagcctgggcgacagagagagactccctctcaaaaaacgaaacaatgttcttggctgggcgcagcagctcacacctgtaatcccagcagtacgggaagttgaggcgggtggattgcttgagcccaggaattcaagaccagccagggcaacacagcaaaacccccacacctctacaaaaaaacacaaaattagccggtcatggtggcacaccccgtagttccagctacccaggaggctgaggtgggaggatggcttgagactaagattgcagtaagccaagatcacaccactgcactccagtctgagcaacaaagccagaccccatttcaaagaaaaaaaacagacccaacactccacacagtatgttctttactgtaaatagaagtgcggacataaacaaaaatttacactttcacatactgcaaaacaaaaataaaaaaaaaaaaaaggctgggcatggttgctcacgcctgtaacccca

SEQ ID NO: 159967 - DNA, 601 bp, Human
tactcagccaaatggataacaccatgtgcacacagttaaatacctgtaattccacagctttccctcaaaactaaaaatcttaagtatcttgaaatacttcatgtatattgtgggtaaggactgtgaggctagactagtagtgtgggctagagggaaagtaaaagagcacttcctcctactggcccaaaagataaagtttctattatgtctctctacgaattacatatcttaaaacaatgttctcggttgggcacagtggctcatgcctgtaatcccagcactttgggaaggccgaggcggrcggatcacgaggtcaagagattgagaccaccctggctaacacggtgaaaccccatctctactaaaaatacaaaacattagccggacatggtggcagcaacctgtagtactagctactctggaggctgaggcaggagaatggcgtgaacccgggaggcagaggttgcagtgagctgagatcacaccactgcactccagcctgggcgacagagagagactccctctcaaaaaacgaaacaatgttcttggctgggcgcagcagctcacacctgtaatcccagcagtacgggaagttgaggcg

SEQ ID NO: 159968 - DNA, 601 bp, Human
ctatgtctcccaagataataataattgtaaaactcaaaagctacttacccatggcaaataggaagaagctcagtatcggctcctcccaccataacccccacttcctccactgcctcctggaccatagtttcctataattgttggaacagcaagagaaaacaaacttactttgatttcccatgatcagcctaacactacagttgattctattttatatccatccagtcttttaaacaagcagatcctaatcctttgcagccagttagcagaattactcaggagataaattactcgggttcayagacatttttatttcgtggctgaccctattcttttaaataaagggtcctttcaccctctcatcctcatttggactgagtaagggatttttttaaaagtacatcaagcccaagacaaagctagtttactcctagctaaaaacctcaaaaataagctaagcaatggtttgaatcatggtttaaggatttaacttcaaagaccctcattccaatgtataccacttgcaatgtgggttgcaactgtatttagctgtttatgagtccccaccagaaattaaactactgaacacccccacctccaa

SEQ ID NO: 159969 - DNA, 601 bp, Human; identical to SEQ ID NO: 159961

SEQ ID NO: 159970 - DNA, 601 bp, Human; identical to SEQ ID NO: 159962

SEQ ID NO: 159971 - DNA, 601 bp, Human; identical to SEQ ID NO: 159963

SEQ ID NO: 159972 - DNA, 601 bp, Human; identical to SEQ ID NO: 159964

SEQ ID NO: 159973 - DNA, 601 bp, Human; identical to SEQ ID NO: 159965

SEQ ID NO: 159974 - DNA, 601 bp, Human; identical to SEQ ID NO: 159966

SEQ ID NO: 159975 - DNA, 601 bp, Human; identical to SEQ ID NO: 159967

SEQ ID NO: 159976 - DNA, 601 bp, Human; identical to SEQ ID NO: 159968

SEQ ID NO: 159977 - DNA, 601 bp, Human
aggagatcgagaccatcctggctaacacagtgaaactccgtctctactgaaaatacaaaaaaacttaaccggctgtgttgggggggtccctgtattcctagctactcgggaggctgaggcaggagaatggcgtgaacccgggaggcggagcttgcagtgagcagagagcacaccactgcaccacagcctgggcgacagagtgagactccgtccccctacaaaaaaaaaaagtgaaagcggaacagttccattaccttttatgcccaggtggggagggatggtaggaagatagttcacagtmctctgtcctgttacggctgtatacttaatcagcagtcacaaagtacaagttagtcaagtaaattggcaagctctttacatttctgagccatttatttatcggtatgtatttatctttgcctcacttggttgtgataatcatgaaggtaatttctgaaaagtgtttttagctcagctcctggaacataatgtatgctcatttttggcaatttggttttggctgtagctatctcccagtaagtattctgaaatttcaggtgaggaactccccctgagttttgcagtttaagttggaagcttt

SEQ ID NO: 159978 - DNA, 601 bp, Human
caccacagcctgggcgacagagtgagactccgtccccctacaaaaaaaaaaagtgaaagcggaacagttccattaccttttatgcccaggtggggagggatggtaggaagatagttcacagtactctgtcctgttacggctgtatacttaatcagcagtcacaaagtacaagttagtcaagtaaattggcaagctctttacatttctgagccatttatttatcggtatgtatttatctttgcctcacttggttgtgataatcatgaaggtaatttctgaaaagtgtttttagctcagctcytggaacataatgtatgctcatttttggcaatttggttttggctgtagctatctcccagtaagtattctgaaatttcaggtgaggaactccccctgagttttgcagtttaagttggaagctttatttctttctgaattgacatgtctttagttttagatgttaaactacaaagcctggtctggtctagtctaggacctaagacactggaaacaggaagaaatgggaaaattgtttagtcccagaaagggtgaaaggcagacccttgagctattttgaatgtgacaaaggacatttgggttt

SEQ ID NO: 159979 - DNA, 601 bp, Human
gttggtgcaaatagtgacaagttggtgttgtcctgtccttcaggactctttgaaatgtttcatcctgctaactgtttggctaacttaaagtaggatttaggtagggttgaggcatttctttttaaaaatttatttattattttttgagacagggtgtctgtcactcaggccagagtgtggtggcatcatcacggctcagtacagcctcaaccttcaggctcaagcagtcatcccaccacagcctcctgagtggctgggactacaggcgtgtgccaccacatccagctaattttttttttttaatagagatggggtcttgctgtgttggccaggctggcctcggaattcctggcttcaagcaaccctccctgtcttggcctcccaaagtgttggaattacaagtataacctactgcacccagcaaggttgaggcatttctttcaacagtttatgcccatgccttttttaaaaaaacatgtttgatttttaaatcattgcctctatcataaaggaaatatttgaaaatacacctgcatattttctctgccctaagttggttattttacagttttatatcttacataatcatttggggtttttt

SEQ ID NO: 159980 - DNA, 601 bp, Human
gtgacaagttggtgttgtcctgtccttcaggactctttgaaatgtttcatcctgctaactgtttggctaacttaaagtaggatttaggtagggttgaggcatttctttttaaaaatttatttattattttttgagacagggtgtctgtcactcaggccagagtgtggtggcatcatcacggctcagtacagcctcaaccttcaggctcaagcagtcatcccaccacagcctcctgagtggctgggactacaggcgtgtgccaccacatccagctaattttttttttttaatagagatgggrtcttgctgtgttggccaggctggcctcggaattcctggcttcaagcaaccctccctgtcttggcctcccaaagtgttggaattacaagtataacctactgcacccagcaaggttgaggcatttctttcaacagtttatgcccatgccttttttaaaaaaacatgtttgatttttaaatcattgcctctatcataaaggaaatatttgaaaatacacctgcatattttctctgccctaagttggttattttacagttttatatcttacataatcatttggggttttttccacctggtattt

SEQ ID NO: 159981 - DNA, 601 bp, Human
atgaagcttgtgctatgtttatttaatggtctcatgatttaacagtgttttaccaattttgttttaaaaaaatgaacttgctgcagtttttttgcctgcctttcgtatttggtgatgacatatcccagagtgttgacctcattcccataattattctcctgtgtgtatatattactgtcagacaaactctgcaggcattacatccttttcccaaagctgattgatccatttactcaccttagactctatcttccccactcccatgacatctctcatattatctttttttttttttttttttgagacggagtctcactcttgttgctcaggctggattgcaatggcacaatctcagctcacaataacctccacctcccaggttcaagcaattctcctgcctcagcctccccagtagctgggattacaggcatgcaccaccacacctggttaattttgtatttttagtagagacgaggtttctccatgttggtcaggctggtctggaactcctgacctcaggtgatctgcctgtctcgccttcccaaagtgctgggattacaggcgtgagccaccgtgcccggtgtccatatttcctatttgt

SEQ ID NO: 159982 - DNA, 601 bp, Human
tcgtgtgtgtaggtacacacacatacatatgtacatggtggtactcctatcctttaaaaataaaaaattgaggttgggcgcagtggctcacacctgtaatctcagctgtttgggaggccgaggcaggtgaattacctggagtcaggagttcgagaccagcccagccaacatggcaaaaccctgtctctactaaaaatacaaaaattagccagggatggtggcatgggcctgtaatcccagctacttgggaggctgaggcatgagaatcacttaaacccaggaggcagaggttgcagtgagycaaaatcgtgccactgcactccagcctgggcaacagagcaagacccggtcccaaaaaaataaatacataaaaataaacaaaaaattgacatttattatagcaggttttgggtataagatcataatctaggccaagtgtggtggctcatgcctgtaatctcaatgctttgggaggccaaggcaggaggatgtcttgaacccaggagttcaaggttacagtgagctgtcatgccactgcactttagcctcagcagagtgcacagtgagatcttgtctgttacccccaacaaagaagagaaaa

SEQ ID NO: 159983 - DNA, 601 bp, Human
cgtgtgtgtaggtacacacacatacatatgtacatggtggtactcctatcctttaaaaataaaaaattgaggttgggcgcagtggctcacacctgtaatctcagctgtttgggaggccgaggcaggtgaattacctggagtcaggagttcgagaccagcccagccaacatggcaaaaccctgtctctactaaaaatacaaaaattagccagggatggtggcatgggcctgtaatcccagctacttgggaggctgaggcatgagaatcacttaaacccaggaggcagaggttgcagtgagcsaaaatcgtgccactgcactccagcctgggcaacagagcaagacccggtcccaaaaaaataaatacataaaaataaacaaaaaattgacatttattatagcaggttttgggtataagatcataatctaggccaagtgtggtggctcatgcctgtaatctcaatgctttgggaggccaaggcaggaggatgtcttgaacccaggagttcaaggttacagtgagctgtcatgccactgcactttagcctcagcagagtgcacagtgagatcttgtctgttacccccaacaaagaagagaaaag

SEQ ID NO: 159984 - DNA, 601 bp, Human
atatgtattctcaatatttaagggcaatcattggtactcttttgtttaggtatttccctcctgctgtgtccaggattgctgtgtggtggtgatgagtgctgggaggtgaaaaattaaaataagccatttaccagtcagcatcccaattaaatatttgatgtaactgtgatctttgagccaggcttatatattcattttcaagcagaggagttccccattttaaatagaggcattgtctgatgtgtttatggttaactgcatctggcttgggtctttctgttttcctttctttgctgaattrgaaggggttactctgaagagtccaggtcttacagtgtggtttatttctcaagtgtgaatattgcacaccttcatggcttgaaaattagaaatgtaaatatgctggaaccagacttcataactgtagactttgttatgtcatcattaaaaagttcgaggtgttgtaatcccagctactagggaggctgaggcaggagaattgcttgaacccaggggcggaggttacagtgagccgagatcacaccactgcactccagcctgggcaacagagcgagactccatctcaaaaaaaaaaaaaaaa

SEQ ID NO: 159985 - DNA, 601 bp, Human
gttcacacttgtagttacagctacctgggagactgaggagggataatcgcttgagcacaggaggtcaaggctgcagtgtgccatgatcatgccactgcgctccagcctgggtgacagagcaagaccttatcttaaaagataaaattatattaaaaaaaagtaaaaaaaaatgaattataccacattgaatttagaggtttattaatcaatgcattataggacttaaaattttttgatgcttaattttatgtattttgatatgattaaatgtatgtaaaaacaattttaaagacaaattttmacatcatccataattttaaaatgcctattgtgatcaactttctttgaatccttgacttaatctgtatatcaacatgtattaatcatttatgattttaatatagtttttgtattatatttaatattgcaaacttttgtgttactttatgactgcacattttgttggatcagtgtaccaatgtttacattaatcctttattaggatttttttctattttagaggtgttgttattcagtaaatagctttgtacacttggatttttttccctctttaaaaattatttcctggctgggttcagtg

SEQ ID NO: 159986 - DNA, 601 bp, Human
attaaaaaaaagtaaaaaaaaatgaattataccacattgaatttagaggtttattaatcaatgcattataggacttaaaattttttgatgcttaattttatgtattttgatatgattaaatgtatgtaaaaacaattttaaagacaaattttaacatcatccataattttaaaatgcctattgtgatcaactttctttgaatccttgacttaatctgtatatcaacatgtattaatcatttatgattttaatatagtttttgtattatatttaatattgcaaacttttgtgttactttatractgcacattttgttggatcagtgtaccaatgtttacattaatcctttattaggatttttttctattttagaggtgttgttattcagtaaatagctttgtacacttggatttttttccctctttaaaaattatttcctggctgggttcagtggctcacacttgtaatcccaacattttgagaggccaaggtgggcaaaatgcttgagcctaggagtttgagaccagtctgggcaacatggcaaaacctcatctccacaaaaaatacaaaagttagccaggcatgttggtgtacatctgta

SEQ ID NO: 159987 - DNA, 601 bp, Human
caggaaaaaccagaagaaaattcagtaaatattgatcactagataggaagagcttttttttcttctcatttacattttttaagaattaatttttttaaaagttatacaagaaggacatgttccttatataaaaaagtaaatgttgggaggccgaggcgggtggatcacctgagatcaggagttcgagaccagcctggccaacatggtgaaaccccatctctactaaaagtggaaaaattagccgggcgtggtggcacacgcctgtagtcccagctacttgggaggctgaggcaggagaatsgcttgaacccgggaggcggaggttgcagtgagctgagatcacgccactgtactccagcctggctgacagagcgagactccatctcaaaaaataataataaaaagaaagtaaacgtagacaggagaaaaataaaattatctatagtcccacccattgttaatattttgatgtgtaccttaccattttctttccctttttcaaaatgacagcatgtatataatgttctatatcatacattttttatgtaattaatttccttttaatatttgtattaataaatttatttcaatgtaagatgca

SEQ ID NO: 159988 - DNA, 601 bp, Human
tacaagaaggacatgttccttatataaaaaagtaaatgttgggaggccgaggcgggtggatcacctgagatcaggagttcgagaccagcctggccaacatggtgaaaccccatctctactaaaagtggaaaaattagccgggcgtggtggcacacgcctgtagtcccagctacttgggaggctgaggcaggagaatcgcttgaacccgggaggcggaggttgcagtgagctgagatcacgccactgtactccagcctggctgacagagcgagactccatctcaaaaaataataataaaaaraaagtaaacgtagacaggagaaaaataaaattatctatagtcccacccattgttaatattttgatgtgtaccttaccattttctttccctttttcaaaatgacagcatgtatataatgttctatatcatacattttttatgtaattaatttccttttaatatttgtattaataaatttatttcaatgtaagatgcatgtttcctgtttttaaaaaattcttatgcattttatttggtggcattttattttcttccctagagttaaataaaatctatgatgcattggacgtctctttaata

SEQ ID NO: 159989 - DNA, 601 bp, Human
catattttttgttgtggttttgtttttttcaacccctttggtagttagttagttaattgctttctggtatacaatattccaggcccattttgtacatttcctgcctcagacctgaaatcaaccatatctctatggaagcctgtttccttgaatgggagtagtattttaatcacagtctagggcctagggaccatactttttaagatgataaaattttggctgggtgcagtggctcatgcttgtaatcacagcacttggagaggctgaggcaggaggaccacttgaggccaggagtttgagrtcagtctgcgcaacatagcaggaccctttctctgccaaaaaattaacaaaattaacaaaagaagtagttgggcatggtgatgcatgcctgtagttctagctatgcttgagcccaggcatttgaggttacagtgagctatgctcacaccactgcactacagcctgggaaacagaatgaggccctgtctctgaaaaaaaaaaaaaaagaataacgagagagagagagaggtcgagcatggcagctcgtgacagtaatctcagcactttgggaggctgaggtgggaggatcacttgagtccag

SEQ ID NO: 159990 - DNA, 601 bp, Human
gacagagcgagactccgtctcaaaaaaaaaaaaattagccaggcgtgatcgtgcatgcctgtggtgacagcttcacgagaggctgaggcaggaggattgcttgagcccaggaggtctaagccacagtgaacatgttcacaccactgcatgacagagaaagacctggatgacagagcaagaccctgtctgaaaaaaataaataaatgcaattttttaaatgtttattttatgagaaaataggcacagagaagttagtatcttcccagggtcacatagctaataagcgatacgtctgagattmaaacctagccagtctggcttcaaagcttatgtttttaactgcttattttatactgcctttacattaccaagcctcaattttctaaactgtaagaaagcatagagttatttactgcatagggttattttgaaggttaaatttaaggacttagcatagtacttggcacatagtagcactcttatatagctgctactgttatcatgttcttcctgtaccttcttgcatccaagaattctgtcttttttatcatgagtgtatgaacatggatttaatttttcttcctacttctcattccaaatg

SEQ ID NO: 159991 - DNA, 601 bp, Human
aagccacagtgaacatgttcacaccactgcatgacagagaaagacctggatgacagagcaagaccctgtctgaaaaaaataaataaatgcaattttttaaatgtttattttatgagaaaataggcacagagaagttagtatcttcccagggtcacatagctaataagcgatacgtctgagattaaaacctagccagtctggcttcaaagcttatgtttttaactgcttattttatactgcctttacattaccaagcctcaattttctaaactgtaagaaagcatagagttatttactgcayagggttattttgaaggttaaatttaaggacttagcatagtacttggcacatagtagcactcttatatagctgctactgttatcatgttcttcctgtaccttcttgcatccaagaattctgtcttttttatcatgagtgtatgaacatggatttaatttttcttcctacttctcattccaaatgccaaatcctgccctgtttgtttccgggaccttgaaacagtgtcaactacttttcagcacgctgttagagatcactataagaattgcagctttctccaagaggaaggttatggctcca

SEQ ID NO: 159992 - DNA, 601 bp, Human
ctcccacaaatctaaattataaaatctattacagtacctgctcagatttcagacactattcaacaatatagcttatgcatttgataaatgtttttgttttttccttcaaagttgaacataggcaaaaggtataagttattgagattccaattaagttttaagattcactggttttgttatgttctctccaaaaatattgtttattgagaactatgtattttaatattcatactttcagcttttctattttctaatttttttatattctcaatatttataaaataaaaaggtaaatacaacygtgtttccatacagtattcctcaattcaaaggcacagcatttttcatgttgtaacctcctgtattcactggtgtcttaggatcacttaccaaaaatctgtggcatcttagatttggtaacaaagcctaaatatttccatcctacaaacgtggtcatgcttctaaaaaaccacatgaagtagctcaagatgtttggccagccaatgcgcagaagccctaattgaacatgtaaaaggcagatgagatgtgttaaggtattatcttagatacagattatgtggagctcaaagaccttgttggg

SEQ ID NO: 159993 - DNA, 601 bp, Human
ctcacagattctatttttaaatgacattttctgttttaattttttgaatgataatttttttttaatttcatcatcttcctgctattccttgtacatctgtttattgaggatgtgctgtgcatggtgttggttggatgctccacaatgtgtatatgcaggtacacggaacatgagctcctctctgaaagaggctatcatctagagcagagcagtttcctgtggagcttgtgaaaatacacatgcaagccccactgtgggagttactgacttattaggtctaaagggggtattaggcatctgktttttttttaaagctctcggtattcagatacgcatccctcattgtagagccactagtcagaatagaccaacacaaaaacaaaaattcatggcaggcgcaggtagggagtaactgaaaggaacagtaattgcaaagtagattaaggaaggtttcctttagcattttgactggtcttcatgatgagtttcattttatcagagatttgaaagttgaacacttaagaagaagtgtatgggctaaagaaagctatggaaatatataatgtatttgtgggataataaaggagttttaattctgtat

SEQ ID NO: 159994 - DNA, 601 bp, Human
aatgacattttctgttttaattttttgaatgataatttttttttaatttcatcatcttcctgctattccttgtacatctgtttattgaggatgtgctgtgcatggtgttggttggatgctccacaatgtgtatatgcaggtacacggaacatgagctcctctctgaaagaggctatcatctagagcagagcagtttcctgtggagcttgtgaaaatacacatgcaagccccactgtgggagttactgacttattaggtctaaagggggtattaggcatctgttttttttttaaagctctcrgtattcagatacgcatccctcattgtagagccactagtcagaatagaccaacacaaaaacaaaaattcatggcaggcgcaggtagggagtaactgaaaggaacagtaattgcaaagtagattaaggaaggtttcctttagcattttgactggtcttcatgatgagtttcattttatcagagatttgaaagttgaacacttaagaagaagtgtatgggctaaagaaagctatggaaatatataatgtatttgtgggataataaaggagttttaattctgtataagcagaattttacagggc

SEQ ID NO: 159995 - DNA, 601 bp, Human
gattgcagtagatctgaacggggccctagcatcctgaggtttttttctcttttttctttctttctttttttttttttaaaggaactggcccaggtgcagtgtctccagcctgtaattccaacactttgggaggctgaggtgggaggatcacttgagaccaggagtttgataggagcctgggcaacatagtgagagacaccatctctataaaaattaaaaaattaaccaggtatggtggctcgcacctatagaattagctacttgggagggtaaggtagaagtattacttaagcccaggagwtcaaggttacagtgagctgtggtcatactacttcactccagcctgggtgacagagcaagaccctgtctctaaaaataaataaatgagtgaatgaagcaagcaagcaactggctgctcaagcatctttcttaaaccttgccaggcgattctggtatgaatcaaggcttggttaccactgaacaagaggaattagtatacagagaaattcaagtgagattttgtcaaagaatttactgactttctcaacaattctagaaacatatattttgattagtaatttttctaaaaaggtgaaacatc

SEQ ID NO: 159996 - DNA, 601 bp, Human
ggtggctcgcacctatagaattagctacttgggagggtaaggtagaagtattacttaagcccaggagttcaaggttacagtgagctgtggtcatactacttcactccagcctgggtgacagagcaagaccctgtctctaaaaataaataaatgagtgaatgaagcaagcaagcaactggctgctcaagcatctttcttaaaccttgccaggcgattctggtatgaatcaaggcttggttaccactgaacaagaggaattagtatacagagaaattcaagtgagattttgtcaaagaatttrctgactttctcaacaattctagaaacatatattttgattagtaatttttctaaaaaggtgaaacatctaagccaaacttagtattccaagaaagcaaacaaattaacaaatatcttctttctctgttaggaaacttattaaaggtaaatatgtagagagtgcttttgagggctagagcataggatgctttgagttgagggctagagatgaaagacacttgaaagcacagtgtttcatgtagtactctccttgcttgatgactggcataaggcattgttaccattggcatcaaccctctct

SEQ ID NO: 159997 - DNA, 601 bp, Human
agggctagagcataggatgctttgagttgagggctagagatgaaagacacttgaaagcacagtgtttcatgtagtactctccttgcttgatgactggcataaggcattgttaccattggcatcaaccctctcttaatagttctcaggggcaatatgtaccttagagatttaaaacatatgttgcagttttgtggtcaggtctctcaaaccttcattttcaaagatttctaagttgaaaagtctgtttcaaaatctgattgggggttttacattttttaggaaaaagtttaaaacacgttcrggtgaaacagtgcgcctcatggatcttctgggagaaggactaaaacgatccatggacaagttgaaggaaaaagaaagagacaaggtaattcaaagccttataggcataatgtgtatcaagcattgtgatttttcatttttgtttttattgagagaactgaggagaagtgtgaggagtcagtcccacctaggacaaggcttatattgctctgactttattgcacagtaagtttattttgtgaattgctgagcatttatttagaaaatatagttcttggcaattaaaaaagaccttggcttt

SEQ ID NO: 159998 - DNA, 601 bp, Human
gtctgtttcaaaatctgattgggggttttacattttttaggaaaaagtttaaaacacgttcgggtgaaacagtgcgcctcatggatcttctgggagaaggactaaaacgatccatggacaagttgaaggaaaaagaaagagacaaggtaattcaaagccttataggcataatgtgtatcaagcattgtgatttttcatttttgtttttattgagagaactgaggagaagtgtgaggagtcagtcccacctaggacaaggcttatattgctctgactttattgcacagtaagtttattttgtgaattgctgagcatttatttagaaaatatagttcttggcaattaaaaaagaccttggctttttcctcctttgttaatgtagcttagtatccgtgctgcttaacagcagttcccaaagatgggagaatattgcagactgaaggggtttgattcgtcagctcacatcagagtctacatgtgccatgctccttcttgggagcatttgtagagtggtcatagcagtcagttcttgccacccaaggccattgatgaaccttcagagcaggcaacatgatggcctttcatggcacccttagaaaag

SEQ ID NO: 159999 - DNA, 601 bp, Human
tcatggatcttctgggagaaggactaaaacgatccatggacaagttgaaggaaaaagaaagagacaaggtaattcaaagccttataggcataatgtgtatcaagcattgtgatttttcatttttgtttttattgagagaactgaggagaagtgtgaggagtcagtcccacctaggacaaggcttatattgctctgactttattgcacagtaagtttattttgtgaattgctgagcatttatttagaaaatatagttcttggcaattaaaaaagaccttggctttttcctcctttgttaatrtagcttagtatccgtgctgcttaacagcagttcccaaagatgggagaatattgcagactgaaggggtttgattcgtcagctcacatcagagtctacatgtgccatgctccttcttgggagcatttgtagagtggtcatagcagtcagttcttgccacccaaggccattgatgaaccttcagagcaggcaacatgatggcctttcatggcacccttagaaaagactatggttcagtttgtgtggaatttggaggaattgaaaagtcaacaagaaaaattttttttttttttttttaagttt

SEQ ID NO: 160000 - DNA, 601 bp, Human
gacaagttgaaggaaaaagaaagagacaaggtaattcaaagccttataggcataatgtgtatcaagcattgtgatttttcatttttgtttttattgagagaactgaggagaagtgtgaggagtcagtcccacctaggacaaggcttatattgctctgactttattgcacagtaagtttattttgtgaattgctgagcatttatttagaaaatatagttcttggcaattaaaaaagaccttggctttttcctcctttgttaatgtagcttagtatccgtgctgcttaacagcagttcccaawgatgggagaatattgcagactgaaggggtttgattcgtcagctcacatcagagtctacatgtgccatgctccttcttgggagcatttgtagagtggtcatagcagtcagttcttgccacccaaggccattgatgaaccttcagagcaggcaacatgatggcctttcatggcacccttagaaaagactatggttcagtttgtgtggaatttggaggaattgaaaagtcaacaagaaaaattttttttttttttttttaagtttagagcagtagaggagaggtcatgcatacctgagactgg

SEQ ID NO: 160001 - DNA, 601 bp, Human
aactcctgggctcaagcgatccactcaccttgccgtcccaaagtgctaggattacaggcataagccaccacacccagctgtagttcatttgtttttattgctgcatgatattctgatatatgaaggtgccacattttgtttatccattctcctattgatggacattaggattatttccagttgttggctgttctgaatacaaagctattttgaacattgttgttcaagcccttttagaggtacatgtgctttttctttcggatatatatctaggaatggcattgctgggttgtagggctgrcttacgcttaactttattaaaaattgccaaggagaaagtggtgaccgttgtatactcccactactaacatatgagagtttcattgcaccatatgtttacccacattggtgtattagtcagggttctctagagggacagaactaataggatagatacatataaagggatgtttattaagtattaacttacacgataacaaggtcccacaataggctgtctgcaagctgaagagcaaggagagccagtctgagtcccaaaactgaagaacttggagtcagatattcgagggcaggaagcatc

SEQ ID NO: 160002 - DNA, 601 bp, Human
ctgggctcaagcgatccactcaccttgccgtcccaaagtgctaggattacaggcataagccaccacacccagctgtagttcatttgtttttattgctgcatgatattctgatatatgaaggtgccacattttgtttatccattctcctattgatggacattaggattatttccagttgttggctgttctgaatacaaagctattttgaacattgttgttcaagcccttttagaggtacatgtgctttttctttcggatatatatctaggaatggcattgctgggttgtagggctgacttaygcttaactttattaaaaattgccaaggagaaagtggtgaccgttgtatactcccactactaacatatgagagtttcattgcaccatatgtttacccacattggtgtattagtcagggttctctagagggacagaactaataggatagatacatataaagggatgtttattaagtattaacttacacgataacaaggtcccacaataggctgtctgcaagctgaagagcaaggagagccagtctgagtcccaaaactgaagaacttggagtcagatattcgagggcaggaagcatccagca

SEQ ID NO: 160003 - DNA, 601 bp, Human
gtcagtgttttttattttagcttttctggtgagtgcatagtgacttattgtggttaaaattttcattcctctgatgaataatgatattgatgatattgactacctttatttttctttcttttctttctttcctttttttttttgagacagagtctcgctctgttgcccaggctggagtgcagtggcacgatctcggctcactgcaagctccgcctcccatgttcacgccattctcctgcctcagcctcctgagtagctgggactacaggcacccaccatcacgccctgctaattttttgtwttttttttttttttttttagtagagacgggatttcaccatgttagccaggatggtctcaatctcgtgacctcgtgatctgccctgccaccgtgcccggcctctttctttctttcttaagacagaatctcactctgtcacccaggctggagtacagtggcacaatcttggctcactgcaacctccgtctcccgggttcaagcagttctcctgcctcagcctcccgagtagctgggactacaggcacatgccaacacaccaagctaatttttgtattgtttttagagatgaggtttcaccat

SEQ ID NO: 160004 - DNA, 601 bp, Human
aattctagtttggcagctgttttctttcagcatttttagagatgacattccacagaactggagaggaccagtggggctgagggaggaaataaataaaaattatactccattgtcttccagctaccatagtttcctttgaaaatcagttgtaagtttcattgtttctcctttgaaagtatgtatctttttctcagactttttttagtatttttcttaggctttatttttagtactttgactaagaaatgcctaagtgtggtttggggagtcatttttgtttttaccctttgggggctgccaracttcctaaatctgtgggttgagttctttcatcaggttaggagaattcttggccctatctcttcaaatgctactacttttccgcattctgttatttttggtactccaagtacatatgttagaactttgtatctcacgtgtttcttatgctctaattcatttttttctttttgctttattttgaatattttctacttcagagaatattttggtattctgtgtttaaggtatttcttgaaatttttcatcttttcttccagttttcttactgttttccttttaattttttgaacatgttaat

SEQ ID NO: 160005 - DNA, 601 bp, Human
ctttatttttagtactttgactaagaaatgcctaagtgtggtttggggagtcatttttgtttttaccctttgggggctgccaaacttcctaaatctgtgggttgagttctttcatcaggttaggagaattcttggccctatctcttcaaatgctactacttttccgcattctgttatttttggtactccaagtacatatgttagaactttgtatctcacgtgtttcttatgctctaattcatttttttctttttgctttattttgaatattttctacttcagagaatattttggtattctrtgtttaaggtatttcttgaaatttttcatcttttcttccagttttcttactgttttccttttaattttttgaacatgttaatcatagttttctttaaacattttaaaacggttttagacataaaaaagttgcaagatagtacaaagaattttgtatctttcatttagtatccccagatactaatatctttcatagctatatagtatgattatcaaaatcaggaaattaacattgatacaataccattaactaatctgcagtccttattctggttgtacagttggtctcactaatgacctt

SEQ ID NO: 160006 - DNA, 601 bp, Human
taggagaattcttggccctatctcttcaaatgctactacttttccgcattctgttatttttggtactccaagtacatatgttagaactttgtatctcacgtgtttcttatgctctaattcatttttttctttttgctttattttgaatattttctacttcagagaatattttggtattctgtgtttaaggtatttcttgaaatttttcatcttttcttccagttttcttactgttttccttttaattttttgaacatgttaatcatagttttctttaaacattttaaaacggttttagacmtaaaaaagttgcaagatagtacaaagaattttgtatctttcatttagtatccccagatactaatatctttcatagctatatagtatgattatcaaaatcaggaaattaacattgatacaataccattaactaatctgcagtccttattctggttgtacagttggtctcactaatgacctttttctagtctaagatccagtccaggataacatgttacatttagttatcatgtctccttctctttaatctgggcagttagttccttggtctgtctttgactttcatgacctcaacacttct

SEQ ID NO: 160007 - DNA, 601 bp, Human
tacaataccattaactaatctgcagtccttattctggttgtacagttggtctcactaatgacctttttctagtctaagatccagtccaggataacatgttacatttagttatcatgtctccttctctttaatctgggcagttagttccttggtctgtctttgactttcatgacctcaacacttctgaagtctgctggtcagttagtttttttggaatatcacttagttggatttgtctgatattggctcctgttctgttaattctgtttccaggttatacagtcttataagtcttataagytgtactctgtttccaggttatacagtcttacaagaatagatgtagagttcttatcagttcatatcaggaggcacatgatattgataagcttcataattaataataataattttgatctctttggtaaggtgatagtatcagttttctcccctgtaaagttagtattttccccctttgtcattaataagtattttttaagtagcttcatcttaaacaatttcagattttaaagttgctattatcttttttcttttgtttctgttgtcttgattctctcctagccctttctttgtagtcccc

SEQ ID NO: 160008 - DNA, 601 bp, Human
tagttggatttgtctgatattggctcctgttctgttaattctgtttccaggttatacagtcttataagtcttataagctgtactctgtttccaggttatacagtcttacaagaatagatgtagagttcttatcagttcatatcaggaggcacatgatattgataagcttcataattaataataataattttgatctctttggtaaggtgatagtatcagttttctcccctgtaaagttagtattttccccctttgtcattaataagtattttttaagtagcttcatcttaaacaatttcarattttaaagttgctattatcttttttcttttgtttctgttgtcttgattctctcctagccctttctttgtagtccccctccttagtatttagttatttcatcttgctcttttatctttttccccccacaagagataggggtctatgttgtccaggctggtttgaaactcctggcctcaagtgatccttccacctcagactcccaagtagctgcgttacaggcatgagccaattacaggcatgagcattacaggcatggctcatcttgcttttttagaaagatttatttgttgttgggtgc

SEQ ID NO: 160009 - DNA, 601 bp, Human
gtatttagttatttcatcttgctcttttatctttttccccccacaagagataggggtctatgttgtccaggctggtttgaaactcctggcctcaagtgatccttccacctcagactcccaagtagctgcgttacaggcatgagccaattacaggcatgagcattacaggcatggctcatcttgcttttttagaaagatttatttgttgttgggtgctcggcattatgaagagaaaattataaagattatggctgaggttatttccctccagagaccgttatgttttcttctagcccacagrtagcataccagctgattatcttgaccctgtttgtattggccttatgcttctttagggctgaactatttaaattttacctgtatgactagggtgaggtccttactcctgaaatatggccctctggccatacttcaatggcgtgtgtgctaatgcccttccattttgccgctgcagaactgccttgtgtcacacagctgctgaaatcactgctcagctctttaattaccatttgctctttcctgatagattttttggagtcttgccttgtgcatgccagccatatgacatttgaaagaaatg

SEQ ID NO: 160010 - DNA, 601 bp, Human
cagctgctgaaatcactgctcagctctttaattaccatttgctctttcctgatagattttttggagtcttgccttgtgcatgccagccatatgacatttgaaagaaatgtgttcacagagtctttgactcctctgtggctccttctttttggggattgtgtccttgcttctttggcagccccgtactctaaactcttgtcttctcacctcagcaagaccacttctttctgcttgggttctgtcccctttgtccactatgtagtgatttgaaaaatgcccttggggaaaaagccaagtgatkatggactccttcccaatgttttcattcttctaagaactatagtcccttcaactttgcttgtgttgatgctctctagtgacttcaaccagttgtttcatatgtttaacccagcttttaaatagttgcttttggtagaatggttagtctgctgcaaggtattctgtcatggccagaagcaaaaatccttaattacttacttgtggcctaataatgctttagaatacttgagcaaatattagcaaaacagtgaatgggttcttttatctactcttaatacacccttgatttcaattaattatt

SEQ ID NO: 160011 - DNA, 601 bp, Human
agttactcaaaaatattttctttttttttttttgaaatgagacggggtcttgggctcaaatgatcctcccacctcagcctcctgagtagctgggattactgacataccaccattacacctgacttctaaagtgtttttttttgtttgtttgtttatttttgagacggagtctcactctgttgcccacgctggagtgcagtggcgcgatctcggctcactgcaacctccacctcccgggttcaggtgattctcctgcctcagcctccccagtaggagggattacaggcactcaccaccatgyccagctaaattttgtatttttagtggagacggggtttcaccatgttggccaggcaggtctggaactctggacctcaagtgattcacccgcctcggcctcccaaagtgctcggattacaggcatgagccatcacgctcagcctaaagtgttcttttcagacttatttttctgcctacaagcatctttggaaatacgtcctcttttagtattgcaagttatcccagaatccctaaacctggccttaactgcacttgccgatactcttctagatgctctatgtttaaatacctagaaagtgtc

SEQ ID NO: 160012 - DNA, 601 bp, Human
gggttcaggtgattctcctgcctcagcctccccagtaggagggattacaggcactcaccaccatgcccagctaaattttgtatttttagtggagacggggtttcaccatgttggccaggcaggtctggaactctggacctcaagtgattcacccgcctcggcctcccaaagtgctcggattacaggcatgagccatcacgctcagcctaaagtgttcttttcagacttatttttctgcctacaagcatctttggaaatacgtcctcttttagtattgcaagttatcccagaatccctaaayctggccttaactgcacttgccgatactcttctagatgctctatgtttaaatacctagaaagtgtcacctgatcccctaaaagaattatatttccatttttagtattatgaaatgctttagatctggctattagttttgcctaatagtatatcgtataataaaatacttcattttataggaacttctttttaatcggtgataatttcgagtggagaatgagtgtgcctaaaaaaagggaacagtggtgattgcctgatgatttttttgttttttttaaggtctattgcacgtctggccaat

SEQ ID NO: 160013 - DNA, 601 bp, Human
ttggccaggatggtttccaactcctgacctcaggtgatccacctgcctgagcctcccaaagtgctgggattacaggtgtgagccaccacgcccaacctcagagcatattttagactggcttccactatctcccacatacagagggcttaaaatgaattatttcaggtaaaaatgaggcaactggataaaccagtgtagtcctccctacacatgggaaagaatacaatgaatgctccagtggctaaattctggatctaatcaatctatttgatagtaatattaactttcattagataacatycacctcacaataaatattaaaaaataattttttttgctaaacatcttgacagatctagggattcaactatacttttcctgaactttgatataattaagcttgatttcaattattaggtctttaaattaaaggtgtaggtggctagaagtacatgatgtttttttcccaaaatggaaatgactgcattatttttgctgattattaaaatattatatgctcactatgaagtttcttttcagaaaatacaggaaatatggggaagaaaattaaaactggtataatcctattcattaaaacttt

SEQ ID NO: 160014 - DNA, 601 bp, Human
gaaagataaaactgaagctggccatatggaagcttggaaagaagctgcttgttaccagtaaaacaaagagaaagtcatgaaataaacacacaggcaccttcaaaagtggatgtgtggataaattcatccttgaaactgtgcaacaggcaaagaagcatttgcacatttctttcctttcaccaagaataaagactacactaccccttccagataccggactcaatgacaataggcacagctggtggggaggaggtaggaatgagaaaatgaatagagagactaagtgaaattttacttcctraactgtgagaattcaggtcctttccttccctgcttggcgacccaaatgctggcagtttacactcttctacagacaagagagtaaaagattcttctctaggaaatctgacactgacacacacccacacaccaccccaccctaaaggacctatggacaatgacatctagagatttaccaatgaaatggacctacagtgaagctcacagtttacaagtcctactacccatgtgtggtaatttcccgtttttcattttaaacctcacgtgactttttgaaactatgtactttgataaaagttaa

SEQ ID NO: 160015 - DNA, 601 bp, Human
tgtaacagactgacacaaatatttacagccattcacttcaaaaaatacaatgaaatgataagaagaagaatccccaagaaaatagagaaaaatttaggcagaaaacctggtaactaacaggcaagtgctaactgactttacagttcagcgaaagataaaactgaagctggccatatggaagcttggaaagaagctgcttgttaccagtaaaacaaagagaaagtcatgaaataaacacacaggcaccttcaaaagtggatgtgtggataaattcatccttgaaactgtgcaacaggcaaasaagcatttgcacatttctttcctttcaccaagaataaagactacactaccccttccagataccggactcaatgacaataggcacagctggtggggaggaggtaggaatgagaaaatgaatagagagactaagtgaaattttacttcctaaactgtgagaattcaggtcctttccttccctgcttggcgacccaaatgctggcagtttacactcttctacagacaagagagtaaaagattcttctctaggaaatctgacactgacacacacccacacaccaccccaccctaaaggacctat

SEQ ID NO: 160016 - DNA, 601 bp, Human
tccccgaactgatctacaggtttaatgtaattcctatcaaaatcccagcaaggtattttgtggataaatgacttattttaacatttatataggtcaggtgcactggctcacacctgtaatcccagcactctgggaggccgaggcaggcaaatcacctgaggtcaggagttcgagaccagcctggccaacatggcgaaaccccatctctactaaaaacacacaaaaaatgagctgggcatcatggcatgtgcctgtaatcccagctactcgggtagctgaggtacaagaatcgcttgagccagggaggcagagggtgcggtaagctgagatcataccactgtactccagcctgggtgacaaagtgagaccctgtctcaagaaaaaaaaaaaaaagagagagagaggcgtaggtcctagaatagccagaattatcttgacaaagaagaaacaagtgaaagcaatcactctacctgatatcaaggcttaccacataggtacagtatttgatatagtgtggtactggtgaaggaacagacacaaacatcaatggaagagaacagagaacccagaaacagatccaccaaaatatgcctaactgact

SEQ ID NO: 160017 - DNA, 601 bp, Human
agcagcatccaaaatatatctgttcaatcaactaaagaaaaataaaatgggatataaggtctgtaaactagaaaactcaacatagtaaagatgtcaattctccccgaactgatctacaggtttaatgtaattcctatcaaaatcccagcaaggtattttgtggataaatgacttattttaacatttatataggtcaggtgcactggctcacacctgtaatcccagcactctgggaggccgaggcaggcaaatcacctgaggtcaggagttcgagaccagcctggccaacatggcgaaaccycatctctactaaaaacacacaaaaaatgagctgggcatcatggcatgtgcctgtaatcccagctactcgggtagctgaggtacaagaatcgcttgagccagggaggcagagggtgcggtaagctgagatcataccactgtactccagcctgggtgacaaagtgagaccctgtctcaagaaaaaaaaaaaaaagagagagagaggcgtaggtcctagaatagccagaattatcttgacaaagaagaaacaagtgaaagcaatcactctacctgatatcaaggcttaccacataggtacagt

SEQ ID NO: 160018 - DNA, 601 bp, Human
gtgggtcacacctgtaatcccagcactttggtaggccacagcgggtggatcctctgaggtcaggagttcaagaccaagtctgaccaacatggagaaaccccgtcactactaaaaatacaaaattatctggatgtggtggcatgcgcctgtaactccagctacttgggaggctgaggcaggagaaccactggaacccaggtggcagaggttgcagtgagccaagatcccgccattgcactccagcctgggcaacaagagtgaaactccagctcaaaaaaaaaaaaaaaaaaaaaaaaaaaamaaaaaaaaaccccaaaatttacgtgtgggggcacacacctttagtcccagctactcaggaggctgaggcaggaagatccgttgagctcaggagtttggggctgcagtgagctatgatcagtctactgcactctagcctgggcaacagagcttatcttaaataaacaaataaataaaattccacaatactcctactattagttttattttgcagaacattctatatgcaactaaatttgaggtttaactaaaaccagacatagtgacagacaattgaaagcacagtaaaagtaaaagccat

SEQ ID NO: 160019 - DNA, 601 bp, Human
gggcacggtgggtcacacctgtaatcccagcactttggtaggccacagcgggtggatcctctgaggtcaggagttcaagaccaagtctgaccaacatggagaaaccccgtcactactaaaaatacaaaattatctggatgtggtggcatgcgcctgtaactccagctacttgggaggctgaggcaggagaaccactggaacccaggtggcagaggttgcagtgagccaagatcccgccattgcactccagcctgggcaacaagagtgaaactccagctcaaaaaaaaaaaaaaaaaaaaamaaaaaaaaaaaaaaaaccccaaaatttacgtgtgggggcacacacctttagtcccagctactcaggaggctgaggcaggaagatccgttgagctcaggagtttggggctgcagtgagctatgatcagtctactgcactctagcctgggcaacagagcttatcttaaataaacaaataaataaaattccacaatactcctactattagttttattttgcagaacattctatatgcaactaaatttgaggtttaactaaaaccagacatagtgacagacaattgaaagcacagtaaaagtaa

SEQ ID NO: 160020 - DNA, 601 bp, Human
gcactccagcctggcaacagagcaagactgtctcaaaaaaaaaaaaaagaattatgtgtcagctcttaacaatattatcagtattatttttaccatttcttaccccaaaccgggaagcaagaaggagctctagagctaaagctgctctctattcacacaaaacattaaattttgcaattcataatccctcctacaaatccttctcttgttgcccacccttcagtatatactccttcaagaatgtccttgatgtactagcaaagaataaacagaaaataaaaaatcaaaacaggccaggtatggcggctcacacctataatcctaacactgtgggaggccaaggcaggcggatcacaaggtcaggagttcgagaccagcctggccaacatgatgaaaccccgtccctactaaaaatacaaaaatcagctgggcatggtaacacgcgcctgtagtcccagctactcaggaggctgaggcaggagaatcccttgaacctgggaggcggaggttacagtgagccaagatcacgccactgcactccagcctgggtgacagagtaaggctctgtctcaaaaaaaaaaaaaaaaaaaaaaaatcaaaa

SEQ ID NO: 160021 - DNA, 601 bp, Human
ctcacaaattagagacgccatataatgtattaagaggacagactccaaagcaggaatgactaaggtcaaatcctggctccatcatttgctagttacttggatttcaggcaagttatttaacttctcagaacctcagtttcctcacatgtaaactggggataataatagtgtctcaaaggacttctgtgggaattaagagctaaaaattataaattactgagaaaagtaacttgcatatagtaaaaattatgtggccaggtgcagtggctcacacctgtaatcccagcactctgggaggccragggggagggatcacgagatcaagagatcgagaccatcctggccaacatggtgaaaccccgtctctactaaaaatacaaaaattagctgggcatggtggcacgtgcctgtagtcccagctactcaggaggctgaggcagcagaatcgcttgaacccaggaggtagaggttgcaatgagctgagattgtgccactgcactccagcctggcaacagagcaagactgtctcaaaaaaaaaaaaaagaattatgtgtcagctcttaacaatattatcagtattatttttaccatttcttacccc

SEQ ID NO: 160022 - DNA, 601 bp, Human
cctggaacatatgctctttgaaggcaggaaccttgtctgtcaagcactttcatatccctgacataaagcaggtgctcagtgagtatttgctaaattcattaacatcctcaatgcatcccagactcctgcctagaatccaccctccagcaaaagtggagtacaagtggtataaatacttaaaatctcaaaacacttattcactcactcacaaattagagacgccatataatgtattaagaggacagactccaaagcaggaatgactaaggtcaaatcctggctccatcatttgctagttacktggatttcaggcaagttatttaacttctcagaacctcagtttcctcacatgtaaactggggataataatagtgtctcaaaggacttctgtgggaattaagagctaaaaattataaattactgagaaaagtaacttgcatatagtaaaaattatgtggccaggtgcagtggctcacacctgtaatcccagcactctgggaggccaagggggagggatcacgagatcaagagatcgagaccatcctggccaacatggtgaaaccccgtctctactaaaaatacaaaaattagctgggcatgg

SEQ ID NO: 160023 - DNA, 601 bp, Human
acattaactttccatatacatactcataaagtactcacccgtctactagctgctctttgaaaactaattactccagaaatttggaactggaaaatacattgcccttctactggatgaagttaagagggctctttgaagttcacttctgaaagctcttacatattcttcagtgtgaagtgaagcatgaaaaccaatctagttaaaaggcaagatcacataaactatggaataagaccgatctgagtttaatcttagctttcacactcctgagttgtgtgactttggagaagttgtttaactyctttaggctttctcctctttctccataaacaaagctgttacaatgaaattagtctggcatgtagaggtcactcaatatgaaaactgctattattataaactatgatcacactagaactcctttcgagtaatgtatatgacctcaggatcctgccctagactctacgaaaaaaaaaatgacagaagacaatatacataggctgacacatggtgacccaaagtttcaacaaaaacagacctgccaatagtgcactatggacagcagccagggaccactttgtcaggtccaacaggctggcat

SEQ ID NO: 160024 - DNA, 601 bp, Human
ctacaggcgcgcgccaccacgcccagctaattttgtatttttagcagagacagggtttcaccaagttggccaggatgttctcgatctcttgacctcgtgatctgcctgccttggcctcccaaagtgctgggattacaggcgtgagccaccgcgcccagccaatatatttgactttctagagatagtaatgtacttttgaatttttggaattttctaataattgctaatgttacagaataaaaataaaatagtaacagtagcttcttatatattacacctctacaacatgctaggcactgcrccaggttgtatggacaaatgatttttatttctcacataaccacagcaggcagatattagccttctttcacaaatgaggaaacaaggtcctgagtgactgcataaagttttttttttttttctttttcctgagacggagtctttctctgttgcccaggctggtgcagtggcgccatctcagctcactggagcctcccatctcctgggttcacgcgattctcctgcctcagcctcccaagtaaccgggattacaggcacaagccaccactcccagctaattgtatttttagtacagacaggg

SEQ ID NO: 160025 - DNA, 601 bp, Human
acttttttttttttttagacagagtctcactttgtcgccaggctggagtgcagtggcgtgatctcagctcattgtaacctttgtctactgcaacctctgcctcccaggttcaagcgattctcctgcctcagcctcccgggtagctgggactacaggcgcgcgccaccacgcccagctaattttgtatttttagcagagacagggtttcaccaagttggccaggatgttctcgatctcttgacctcgtgatctgcctgccttggcctcccaaagtgctgggattacaggcgtgagccaccgygcccagccaatatatttgactttctagagatagtaatgtacttttgaatttttggaattttctaataattgctaatgttacagaataaaaataaaatagtaacagtagcttcttatatattacacctctacaacatgctaggcactgcaccaggttgtatggacaaatgatttttatttctcacataaccacagcaggcagatattagccttctttcacaaatgaggaaacaaggtcctgagtgactgcataaagttttttttttttttctttttcctgagacggagtctttctctgttg

SEQ ID NO: 160026 - DNA, 601 bp, Human
gggatgttatagggacgagcctttgactttatccctccaggtttaaaaaatccttaatatgtaaaatgttatttatttgacttttttttttttttagacagagtctcactttgtcgccaggctggagtgcagtggcgtgatctcagctcattgtaacctttgtctactgcaacctctgcctcccaggttcaagcgattctcctgcctcagcctcccgggtagctgggactacaggcgcgcgccaccacgcccagctaattttgtatttttagcagagacagggtttcaccaagttggccasgatgttctcgatctcttgacctcgtgatctgcctgccttggcctcccaaagtgctgggattacaggcgtgagccaccgcgcccagccaatatatttgactttctagagatagtaatgtacttttgaatttttggaattttctaataattgctaatgttacagaataaaaataaaatagtaacagtagcttcttatatattacacctctacaacatgctaggcactgcaccaggttgtatggacaaatgatttttatttctcacataaccacagcaggcagatattagccttctttcacaa

SEQ ID NO: 160027 - DNA, 601 bp, Human
tctgagtgatccaacttcatatactaagaccaagtcctttgaagagacacatacctaaaagccattttaatcaatactatatcattgatagacagtggttaggtcatgagaccacagtgcaaaggaaggaatcagtgggatgttatagggacgagcctttgactttatccctccaggtttaaaaaatccttaatatgtaaaatgttatttatttgacttttttttttttttagacagagtctcactttgtcgccaggctggagtgcagtggcgtgatctcagctcattgtaacctttgtcyactgcaacctctgcctcccaggttcaagcgattctcctgcctcagcctcccgggtagctgggactacaggcgcgcgccaccacgcccagctaattttgtatttttagcagagacagggtttcaccaagttggccaggatgttctcgatctcttgacctcgtgatctgcctgccttggcctcccaaagtgctgggattacaggcgtgagccaccgcgcccagccaatatatttgactttctagagatagtaatgtacttttgaatttttggaattttctaataattgctaatgttacagaa

SEQ ID NO: 160028 - DNA, 601 bp, Human
ctagctctagtgacaacacagctcaactctgagtgatccaacttcatatactaagaccaagtcctttgaagagacacatacctaaaagccattttaatcaatactatatcattgatagacagtggttaggtcatgagaccacagtgcaaaggaaggaatcagtgggatgttatagggacgagcctttgactttatccctccaggtttaaaaaatccttaatatgtaaaatgttatttatttgacttttttttttttttagacagagtctcactttgtcgccaggctggagtgcagtggcgygatctcagctcattgtaacctttgtctactgcaacctctgcctcccaggttcaagcgattctcctgcctcagcctcccgggtagctgggactacaggcgcgcgccaccacgcccagctaattttgtatttttagcagagacagggtttcaccaagttggccaggatgttctcgatctcttgacctcgtgatctgcctgccttggcctcccaaagtgctgggattacaggcgtgagccaccgcgcccagccaatatatttgactttctagagatagtaatgtacttttgaatttttggaat

SEQ ID NO: 160029 - DNA, 601 bp, Human
tgtacattgaaactatattctgatatatacatgaaagagtttacattctatacaacgaatcaaaacatagtcatagcaagtgaaatattcatctattttgggaagtcttactcttgctttgtcctacagcctctgcgtttaggaacaaaaaaaaaaaacacaaggaatggcaaaaaaaactcatgagagataaaattgcaatcaacttttatttaaatgagttgcataagcactctaatatttaaacactgaatgtaattagaaaccaaagttttgactcatatgtaagcacatgacaaamgtatatggtttgggagtttagaaagaaaagataaactgaaagtcctactagtagatcccattgagctggcatgaaccagaacaataaattatcattctgtctcaactcccaacagatctatgtgaccatctaatcacgggatatacaaatataaaaaacccacgctacaaggttctcaatctacaaggatcaacacaaaatcaagaacaacaaaaacaagaacaatctgtagcaacttaggacaatatttttaaattatgctccatgacactcctcaggtttggtgggccagtggggtac

SEQ ID NO: 160030 - DNA, 601 bp, Human
cacatttactatttcccctcttgttctaagcgcaaaggaactgtactgacattttctactattctttcaaaaccaaaaggagaggataataaaaaaatccatctttatccaaaagataatactacacggtttccttatacactgagttttttcatgtacattgaaactatattctgatatatacatgaaagagtttacattctatacaacgaatcaaaacatagtcatagcaagtgaaatattcatctattttgggaagtcttactcttgctttgtcctacagcctctgcgtttaggaacaaaaaaaaaaaacacaaggaatggcaaaaaaaactcatgagagataaaattgcaatcaacttttatttaaatgagttgcataagcactctaatatttaaacactgaatgtaattagaaaccaaagttttgactcatatgtaagcacatgacaaacgtatatggtttgggagtttagaaagaaaagataaactgaaagtcctactagtagatcccattgagctggcatgaaccagaacaataaattatcattctgtctcaactcccaacagatctatgtgaccatctaatcacgggatatac

SEQ ID NO: 160031 - DNA, 601 bp, Human
aagggccaaaactaccatgtacatcctcacagcatatcacacaacaccactcaaatccaggggaacaccagtgttctaacgctaggtggtactagcactgtaactgaagttcccaaatgtctgcttccttttgtacttcagaactaaaactaatttgattgcagtatctaaaactgacattttcttgctaataaactgagttatatatggctactctacctttaaaattatcatttcacttcaaatttaaaaataaccaatcaatatacttatgctatcatccaaatttcaaaacaagctmctttaatattagaaaatatttcaaaacaacctctggattttaaacctaaaatatataccaaggaatcatccctcagttatttagaaaaagactgataaataacatgataaaaatatgtttcttattgtctcataaatccaagacttgacattttcattttcttaaatggtgtcacacaaaactttttaaaaaataatcatttaagaaatgactgaattggcttacagaatactaattaaaaataactgagtcaacaacttggaatacaggaaaacatactaacagattctaaaaacggaa

SEQ ID NO: 160032 - DNA, 601 bp, Human
ctgactacacagaaaagtcccacaagctggatgatcacccatttctgggttagctcaggctctggctaaacatcatatggaatgtgacaggcaactgtgagtagatgccatgctcacagatgatcatgccagtgatggggaaaaagacaaagtagatatgattaaaagaagaaaaaaagaaaacctaatttgtcacatgcagagaaagttcagcctcttgagataaacagaatgcaagggagcaagaagtcacagatgagcatttcaaagaaatgtacaaaatgtactgaatatacccccmaaaaaaaccccagaaaacaacaaaagtgatgtacgtcagaaagtcttacatctagttttgtgtcaaaaacattcagaccctttacatgcattatagcaacacatgcaacagaaagccatatattggcaggaaaatacattgttaacatacattcttgctgtactatagtttctcagcctagacaaatggacatttgcaaagtagctgtactggaaatatcacgggtagagatacattttttaggcaatggcataaatgtattaagaagtaaaatctaaaaggtaatttcttcctaaagtg

SEQ ID NO: 160033 - DNA, 601 bp, Human
atgaaaggtactattcaacacattaaatctaatacgaaaccagatggtttcagtaggaaaaaaactgactatattgattaacctattaatgagctaactgttgcacaaatagacaaaaagtaaagccatgtcaatgtgtgggggtaattcagtaaaatttacacctagaaaaataaggacgcttgccttactgagaagggaaattgcacttcatttctaagaaatgcatatttagatgccagggtggtacaaggcaatctggaccaagtttcctgatgacagctttataaatgcagaaccyatgacaaatgttatgctaaagtcacatcctggctcctctagacgtttgtttagaaatgcattcacgagaatcatctaagtaacaaaaacaaaaacctgaattacaaagcagtaattcattctacttaggaatgtccaaatgtccatagcattaattcaattacagcgcaggctccagatgaagggctgccctacagagtagtaagccacaggtgaaattaccacagtattatcaggttccacctaaagcccctcaccctaataccaacttggtttattagtaatgagagcctgactacac

SEQ ID NO: 160034 - DNA, 601 bp, Human
tttccattactttcatataaaaatgttcagtaaattccaaatacagttatctctattggtattatctccttatctaataaaagaaaactctaaaatggttcgcttccattatattcttcatcagcagataaaaacttataataaattcaaagtgtcctgggaggtttgttttttttttaaatacaccagaagataaatataaaatatcctataacacacagtccctggaggtggacatggatgagaagtgatcagggagatgaactccctcttataaccttaaaaggactgtacagctctyggtagtggggaaaagttaacgaaaaatataaatttctctgaatattctttgctgtttcctaaaagaactatctgtaaaacttaaagctaactaacgggtacaacaaacatgaaattcctaccatctatctgatcaaacaataatttagtaggtcacaaaacatgaagaggtttcatcctaaattcaagctttttcttttgtacacatgtcacattatcccccgctacaggtaattgtattttggtttaataatgcatgttcaattaaaaacattcaagtgtgatcagagtatcgatgctt

SEQ ID NO: 160035 - DNA, 601 bp, Human
caattataattatggtttcagatcactataagataaagacctatacaaaaagttggtgctaacaagttgacaacactcttaacacttttaagtgaagagatattaagaatgccaataattcaattatttacttataattgcataggcaaatgggttttaacactaaaaaaactgagtatcaggaagtatggattacaagattttttcttagcaataaaaacaaaagattagagggaataaatattaaagtcctcttccattaaaaaaaaatctaattcttttatttcactcttcaaaagayagtaaaaacgatgatccccaatttcttttggttcctactacatgacctattggttctcatcagggaactagtaagctgtttgtttaaagttatctagcactggtggggggttgtggggggcatagatgagatgattaaggctaaaacctcataacacgtctgtaacatttaaatccacttcaaaagattatagttcaagaaattatataaaaataattaaccaaattattcattaagaattgtaacacacaacttctacatacctggcctcataactacaagatgcaatttcagcccttg

SEQ ID NO: 160036 - DNA, 601 bp, Human
gtcatgaatggaaaacagtttaaaatataagcatgcacgtttgaacttaatgctttttaacttaaatatactttaaataaaataattagcaaatttaaaaaaaactattatgattagacgatgctgagctcaaatattttttcttcagattagatgcctgaatagccacaactctgaatcaagactaaaaagatgtaactaggccaggcacagtggctcacgcctgtaatcccagcactttgggaggctgaggcggatggatcacgaggtcagttagccatcctggctaacacggtgaaaycctgcctctactaaaaaaatacaaaaaaattagccgggtgtggtggcgagcacctgtagtcccagctactcgggaggctgaggcaggagaatggcatgaacctgggaggtggagcttgcagtgagccaagatggtgccactgcactccagcctgggtgacagagcgagactccgtctcaaaaaaaaaaaaaaaaaaaaagatgtaactgatctaagactctgtttcgatttgaaattattgaatactttaacacttgccagcaatgtgtaagggcttgctgtgtgatataggtaaaaatg

SEQ ID NO: 160037 - DNA, 601 bp, Human
tggccacagcatcaagtgacaatgaaaaccattaaaacataattctgttaatgagaaaggcaaagttagctggggaggaaaagtttggcatgtcatgaatggaaaacagtttaaaatataagcatgcacgtttgaacttaatgctttttaacttaaatatactttaaataaaataattagcaaatttaaaaaaaactattatgattagacgatgctgagctcaaatattttttcttcagattagatgcctgaatagccacaactctgaatcaagactaaaaagatgtaactaggccaggcrcagtggctcacgcctgtaatcccagcactttgggaggctgaggcggatggatcacgaggtcagttagccatcctggctaacacggtgaaatcctgcctctactaaaaaaatacaaaaaaattagccgggtgtggtggcgagcacctgtagtcccagctactcgggaggctgaggcaggagaatggcatgaacctgggaggtggagcttgcagtgagccaagatggtgccactgcactccagcctgggtgacagagcgagactccgtctcaaaaaaaaaaaaaaaaaaaaagatgtaactg

SEQ ID NO: 160038 - DNA, 601 bp, Human
gaccagcctggccaacatggtgaaaccccatctctactaaaaatacaaaaattagccaggcgtggtggcgggagcagtaatcccagctactcgggaggctgaggcaggagaacggcttcaacctgggaggcaggggttgcagtgagccgagatagcaccactgcactccagcctgggcaaaagagcaagacttcatctctgggggaaaaaaattgccatcaaaccactgtcactgtccattctacatactaaaatacatccataaagtaagaaaggtagtgggtccttacaaaagcacaaraaaatggggtttagaaattatatgactttaaagatctgtgattctaggatatctgtgtatcgttacctattcatgtacaatctaccttctcactgattccatataaagtttgctctctactgtaagtataggccaactactaacagcagtgcaaactgtgacccacatatacacattctactttgtatttctaccatttcatattcacattctatcctttgctggccccattattaagctatgtatagtgaaaactcaccagtgcatcaaactgagcagatcatccccacaatctagtcc

SEQ ID NO: 160039 - DNA, 601 bp, Human
tacagtaatttgctagtttgattttataaagtattctcaaattaaatgtgaaactaaccatcaaaaatgtcatattacacatttctgacactaatacatcgttttaagttatatactacgggggtcaggaagctttaaaactaacctaccataaaatgccatttctgtcgtttaatatttatggcctgttaacagaaacttctaagttagttcggacatacttttattaggcttaaaaataggcatctaaaaatgccactaaatctacttttaacaaatgaattttaaaactttcactataaatgaagatggaagactttacaaagctgacagaggcactttataataaataggtaactacacaaaaatatgaaataactgaacatcctgccccttaggtgagaaaggttaagatggaaggtttttttccatgagtggagttaattgaaaacacaatccttctttacgtttcctttttcctaatacagctcacacacattctatttatacttttaaaagtacttgtttaataaactcagaaaactgtcgctagtcctgcagcatgacataggagaatcgaagctcaaaacttttatcttta

SEQ ID NO: 160040 - DNA, 601 bp, Human
actacaaaaagggttcgatttaaagatggtgttttggactaaactgtgtcttccccaaatttatatgctgaagtcctgaccccagtacttcaccatgtgactgtatttgtttttgttttgtttttttcaacacagtctcactctgtcacccatgctggagtgcagtggtgcgatcttggctcgctgcaacctctgcctctcgggctcaagcgattcttgtgcctcagcctcctgagtagctgggactacaggcatgtgccacctacccccagctaattttttttgtagttctagtagagasagggtttcaccatgttggccaggctggtcttgaactcctggcctcaaatgatccatctgcctcggcctcccacagtgctgggattacaggtgtgagtcaccatgcccggccacagtgtgactgtatttggacacagaatctttaaagggtaattaagataaaacaaggtcatattgatgagcctaatccaacatgactggtatcctcacaagaagagatcaggacggagacatgcatatggggaaggccatgtgaagacacagggagaggagggtcacctacaagccaagcagaggcttc

SEQ ID NO: 160041 - DNA, 601 bp, Human
atctgttctcagggacttccaagattagcaagagacaatcatcatcctgggttgtgttagtgtgtccatgtgttggggtggaaaccccatagtttaaaattttagagtatcttgagtataccacaacaaattatgcactacaggtgcaaaggaaaggctatattaaacatcaccaagttaaccgtaatcaatctaatctaagtggacatccctctatgaaagaagcacagttcttctccatgcaggctcatctgatggaatgaaatggcctgaaccggaggtgggggagggaggcagggcrtgtggtgtacctccaactcctattgagtgggggtgggaaaattaaacttggagccaggaccaaaaccttgaagagggctgctagttttaactaaatacgtcaattaagtaggtgtttataagggaaagatggcaactctatggacaaagtaaggggggctccgggcccaaagagtgcagccacctattaaggaaaaggtgaaggaaaatatgctcttttagaatcaaatctcaacgaagagagagtcaaggaggctcctggtcaagcaactgggacaaagacttggcatctgtccttgaa

SEQ ID NO: 160042 - DNA, 601 bp, Human
agtgtttcagaccgggcacattggctcatgcctgtaatcccaacactatgggaggctgcggtgggcggatcatttgaagtcaggagttcaagatcagccttgccaacatagtgaaaccctatctctactgaaaatacaaaaattcgctgggcatggtggcatgccccataatcccagctacccaacaggctgagacaggaggattgcttgaacccaggaggtagaagttgcaatgagccgagatcgcaccactgccctcaggcctgggtgacagagccagactctgtctcaaaacaaacamccccccccccccccaaaaaaaacagcgtttttaaatgcttttaccagttttcagacattacagtgattcattcatctttttaccaattaaatgtatacacctatgtaaatgaagttgctctccttcaccatcatttttctagctactatagtctgcctttgtgtatcatttttttgagacagaatgttgctctgttgcccaggcaggagtgcactggcgcgatctcagctcactgcaacctctgcctcctgggttcaagcaatcctcctgccccagcctcctgagtagctgggactacag

SEQ ID NO: 160043 - DNA, 601 bp, Human
gagtgtttcagaccgggcacattggctcatgcctgtaatcccaacactatgggaggctgcggtgggcggatcatttgaagtcaggagttcaagatcagccttgccaacatagtgaaaccctatctctactgaaaatacaaaaattcgctgggcatggtggcatgccccataatcccagctacccaacaggctgagacaggaggattgcttgaacccaggaggtagaagttgcaatgagccgagatcgcaccactgccctcaggcctgggtgacagagccagactctgtctcaaaacaaacmaccccccccccccccaaaaaaaacagcgtttttaaatgcttttaccagttttcagacattacagtgattcattcatctttttaccaattaaatgtatacacctatgtaaatgaagttgctctccttcaccatcatttttctagctactatagtctgcctttgtgtatcatttttttgagacagaatgttgctctgttgcccaggcaggagtgcactggcgcgatctcagctcactgcaacctctgcctcctgggttcaagcaatcctcctgccccagcctcctgagtagctgggactaca

SEQ ID NO: 160044 - DNA, 601 bp, Human
gacgagtgtttcagaccgggcacattggctcatgcctgtaatcccaacactatgggaggctgcggtgggcggatcatttgaagtcaggagttcaagatcagccttgccaacatagtgaaaccctatctctactgaaaatacaaaaattcgctgggcatggtggcatgccccataatcccagctacccaacaggctgagacaggaggattgcttgaacccaggaggtagaagttgcaatgagccgagatcgcaccactgccctcaggcctgggtgacagagccagactctgtctcaaaacacacaaccccccccccccccaaaaaaaacagcgtttttaaatgcttttaccagttttcagacattacagtgattcattcatctttttaccaattaaatgtatacacctatgtaaatgaagttgctctccttcaccatcatttttctagctactatagtctgcctttgtgtatcatttttttgagacagaatgttgctctgttgcccaggcaggagtgcactggcgcgatctcagctcactgcaacctctgcctcctgggttcaagcaatcctcctgccccagcctcctgagtagctgggact

SEQ ID NO: 160045 - DNA, 601 bp, Human
agacgagtgtttcagaccgggcacattggctcatgcctgtaatcccaacactatgggaggctgcggtgggcggatcatttgaagtcaggagttcaagatcagccttgccaacatagtgaaaccctatctctactgaaaatacaaaaattcgctgggcatggtggcatgccccataatcccagctacccaacaggctgagacaggaggattgcttgaacccaggaggtagaagttgcaatgagccgagatcgcaccactgccctcaggcctgggtgacagagccagactctgtctcaaaacaaacaaccccccccccccccaaaaaaaacagcgtttttaaatgcttttaccagttttcagacattacagtgattcattcatctttttaccaattaaatgtatacacctatgtaaatgaagttgctctccttcaccatcatttttctagctactatagtctgcctttgtgtatcatttttttgagacagaatgttgctctgttgcccaggcaggagtgcactggcgcgatctcagctcactgcaacctctgcctcctgggttcaagcaatcctcctgccccagcctcctgagtagctgggac

SEQ ID NO: 160046 - DNA, 601 bp, Human
tagagcaagaataaggaattaagagcaagaataaggaattaagagtactaacttaaagaaacccactacaacagcagaacctgggcaaaatgcactagtagaaaatgggaagcaaaacattgaaacagggactcaggttgttactgtcccccatgcaggattatacatctccgctctgttgtattcaagtgtggccattgatgtgtttgccccagatcagtgtgtttctgtcttagcatgccctcccccgtctcttccctgctgcttcagcgggaggctgctctgtgtctacatcctgcaratgcaggagatggagacaagcccactctcccctcccctcccctcccctccccagtggatgtggtgtcagatacagaggagaaagggaagtgagacaggtcctaagttggagcaggggggtgagaatattgaaactacagcagagggttcccatatttaacttacctgtgaaaatgctggaagggctattaaatttattcctgcgtcactgttcgattcttgaggttctggtatttgcaacaagactgtcccaactggttgtggcaaaattcctgtattacagccatttactggttctttc

SEQ ID NO: 160047 - DNA, 601 bp, Human
ggttagagcaagaataaggaattaagagcaagaataaggaattaagagtactaacttaaagaaacccactacaacagcagaacctgggcaaaatgcactagtagaaaatgggaagcaaaacattgaaacagggactcaggttgttactgtcccccatgcaggattatacatctccgctctgttgtattcaagtgtggccattgatgtgtttgccccagatcagtgtgtttctgtcttagcatgccctcccccgtctcttccctgctgcttcagcgggaggctgctctgtgtctacatcctkcagatgcaggagatggagacaagcccactctcccctcccctcccctcccctccccagtggatgtggtgtcagatacagaggagaaagggaagtgagacaggtcctaagttggagcaggggggtgagaatattgaaactacagcagagggttcccatatttaacttacctgtgaaaatgctggaagggctattaaatttattcctgcgtcactgttcgattcttgaggttctggtatttgcaacaagactgtcccaactggttgtggcaaaattcctgtattacagccatttactggttct

SEQ ID NO: 160048 - DNA, 601 bp, Human
cgcaagttgcggagtttctgtttcctttttcctctggcgagctttgcgttccctgtgcgccggaagtgatcccctgcgtggctgggctgctcgggttagatcgtcaggtgagggaggaagggatagccagcgcgaaggaagtgctggagtcgtgtgttttggctgcgcgtgatcctgcgtgggtcgggaggtgtttctgtgtaggtgtctggccctttcatcagtcgtgcggaggaccgcgtgatttccttccagttctcctcggttttcaggtggtggcgccatcttcggtaaagggtgyccacctctccctatggtgtggctggctagcccgggggtctctacgctgcttggtctttgttaacggagatgaaggcagtaatttttcagtaacaggtttcagatataagtcccttggtgatgctaatatttatggaggccttactatgcattaagaacttttttagaagtttagaaaatggcagtgaataaagcagatacaaatctctgctctaagggagcttgcatagtaatgaaatttgagaagacagtggattggaagtgggattaactcagaatcaaaattttgtcgatgggttgg

SEQ ID NO: 160049 - DNA, 601 bp, Human
agctcacccacccacctctatactcatttgatatggaggattggggacgattttgccagtgtaaattatgttcactaaaacaaaaaaaaagttcaggtttattcacacgtaataggaatcattaatttttaaaatgtgtgtgtgttgcttgaatttaaccagtgagaggacattaaaggtctttagtgacctaaagactgtaggaatcattgttccaacttttttcttaaggcatgtagttgcttttttgaccatctacctcctgtgttgctaaacgttcctcttcccccatctttccacrctgaagagagcatctcaagtctcagtggtcaccagagatttcactatgtagaaaatgccttctcattccacttagtatgggtcctcacttttccagacactagcccaccttgagccagcttagactaccatttttcctcacttaccacattcgggcaccagctcctgtagattcttctttggctctcctactccccatcctcctgtgaagaccaatgaagaaccagttcctccatgactctgtcattttccccaccttaatcctatattcttggatccccactttaacctgtatgtatct

SEQ ID NO: 160050 - DNA, 601 bp, Human
cctctatactcatttgatatggaggattggggacgattttgccagtgtaaattatgttcactaaaacaaaaaaaaagttcaggtttattcacacgtaataggaatcattaatttttaaaatgtgtgtgtgttgcttgaatttaaccagtgagaggacattaaaggtctttagtgacctaaagactgtaggaatcattgttccaacttttttcttaaggcatgtagttgcttttttgaccatctacctcctgtgttgctaaacgttcctcttcccccatctttccacactgaagagagcatytcaagtctcagtggtcaccagagatttcactatgtagaaaatgccttctcattccacttagtatgggtcctcacttttccagacactagcccaccttgagccagcttagactaccatttttcctcacttaccacattcgggcaccagctcctgtagattcttctttggctctcctactccccatcctcctgtgaagaccaatgaagaaccagttcctccatgactctgtcattttccccaccttaatcctatattcttggatccccactttaacctgtatgtatctttaatctatttttt

SEQ ID NO: 160051 - DNA, 601 bp, Human; identical to SEQ ID NO: 122097

SEQ ID NO: 160052 - DNA, 601 bp, Human; identical to SEQ ID NO: 122096

SEQ ID NO: 160053 - DNA, 601 bp, Human; identical to SEQ ID NO: 122095

SEQ ID NO: 160054 - DNA, 601 bp, Human; identical to SEQ ID NO: 122094

SEQ ID NO: 160055 - DNA, 601 bp, Human
taaatagaaatagatgaggcaggagagaaggcaaagtgtatcaagtggcatttgagcaagtcaaacatctgctttgaggaattcctgtgcctctgtggccggggatgctgagggtggcttcttgcctgttggctgccacatggtatttccagcagaggatctggaatgtctgaagcctgacatgccaacttcatcttcgtggcagttattttatatttgatgattttctgtaggcttaatagttcccttttggaaggcttggattgagtatgtataaaaagtatgttttccaaactcataraaggacaaaacggtgtgtgtaacagcagttgtattgatagttaatatgtttagaaatgtacttgttttgtagaaagaaaacatattttatgaaaaataatttagcaatcactaaaatttttcttttcaataactgtatagcttttcttcctatgtatcttcattgccctttatgtatgtttatgaatatgtgcacatacacacacaaacacatataaggtatttcaagggaagtgtctgcactcccacttactgattgatgggtgtgtgtgtggggtggggagcacctgatgtttcacta

SEQ ID NO: 160056 - DNA, 601 bp, Human
ggatctagccctaaccaggaagaagcgtatgccaagataagaattacactaatgtgagtgtgcagatttattcggaacctctttggtacttagtatgtgaaatttctatttgaaattaagatttttttaattttattttttttgagccagaatctcactctgtcacccaggctggagtgcaatggcacaatctcggctcattgcaacctctgtctcctggattcaagtgattctcctgcctcagcctcctgagtagctaggattataggtgcgtgccacaccacctggctaatttttgtarttttcgtagaggcggggtttcaccatgttggtcaggctggtcttgaactcctgacctcaggtgatccatccacctcggcctcccaaagttgtgagattacaggcatgagccactgtgcccagccaagaagtttttaattttctctttttttgtttttgttttgagacagggtctccctctgtcaaccaggctggagtgcaatggtgtgatcacagcttactgcagcctctacctccccaggctcaggtgatcttcccacctcagccttctcccaagtagctgggacaacaggtgtacacc

SEQ ID NO: 160057 - DNA, 601 bp, Human
agatatcccttaggaaagagtttttaaacttttgaaaatgctataagaattttgaaaataatatacccctctggatgtctgcaagcgacattaagaaatttttttcaatacaaaattgtgttatttttaaatgtatcaatggaatctaaatagcatagcaatgtgatacctactatcctgtaaaaaaataccagttcagcatttggaaattttccattattcttttttctttgaacttgttttactgtttttattttcccctcagaagtgtatcttaatagtatatggtatagttaagaaytttttattaccctgtttgtaacaaaaatgcatgcataaaagaaactttaaaatatttaaaagaattctatgacaaattcttctcaattgacttatcattaaagttgtttttagtacctaattgatcaaaacaattttaatgtatttaaattatattggaaatatgtctttaaatgagatagatggtgcttttttcacttcttgagtaaattgctaaaattagacattgtgaattttgtgcttttgtttgcttttatggacataaatactaagaaagctttttaaaataaatacatggcaa

SEQ ID NO: 160058 - DNA, 601 bp, Human
atttttttcaatacaaaattgtgttatttttaaatgtatcaatggaatctaaatagcatagcaatgtgatacctactatcctgtaaaaaaataccagttcagcatttggaaattttccattattcttttttctttgaacttgttttactgtttttattttcccctcagaagtgtatcttaatagtatatggtatagttaagaactttttattaccctgtttgtaacaaaaatgcatgcataaaagaaactttaaaatatttaaaagaattctatgacaaattcttctcaattgacttatcrttaaagttgtttttagtacctaattgatcaaaacaattttaatgtatttaaattatattggaaatatgtctttaaatgagatagatggtgcttttttcacttcttgagtaaattgctaaaattagacattgtgaattttgtgcttttgtttgcttttatggacataaatactaagaaagctttttaaaataaatacatggcaataaactaaattttactatattaatgtttctgtgtttatgaacttctgagatatgcccaaattagattttttttttttttttttttttttgagacagc

SEQ ID NO: 160059 - DNA, 601 bp, Human; identical to SEQ ID NO: 122261

SEQ ID NO: 160060 - DNA, 601 bp, Human; identical to SEQ ID NO: 122260

SEQ ID NO: 160061 - DNA, 601 bp, Human
ggcctccctgcaagggaacagacgtttcctttattggatcgtgactgtggacttttttctgtaattttgcgagagggtggtggttatgttgcgacatatcaaaaagcagttattttaccgcctttagcagttggggctcaccccatccccccatttgtagatataattggggttagtttagggcgagtcacttcctggtcaggatggcctcttaacttcccttttgctcctccttcctcaggaagtgattttgctgtcacgactcttcgacaaggagaggtcccaaatgttgtccatctcmctacacatgcactacttttctcctgtactgtcgcctgtctgattcgctataataaatctgtgagcctcagggcatttgcttcagaatttgaacaccagtctttccctatagacacatcccttttaacgataatttttgaaaattttgtttcttgttaacaaatctagaatagctgatggattttcttaacctccagaaaggttttctgtaacacataataaaccttatgttaacacgttcaagactgaacaaagcatcctgccttctttgatgctccactgtggagtctttgatcagttg

SEQ ID NO: 160062 - DNA, 601 bp, Human
taacctccagaaaggttttctgtaacacataataaaccttatgttaacacgttcaagactgaacaaagcatcctgccttctttgatgctccactgtggagtctttgatcagttgaatttgtcagtgtgcattttgtatgctcatttcttgaaaagggtcttaaatacaagagcacattctaaggtggaataacttttcttctgacagttgcacagtttcataacagtttgtcaggcttttcagtaagtacatggttttagggcacgtagaacttagaatgacctcacaaggcaacttattrgacaagaattatgacatttgtctcccactgtggctattagaaaatgtgtccccttgagtgctctgtaaatctacctgggtgtttttttcaataagaagttggtatgggaaggggactgttatgatccataagtcctctgtacggaataacttgatatatgtagatatggcatgccattttgaaatgtttaacaagccattgacaacagcgttagattttctcttatttggaaactgatcttcatacatgtttaagatttaggacaaaaacatttatgtataagcctatgctggaaatcga

SEQ ID NO: 160063 - DNA, 601 bp, Human
ttgatcagttgaatttgtcagtgtgcattttgtatgctcatttcttgaaaagggtcttaaatacaagagcacattctaaggtggaataacttttcttctgacagttgcacagtttcataacagtttgtcaggcttttcagtaagtacatggttttagggcacgtagaacttagaatgacctcacaaggcaacttattagacaagaattatgacatttgtctcccactgtggctattagaaaatgtgtccccttgagtgctctgtaaatctacctgggtgtttttttcaataagaagttggkatgggaaggggactgttatgatccataagtcctctgtacggaataacttgatatatgtagatatggcatgccattttgaaatgtttaacaagccattgacaacagcgttagattttctcttatttggaaactgatcttcatacatgtttaagatttaggacaaaaacatttatgtataagcctatgctggaaatcgatctataataaattgttctaaggcaaatagttactattcaaataaaattaagcaaaaatcctgttacaatacaactaaacaatttttttttttttgagacggag

SEQ ID NO: 160064 - DNA, 601 bp, Human
tctgtacggaataacttgatatatgtagatatggcatgccattttgaaatgtttaacaagccattgacaacagcgttagattttctcttatttggaaactgatcttcatacatgtttaagatttaggacaaaaacatttatgtataagcctatgctggaaatcgatctataataaattgttctaaggcaaatagttactattcaaataaaattaagcaaaaatcctgttacaatacaactaaacaatttttttttttttgagacggagtctcgctcggctcactgcaacttccgcctcccyggttcaaattattctcctgcctcagcttcccgagtagctgggattacaggcacccgccaccaagtccagctaatttttgtatttcttgtagagagtgggtttcgtcttgttgcccaggccggtctcaaactcttgggctcaaacgatccatccgtcttcgccacttaaagtgctgggattacaggcgtaagccaccgcggccggccaaaatttcacaaataatttaaataataaacttttaagtttattgtgcctacctgatacacattgaccagtgttgttggatttttgtctttgata

SEQ ID NO: 160065 - DNA, 601 bp, Human
ggccggtctcaaactcttgggctcaaacgatccatccgtcttcgccacttaaagtgctgggattacaggcgtaagccaccgcggccggccaaaatttcacaaataatttaaataataaacttttaagtttattgtgcctacctgatacacattgaccagtgttgttggatttttgtctttgataccaggttagaatgcctttaattaaacttgggaaaatatatattttaaaatgccaattaagatgcctttagatactggcagtgttttaattaataacattaatgtcttgggttatggttttttttttttttttttgagatggagtctcgctctgtcacccggggtggtgtgcagtggtgcgatctccgctcgctgcaacctctgcctctctggttcaagcgattctcctgcctcagcctctcgagtagctaggattacaggcgcccgccaccaagcctggctaattttttgtatttttagtagagacggggtttcactatgttggccaggctggtctcgaactcctgacctcatgatctgcccgccttggcctcccaaagtgctgggattacaggcgtgagccaccgagcccagccag

SEQ ID NO: 160066 - DNA, 601 bp, Human
tattaaaactgtcattcttccatcttcacttttcagttagttttgctgagaggtattcatataatctgttaagacatcctaggacaggccgggcccagtggctcacgcctgtgaccccaacactctgggaggccgaggcaggtgcatcatctgaggtcgggagtttgagaccagcctgaccaacatggagaaaccccatctctactaaaaatacaaaaattagctgggcgcagtggcacatgcctgtaatcccagctactcagtaggctgaggcaggagaatcgctggaacctgggaggcrgaggttgcggtgacccgagatcacgccattgcactccagcctgggcaacaggagcgaaactccgtctcaaaaaaaaaaaaaaagaaaagaaagcccgggcgcggtggttcatgcctgtaatcccagcactttgggaggccgaggcgggtggatcacgaggtcaggagatcgagacctgacctcaggagatcgagatcctggctaacgcagtgaaacaccgtctctactaaaaatacaaaaaaattagccgggcgtggtggcaggtgcctgtagtcccagctaatcgggaggctgaggcag

SEQ ID NO: 160067 - DNA, 601 bp, Human
ttttaacaacatttttaattatctctctgcctcaggcctctcctttctttatacatccttcctggtttatcataaattcttcacagctataacgtattacaaaattttgagcagtgtgtaaaatttatctttggtacaactgcacatacagattgttaaggcagtgtcagtgaaatggaacattgatcgaattctgttgagtgtagtcatggtataacatactgtttaaacaagaaaacagcataatggcagactgtagcaaaggaaggtggtaagagaactttgctttgtggattctttsttttacatctgggtaacatttaagtgcttcttttgtgctaactatgtattaaccatgtatttatctcacaacatccttataggacagatacttatgcccattttacagtagagtaaactgaggcacaggcacatttgaggttaaaatatatgacccaagtgtccagaactaataaatggcagagtggatacaatgctgttgtctgctgtcagagcctatgctcttacccattttgattcctttaagtagatagtaagatagtaagcagttttgatgaaataatgacatagtcctaaacag

SEQ ID NO: 160068 - DNA, 601 bp, Human
tcttcacagctataacgtattacaaaattttgagcagtgtgtaaaatttatctttggtacaactgcacatacagattgttaaggcagtgtcagtgaaatggaacattgatcgaattctgttgagtgtagtcatggtataacatactgtttaaacaagaaaacagcataatggcagactgtagcaaaggaaggtggtaagagaactttgctttgtggattctttgttttacatctgggtaacatttaagtgcttcttttgtgctaactatgtattaaccatgtatttatctcacaacatccktataggacagatacttatgcccattttacagtagagtaaactgaggcacaggcacatttgaggttaaaatatatgacccaagtgtccagaactaataaatggcagagtggatacaatgctgttgtctgctgtcagagcctatgctcttacccattttgattcctttaagtagatagtaagatagtaagcagttttgatgaaataatgacatagtcctaaacagcaaccaagttaatcatgtagtaacctggatgcctttatagacactgaaacattggtgttctgtggtcctgattgcat

SEQ ID NO: 160069 - DNA, 601 bp, Human
tagtgaaaccccatctctagagaaaatacaaaaattagcccagcatagtggcacacgcctgtagtcccagctacttgggagaatcacttgaacctgagagtaggaggttgcagtgagccgagatcatgccattgcactccagcctggcctggccgacagtgcgagactctgtctcaaaaaaaaaaaaaaaaaaaaaaaaagaagggccaggcgtagtggttcacgcctgtaatcccagcactttgggactttgggaggctgaggcaggcggatcacctgaggctaggagtttgagaccagyctgaccaacatggagaaaccccgtctctactaaaaatacaaaattagctgggcgtgatggcgcatgcctgtaatcccagctactcagcaggctgaggcaggagaatagcttaaacccaggagacggaggttgcagtgagccaagattgcgccattgcactccagcctgggcaacaagagtgaaactctgtctcaaaaaaaaaaaagttgcttagtgctctttgagcttaagtatgccgtgaagagttctagtatttatgctgtgttattaaacaggtgttgaaaaacatggctctagaaa

SEQ ID NO: 160070 - DNA, 601 bp, Human
gcttactgtatgttatattcgtcttatgttgtttgtatctaccaggatgaattgcactttatattagcttaaggtagtggctgtcaaccctgacagcatgttagaatcacctgaggaagcttttaaactgatgcccaagccctaccccagactagtacatcagaatttctgcaggtggaacccatatgtcaatatagttaaatcttcccaggtgattctaatgtgtagccaaggtccagaaccactgatttaaggcaaaagataatttgttggcttacctctttgacaatcctactctttrtctttatctttagtattcacctcagtgcctgagaccaaatgaattgttttgtggtttgttttgagtgaatgaacaaattgttaaacacaaagagctgaactttttaaaagacaacataactcagaattcagtgatgtctaggtatttgcttagggaagaaaattaaggatctgctgtatgggagtctgtctcatgttacctcatgggttcttaaaacagtcctagatatgagtaggttttataatcacaaatgaagaaactaagacccaagcaatttagcagtaaagctggcatgtgaaa

SEQ ID NO: 160071 - DNA, 601 bp, Human
tattcatctttctgtgtctggcttatttcacttagcatatatctttcaggtccatccttgttgttgcaaaagacagaatttccttctttttaaaagctgtatagtattccattgtgtgtatataacacattttctttatccattcatctgttgagttgattgatacttaggttacttttgtatcttgattattgtgaacactgctgaaatgaacatgggggtgcagatatctctctgacataccaatttcagttcctttggctatctatccagaagtgaatttccgaatcatatggtaatwttagtatattgcggaatttccatgctgttagtattttccaaaatggctgtactaatttacattcccaccaacagaagggttcctttttctccttatcctggcccaagacttgttatcatttgtctttttgataatagccattctgacaggcatgaggtgatatctcattgtggttttaatttgcatttccctgattagagatgttgagcattttttcatatatctcttgcccatttgtatatctttgagaaatgtctgttcagaccgtttgcccattttaaaattgggttatttgttttc

SEQ ID NO: 160072 - DNA, 601 bp, Human
ctgtgcaagcagaacttaccaggataagaataacatcctgtacatatctctttcaggaaaaataaatgcaactatttattcttgaatacttttggaatgggttagagtgaaaataagtaaaataaatatttacggaggcatagtttactactattatactttctttaagtataccctatttggaaaactttaaaaactttgaaatatgtgttattacttcaaagggaaattggaacagacattttcataaagcttttttggtcagtaaaaagttgtgtagttattggtggggattattatkatggcaatgatagagaatataaagtggctaggacccaaaggatttctagaacaagaggattattttctttgaagtagtaatttgatagtaatttgaagggtttgctcagtttataatttaaagtaagagttatcctgctgtgaccagttaagataacagtagctgacatttattgagcctctcctgttatattttaagtattctgctaaagatttgaccatatattgtctcatttaatctttacaacaatttttttaaatttaatattgggtaggttggtttctggtgaaaaccagaaaa

SEQ ID NO: 160073 - DNA, 601 bp, Human
gtgattctcaagttagaggagctgacatacctcccctttatgggagataactgccttctttctttcactctcccacccttgagaatgattgactaaatcactgttaatgaaaatgtcatccctcatctgtattgtagcaaagatattttttcagtcactaactgcttagtcatttccctctccccttttgctctattaatttcatcttagctttgacccagttttgaagttggataaaatgttaacttttaaacttatttatcattttatctattcttctcaactttgtaacaactgcatytttcacaagcatagctttgactcaattcttggttaaaacagtctaaaaggacagtcaaattcatgtgacacactaaaggtaatcctccagacttatacttccttttaatactgcatgatatagttgaatgtctaagttacaattccagctccacccatttattataagcatgcaatcttagacaaggcacttacactccctgaacctatttcttgatttataaatggggataatagtctctcccctgccttctttaacaagctgttttaaagatcaataaaagaaacagcttacataaga

SEQ ID NO: 160074 - DNA, 601 bp, Human
ctctctgcagaaaattaaaattttttaaaaattagccaggcatggtgaggcacacctgtagtcttagctacttgagagcttgaggcaggaggatcacttgaacccaggagtttgaggttacagtgaactaggatcacaccactgcactctagcctgagcaaccaagtgagaccctgtctctgagaaaaaataactacaaaaattaaataagtagttagtgtcctcataaagatattgtatacacactaaaataaattgctttgctctacatacttgccagtgcaaaaaaaaaaaaaaaaaagacaaaaggaattaccaaaaatcttggaaattaaaaattgaatagtcaaaataattgttatgctgggcctgttgatgagtgcctgtagtcccagctactcaggaggctgatgcggaaagattcctgaggtcaggagttggaggctgcagtgagctatgatcacaccacagtactccagtctgggcaacaacatagcgagaccctgtctcttaaaaaaaaaaatggagcaggaaaatgggcacagacgaagagcatattaatggattggagtagagcattttccccagacaaatcataaaa

SEQ ID NO: 160075 - DNA, 601 bp, Human
ggtgaggcacacctgtagtcttagctacttgagagcttgaggcaggaggatcacttgaacccaggagtttgaggttacagtgaactaggatcacaccactgcactctagcctgagcaaccaagtgagaccctgtctctgagaaaaaataactacaaaaattaaataagtagttagtgtcctcataaagatattgtatacacactaaaataaattgctttgctctacatacttgccagtgcaaaaaaaaaaaaaaaaaagacaaaaggaattaccaaaaatcttggaaattaaaaattgaayagtcaaaataattgttatgctgggcctgttgatgagtgcctgtagtcccagctactcaggaggctgatgcggaaagattcctgaggtcaggagttggaggctgcagtgagctatgatcacaccacagtactccagtctgggcaacaacatagcgagaccctgtctcttaaaaaaaaaaatggagcaggaaaatgggcacagacgaagagcatattaatggattggagtagagcattttccccagacaaatcataaaatgacaaaaaagataaaatatagaggaaaacaatgagataagcg

SEQ ID NO: 160076 - DNA, 601 bp, Human
ctcataaagatattgtatacacactaaaataaattgctttgctctacatacttgccagtgcaaaaaaaaaaaaaaaaaagacaaaaggaattaccaaaaatcttggaaattaaaaattgaatagtcaaaataattgttatgctgggcctgttgatgagtgcctgtagtcccagctactcaggaggctgatgcggaaagattcctgaggtcaggagttggaggctgcagtgagctatgatcacaccacagtactccagtctgggcaacaacatagcgagaccctgtctcttaaaaaaaaaaatggagcaggaaaatgggcacagacgaagagcatattaatggattggagtagagcattttccccagacaaatcataaaatgacaaaaaagataaaatatagaggaaaacaatgagataagcggattagaacctaacattttatcatccatttataatagtatatccagaaagggagaatggcaacagggggcagaggacagaggctaggttgaataacaggagaaatattttccatagcattccttgtgccctctaatacagtggtgaatagtagaggtgataggagtcatctttgccttg

SEQ ID NO: 160077 - DNA, 601 bp, Human
aatagtatatccagaaagggagaatggcaacagggggcagaggacagaggctaggttgaataacaggagaaatattttccatagcattccttgtgccctctaatacagtggtgaatagtagaggtgataggagtcatctttgccttgtgtttaaagttgatgacttagggcaggcacggtggctcacaccaataatcccaacactttgggaggccgaggccagaggatcacctgaacctaggagtttgagaccagcctgggcatgatgagacctgtctctacaaaaataaaaattacgaarttaggtgtggtggcacatgcctgtggccccagctactcaggaggctgaggcaggaagagcgcttgagcccaggaatttgaggctgcagtaagccttgatcatgccactgcactccagcctggacaacagccaagaccctatctcaaaataaataaattaataaagttagtgacattgcttatgtttcattattaaggttgttgtagaattttggtaggtagtcctttattaaattaaaggtgtttattttatatctaccaaaaattaatagttttggttttttatgatattggagtaggt

SEQ ID NO: 160078 - DNA, 601 bp, Human
cctgtggccccagctactcaggaggctgaggcaggaagagcgcttgagcccaggaatttgaggctgcagtaagccttgatcatgccactgcactccagcctggacaacagccaagaccctatctcaaaataaataaattaataaagttagtgacattgcttatgtttcattattaaggttgttgtagaattttggtaggtagtcctttattaaattaaaggtgtttattttatatctaccaaaaattaatagttttggttttttatgatattggagtaggtgttaatttttttttttttttcagcatgagttgagatgatcacatggttttggtcttttaatttgtaagttacagtaacttattatattgaaccgtccttgtattgggagaattggtattggtatactatttaatttgctaatattttatttagttttgcttaaatgttcataatcaagatcatagctttctctttttgtgaatgtaatgtatttggtcaaaaactattatcctgtttttgaaagacgaattcagatttatcaaaacacgtatattcccaaatcagaatgtacctatattgatagtaacagctttggggtg

SEQ ID NO: 160079 - DNA, 601 bp, Human
tatttctgcccacatttgcccgattaaagcagagtttaatgttagctgttaggttttcctttatagttgttctagttcgtgttgaatttttttaaacagctagctatacataggaatgatctgccagtgaggaatgataatgtttaagaatagcaaatattaataaagtgccttaatagttaaaattaaccataagataaaagcatgattagcttacctagtcattgactccttaccactctgaagctaattaatctttctaaaatattttcattgtgtccttgccttcaaaaatattacrgtggtgcctctttttttttttgatatcttctataataaaatctaaacttgctgtagctttcaaggctccctgttgtctggctttatcactactctacttttcaacacaaagttctgtttcagttgctgtctacccaactggctcagagttcctttgtaaagagttggataatggctagagtgggtagggatggggagacaggacaaggacatgttgatgcagagcaacaaataattatcataaagtcattgggtatgatatataattggtttagattttagccatagaaaacagttgtaa

SEQ ID NO: 160080 - DNA, 601 bp, Human
cacatcggagatatactctaatgatggtttctcttagattcatagaatctgccatagaaaaggacattcatgatttgctagtttaactcctctctactttctttcactgaaagaatctcatcaacatctgtcaatagacagttatctaatctgaatgcttctaataataaggaattcacaatctcacaaggcaagttcttcaatttgcctgccatattggtcccagttttatccttgagaactacccacagtaaatatgctctgtacgtcacttgataagctgaaaggggtggatgttgartatcacctaagtgtcattgcaacctaaagcctgttatcctctttccaatagaaccaaagagaagttggtatgtagcttctcggccttttggctaagattaagagaagttggtatgtagttcagatacttcattttctttaattgcactgacactaaagctttgtatttataactattctggttcttatagactataggttcttggggaaccctcttgttaagagaattttcctggacccaaatatttgattttccatagagaagaaaaattcagttttatttctgtattaaagcatttca

SEQ ID NO: 160081 - DNA, 601 bp, Human
gttcctcctgaaatttagactacttatttattactttaggattttggtggttgggaaatgggatgagaaaacagttcactttgtgtattttttcatttttgaaccatgtgaatgtattacctattttaaatgctaagtgtaatggccctaaagtttcataatgactctggaaaaatatgtgaaaaaaatacaaaagtgtacataaaagttattacagctatgtataaagtacatatatagttatgtataagtatatattagaaaccaagaaatgaatattattagtatgggggatattttrtagtttaaagttgacttattcataaatacaatattcttaataatacgggacttggttgaaaaattaatatgaaagaaatctgactaaatgaaaagttaactgcctcagaatttttattgatgtgtttcataaaaggcagtaagaattgtcttttttacagttactcatatgtttaatgattctttggaaggtcttaattacagagcacggtgacctgggtaatagcagatttttagatccaagaaacaaaatttcctttaaatttgaccacttacggaaagaagcaagtgacccccagcc

SEQ ID NO: 160082 - DNA, 601 bp, Human
cattttggaaaggggtataaatgaaatttttatatggaaaatttctttttaaaatcccaatgcacaaaaaatttaggtatcagtgtattctgttttcacatttgacttatgaaaaatgccttacacccatcagaaaaaggtctttggtttttctttttttctttcttttttttaaattaaccttttaaattaatttttttttgtttgtatttttacccagatctaaaaggtctttggtttggacatggagaaaaaaatggtatactaagattgttgagagagcttttgctcatatttatgrctttttgatataggcatttttacacaaactacttctacatagtttagatgtttatattcagtaatcaaaactattagaactaaacaattggctggacatggtggctcatgcctgtaatcccagcactttgggaggccaaggtgggcagatcacttgaggccaggagttcgagaccagcctggccaacatggtgaaacctttacttaaaaaatacaaaaagtagctggatgtggtggtgtacacctgtagtttcagctactcaggaggctgaggcacaagaatcacttgaaccagggaggt

SEQ ID NO: 160083 - DNA, 601 bp, Human
atttaggtatcagtgtattctgttttcacatttgacttatgaaaaatgccttacacccatcagaaaaaggtctttggtttttctttttttctttcttttttttaaattaaccttttaaattaatttttttttgtttgtatttttacccagatctaaaaggtctttggtttggacatggagaaaaaaatggtatactaagattgttgagagagcttttgctcatatttatggctttttgatataggcatttttacacaaactacttctacatagtttagatgtttatattcagtaatcaaarctattagaactaaacaattggctggacatggtggctcatgcctgtaatcccagcactttgggaggccaaggtgggcagatcacttgaggccaggagttcgagaccagcctggccaacatggtgaaacctttacttaaaaaatacaaaaagtagctggatgtggtggtgtacacctgtagtttcagctactcaggaggctgaggcacaagaatcacttgaaccagggaggtggaggttgcagtgagctgagaccacaccactgcattccagcctgggcaacagagtgagactctgtctcaa

SEQ ID NO: 160084 - DNA, 579 bp, Human
tggacatggagaaaaaaatggtatactaagattgttgagagagcttttgctcatatttatggctttttgatataggcatttttacacaaactacttctacatagtttagatgtttatattcagtaatcaaaactattagaactaaacaattggctggacatggtggctcatgcctgtaatcccagcactttgggaggccaaggtgggcagatcacttgaggccaggagttcgagaccagcctggccaacatggtgaaacctttacttaaaaaatacaaaaagtagctggatgtggtggtgyacacctgtagtttcagctactcaggaggctgaggcacaagaatcacttgaaccagggaggtggaggttgcagtgagctgagaccacaccactgcattccagcctgggcaacagagtgagactctgtctcaaaaaaacaaaaaacaaaaaaaacacaaacaatttttttttaatcaggagtgattttctttttgttgttgtttttgctgttgttgttgttgttcttttgttttttgagactaagtcttactctgtcacccaggctagaatgcaggggca

SEQ ID NO: 160085 - DNA, 457 bp, Human
gtaatcaaaactattagaactaaacaattggctggacatggtggctcatgcctgtaatcccagcactttgggaggccaaggtgggcagatcacttgaggccaggagttcgagaccagcctggccaacatggtgaaacctttacttaaaaaatacaaaaagtagctggatgtggtggtgtacacctgtagtttcagctactcaggaggctgaggcacaagaatcacttgaaccagggaggtggaggttgcagtgagctgagaccacaccactgcattccagcctgggcaacagagtgagacwctgtctcaaaaaaacaaaaaacaaaaaaaacacaaacaatttttttttaatcaggagtgattttctttttgttgttgtttttgctgttgttgttgttgttcttttgttttttgagactaagtcttactctgtcacccaggctagaatgcaggggca

SEQ ID NO: 160086 - DNA, 425 bp, Human
tggacatggtggctcatgcctgtaatcccagcactttgggaggccaaggtgggcagatcacttgaggccaggagttcgagaccagcctggccaacatggtgaaacctttacttaaaaaatacaaaaagtagctggatgtggtggtgtacacctgtagtttcagctactcaggaggctgaggcacaagaatcacttgaaccagggaggtggaggttgcagtgagctgagaccacaccactgcattccagcctgggcaacagagtgagactctgtctcaaaaaaacaaaaaacaaaaaaaacacaaacaatttttttttaatcaggagtgattttctttttgttgttgtttttgctgttgttgttgttgttcttttgttttttgagactaagtcttactctgtcacccaggctagaatgcaggggca

SEQ ID NO: 160087 - DNA, 601 bp, Human
acctggctaatttttgtatttttagtagagatggggtttcaccatgttggccgggctggtcttgaactcctgacctcaggtaatccccctgccacagcctctcaaagtgctggggttacaggcttgagccattgcacccagccccctaattattcttactctatactaagttctttttttcccctacctttgtaaatgtaggcattcccccaaagttcataattcatttaatgcaggtaaagtaacacagacttcggtgtcacaaaaacagtgggtttggattctacctttaccacttcckgagtgaccttaggcaagaagctttgtgaacttcaacttcttatctgtagataacactgtatttcatcagatttattagaggaaaaagaaaatacatgtaagaacatattttgtggactataaagcactattttttttttcttactttcccttggtgattgcatttccattcacctctcccacactaaagaagagttagtgtttctaactactaactagacatctccatctgtaatttccagtttgttaatgacaccaccatctttttagtcactcttgagttccttctttcctttgccca

SEQ ID NO: 160088 - DNA, 601 bp, Human
gttttatcttgaataccagtattgattattctcccacaatattagttctagtcatgttttgctgtctctccattgcctatagaataaaatcttaaacttcttactttacatctactattacatgacctaaatctaccatcctgttttgtctttcattagtccacttcacacacaccctttaaacctgacagtcttgttcactgaacaagtccttagtttcctgtcttgcctttattttcagtctctgcttatcagaatctcatctgtcttgtatgacccagcctaaatggcacccgccttstaccccaaaccaagagcagtatttccctctgttttcattgtatcactgtctctggtagaacctaacatgttctgctttgttttcatatcccatgtgcactattgtgttctaagctcattttatgtgattctttgtctcccccaaggatttaacactctgcttttgtacaatgcatgttgtttaaattaaaagtgtttggagtctttaactatttttttttcccaacaataggtttatgctaaaactatcgatgggcaacagactattattgcatgtattgaaagccaccagtttcagcct

SEQ ID NO: 160089 - DNA, 601 bp, Human
ttactcttattttgagtgagaacaagtgattagtaaagtgccctgttgaaaatctgagttttacttggcttagggttactgctacttgagttaattgtgtaactcagcagcctattcatctgattttggaagagcctcccatgagcagaataggcatggttttccatttcaagggaaaaaaggaaaaatgaaagacaaaataacttagaaaaggcttatggtcaggccacttagatccagacttacatttgagtagacagagctttgggtttgccaaactggaaatgacagtttctctctctctttttttttttttctttttttgcacccctctttcccaacttctgtacctcagtggcaaatcacctctttcttgtgcttattgctaattctgcaatgttgtgtgtgtgttttaataggaatggtcgttggagatcagagtggaagttcaccatcacaccacctacagcccaggtggttggcgtgcttaagattcaggtgagattccaacatgtttatagacttaaaacttcacatctttaaaacatgtgcaggttgctttggtattaaataaggaccaagtatgtgtagatgcaaaggg

SEQ ID NO: 160090 - DNA, 601 bp, Human
actcttattttgagtgagaacaagtgattagtaaagtgccctgttgaaaatctgagttttacttggcttagggttactgctacttgagttaattgtgtaactcagcagcctattcatctgattttggaagagcctcccatgagcagaataggcatggttttccatttcaagggaaaaaaggaaaaatgaaagacaaaataacttagaaaaggcttatggtcaggccacttagatccagacttacatttgagtagacagagctttgggtttgccaaactggaaatgacagtttctctctctctttttttttttttctttttttgcacccctctttcccaacttctgtacctcagtggcaaatcacctctttcttgtgcttattgctaattctgcaatgttgtgtgtgtgttttaataggaatggtcgttggagatcagagtggaagttcaccatcacaccacctacagcccaggtggttggcgtgcttaagattcaggtgagattccaacatgtttatagacttaaaacttcacatctttaaaacatgtgcaggttgctttggtattaaataaggaccaagtatgtgtagatgcaaagggag

SEQ ID NO: 160091 - DNA, 601 bp, Human
tcttattttgagtgagaacaagtgattagtaaagtgccctgttgaaaatctgagttttacttggcttagggttactgctacttgagttaattgtgtaactcagcagcctattcatctgattttggaagagcctcccatgagcagaataggcatggttttccatttcaagggaaaaaaggaaaaatgaaagacaaaataacttagaaaaggcttatggtcaggccacttagatccagacttacatttgagtagacagagctttgggtttgccaaactggaaatgacagtttctctctctctytttttttttttctttttttgcacccctctttcccaacttctgtacctcagtggcaaatcacctctttcttgtgcttattgctaattctgcaatgttgtgtgtgtgttttaataggaatggtcgttggagatcagagtggaagttcaccatcacaccacctacagcccaggtggttggcgtgcttaagattcaggtgagattccaacatgtttatagacttaaaacttcacatctttaaaacatgtgcaggttgctttggtattaaataaggaccaagtatgtgtagatgcaaagggagac

SEQ ID NO: 160092 - DNA, 601 bp, Human
gctacagaactcagtcggatccgcaataacgacaggccggggactgcgaaacgtgagcctgccgcggggactggggattgggggcgtccctcccctcctacatctgcgggtccgctcctcgaacacgcgcagtccgcgcggagggggcgcatgcgtgcacttacgtgaccccggcctcgtcgtggtcgtctggaaaatgggcctcggcgtgatgctcgccggaccctggcaccacgagggaaatctcaagtagaaccccagctttggcactcgggacgggtcagccccgccgcagctacccacggtcttccggtttggaccggaagtgcctcctgcggaggcaggaagtcccgcctcccagccaggcctcttagggtcctggcgcgccccctcccgggaggagagggaacgggcgtgcaggcggcgcgtgggcagcggaaataaagctcccttgagtcccaatagtggaggccgggtggacttaggttcgaatcccacatctacttcaccaatttcctcagagttgtattaaattaatcatttaacgaactcccacagaacacctactataagccagacctgtattggtcagtaggtatcc

SEQ ID NO: 160093 - DNA, 601 bp, Human; identical to SEQ ID NO: 33074

SEQ ID NO: 160094 - DNA, 601 bp, Human; identical to SEQ ID NO: 33075

SEQ ID NO: 160095 - DNA, 601 bp, Human; identical to SEQ ID NO: 33076

SEQ ID NO: 160096 - DNA, 601 bp, Human; identical to SEQ ID NO: 33077

SEQ ID NO: 160097 - DNA, 601 bp, Human; identical to SEQ ID NO: 33078

SEQ ID NO: 160098 - DNA, 601 bp, Human; identical to SEQ ID NO: 33079

SEQ ID NO: 160099 - DNA, 601 bp, Human; identical to SEQ ID NO: 33080

SEQ ID NO: 160100 - DNA, 601 bp, Human; identical to SEQ ID NO: 33081

SEQ ID NO: 160101 - DNA, 601 bp, Human; identical to SEQ ID NO: 33082

SEQ ID NO: 160102 - DNA, 601 bp, Human; identical to SEQ ID NO: 33083

SEQ ID NO: 160103 - DNA, 601 bp, Human; identical to SEQ ID NO: 33084

SEQ ID NO: 160104 - DNA, 601 bp, Human; identical to SEQ ID NO: 33085

SEQ ID NO: 160105 - DNA, 601 bp, Human; identical to SEQ ID NO: 33086

SEQ ID NO: 160106 - DNA, 601 bp, Human; identical to SEQ ID NO: 33087

SEQ ID NO: 160107 - DNA, 601 bp, Human; identical to SEQ ID NO: 33088

SEQ ID NO: 160108 - DNA, 601 bp, Human
ttgccattttcttgatactgttccccgtttcaatagctttccattgctcacaaaataaaggaaaatatctttaatctggcctcaaattccctgcacgttgtgaccattgcctactctgcaaccccatttcttagtacttgccttccagacatactgaattgtctctaattcttggaaatttccatggttttctttttctttcttgcctctcagacttctgaactcagtttctcctagtttaggacgctgtgccttccaccctcccagtaacctagagactaccctgcgagactcaccctcytctccctggaagaagagggagttctgccagcagactgtctttggacttggactgagtacttctctgggtctccagcctactggcccaccctgcagattttagacttgcatctccacagtcgtgtgatccagttttaaaaataccccctctctccatacacatatatacacatatacatcttgttgattctgtttctctgaagaactctactaaaagaagtattatcaaaattaaaaaggagcttgaactcatgtagcctaatgctcttctttttaaagatgaggaaaagagatattcaga

SEQ ID NO: 160109 - DNA, 601 bp, Human
gaattgcataggttaatatacgcaaaccacttcaatcattgtctagtactataaatatttgccattttcttgatactgttccccgtttcaatagctttccattgctcacaaaataaaggaaaatatctttaatctggcctcaaattccctgcacgttgtgaccattgcctactctgcaaccccatttcttagtacttgccttccagacatactgaattgtctctaattcttggaaatttccatggttttctttttctttcttgcctctcagacttctgaactcagtttctcctagtttagsacgctgtgccttccaccctcccagtaacctagagactaccctgcgagactcaccctcttctccctggaagaagagggagttctgccagcagactgtctttggacttggactgagtacttctctgggtctccagcctactggcccaccctgcagattttagacttgcatctccacagtcgtgtgatccagttttaaaaataccccctctctccatacacatatatacacatatacatcttgttgattctgtttctctgaagaactctactaaaagaagtattatcaaaattaaaaaggagc

SEQ ID NO: 160110 - DNA, 601 bp, Human
aatctttccaatatctgcttggccaattcactccacttctctgaagttaatgttattaccaaccataaaatcaaactctgttcagtaaagattcaaattttgctaatatgcatgaaagtgcttgacaaactctaagttatgctgcaatttgtcctccaccctcattcacccattcatccctaactccatcctagctcaactccattcaaatcttgcccatataatgtttactctctctcttttttttttttttttttgagacagggtctccctgtgtcaccaaggctggagtgcagtggcrccatctcagctcactgcagccttgatctcccaagctcaagtgatcctcccacctcagcctcccaagtagctgggactaaaggtgcgtgccactaggcctggctaatattttgtattttttgtagagatggggtttcaccatgttgcccaggatggtctcaaacacctgggcttaagcgatttgtctacctcagcctctcaaagtgctgggactacaggcatgagccactgcgaatggcctatctttcaaaacattatgaatgcttccttccctcttttggaaattccacctctttaaaca

SEQ ID NO: 160111 - DNA, 601 bp, Human
aaatctttccaatatctgcttggccaattcactccacttctctgaagttaatgttattaccaaccataaaatcaaactctgttcagtaaagattcaaattttgctaatatgcatgaaagtgcttgacaaactctaagttatgctgcaatttgtcctccaccctcattcacccattcatccctaactccatcctagctcaactccattcaaatcttgcccatataatgtttactctctctcttttttttttttttttttgagacagggtctccctgtgtcaccaaggctggagtgcagtggygccatctcagctcactgcagccttgatctcccaagctcaagtgatcctcccacctcagcctcccaagtagctgggactaaaggtgcgtgccactaggcctggctaatattttgtattttttgtagagatggggtttcaccatgttgcccaggatggtctcaaacacctgggcttaagcgatttgtctacctcagcctctcaaagtgctgggactacaggcatgagccactgcgaatggcctatctttcaaaacattatgaatgcttccttccctcttttggaaattccacctctttaaac

SEQ ID NO: 160112 - DNA, 601 bp, Human
tcctgctatcttgccagtaagttttttcttatcaatgaccaaagctgctaaaccaaatagagaatgtgggtgatctttttccttctcctttgcttccaacgtccagttgagtctccccatttggtgggggtggacatttaagttaatttctttcttcttagttgcaactcggatatttagtttgagcctgagtcacccagtacatcatctggcttattccaagagctaaaacaactgctaaaatctttccaatatctgcttggccaattcactccacttctctgaagttaatgttattacmaaccataaaatcaaactctgttcagtaaagattcaaattttgctaatatgcatgaaagtgcttgacaaactctaagttatgctgcaatttgtcctccaccctcattcacccattcatccctaactccatcctagctcaactccattcaaatcttgcccatataatgtttactctctctcttttttttttttttttttgagacagggtctccctgtgtcaccaaggctggagtgcagtggcgccatctcagctcactgcagccttgatctcccaagctcaagtgatcctcccacctcagcc

SEQ ID NO: 160113 - DNA, 601 bp, Human
gtatagacagtgtctcctgctatcttgccagtaagttttttcttatcaatgaccaaagctgctaaaccaaatagagaatgtgggtgatctttttccttctcctttgcttccaacgtccagttgagtctccccatttggtgggggtggacatttaagttaatttctttcttcttagttgcaactcggatatttagtttgagcctgagtcacccagtacatcatctggcttattccaagagctaaaacaactgctaaaatctttccaatatctgcttggccaattcactccacttctctgaarttaatgttattaccaaccataaaatcaaactctgttcagtaaagattcaaattttgctaatatgcatgaaagtgcttgacaaactctaagttatgctgcaatttgtcctccaccctcattcacccattcatccctaactccatcctagctcaactccattcaaatcttgcccatataatgtttactctctctcttttttttttttttttttgagacagggtctccctgtgtcaccaaggctggagtgcagtggcgccatctcagctcactgcagccttgatctcccaagctcaagtgatc

SEQ ID NO: 160114 - DNA, 601 bp, Human
gctgtgcagcctgttccttacaggtcatggactggtgctggtccatggcctggcggttggggacccatgctatataggacttagctctggttaaggcaccctaagtgcagctactccatgccttctcacagtatactctgttctatcagtatagacagtgtctcctgctatcttgccagtaagttttttcttatcaatgaccaaagctgctaaaccaaatagagaatgtgggtgatctttttccttctcctttgcttccaacgtccagttgagtctccccatttggtgggggtggacatttaagttaatttctttcttcttagttgcaactcggatatttagtttgagcctgagtcacccagtacatcatctggcttattccaagagctaaaacaactgctaaaatctttccaatatctgcttggccaattcactccacttctctgaagttaatgttattaccaaccataaaatcaaactctgttcagtaaagattcaaattttgctaatatgcatgaaagtgcttgacaaactctaagttatgctgcaatttgtcctccaccctcattcacccattcatccctaactccatcctagctca

SEQ ID NO: 160115 - DNA, 601 bp, Human
ctaggattctgccactgatctgacaggaggcggagctcaggtggtaatgcaagctatggggaacagctgtaaatacagatgaagtttcgctcgcttgcctgcccgctgctcacttcctgctgtgcagcctgttccttacaggtcatggactggtgctggtccatggcctggcggttggggacccatgctatataggacttagctctggttaaggcaccctaagtgcagctactccatgccttctcacagtatactctgttctatcagtatagacagtgtctcctgctatcttgccagtaarttttttcttatcaatgaccaaagctgctaaaccaaatagagaatgtgggtgatctttttccttctcctttgcttccaacgtccagttgagtctccccatttggtgggggtggacatttaagttaatttctttcttcttagttgcaactcggatatttagtttgagcctgagtcacccagtacatcatctggcttattccaagagctaaaacaactgctaaaatctttccaatatctgcttggccaattcactccacttctctgaagttaatgttattaccaaccataaaatcaaactctg

SEQ ID NO: 160116 - DNA, 601 bp, Human
gcttcctggaagacaatttttccacgggtggtggagaggggaagggtagatggtttagggatgattcaagtgcattacatttattgtgcactttgtttctattattatattataatatgtcatgaaataattatacaactcaccacaatgaagaatcagtggaagacctgagcttgttttcctgaaactagacagtcccatctgggtgtgatgggagacaatgacagatcatcaggcattagattctcgtaagtagagcgcaaggtagatccctcatatgcacagttcacagtagggtttytgatcctaggagaatctaggattctgccactgatctgacaggaggcggagctcaggtggtaatgcaagctatggggaacagctgtaaatacagatgaagtttcgctcgcttgcctgcccgctgctcacttcctgctgtgcagcctgttccttacaggtcatggactggtgctggtccatggcctggcggttggggacccatgctatataggacttagctctggttaaggcaccctaagtgcagctactccatgccttctcacagtatactctgttctatcagtatagacagtgtctcctg

SEQ ID NO: 160117 - DNA, 601 bp, Human
cagtgccaaaatcacaaataagcaccctctacaaccattccatactggaagaccttccatccacatccttctttttcttcttcccattaggatcaccctgcaatggctgaccaagtcagaggcattgaagtgagtcaggattaaatcctcaaccctcttatacttgcctaaaaagtggtccccaacctttttggcaccagggatgggcttcctggaagacaatttttccacgggtggtggagaggggaagggtagatggtttagggatgattcaagtgcattacatttattgtgcactttstttctattattatattataatatgtcatgaaataattatacaactcaccacaatgaagaatcagtggaagacctgagcttgttttcctgaaactagacagtcccatctgggtgtgatgggagacaatgacagatcatcaggcattagattctcgtaagtagagcgcaaggtagatccctcatatgcacagttcacagtagggtttctgatcctaggagaatctaggattctgccactgatctgacaggaggcggagctcaggtggtaatgcaagctatggggaacagctgtaaatacaga

SEQ ID NO: 160118 - DNA, 601 bp, Human
ccaagccctgttctgagagtctaacagtgccaaaatcacaaataagcaccctctacaaccattccatactggaagaccttccatccacatccttctttttcttcttcccattaggatcaccctgcaatggctgaccaagtcagaggcattgaagtgagtcaggattaaatcctcaaccctcttatacttgcctaaaaagtggtccccaacctttttggcaccagggatgggcttcctggaagacaatttttccacgggtggtggagaggggaagggtagatggtttagggatgattcaagygcattacatttattgtgcactttgtttctattattatattataatatgtcatgaaataattatacaactcaccacaatgaagaatcagtggaagacctgagcttgttttcctgaaactagacagtcccatctgggtgtgatgggagacaatgacagatcatcaggcattagattctcgtaagtagagcgcaaggtagatccctcatatgcacagttcacagtagggtttctgatcctaggagaatctaggattctgccactgatctgacaggaggcggagctcaggtggtaatgcaagct

SEQ ID NO: 160119 - DNA, 601 bp, Human
aatatttatcatatggtcctttacagaaagtttgccaagccctgttctgagagtctaacagtgccaaaatcacaaataagcaccctctacaaccattccatactggaagaccttccatccacatccttctttttcttcttcccattaggatcaccctgcaatggctgaccaagtcagaggcattgaagtgagtcaggattaaatcctcaaccctcttatacttgcctaaaaagtggtccccaacctttttggcaccagggatgggcttcctggaagacaatttttccacgggtggtggagmggggaagggtagatggtttagggatgattcaagtgcattacatttattgtgcactttgtttctattattatattataatatgtcatgaaataattatacaactcaccacaatgaagaatcagtggaagacctgagcttgttttcctgaaactagacagtcccatctgggtgtgatgggagacaatgacagatcatcaggcattagattctcgtaagtagagcgcaaggtagatccctcatatgcacagttcacagtagggtttctgatcctaggagaatctaggattctgccactgatct

SEQ ID NO: 160120 - DNA, 601 bp, Human
ctgtctggctcataagaccaaaatatttatcatatggtcctttacagaaagtttgccaagccctgttctgagagtctaacagtgccaaaatcacaaataagcaccctctacaaccattccatactggaagaccttccatccacatccttctttttcttcttcccattaggatcaccctgcaatggctgaccaagtcagaggcattgaagtgagtcaggattaaatcctcaaccctcttatacttgcctaaaaagtggtccccaacctttttggcaccagggatgggcttcctggaagacartttttccacgggtggtggagaggggaagggtagatggtttagggatgattcaagtgcattacatttattgtgcactttgtttctattattatattataatatgtcatgaaataattatacaactcaccacaatgaagaatcagtggaagacctgagcttgttttcctgaaactagacagtcccatctgggtgtgatgggagacaatgacagatcatcaggcattagattctcgtaagtagagcgcaaggtagatccctcatatgcacagttcacagtagggtttctgatcctaggagaat

SEQ ID NO: 160121 - DNA, 601 bp, Human
acactggagaaaataaaatcagaaaatacccagaagcctcctagcagttaggtttcagcttccactggtttctatgtatcccccatttctttcccttattcaggtccgatatttcttttttatttttttttttattttttttttttgagacagagtctcactctgtcgcccaggctggagtgtagtggcacgatctcagctcactgcaacctctgcctcctaggttcaagaggttctcctgcctcagcttctcgagtagctgagattacgcgcctgccaccacacccagctaatttttctrtttttagtagagacgggggttcaccactttggccaggctggtctcaaactcctgactttgtgatccacccgcctcggcctcccaaagtgctgggattacaggtgtgagccgctgcgcccggcccaggtcccatatttctcctccttctattccaccttttccaaacataagcctttttaggcataagcactttaacaatgactactaagttaaatgaaaaaaccttaacgttcacgaataaaatagtcatgcactgcaaaatgatgtttggtcgacgatggaacccatatatgacagtgg

SEQ ID NO: 160122 - DNA, 601 bp, Human
gagctgctcttatcaaatctgcagaaagttgactcaaaatatggcagtaaataacagtcctgctgccagtctctcactagcatgaatacctgtatttcttcagggaacaagtgaacaaacttaagaggctaaccacagcaacaagataaaatatcaacactggagaaaataaaatcagaaaatacccagaagcctcctagcagttaggtttcagcttccactggtttctatgtatcccccatttctttcccttattcaggtccgatatttcttttttatttttttttttattttttttttktgagacagagtctcactctgtcgcccaggctggagtgtagtggcacgatctcagctcactgcaacctctgcctcctaggttcaagaggttctcctgcctcagcttctcgagtagctgagattacgcgcctgccaccacacccagctaatttttctgtttttagtagagacgggggttcaccactttggccaggctggtctcaaactcctgactttgtgatccacccgcctcggcctcccaaagtgctgggattacaggtgtgagccgctgcgcccggcccaggtcccatatttctcctcc

SEQ ID NO: 160123 - DNA, 601 bp, Human
gctaaactcttgagctgctcttatcaaatctgcagaaagttgactcaaaatatggcagtaaataacagtcctgctgccagtctctcactagcatgaatacctgtatttcttcagggaacaagtgaacaaacttaagaggctaaccacagcaacaagataaaatatcaacactggagaaaataaaatcagaaaatacccagaagcctcctagcagttaggtttcagcttccactggtttctatgtatcccccatttctttcccttattcaggtccgatatttcttttttatttttttttttwttttttttttttgagacagagtctcactctgtcgcccaggctggagtgtagtggcacgatctcagctcactgcaacctctgcctcctaggttcaagaggttctcctgcctcagcttctcgagtagctgagattacgcgcctgccaccacacccagctaatttttctgtttttagtagagacgggggttcaccactttggccaggctggtctcaaactcctgactttgtgatccacccgcctcggcctcccaaagtgctgggattacaggtgtgagccgctgcgcccggcccaggtcccat

SEQ ID NO: 160124 - DNA, 601 bp, Human
ctccctgtgaccctgcccctggcactatcttctccctcctcaccaacatcttgcttcctctgagaagcagagaaaaaaagtaccttctcccgatccctcctggtgggacatactttctatctttagagaagggtatctaaccttcaaacaatgtccagaggtcagccaaatgaacaggggaatataacattccaaatcaaagcccaaacatcaggtacagaatggaaacacataaatgtgcctcaagacagtaagcagcatcttcagtcatttgaccaaagtttaagtaaaactaccatayaacagagcttactaaggtgaggaaagtatcagggaaaaatgaaaaatagcttccagaaggattcagctaaattaatggatgaaataaatccaacactccttcattcaaaattgttgatcaggcaccagccaagcttaggggtgggccagaaactgtctaccccagccttcagcactgactagctgggtgaagctgggcaagttaccctcccttaagctcagttcctcaactacaaagtgacagaatcataggaggcagttcctaagtttgctacgaagattcaataactacagatgtaaa

SEQ ID NO: 160125 - DNA, 601 bp, Human
ataaacaactggaaggaacactttggcaagtttacttaaggcataaaagtaaattatagctccagcagcaaaggtcccttcctccctgtgaccctgcccctggcactatcttctccctcctcaccaacatcttgcttcctctgagaagcagagaaaaaaagtaccttctcccgatccctcctggtgggacatactttctatctttagagaagggtatctaaccttcaaacaatgtccagaggtcagccaaatgaacaggggaatataacattccaaatcaaagcccaaacatcaggtacaraatggaaacacataaatgtgcctcaagacagtaagcagcatcttcagtcatttgaccaaagtttaagtaaaactaccatacaacagagcttactaaggtgaggaaagtatcagggaaaaatgaaaaatagcttccagaaggattcagctaaattaatggatgaaataaatccaacactccttcattcaaaattgttgatcaggcaccagccaagcttaggggtgggccagaaactgtctaccccagccttcagcactgactagctgggtgaagctgggcaagttaccctcccttaagctc

SEQ ID NO: 160126 - DNA, 601 bp, Human
aggggcccccctatgccccacccacaccttgatagtctctcctcagtctgagagtgtcatcttctcctgccaacatcctgagctgatatacacacctatacataaacaggatgctgagtaatggcaaaaaggcattatttaccttcccagaaagaaatgtaaaggtcattttctgggaataatatgctgtattaggggaaaaatactggaaacaagatagaaacagtcctgctctttaataaacaactggaaggaacactttggcaagtttacttaaggcataaaagtaaattatagctctagcagcaaaggtcccttcctccctgtgaccctgcccctggcactatcttctccctcctcaccaacatcttgcttcctctgagaagcagagaaaaaaagtaccttctcccgatccctcctggtgggacatactttctatctttagagaagggtatctaaccttcaaacaatgtccagaggtcagccaaatgaacaggggaatataacattccaaatcaaagcccaaacatcaggtacagaatggaaacacataaatgtgcctcaagacagtaagcagcatcttcagtcatttgaccaaagt

SEQ ID NO: 160127 - DNA, 601 bp, Human
ttgggctggccgtacccgtgaatggaggtagcagctcctgtaaggtgctctctctacacaacttatctgcagattcggtagcagctattccccacccacccgttgactctgcaagctcaggtggtaatcactcccactacacatgctaggaggtgctgcactgccccgaggggcccccctatgccccacccacaccttgatagtctctcctcagtctgagagtgtcatcttctcctgccaacatcctgagctgatatacacacctatacataaacaggatgctgagtaatggcaaaaaggyattatttaccttcccagaaagaaatgtaaaggtcattttctgggaataatatgctgtattaggggaaaaatactggaaacaagatagaaacagtcctgctctttaataaacaactggaaggaacactttggcaagtttacttaaggcataaaagtaaattatagctccagcagcaaaggtcccttcctccctgtgaccctgcccctggcactatcttctccctcctcaccaacatcttgcttcctctgagaagcagagaaaaaaagtaccttctcccgatccctcctggtgggacatact

SEQ ID NO: 160128 - DNA, 601 bp, Human
taaacaactggcggagctgggcatcaaacccaggtctgcctgacttcagagcccatgtgcttaatcaaccaatccattccatgatctccctatttagagtgttaaaaacaacaactcaatacaacacgtataccaaggacatgtcatccattcacccctccagacctacttcccgtcttcacctgtttctctggcctgggaggctgacttgaacgtaatgcacggaagggctcctttgctgccaggtacctggctcccttgctaggatgaccttgggctggccgtacccgtgaatggaggyagcagctcctgtaaggtgctctctctacacaacttatctgcagattcggtagcagctattccccacccacccgttgactctgcaagctcaggtggtaatcactcccactacacatgctaggaggtgctgcactgccccgaggggcccccctatgccccacccacaccttgatagtctctcctcagtctgagagtgtcatcttctcctgccaacatcctgagctgatatacacacctatacataaacaggatgctgagtaatggcaaaaaggcattatttaccttcccagaaagaaatgta

SEQ ID NO: 160129 - DNA, 601 bp, Human
ctggaggaatctgaaaaatgacgtgcaggtaggattttctgactgtcccctgaagcaggtcataaaagcatctcacataagaggtgccctccctacactcagaggaaagcaacatccttatctcagaagaagggacagagagaggaatctgaacaaaagacttgctaagtttctcctggcttattactcttcgttcataccccttgctcccatcatatttcttcacaactttccactcttcatcaaagctaacataaaaacactcaggttcaaccagttcttcggtattcattttcttatraaggctcctgtgtcacctaaaacttttgtgaaataaaagtgtatacctttctctttgttaatctgtcttttgttacagggaccccaactaatgaacttcaaatgggtggaaggaaaggctattgtccctcccctacatctcagacccagaaggttcctatcttccaccagcatcagtgaaagtgtggcaggctaacttgttagtttcaggtccctatagcttctgactccaaacagaccacaaaacacaagtataagatgtacaatagccaaaaatacttcttaaacaacttgctacggc

SEQ ID NO: 160130 - DNA, 601 bp, Human
ggggacaaaagagaaatgacgcaaacttgatgcttgtgctgcttgctgtacagtaagtcctttgtttctgatggtgttcaggagacactactcccaaaatatggcatcttggcatactgaaaattttacactggaggaatctgaaaaatgacgtgcaggtaggattttctgactgtcccctgaagcaggtcataaaagcatctcacataagaggtgccctccctacactcagaggaaagcaacatccttatctcagaagaagggacagagagaggaatctgaacaaaagacttgctaagtwtctcctggcttattactcttcgttcataccccttgctcccatcatatttcttcacaactttccactcttcatcaaagctaacataaaaacactcaggttcaaccagttcttcggtattcattttcttatgaaggctcctgtgtcacctaaaacttttgtgaaataaaagtgtatacctttctctttgttaatctgtcttttgttacagggaccccaactaatgaacttcaaatgggtggaaggaaaggctattgtccctcccctacatctcagacccagaaggttcctatcttccaccag

SEQ ID NO: 160131 - DNA, 601 bp, Human
catccacctgggccacttcacgccatccctcataggagttggggacaaaagagaaatgacgcaaacttgatgcttgtgctgcttgctgtacagtaagtcctttgtttctgatggtgttcaggagacactactcccaaaatatggcatcttggcatactgaaaattttacactggaggaatctgaaaaatgacgtgcaggtaggattttctgactgtcccctgaagcaggtcataaaagcatctcacataagaggtgccctccctacactcagaggaaagcaacatccttatctcagaagaggggacagagagaggaatctgaacaaaagacttgctaagtttctcctggcttattactcttcgttcataccccttgctcccatcatatttcttcacaactttccactcttcatcaaagctaacataaaaacactcaggttcaaccagttcttcggtattcattttcttatgaaggctcctgtgtcacctaaaacttttgtgaaataaaagtgtatacctttctctttgttaatctgtcttttgttacagggaccccaactaatgaacttcaaatgggtggaaggaaaggctattgtccctc

SEQ ID NO: 160132 - DNA, 601 bp, Human
agcagccttgaaaaacagtcttcctctaaagcgaagggcagatttgcttactgtccagcataatacagatgcctctcttggggccgaaggcaagtctgcttgtggtccgttatccaaggttccagttttctaagctcaggagatctcagctatgatgcaaatccactgggtgcacagcatccacctgggccacttcacgccatccctcataggagttggggacaaaagagaaatgacgcaaacttgatgcttgtgctgcttgctgtacagtaagtcctttgtttctgatggtgttcaggasacactactcccaaaatatggcatcttggcatactgaaaattttacactggaggaatctgaaaaatgacgtgcaggtaggattttctgactgtcccctgaagcaggtcataaaagcatctcacataagaggtgccctccctacactcagaggaaagcaacatccttatctcagaagaagggacagagagaggaatctgaacaaaagacttgctaagtttctcctggcttattactcttcgttcataccccttgctcccatcatatttcttcacaactttccactcttcatcaaagctaaca

SEQ ID NO: 160133 - DNA, 601 bp, Human
atggtctcgatctcctgacgtcgtgatccgcctgcctcggcctcccaaagtgctgggattacaggtgtgagccaccgtgcccggcctaggagttctaaataatttttataaatgcaaatagcttctgagttccaaaactctgagaaccactgtgattttggttcctctctcactggccctctagtctggctagaaactcacttacttcagaaccgcctctccctgagggaatctaaatttgggcacagaacttgctgttcagctttttctatgaacttgggattccctctcaattgcccartcttattccttatagagggagcagctgatgagacctcctcaattccaaagtaaatcatctctctcaggaaagcaccatacatcaaagctttcacttaaggcaaaggagggacccagagaaagacaacctccagaggtcaggactggattcagagcaggactactggcccctcagaggtttttcccacgggtttgcattgacaccgtatctttaatataaaaaggagcacaggtgttttgtatctacatgcatggttttaagaattagaaaaattaattacagagttggcaagcaagtgaa

SEQ ID NO: 160134 - DNA, 601 bp, Human
gtgccactcttctcgttaaattttttgtcttgaaaaagttatttgtcattaaaaatgtgttaggtaatgaatttgttatttaaataatttttaaaatttcttacatagtaaatattaacaaatataaatcacacaaaacactctttaggtgttctaaataaatttttttttttgagatggagtctcattctgttgcccaggctggagtgcagtagcgcaatctcggctcaatgcaacctccgcctcctggattccagtgattctcctgcctcagcctcctgagaagctgggactacaggcrcacgccatcatgcctggctaattttttttgtatttttagtagagacggggtttcaccatgttaaccatgatggtctcgatctcctgacgtcgtgatccgcctgcctcggcctcccaaagtgctgggattacaggtgtgagccaccgtgcccggcctaggagttctaaataatttttataaatgcaaatagcttctgagttccaaaactctgagaaccactgtgattttggttcctctctcactggccctctagtctggctagaaactcacttacttcagaaccgcctctccctgagggaa

SEQ ID NO: 160135 - DNA, 601 bp, Human
agtgaacctgacacttcaaggggaataactgacactatttactgccaataacaaaattcaagctttcaagcaaaagttagaattccgaatagcttttatctgtcatcttgggcttgatagcttcccaacacttaaaagacttttctgttgaaacccacggtgatactaatgaatgtgatttttgatattgtataacaagatgagttaacactgggaaaatctatacaactcattttccaaatgacagatgcaggatgttaagaaatcatatacaggtaaaagatctatttggaatacaagrcagaccaagacatgaaaaattcactggtgttttcagattccacgttgcaatttactctgaagaaactactactgactgagttttggagttgtaccaaagaattatctgaaaaggccattgagatactcctctcttttcaactgtatcacctgtgtgagggggattttctttatatacttcaaccaatacaacatgctttaacaggctgactgcaggcgttcagagtctagctgtcttctattatgccacaatgttaaagagatttgcaaaaacagaaaacagtgccactcttctcgttaa

SEQ ID NO: 160136 - DNA, 601 bp, Human
ggaggctgaggcagcagaatggtgtgaacccgggaggtggagtttgcagtgagcggagatctcgccactgcactccagcctgggtgacagagcgagactccgtctcaaaaaaaaaaaaaaaaaaaaaaaaagatacttcatcatagtcaaataatctaactgcacttgtgtgactgaaccgagagatgaattagacactttttttcaatgtcacaccgtaactatggttttgcgggtttgggttctttggcagacattttcttgaaaataaataaagtgaacctgacacttcaaggggaayaactgacactatttactgccaataacaaaattcaagctttcaagcaaaagttagaattccgaatagcttttatctgtcatcttgggcttgatagcttcccaacacttaaaagacttttctgttgaaacccacggtgatactaatgaatgtgatttttgatattgtataacaagatgagttaacactgggaaaatctatacaactcattttccaaatgacagatgcaggatgttaagaaatcatatacaggtaaaagatctatttggaatacaagacagaccaagacatgaaaaattcact

SEQ ID NO: 160137 - DNA, 601 bp, Human
tctttaacattattagtcatcaggaaaatgctaattaaaaaccacaatgagatgccactagaataaaattaaaaagatatctaactccaaatgttgaactctcatacttccttagtgaaagtgttataacacttctctattaatgtccattaatagaagaatgaatagatataccgtggtgtatctgtaaaatgaaataccacttagcaacagaaacaaattactgatgttccaaaacaaggatgaatatccaaaacattttgctgacacagttaagcacatattgcacaattcctttttyatgaagttcaagaacagacaaaattaatctacggtttaagaaatcagaacagtgcttgcatcagagcaggagtgagactgactagaaagagggatgaagatctttacgtgatgatggaaatgtttccttgataggagtatggtttacaaagatgcatgcactatcaaaacacatacagctgtagacttaagtacattccactgaatgcaaccaccacccacacacccacacgtgcacacagtttaaggggagatactgagggcagactagaggagaggcgtcttttaaaagagtggtctg

SEQ ID NO: 160138 - DNA, 601 bp, Human
gcaggagaaccgcttgaacctgggaagcaggctgcagtgagccgcggttgcgccagtgcactgtagcttgggcaacagagcgagactccatttcaaaaaaaataaataaataaaaataaaaaaataaaaaactggaaacaacccaatcatgagttctttaacattattagtcatcaggaaaatgctaattaaaaaccacaatgagatgccactagaataaaattaaaaagatatctaactccaaatgttgaactctcatacttccttagtgaaagtgttataacacttctctattaatgtscattaatagaagaatgaatagatataccgtggtgtatctgtaaaatgaaataccacttagcaacagaaacaaattactgatgttccaaaacaaggatgaatatccaaaacattttgctgacacagttaagcacatattgcacaattccttttttatgaagttcaagaacagacaaaattaatctacggtttaagaaatcagaacagtgcttgcatcagagcaggagtgagactgactagaaagagggatgaagatctttacgtgatgatggaaatgtttccttgataggagtatggttta

SEQ ID NO: 160139 - DNA, 601 bp, Human
taatcccagctactccggaggctgaggcaggagaaccgcttgaacctgggaagcaggctgcagtgagccgcggttgcgccagtgcactgtagcttgggcaacagagcgagactccatttcaaaaaaaataaataaataaaaataaaaaaataaaaaactggaaacaacccaatcatgagttctttaacattattagtcatcaggaaaatgctaattaaaaaccacaatgagatgccactagaataaaattaaaaagatatctaactccaaatgttgaactctcatacttccttagtgaaartgttataacacttctctattaatgtccattaatagaagaatgaatagatataccgtggtgtatctgtaaaatgaaataccacttagcaacagaaacaaattactgatgttccaaaacaaggatgaatatccaaaacattttgctgacacagttaagcacatattgcacaattccttttttatgaagttcaagaacagacaaaattaatctacggtttaagaaatcagaacagtgcttgcatcagagcaggagtgagactgactagaaagagggatgaagatctttacgtgatgatggaaa

SEQ ID NO: 160140 - DNA, 601 bp, Human
attatgtcatcaggaaaatgcaaattaaaaaccataataagatgccactaaaatagttaaaagtaaaaagatacataactccaaatgttggactctcacacttccttagtgaaagtgtaaaatcatagaacaaactagtctgaaaatttctgttaaagtacaattccacagttacaaaagaaatgaaaacataacaaaacaaaacttgagtatgaatgtcataccagctttatccataagcgtaaaaaaacaggctgggtgtggtgcctcatacctgtaatcccagcactttgggtatccraggccagcgatcacctgagatcaggagttcaagaccagcctggccaacatggtctctattaaaaataaaattagccgggcatggtggtgcacgcctgtaatcccagctactccggaggctgaggcaggagaaccgcttgaacctgggaagcaggctgcagtgagccgcggttgcgccagtgcactgtagcttgggcaacagagcgagactccatttcaaaaaaaataaataaataaaaataaaaaaataaaaaactggaaacaacccaatcatgagttctttaacattattagtcatcag

SEQ ID NO: 160141 - DNA, 601 bp, Human
aattcctagacatgcaaggaagcaagaaaatgtaatcccctcatagaaagaaagaaaacaactgaaaatgaaattagtagaaatggactttagaatagttactgtaaatttattcaaggatttaaacgaaaacatgcatgcaatgaagaaagaaacagaaagcctgaattaagaaatagagactgcaaaaaaacaccaatagaacttatgtaattaagggaaaaaacaatttaaaaaaataaattatataactgaaaaaaaaactgcagtgaaaaactggatcagtcctatatctatcaamtaaatggaattcattactaaaaatcttttcacagagaaagcttcagatccagatggcttcactggtgaatttcaccaagcatttaaggaagaaataatttcaattttacacaaaccaagaactaagaagaggaggtaggaacactttccaactcattttatggccaaaaccaaagacattacaataactctacagtctaatatcttttttaaatatagatgtgaaaatcatcaataaaatgtcagcaaattgaatttaaaaattttaaatgttacatatgaagaccaagtagagtgtatg

SEQ ID NO: 160142 - DNA, 601 bp, Human
atgaaacaaaattcaacactctattaagaaaaataacaaaatccaggtagtcagcaatgtaatacatacaaatgtacagcacacaataaaaaattcctagacatgcaaggaagcaagaaaatgtaatcccctcatagaaagaaagaaaacaactgaaaatgaaattagtagaaatggactttagaatagttactgtaaatttattcaaggatttaaacgaaaacatgcatgcaatgaagaaagaaacagaaagcctgaattaagaaatagagactgcaaaaaaacaccaatagaacttatrtaattaagggaaaaaacaatttaaaaaaataaattatataactgaaaaaaaaactgcagtgaaaaactggatcagtcctatatctatcaaataaatggaattcattactaaaaatcttttcacagagaaagcttcagatccagatggcttcactggtgaatttcaccaagcatttaaggaagaaataatttcaattttacacaaaccaagaactaagaagaggaggtaggaacactttccaactcattttatggccaaaaccaaagacattacaataactctacagtctaatatcttttt

SEQ ID NO: 160143 - DNA, 601 bp, Human
ggagtagagacaatttagctacaaaacacaccctaacaaaatcaagctgattggcatgtaagtcaactgcctaatgaaacaaaattcaacactctattaagaaaaataacaaaatccaggtagtcagcaatgtaatacatacaaatgtacagcacacaataaaaaattcctagacatgcaaggaagcaagaaaatgtaatcccctcatagaaagaaagaaaacaactgaaaatgaaattagtagaaatggactttagaatagttactgtaaatttattcaaggatttaaacgaaaacatgmatgcaatgaagaaagaaacagaaagcctgaattaagaaatagagactgcaaaaaaacaccaatagaacttatgtaattaagggaaaaaacaatttaaaaaaataaattatataactgaaaaaaaaactgcagtgaaaaactggatcagtcctatatctatcaaataaatggaattcattactaaaaatcttttcacagagaaagcttcagatccagatggcttcactggtgaatttcaccaagcatttaaggaagaaataatttcaattttacacaaaccaagaactaagaagaggaggt

SEQ ID NO: 160144 - DNA, 601 bp, Human
gctaaacactctgtgatatttagtagaaaggccacaccttaggagtagagacaatttagctacaaaacacaccctaacaaaatcaagctgattggcatgtaagtcaactgcctaatgaaacaaaattcaacactctattaagaaaaataacaaaatccaggtagtcagcaatgtaatacatacaaatgtacagcacacaataaaaaattcctagacatgcaaggaagcaagaaaatgtaatcccctcatagaaagaaagaaaacaactgaaaatgaaattagtagaaatggactttagaayagttactgtaaatttattcaaggatttaaacgaaaacatgcatgcaatgaagaaagaaacagaaagcctgaattaagaaatagagactgcaaaaaaacaccaatagaacttatgtaattaagggaaaaaacaatttaaaaaaataaattatataactgaaaaaaaaactgcagtgaaaaactggatcagtcctatatctatcaaataaatggaattcattactaaaaatcttttcacagagaaagcttcagatccagatggcttcactggtgaatttcaccaagcatttaaggaagaaat

SEQ ID NO: 160145 - DNA, 601 bp, Human
acaaaatataaaatgaccattttcagataatgaacaaatccaagcatatgactgtgatgcctgagagaagaaaatcaaatgaagtagaccccatgaatgcggagctttctgcctggaggcaatttccagattgtggagcagggagtgggggactcacacaaaaccctgtcttgctgagcttaagagacaaactgtttcattggggctttagttgaaaaaaataaaggcacaaactgaagtttggggttatggcggtggctggaatatctgggtgaggataccactgaaagggagctacacyatggaattcaggacctgcatactgggttcccttgaatctttggctgaccatgaagctgcacatgtgcaggatgagtctttagacttagggaaaaagtaactgctggagagatgatttctgggagaacacctgctgcattagcttcctgtggctgctgtaacaaatttaagctgacaaaattggtggcttagagcaacagaatttatgctcctacagttctgtacaaaatccagatgttagtaggcctgggatccctccagaagcttccacggttacaaggccttctgtgtgtcaaatctt

SEQ ID NO: 160146 - DNA, 601 bp, Human
taattggtatggaactagctttcctgcaccataattatataaaacaggacaaaatataaaatgaccattttcagataatgaacaaatccaagcatatgactgtgatgcctgagagaagaaaatcaaatgaagtagaccccatgaatgcggagctttctgcctggaggcaatttccagattgtggagcagggagtgggggactcacacaaaaccctgtcttgctgagcttaagagacaaactgtttcattggggctttagttgaaaaaaataaaggcacaaactgaagtttggggttatggyggtggctggaatatctgggtgaggataccactgaaagggagctacactatggaattcaggacctgcatactgggttcccttgaatctttggctgaccatgaagctgcacatgtgcaggatgagtctttagacttagggaaaaagtaactgctggagagatgatttctgggagaacacctgctgcattagcttcctgtggctgctgtaacaaatttaagctgacaaaattggtggcttagagcaacagaatttatgctcctacagttctgtacaaaatccagatgttagtaggcctgggat

SEQ ID NO: 160147 - DNA, 601 bp, Human
aatggatgaaaataaagcaggttattccatccctagctgtaggggagtaattggtatggaactagctttcctgcaccataattatataaaacaggacaaaatataaaatgaccattttcagataatgaacaaatccaagcatatgactgtgatgcctgagagaagaaaatcaaatgaagtagaccccatgaatgcggagctttctgcctggaggcaatttccagattgtggagcagggagtgggggactcacacaaaaccctgtcttgctgagcttaagagacaaactgtttcattggggmtttagttgaaaaaaataaaggcacaaactgaagtttggggttatggcggtggctggaatatctgggtgaggataccactgaaagggagctacactatggaattcaggacctgcatactgggttcccttgaatctttggctgaccatgaagctgcacatgtgcaggatgagtctttagacttagggaaaaagtaactgctggagagatgatttctgggagaacacctgctgcattagcttcctgtggctgctgtaacaaatttaagctgacaaaattggtggcttagagcaacagaattta

SEQ ID NO: 160148 - DNA, 601 bp, Human
tgtgaaacactcacctccaaaaaaaaagaaaaaaaaggagcctctgctctcctggaggttacagtctatagaaagaggggccaaataatgaatgaaacatgaaacatttatatcacacaatggatgaaaataaagcaggttattccatccctagctgtaggggagtaattggtatggaactagctttcctgcaccataattatataaaacaggacaaaatataaaatgaccattttcagataatgaacaaatccaagcatatgactgtgatgcctgagagaagaaaatcaaatgaagtagrccccatgaatgcggagctttctgcctggaggcaatttccagattgtggagcagggagtgggggactcacacaaaaccctgtcttgctgagcttaagagacaaactgtttcattggggctttagttgaaaaaaataaaggcacaaactgaagtttggggttatggcggtggctggaatatctgggtgaggataccactgaaagggagctacactatggaattcaggacctgcatactgggttcccttgaatctttggctgaccatgaagctgcacatgtgcaggatgagtctttagactta

SEQ ID NO: 160149 - DNA, 601 bp, Human
agtgtgaaacactcacctccaaaaaaaaagaaaaaaaaggagcctctgctctcctggaggttacagtctatagaaagaggggccaaataatgaatgaaacatgaaacatttatatcacacaatggatgaaaataaagcaggttattccatccctagctgtaggggagtaattggtatggaactagctttcctgcaccataattatataaaacaggacaaaatataaaatgaccattttcagataatgaacaaatccaagcatatgactgtgatgcctgagagaagaaaatcaaatgaagtrgaccccatgaatgcggagctttctgcctggaggcaatttccagattgtggagcagggagtgggggactcacacaaaaccctgtcttgctgagcttaagagacaaactgtttcattggggctttagttgaaaaaaataaaggcacaaactgaagtttggggttatggcggtggctggaatatctgggtgaggataccactgaaagggagctacactatggaattcaggacctgcatactgggttcccttgaatctttggctgaccatgaagctgcacatgtgcaggatgagtctttagact

SEQ ID NO: 160150 - DNA, 601 bp, Human
ccagttactcaggtggctgaggcaggagaactgctcgcatcccagaagtggaagttgcaatgagtcaagattgtgccactgcactccagcctgggtgacagtgtgaaacactcacctccaaaaaaaaagaaaaaaaaggagcctctgctctcctggaggttacagtctatagaaagaggggccaaataatgaatgaaacatgaaacatttatatcacacaatggatgaaaataaagcaggttattccatccctagctgtaggggagtaattggtatggaactagctttcctgcaccataaytatataaaacaggacaaaatataaaatgaccattttcagataatgaacaaatccaagcatatgactgtgatgcctgagagaagaaaatcaaatgaagtagaccccatgaatgcggagctttctgcctggaggcaatttccagattgtggagcagggagtgggggactcacacaaaaccctgtcttgctgagcttaagagacaaactgtttcattggggctttagttgaaaaaaataaaggcacaaactgaagtttggggttatggcggtggctggaatatctgggtgaggataccactga

SEQ ID NO: 160151 - DNA, 601 bp, Human
cataaaccctaaagcatggcaggaaagcaaacatgtggcttttaaggcttgtttgccggagtaggctctgattctcataaagattcccttatgcaacaaacacttattaaaccaaactgtgtgtattaaatcaaactgcggaaacagccaccagtaaaagagcctcagctgggcacagtggcggatgcctgtagtcccagttactcaggtggctgaggcaggagaactgctcgcatcccagaagtggaagttgcaatgagtcaagattgtgccactgcactccagcctgggtgacagtgtsaaacactcacctccaaaaaaaaagaaaaaaaaggagcctctgctctcctggaggttacagtctatagaaagaggggccaaataatgaatgaaacatgaaacatttatatcacacaatggatgaaaataaagcaggttattccatccctagctgtaggggagtaattggtatggaactagctttcctgcaccataattatataaaacaggacaaaatataaaatgaccattttcagataatgaacaaatccaagcatatgactgtgatgcctgagagaagaaaatcaaatgaagtagaccc

SEQ ID NO: 160152 - DNA, 601 bp, Human
tgtctgcagcagaatttctctgctgagtcaccaccacatgaccgtaaatccaaggtgacatatctatctccagcctggccataaaccctaaagcatggcaggaaagcaaacatgtggcttttaaggcttgtttgccggagtaggctctgattctcataaagattcccttatgcaacaaacacttattaaaccaaactgtgtgtattaaatcaaactgcggaaacagccaccagtaaaagagcctcagctgggcacagtggcggatgcctgtagtcccagttactcaggtggctgaggcagragaactgctcgcatcccagaagtggaagttgcaatgagtcaagattgtgccactgcactccagcctgggtgacagtgtgaaacactcacctccaaaaaaaaagaaaaaaaaggagcctctgctctcctggaggttacagtctatagaaagaggggccaaataatgaatgaaacatgaaacatttatatcacacaatggatgaaaataaagcaggttattccatccctagctgtaggggagtaattggtatggaactagctttcctgcaccataattatataaaacaggacaaaatataaa

SEQ ID NO: 160153 - DNA, 601 bp, Human
actgatggcattggggcaggttgcgttccctggaccaggatgtttctgtctgcagcagaatttctctgctgagtcaccaccacatgaccgtaaatccaaggtgacatatctatctccagcctggccataaaccctaaagcatggcaggaaagcaaacatgtggcttttaaggcttgtttgccggagtaggctctgattctcataaagattcccttatgcaacaaacacttattaaaccaaactgtgtgtattaaatcaaactgcggaaacagccaccagtaaaagagcctcagctgggcayagtggcggatgcctgtagtcccagttactcaggtggctgaggcaggagaactgctcgcatcccagaagtggaagttgcaatgagtcaagattgtgccactgcactccagcctgggtgacagtgtgaaacactcacctccaaaaaaaaagaaaaaaaaggagcctctgctctcctggaggttacagtctatagaaagaggggccaaataatgaatgaaacatgaaacatttatatcacacaatggatgaaaataaagcaggttattccatccctagctgtaggggagtaattggtatggaa

SEQ ID NO: 160154 - DNA, 601 bp, Human
tgacggggctgagcacgacaccactgatggcattggggcaggttgcgttccctggaccaggatgtttctgtctgcagcagaatttctctgctgagtcaccaccacatgaccgtaaatccaaggtgacatatctatctccagcctggccataaaccctaaagcatggcaggaaagcaaacatgtggcttttaaggcttgtttgccggagtaggctctgattctcataaagattcccttatgcaacaaacacttattaaaccaaactgtgtgtattaaatcaaactgcggaaacagccaccartaaaagagcctcagctgggcacagtggcggatgcctgtagtcccagttactcaggtggctgaggcaggagaactgctcgcatcccagaagtggaagttgcaatgagtcaagattgtgccactgcactccagcctgggtgacagtgtgaaacactcacctccaaaaaaaaagaaaaaaaaggagcctctgctctcctggaggttacagtctatagaaagaggggccaaataatgaatgaaacatgaaacatttatatcacacaatggatgaaaataaagcaggttattccatccctagctg

SEQ ID NO: 160155 - DNA, 601 bp, Human
ttttccaattctttttcagaaaggaaataatatgtatgtaaaaatacacatacagtatacagtgacacactactccaaatcattttaataaagtttctggcatattttgtctttcgttctcagggatttcaaaaattccattctctaattatcaaagcagcacattttaaggaacgtaatttggaaagcagaataaagtatgagtttataaactgcctgtaagctccttaccaagaggataaaaaggactgttagtatatttgaatatttccttccagtcttttttgtacttgcatttacrttgattcttgaacacaggtctgagctgtgtggtgcacttatacacagatttttttcaaaaaatttcaatagtttttggggaacaggtggttttttggttacatggataagttctttagtggtgacttctgagattttggcccccaccaaattcttattacaaatccaggagaagtagtgggaaatcagaggcttgagcagctttaacagtgttatcagtcagagctcttagctataaacaccaaaggctgaccctggatgacttcagcagagaaggaatttactgtaagaacactgtagg

SEQ ID NO: 160156 - DNA, 601 bp, Human
atttaatacctcaacctcaggattaaatcctctgaatgacattcttccatagagaagatcttcacatagtaagaaactctgctcttctattatgaaactcctaaatgggaaaataaaaatagcatttctccatatataaagcacagcaaacaaaagccaacactttgaataaaaaaaataatcaacctatggttctcagtagaatgaagtaaaaatacagtaagatttctaacttagggttaaaaataaaatctgattaatttggtcagcaaaggcattaggagacaagagcagcaagctrgaggcacagcctctcttaaacaccacatttaatttgcataaatatctacataatataaagatctaaagtattgacaataaacttgaatttgccaaagttgaagcaaagtttcttttgtgtttacatcccctcaccatatttttttccaattctttttcagaaaggaaataatatgtatgtaaaaatacacatacagtatacagtgacacactactccaaatcattttaataaagtttctggcatattttgtctttcgttctcagggatttcaaaaattccattctctaattatcaaagca

SEQ ID NO: 160157 - DNA, 601 bp, Human
ataccacatcttcataatccctgcctttttcttccctcttcaccccactgcccagcccctctccttctcaatctgaagcttaattaaagaaagtcaaagcgagaccagcatatattaaaaacaaacacttctaacataacaccttaattatcacacatgcctcctcccactccgccaaaaaagaaaaggaaaactaacctagaatctttcaataaactctggcaattggcttagttaactgtggctcctagagaagtggttcttaactggggatgattttccccaccagggaacctgtgamaatgtctggaaacatttttggttgtcacagctgggtaggagggtggggtgtgtgtgtgctactgatatttagttggtagagaacagaggacagggatgtggttcgtcattctcttaggaaagccaccaccacaaagaattatctggccccaaatgttaacactgccaagggcaagaaacactggcttcaagtaatatttaccaaactaaagatttatatctcatgtgtccatttggttcatcaagtacttgataggatggcttttaacatatgagccagagttctaatgaatatttgtta

SEQ ID NO: 160158 - DNA, 601 bp, Human
aataccacatcttcataatccctgcctttttcttccctcttcaccccactgcccagcccctctccttctcaatctgaagcttaattaaagaaagtcaaagcgagaccagcatatattaaaaacaaacacttctaacataacaccttaattatcacacatgcctcctcccactccgccaaaaaagaaaaggaaaactaacctagaatctttcaataaactctggcaattggcttagttaactgtggctcctagagaagtggttcttaactggggatgattttccccaccagggaacctgtgraaatgtctggaaacatttttggttgtcacagctgggtaggagggtggggtgtgtgtgtgctactgatatttagttggtagagaacagaggacagggatgtggttcgtcattctcttaggaaagccaccaccacaaagaattatctggccccaaatgttaacactgccaagggcaagaaacactggcttcaagtaatatttaccaaactaaagatttatatctcatgtgtccatttggttcatcaagtacttgataggatggcttttaacatatgagccagagttctaatgaatatttgtt

SEQ ID NO: 160159 - DNA, 601 bp, Human
attatacttagggtgaatttaaagtgtatttaagatcataaatcttagtattagttactcatatttaaagcaggcatactgctgacacattccggtgagtgggggaagaaataataaactttcagattttccctgaacttcccccacccatctttaagccatatggaagaaacactagtcgtcagtaataattttaaatgcatctcttggtggtggtggtggtgagtggaggaggtgggagaagtggaaggctggccctgtttaatggagggaatctgcacctcagccttaccctcctaaactttagagtggataatgcatcccatgtaacatccatgcaccacagggtctctcctccaactctttcacataaacctttttgtgataattatcctctgacctttttttttttaaatgtgtaatctcttctttttagcaagaggagaaggaataaaagatgagaaatcagtcttaactagtttttctaaggcttaaaagagtgataatagtttaaaaccttttcctagggggagtgtattcagtgtttcagaatccagtaattagggccattttctaacacccgtccctgccccccatcaat

SEQ ID NO: 160160 - DNA, 601 bp, Human
ataatctagagaactagtcaaaattgataagggactctctgtaatacttgataccacaatggtgtaagagaagtaagctctgagtcaaaaaaatagtaaggcaaagccccactgaattatacttagggtgaatttaaagtgtatttaagatcataaatcttagtattagttactcatatttaaagcaggcatactgctgacacattccggtgagtgggggaagaaataataaactttcagattttccctgaacttcccccacccatctttaagccatatggaagaaacactagtcgtcagyaataattttaaatgcatctcttggtggtggtggtggtgagtggaggaggtgggagaagtggaaggctggccctgtttaatggagggaatctgcacctcagccttaccctcctaaactttagagtggataatgcatcccatgtaacatccatgcaccacagggtctctcctccaactctttcacataaacctttttgtgataattatcctctgacctttttttttttaaatgtgtaatctcttctttttagcaagaggagaaggaataaaagatgagaaatcagtcttaactagtttttct

SEQ ID NO: 160161 - DNA, 601 bp, Human
aagaatatcagaccaaatatgcaataaaaaagattacgaaaaagaaaactatcattaaaagaaaccatctgatttaacaatttatgaacttctctaagagtgattaaattccttgccattttggtgtttgcattaccctaaataaatagagatgtacattttaaaatacacatttccagcagctctggaaatgggccctcaactggcagcctgagacaggtctgtggcccccgtaggccattaagagaaggccgatcacagtcatcgtcctactgggggactcccttgaaagctgccgtgsactgtggggtaagaggagcattcctgggagagccaatgaatgctaggtccagattagaaggctgctgcgcagcacggttaccttctagccatctcttcatctgacacatcaagctctactgtttcatcttcaacttcttctgctttgtgcttagcattcatctgaagcatcaatttctgaaaaatacaccagtgctgaccttcaggctagaaaacgcttgtgaaaggaactgatgtcaaacttacctgaaggcagagaaactgaagtcaaataatctagagaactagtcaaaattgataa

SEQ ID NO: 160162 - DNA, 402 bp, Human
aataaagtacgctgacacacagatattctgagggtcccaggtgcttacaggctccctgccgaatcgcaactgtttacagggctcagcagggagcctgtaagkggcttggaccctcagctggactggcagagcagaatatctgtgtgtcagtgtactttattcattcatcgcgtggtcaggggtctgcaaggaacagacttcccgcagctggtgccccctcgaggagcgctgccgcatatgcacataaggagcaataacatttttaatgtttttgcatttgcacgtgaaatcgcactccaataaacagcggtggcatgtcagtgtgcttttcaccccaacaaaatcccctataaattgttatcaatcactctgtctaaatgcaaagcagtcactaacaagaaa

SEQ ID NO: 160163 - DNA, 601 bp, Human
agttcaatctgtaactctgtaactgtaaacaatcaatcgagttagcgtactacctttggactagccaataaaaggtaattttgaggaaggaatctttgacctaggatattagcttacagcaaatttttactgagttaactttttttttttaaaatggagtcttgctctgtcacccaggctggagtgcagtggcacgatcttggctcactgcaacctccacttcccaggttcaagcaattcccctgcctcagcctcccaagtagctgggattacaggtgcacaccaccatgcccagctaacktttttgtatttttggtagagacagggtttcaccatgttggccagctggtttcgaacttctgaccttaagtgatctgcccatctcgtcctcccaaagtgctaggattataggcatgaaccaccaccccggcccgagttaatttttaaattgaaatggatatagatgataaatgaattcattttacccatcacaaaatcaacccattgccaaatagttacacaacagctattatagaccaagtgtgttgttaggagctacaagaaaataagagatgagccaaagaaaatgcctactttgggg

SEQ ID NO: 160164 - DNA, 601 bp, Human
aaaagaacagaggctcattgatgtgaaaggcagataccaattcttggaaatgcttttaaagtttcaataacttacagctactgagcacttactatgtgccaggagctattctgagacgccttacattattaactcacttgattctcacagaacacttcaaggaagctactattgttttctttatatttgtgatgcacagaagggttaatctgtccaagattacactgtcgtaactgatagagccgcgctttatctcaggcagcctggatccagagcctggttgcttaatcaatgcactctrttgcctctcggtgttcttacacatgtgtgttattaacacatggcctggtgccagaagattctctggcccatcccagtggtgactgtgccatgtgccctggaggtgaatcagtatccaattgagaagggagggatggctttgcatgcctacctttctaccacaaaccctccctggcagccaccctctctctctcccactggtgaccatcactggtgacctgtgaaagggacacaccaacagcacagctggggccctggcattgtgccaggggcaggatcacacagggcagtgccgcggtag

SEQ ID NO: 160165 - DNA, 601 bp, Human
ctctgttgcctctcggtgttcttacacatgtgtgttattaacacatggcctggtgccagaagattctctggcccatcccagtggtgactgtgccatgtgccctggaggtgaatcagtatccaattgagaagggagggatggctttgcatgcctacctttctaccacaaaccctccctggcagccaccctctctctctcccactggtgaccatcactggtgacctgtgaaagggacacaccaacagcacagctggggccctggcattgtgccaggggcaggatcacacagggcagtgccgcrgtagcacccgtggtgccacaggtgtggtggctcctggtcccaactccaccccaccagctgctgtgtggtgttgtgtcaggtcaccacaccaatcggagcttcagttttgtatgtgataaagagattgtgtctgacaaggtgaccttttcctagtctgctgatctatgcagttctagggccacagaatggagactagaggcagcagctcagtctgaagtgcaagactttatccagtaaaaggtccaattccagcagctctgccagaagctacagccttgacaactgtacgaacatttggca

SEQ ID NO: 160166 - DNA, 601 bp, Human
ctctcggtgttcttacacatgtgtgttattaacacatggcctggtgccagaagattctctggcccatcccagtggtgactgtgccatgtgccctggaggtgaatcagtatccaattgagaagggagggatggctttgcatgcctacctttctaccacaaaccctccctggcagccaccctctctctctcccactggtgaccatcactggtgacctgtgaaagggacacaccaacagcacagctggggccctggcattgtgccaggggcaggatcacacagggcagtgccgcggtagcaccygtggtgccacaggtgtggtggctcctggtcccaactccaccccaccagctgctgtgtggtgttgtgtcaggtcaccacaccaatcggagcttcagttttgtatgtgataaagagattgtgtctgacaaggtgaccttttcctagtctgctgatctatgcagttctagggccacagaatggagactagaggcagcagctcagtctgaagtgcaagactttatccagtaaaaggtccaattccagcagctctgccagaagctacagccttgacaactgtacgaacatttggcactggtgctg

SEQ ID NO: 160167 - DNA, 601 bp, Human
tctgaagtgcaagactttatccagtaaaaggtccaattccagcagctctgccagaagctacagccttgacaactgtacgaacatttggcactggtgctgcatgaggggcgggaacataccaagcacagggttaaccagtgacctgaacattttccttctcacattcacacaccagagacccgctacagaagattcaaactgagcaaatcgcctaatcttccaaattctttttcctggcttgttagagcagccaagggtggggtggagcttgtgaataaaaagcctgcttcatcttcctcaygcaggagaacatggccaagcgagttgccattgtgggagctggggtcagcggcctggcctccatcaagtgctgtctggaagaaggactggagcccacctgctttgagaggagcgatgaccttggggggctgtggagattcaccgtaagtggggtttcaacaactttatctgtctattggagaatggcttggcagctgggaaattatatctgtgcttctttcacaagggttggtggccttgaggaaggttagaaatgtctgctgaacaggggaccatgaggagccactgaaattgtaaaaga

SEQ ID NO: 160168 - DNA, 601 bp, Human
tgaataaaaagcctgcttcatcttcctcatgcaggagaacatggccaagcgagttgccattgtgggagctggggtcagcggcctggcctccatcaagtgctgtctggaagaaggactggagcccacctgctttgagaggagcgatgaccttggggggctgtggagattcaccgtaagtggggtttcaacaactttatctgtctattggagaatggcttggcagctgggaaattatatctgtgcttctttcacaagggttggtggccttgaggaaggttagaaatgtctgctgaacaggggrccatgaggagccactgaaattgtaaaagaaacaggacatgggtgagctagggtggaagtcagaacagacttgtacactttatctagagccaaggggaagaagtgtttccaaagatgcccaagaagtatggaagagaatggagtaactgggccaggccaggaaagcctaggagcaaaggagcaggaccagggcgtctgaagcagggccagagacggcagtgttaggagcaagagcaagaatttcagcctctgcctgcaagactgagctgcttttacctgcttcttttcccagcctggctcc

SEQ ID NO: 160169 - DNA, 601 bp, Human
ggctgagagaaagacacagcatttctctgttacagaagggtagaatttggaactgaagtaaagtaattattttctagctcagtgagtaaaactccagagaggccaaggttactagtttagtcacagtcctccagcataggcggcttggctcacataaagaactgcatatcttaaagtgtacccaccaaatgtgatcatcaatgcatggagactgccaaagaggacaaggtaaaagagcatgcctcttctcaggaatcaaaccacatatgttccaacaggatggcagaaacctgacacctargccaaaaatctccccactcccatgtccatcgaagacattattatcaaacatgatgcctttcccctagggagcctcagaatccttcttaacattattccaaacaagcatacctaatcagtcagggtcaggagttggcttgaaagatgaaactgcctaactaaattagccgagttatttgactaaagtaatctcagtcaaaacaaaaactaaacctaaagatcaaaagcagtacttagcctcttgcagcaccagacataaatgctccttgtataggtcacaggcacctaatcatcaacacta

SEQ ID NO: 160170 - DNA, 601 bp, Human
atctccccactcccatgtccatcgaagacattattatcaaacatgatgcctttcccctagggagcctcagaatccttcttaacattattccaaacaagcatacctaatcagtcagggtcaggagttggcttgaaagatgaaactgcctaactaaattagccgagttatttgactaaagtaatctcagtcaaaacaaaaactaaacctaaagatcaaaagcagtacttagcctcttgcagcaccagacataaatgctccttgtataggtcacaggcacctaatcatcaacactaaaaatcaytgatctaagaatcaagagaaatgagtctggatccagctgggcccatttccagctgtgtgatgcaggtaggtcaaacaccagtgcacaaagcacaaaaccctgtgggggacacaaaaatgaggattcaccctgccctcaggagctgtcaggtagatggaagaaggctaggattctgcaagtcagaaacagtgctgtgagcatttcattgagagcaggatgacagccacatttaggaagccagaaaaggcttcactgaagaggtagtgtgtgatggactttgaaaaatttcaacaggtagac

SEQ ID NO: 160171 - DNA, 601 bp, Human
aagacaccagggagggtagggacagtaaagaaaaagtactgggcatattcagaaagtaaaaatagctttttggtgcataaggtacacgtaagaggaagaatgggagggaaaagggtggctgcatgtttgggcaaggggtttatactcagttttaaaagcaataggtaatgaggaacaaaattaaggagatttcctggttgtcgcgtttgttttgtttgcatgataggaagacccaaagatttttgtaggcaaatagaaactatctggatgaccagaaataactgagcacataaatccaaaytgagacacaatcctggcaggaaaagggaggagtggaattgtaggtaccagtggaagggttagccctggcaaggtggggagacaagagatacaccctccccagagattggaggggaagggaaggtgaacatggaagagaaattttgaggtagaggaagaagatataagagcactcacaccagaggccctcaattctatcgagaaaatatggcacctgcaagggtaaagagggtgtgggggtggcaaatggggttggagaattagaaaaatagagaaggtcagccaggcacggtggctcacg

SEQ ID NO: 160172 - DNA, 601 bp, Human
cctcatttataaaatgaaaacatgggaccagtatgaaacacatacaaaagctgaattagtaacgggcttaggaaaatccaccctcaccttcatgcagcagccttctcttgacactgcagcctttttaggcacctctgtaataccttgagatttctctaaagcttgactggacattcctaaactaggcaatcttgaaggtgccttcagctctaatatgcgatgagtctcctgagtctttctagagacattcctttccctccttccccaacacacacaggacacacacacacacacacacacccacacacaaaaggttagagatgtctttgcactcaaggtaggtggcccatttaaaacctgtaaaatcaaaaaccctgccctggcaatggctgtgcttgctagaaagtgttcagaagggaattcttactgccttagggtggaagggaccataatgcaaaagtagaaaggcaaattgcagagatccaataaaacacatgtggtgacagtttccatttccagatggggagaggccccagagaatatagacatcataaattactgcattttggccaggcgcggtggctcatgcctgtaatcccag

SEQ ID NO: 160173 - DNA, 601 bp, Human
agaaggtctctatttaggggtgaattttattatcactttatatccgtttttaaaatgagaaagaaaagaactgacctgacaaaattttcttcccattgcctacactcctgcctgaaggatacaagcttaagaaagtaaatttccatggtagctgtgaaagaataatacaaataatgattaatattattgacagcctagaggcattgttccattagtaccattagcatgatacgattgcttcattgttccattagcatgatagctatcactccaatttctcctaggggctatgtaatattgyggttccagcatatagatatggaaactgagagaagttaagaaaattcccagatcagccagctaaaaatgtagagcttgagtatgaacctaggcagtctgacattgaggcctattctgttaagaactacattgcatgcatttctggagtctgtttcacagctcaagaatcaggcaaatcctgggctgcgtctcaaagagtcccagcaagtgtcccagtggtgatggtgacctcccaactgtgctgcaggaccaaagtggaccagaaggacagaaacacctctgctcatgctcttagtctctt

SEQ ID NO: 160174 - DNA, 601 bp, Human; identical to SEQ ID NO: 103890

SEQ ID NO: 160175 - DNA, 601 bp, Human; identical to SEQ ID NO: 103889

SEQ ID NO: 160176 - DNA, 601 bp, Human
agagaattatacacagaaaacaacacaaatggagacattgaccaaaacaagtggaaaataaaatttgcattcacattcacgaccttaaaagtcctctgatatggtttggctgtgtcgccatccaaatctcatcttgaatttccacatgttgtgggagggactcagtgggaggtaattgaaccatgggggcaggtctttcccatgctgttctcctgatagtgaataagtctcatgagatctgatggttttataaggcggagcttccctgcacaagctctctctctgcttgctgccatgcacrtaagatgtgatttgctcttctttatcttccaccatgattgtgaggcttccccagccacaaggaactgtgagttctccattaaacctctttcctttgtaaattgccaggtctctggtatgtctttatcagcagcatgaaaatcaatacagtaaattggtaccagtagagtggggagctggtgaaaagatatcaaaaaatgtagaagtgactttggaactgtggaaacgtcagaggttagaacagtttggagggctcagaagaagaaaggaaaatgtaggaaactttggaacttcctagaga

SEQ ID NO: 160177 - DNA, 601 bp, Human
aagaggtgacttgggtgctgttaaaggcattcagttttaaaagggaatcagcataaaagttcagaaaatctgcagcctgacaatgcaatagaaaagaaaatcttattttctggagaagaaatccaagccaactgcagaaatttgcataaataacaaggagccaaatgttaattcccaaaacaatggggaaaatgtctccagggcatgtcagaggtgttcaccacagcccttcccatcacaggcctggaggcctaggaagaaaaagtggtttcatgggccaggcccagagcccccatgctgygtgcagccaagggacttggtgccctgcatcccagctgctccagctgtggctaaaaggggccaacatagagctcaggcagtggctttagagggtgcaaaccccaagacctggcagcctccacattgtattgagcctgcaatacacagaagtcaagaattgaggtttgggaaccttcacctagatttcacaggatgtatggaaatgcctggatgtgcaggcagaagtttgctgcaggggcagggatctcatggaaaacctctgctagggcagtgcagaagggaaatgtggggtcagagtccc

SEQ ID NO: 160178 - DNA, 601 bp, Human
atgacactatcatggctcactgaagccttgacttcccaagcacaggtgattctcccaaatcagcctcctgagtagctgggactacaggcatgggccaccacacctgggtaattttttgtattttttttgtaaagatgggattttgccatgttgcccaggctacatatttattatttttatgattaaaaataaatctattttgaaagattttaaactaactgaaaatttacttttagaaaagacagttgcactacaaatgtagaaacacaataagcacttcaaatagtataaatcaaatagygaacccattaagagggacttaagaagcctatattctttaaaaactttaaaaaagaaagaaagatagcaagccacttggtgagtgaataatttatccttttaaatttcacttgtctgagatttattgtacatatatttcctgaaccaaagcctggtaatcatggacatgtatgtactcactaagagcaaaaaatagattctttgaaatgtggactactctcaaaaaaattcaggccataatgttagcacttttcaattgctttctagttctggaaaaacttcagcaacatattctataaaa

SEQ ID NO: 160179 - DNA, 601 bp, Human
gtaattttttgtattttttttgtaaagatgggattttgccatgttgcccaggctacatatttattatttttatgattaaaaataaatctattttgaaagattttaaactaactgaaaatttacttttagaaaagacagttgcactacaaatgtagaaacacaataagcacttcaaatagtataaatcaaatagtgaacccattaagagggacttaagaagcctatattctttaaaaactttaaaaaagaaagaaagatagcaagccacttggtgagtgaataatttatccttttaaatttsacttgtctgagatttattgtacatatatttcctgaaccaaagcctggtaatcatggacatgtatgtactcactaagagcaaaaaatagattctttgaaatgtggactactctcaaaaaaattcaggccataatgttagcacttttcaattgctttctagttctggaaaaacttcagcaacatattctataaaacctcataagctaatatacacaggaccaaattcaggttttcaattatatcttacccatgtatctgtcaaagaaatttttgttaaagagacagccctgtgagaaatgag

SEQ ID NO: 160180 - DNA, 601 bp, Human
aatcatatctgtgattcttttttcagaccaaagtctgcagtgtaacaaaatgctcagattctgctgtctctggccaatgggaggtggtcactatgcatgaagagaagcaagagtcagccatctttgatgctgtcatggtctgcactggctttcttactaatccttatttgccactggattcctttccaggtacagcattttctgtaactaactttaagttttctcgtgggagccattctgatgcttgattggtctgggaatgaattcctatggctgttccattaaatagttaaagttgggmggtaggaggaggctttttttgttttgttttgtttttttctagccagcattttctggccagtttttggctttcatttgttccaaacaatctgtgaatacataagagcaaaatggataactttataagtatttttatgctttaccaagattcaatgtccctcaagtgactggtagcactcagaaagtcttctgagacatgggatgcttacacaagtcattaacttcagcagcaggtacacattgccaaagttgagtttagaggccacaaaagtcaatctgtgaaaaaagaaaaaagtaattt

SEQ ID NO: 160181 - DNA, 601 bp, Human
aaatgctcagattctgctgtctctggccaatgggaggtggtcactatgcatgaagagaagcaagagtcagccatctttgatgctgtcatggtctgcactggctttcttactaatccttatttgccactggattcctttccaggtacagcattttctgtaactaactttaagttttctcgtgggagccattctgatgcttgattggtctgggaatgaattcctatggctgttccattaaatagttaaagttgggaggtaggaggaggctttttttgttttgttttgtttttttctagccagmattttctggccagtttttggctttcatttgttccaaacaatctgtgaatacataagagcaaaatggataactttataagtatttttatgctttaccaagattcaatgtccctcaagtgactggtagcactcagaaagtcttctgagacatgggatgcttacacaagtcattaacttcagcagcaggtacacattgccaaagttgagtttagaggccacaaaagtcaatctgtgaaaaaagaaaaaagtaattttttctatttgttcctcttatgtgagtgatagcaattagattagaggt

SEQ ID NO: 160182 - DNA, 601 bp, Human
cttactaatccttatttgccactggattcctttccaggtacagcattttctgtaactaactttaagttttctcgtgggagccattctgatgcttgattggtctgggaatgaattcctatggctgttccattaaatagttaaagttgggaggtaggaggaggctttttttgttttgttttgtttttttctagccagcattttctggccagtttttggctttcatttgttccaaacaatctgtgaatacataagagcaaaatggataactttataagtatttttatgctttaccaagattcartgtccctcaagtgactggtagcactcagaaagtcttctgagacatgggatgcttacacaagtcattaacttcagcagcaggtacacattgccaaagttgagtttagaggccacaaaagtcaatctgtgaaaaaagaaaaaagtaattttttctatttgttcctcttatgtgagtgatagcaattagattagaggtttacggcactggtcaatagtcaagagggagattagtcttgggagacaacttaagacatctttgggtctcagttttcttatcggccttttgcaaccatagtcatgt

SEQ ID NO: 160183 - DNA, 601 bp, Human
tcatctgtaacaagcattcaaaaagttaaaactttcagaaacttttctccaaatcatctaatgattgcctagaatgatcccaagactcatcttaccacaataaatttaggagcatgctatggttctggatctgcccccagaggtcactcagatcaggttagattaggataaagcatatcctgaaaattgccagagaatagaatcattgaattggaaagaaccaagttcagtcttcttcccaatgcaggaaattatttttcagcaattctgagagaggctccatagcctcttcttgaacccrttcaacaatggaatctcatcatcacagaagacaacccaattttttgtcattcttgcctgcagagcaaggctctgagcagccatccactccaaaattccagaaaggagtacctagtcactgcaagaatccagaaagttccatggcatagggagtaaactacattcattcagcacttacagtatattgcactaggtgctaagaatatagaggtgaataaggcaacatgtaacctgtattggaggaatgaatagagttttatggagtccagtggagaaatcacagtctgcatatgacctgtag

SEQ ID NO: 160184 - DNA, 601 bp, Human
aaattctaccaactttttcctgctactatctcccatttgcccattcctctccttattaattaccaacaccctcatcaggtccatgctacctcacactgaggatattgcattgtcctcctaataatagttgtagaaatagttaatatttattaggattattctgtggccggcactgcactaaatgtgtttttactgcactactttatccagtcatcaaaacaagccactgaagtaggtactgttagtatccttgactgcacatgaggaaaccaaggcttagagaagttaaagaacctgcctraaatcttaccactagcatgtggcagagccagttctcaaacccaagtctctttgactcaaagcctacgttcctaactatcctcttctacctcctaccttcaggcttctcaagggttttgccctgcattttatttttgccttgtaccactacccaaggtcactgccacccacaacaagccatctagaccccaactaccaacaaacaaatcctcagaagagcctgctctcattatagcactctcatgctgaaaaacctctaattattctctttacctgaaaaaaataaattgcagacgtagta

SEQ ID NO: 160185 - DNA, 601 bp, Human
tctagaccccaactaccaacaaacaaatcctcagaagagcctgctctcattatagcactctcatgctgaaaaacctctaattattctctttacctgaaaaaaataaattgcagacgtagtagctctgcatcagagagttttctataatctgaaccaaatctgccattttaattttaacttctgtttcttgcatgataatcaactgtagcattttccagttcctgtctttagttcccctttgctcacgctacccctctctcttcttcagagcccctttctcttctattacaatctacctttwccttcccagatatctcactccaacacgaagtgatctctccctattcagaatgtaagtaatattgtaatttgcacccctcagttttcacttttaaattcttaatattgcaaattacctttcatcatatatagtttcttttcaactatgctgtaaactcattgagggccattcagctaactaatatatactagttgctggctccccagtttggtgggggaagaaacaatctgttaaatcagctgttttgtatcagcaaagcaacagattgcttaactaattattttctttgtaaacaattgt

SEQ ID NO: 160186 - DNA, 601 bp, Human
tctcaaaaggattaactttaaaatagaagttagaagaaccaagactatcttgtcaggggtgtattttgagagtggcagacttttcagtgcctttccattcatgacacttcttgaatctctggcagaaccagccagccgtgttcacagtgtcaaatgaagggatgtctttgattgcttccaggtgttcctcagcaccaccggagggggatgggtgatcagccgaatctttgactcgggctacccatgggacatggtgttcatgacacgctttcagaacatgttgagaaattccctcccaacyccaattgtgacttggttgatggagcgaaagataaacaactggctcaatcatgcaaattacggcttaataccagaagacaggtaaatataatgtgactgccaagggcttttaggaagaaggagcctctgcctgtccagcagcctatacaagccaggcagtaccacagcaacatggctgaatgtgtgggaacacttgatacaaatttgcttgataataacagctaactgttcttaagtactcagaaagtgaaattatgtatttcaccttgtcagcaacactttacgtattattataataatc

SEQ ID NO: 160187 - DNA, 601 bp, Human
tgcacatctgcaaaagccaaccctggccattattggcctcatcaaacccttgggctccatgatacctacaggagaaacacaagctcggtgggctgttcgagtcctgaaaggtaagtataagaaatagcagggcatgtgtttttggtgtgccatgtgattctggatactggaaatgttgagactattattcctcctgcttctatttaaaataacagaatctttaaaagcaggatgcattctattgtttgctgaattatactgtcataatgatttgttccattactgcataaatggtatatcrgggtcaaaaatatatatatttttttgatataccaaaaatataacagttgacataggctgtatctatgtcaactgtgatattttttcttttttatttttaagacacagggtctcactatctcgtccagactagtgtgcagtggctatttataggcatgatcatagattactgcagcctcaaactcctggtctcaagcaatcctcctacctcagtctcctgagtagtggagactacagacatgcacactgcacacagctacctgttattttgactaaaacaaaatgacagttaacatttctg

SEQ ID NO: 160188 - DNA, 601 bp, Human
aaccctggccattattggcctcatcaaacccttgggctccatgatacctacaggagaaacacaagctcggtgggctgttcgagtcctgaaaggtaagtataagaaatagcagggcatgtgtttttggtgtgccatgtgattctggatactggaaatgttgagactattattcctcctgcttctatttaaaataacagaatctttaaaagcaggatgcattctattgtttgctgaattatactgtcataatgatttgttccattactgcataaatggtatatcagggtcaaaaatatatatatttttttgatataccaaaaatataacagttgacataggctgtatctatgtcaactgtgatattttttcttttttatttttaagacacagggtctcactatctcgtccagactagtgtgcagtggctatttataggcatgatcatagattactgcagcctcaaactcctggtctcaagcaatcctcctacctcagtctcctgagtagtggagactacagacatgcacactgcacacagctacctgttattttgactaaaacaaaatgacagttaacatttctgtcagttgactgaatcaac

SEQ ID NO: 160189 - DNA, 601 bp, Human
agaatctttaaaagcaggatgcattctattgtttgctgaattatactgtcataatgatttgttccattactgcataaatggtatatcagggtcaaaaatatatatatttttttgatataccaaaaatataacagttgacataggctgtatctatgtcaactgtgatattttttcttttttatttttaagacacagggtctcactatctcgtccagactagtgtgcagtggctatttataggcatgatcatagattactgcagcctcaaactcctggtctcaagcaatcctcctacctcagyctcctgagtagtggagactacagacatgcacactgcacacagctacctgttattttgactaaaacaaaatgacagttaacatttctgtcagttgactgaatcaactggctcaattaaaatttttaaactcaagcaaatgagtgacaacattcagccaaactagttgtgagattctgctatatcaaataattagtgagatgaccagatgcttatcttttcagctgacggcattattaccaggagcatacaaccagtcagctcaggctgctaacatttttgccagaaggatcaatgagtagc

SEQ ID NO: 160190 - DNA, 601 bp, Human
atatcagggtcaaaaatatatatatttttttgatataccaaaaatataacagttgacataggctgtatctatgtcaactgtgatattttttcttttttatttttaagacacagggtctcactatctcgtccagactagtgtgcagtggctatttataggcatgatcatagattactgcagcctcaaactcctggtctcaagcaatcctcctacctcagtctcctgagtagtggagactacagacatgcacactgcacacagctacctgttattttgactaaaacaaaatgacagttaacakttctgtcagttgactgaatcaactggctcaattaaaatttttaaactcaagcaaatgagtgacaacattcagccaaactagttgtgagattctgctatatcaaataattagtgagatgaccagatgcttatcttttcagctgacggcattattaccaggagcatacaaccagtcagctcaggctgctaacatttttgccagaaggatcaatgagtagctggtactagacgtgaaaggagagccatagtaaagcatctttatccataagtcaacagctagacctaaacttaagttgcattt

SEQ ID NO: 160191 - DNA, 601 bp, Human
gtggctatttataggcatgatcatagattactgcagcctcaaactcctggtctcaagcaatcctcctacctcagtctcctgagtagtggagactacagacatgcacactgcacacagctacctgttattttgactaaaacaaaatgacagttaacatttctgtcagttgactgaatcaactggctcaattaaaatttttaaactcaagcaaatgagtgacaacattcagccaaactagttgtgagattctgctatatcaaataattagtgagatgaccagatgcttatcttttcagctgayggcattattaccaggagcatacaaccagtcagctcaggctgctaacatttttgccagaaggatcaatgagtagctggtactagacgtgaaaggagagccatagtaaagcatctttatccataagtcaacagctagacctaaacttaagttgcatttgaggtttttattttaatcctacaggtgtaaataagttaccaccaccaagtgtcatgatagaggaaattaatgcaaggaaagaaaacaagcccagttggtaagttaactacttaatgcaccctttttaaattataactgaaattg

SEQ ID NO: 160192 - DNA, 601 bp, Human
gacctaaacttaagttgcatttgaggtttttattttaatcctacaggtgtaaataagttaccaccaccaagtgtcatgatagaggaaattaatgcaaggaaagaaaacaagcccagttggtaagttaactacttaatgcaccctttttaaattataactgaaattggtaaaaaaaaaaaaaaaaaaaaaaaaaaaaaaaaggaaatgaaaaagaaaaaaaaacaatagcagagagatgaaagttacattggagaaaaaaagaagcatctgagacttacaagaaaaatactaggagagcctrtttaagaagagagaagggaaaggggaatttagaatttttaatgtccccaaagtcatcacttcagcccatggttttctagtatcacatagagtttggattccaaatcaagtactacataattaaccctaatctaccaggtacattattccatatcttatccataatcaacaggcaagcagttgtacctatttactctgacactagaagtgtctgctcattcattcactgaacaagtctctatcagctctattgtttttattcggagtgtggcttttgctcttcatttataattggctggaa

SEQ ID NO: 160193 - DNA, 601 bp, Human
attataactgaaattggtaaaaaaaaaaaaaaaaaaaaaaaaaaaaaaaaggaaatgaaaaagaaaaaaaaacaatagcagagagatgaaagttacattggagaaaaaaagaagcatctgagacttacaagaaaaatactaggagagcctgtttaagaagagagaagggaaaggggaatttagaatttttaatgtccccaaagtcatcacttcagcccatggttttctagtatcacatagagtttggattccaaatcaagtactacataattaaccctaatctaccaggtacattattccrtatcttatccataatcaacaggcaagcagttgtacctatttactctgacactagaagtgtctgctcattcattcactgaacaagtctctatcagctctattgtttttattcggagtgtggcttttgctcttcatttataattggctggaaaaaaggaagaagaaaaacaaaattttgtagcatgtgaaaaaatcatatgaaatggaaaccatactggccataaataaaattttattagaacacagccatggttattcatttacatattgtcaatggctgtttttgtgttacagtaccaaa

SEQ ID NO: 160194 - DNA, 601 bp, Human
agaatttttaatgtccccaaagtcatcacttcagcccatggttttctagtatcacatagagtttggattccaaatcaagtactacataattaaccctaatctaccaggtacattattccatatcttatccataatcaacaggcaagcagttgtacctatttactctgacactagaagtgtctgctcattcattcactgaacaagtctctatcagctctattgtttttattcggagtgtggcttttgctcttcatttataattggctggaaaaaaggaagaagaaaaacaaaattttgtagyatgtgaaaaaatcatatgaaatggaaaccatactggccataaataaaattttattagaacacagccatggttattcatttacatattgtcaatggctgtttttgtgttacagtaccaaagttgtttagcagttgagatagaaactgtaatgtggctctcaaagcctgaacatttactgtctggcctttttcagaataaagtttattgagcacttctctatgggaaaggttttcacttatgctgtgctctgtggctaccactcaaggctagagacaatggaagactgatggccagcaaagt

SEQ ID NO: 160195 - DNA, 601 bp, Human
caaatcaagtactacataattaaccctaatctaccaggtacattattccatatcttatccataatcaacaggcaagcagttgtacctatttactctgacactagaagtgtctgctcattcattcactgaacaagtctctatcagctctattgtttttattcggagtgtggcttttgctcttcatttataattggctggaaaaaaggaagaagaaaaacaaaattttgtagcatgtgaaaaaatcatatgaaatggaaaccatactggccataaataaaattttattagaacacagccatgkttattcatttacatattgtcaatggctgtttttgtgttacagtaccaaagttgtttagcagttgagatagaaactgtaatgtggctctcaaagcctgaacatttactgtctggcctttttcagaataaagtttattgagcacttctctatgggaaaggttttcacttatgctgtgctctgtggctaccactcaaggctagagacaatggaagactgatggccagcaaagtaaagagtcttggccctcccctctcactctcaatccaaccaaaacatttctgattgttttgtggtttgata

SEQ ID NO: 160196 - DNA, 601 bp, Human
actagaagtgtctgctcattcattcactgaacaagtctctatcagctctattgtttttattcggagtgtggcttttgctcttcatttataattggctggaaaaaaggaagaagaaaaacaaaattttgtagcatgtgaaaaaatcatatgaaatggaaaccatactggccataaataaaattttattagaacacagccatggttattcatttacatattgtcaatggctgtttttgtgttacagtaccaaagttgtttagcagttgagatagaaactgtaatgtggctctcaaagcctgarcatttactgtctggcctttttcagaataaagtttattgagcacttctctatgggaaaggttttcacttatgctgtgctctgtggctaccactcaaggctagagacaatggaagactgatggccagcaaagtaaagagtcttggccctcccctctcactctcaatccaaccaaaacatttctgattgttttgtggtttgataaaaccactttgttttatctgttcatctgtttctgcgtttgatatacattttcacttgaaataaaggttctgtggcaaaaaaaaaaaaaaaaaaacagca

SEQ ID NO: 160197 - DNA, 601 bp, Human
tcaaagcctgaacatttactgtctggcctttttcagaataaagtttattgagcacttctctatgggaaaggttttcacttatgctgtgctctgtggctaccactcaaggctagagacaatggaagactgatggccagcaaagtaaagagtcttggccctcccctctcactctcaatccaaccaaaacatttctgattgttttgtggtttgataaaaccactttgttttatctgttcatctgtttctgcgtttgatatacattttcacttgaaataaaggttctgtggcaaaaaaaaaaaacaaaaaacagcaagttttaaaatcattgcatctaaggaacttattatcactctcttgttcatatatattcccaaacttcaagggttgatctatccttgtcaaggtaccaaattccaaaacaataatagcattttagatgtctcttctttatcctcaacctgggatatgatttgatcttcattatggaactccagtgtaatagataactaattagaactgctataaaatgaaaatcttcttgtcacgcatgtcagcaaacaattttaggggccaggtgcagtggatcatgcctgtaatccca

SEQ ID NO: 160198 - DNA, 601 bp, Human
tttgccagaactatgacgttgaggagggtggggtaaaggggcaggaagcgtttatgttctgccaatccaacagctgtattctaactcaccattccgccctcccttaagatcacggaagtatcacgcttgcctcttacacaactttttttccttagtctgtatactttctgctgtcactagcataacagaaaagacgaatggcttttgttttaaactgagggcacttttacaaaagtcatctttccatttatttttctttcagaaaaaagaatttgggttttgagcttttttaaaaaaaaaagacaaacactttccttgactttgagaaataatttaagtcaaagaatctgctctatgctaaccaaggtaagtgtcctggattttttttttaatggggaaatgatccagaaactgctttcacaaaagatgaatgtttttcttggagtgtgttccttaagaatgaatgtgattatcttcttttggggtctcttgactagggctaaagcaagagaattaaggagagagtcaggaagcaaagggaagttgtaaggaaacaaagttatgttgtggacagaaccatccaaaaggaaagtgtcagtga

SEQ ID NO: 160199 - DNA, 601 bp, Human
aggcatgaccgtgaccagctattctttaggactctaaatgctttgaatcaaaaccaacatttctactgactgaaattcctaggattcagaggcaaagtgatagcaaagagcccctttaatactgacaaattctagcatcccaacggggtcaaggtactgtctacactctctaatagtaataccacagattgagtactccttatccaaaatacttgggaccaggccgggcacggtggcttacgtctgtaatcccagcactttgggaggctgaggccagcagatcacttgaggtcaggagttygagaccagcctggccaacatggtgaaaccccatgtctactaaaaaatacaaaaattagctgggcgtggtgacaggcacctgtaatcccagctacttgggaggctgaggcataagaatcacttgaacctaggaagtggaggttgcagtgagctgagattgtgccactgcactccagcctgggtgacagagcaagactgtctcaaaataataataataataataataataatagttgggatgagaaatgtttcactaggatgaacatggtggctcactcctgtaatactagcactttgggag

SEQ ID NO: 160200 - DNA, 601 bp, Human
cccagacattgttcaggtctttaggaacagaactggcaagagtgaggcatggccccagatcttggaaggccttgtgggagggggagggttccctgtcacattttcagaatacaaagaactcaggcactaaccaatcattctttgaagtggaatatttagcctcggaggctacactcaggtccaggccacctgttaggtgacttgagcatcagacagtggggatggaagtggttaaataccacctgcctctggtcaggattggtgctggttactggaagtagcagggtatccagtagggackgagggatctgccccagtagtgaagtataaggaggtatcagaaggtttatgcctgtaatcccagcactttgggaggctgaggtgggaggatcacttgaggccaggagctcaagaccagcatgggcggcatagtgagaccctatctctacaaaaaataaaatgaaaaacaaacaaaaaaaataagatggaagctaggcaggcccaagtactaaatgctataggggaaaagaagagtggcattcgttcaacaggcgtgagagagaagccttcatagaagacatgttgtttgctattaatagat

SEQ ID NO: 160201 - DNA, 601 bp, Human
tgcagtggctcatgcctgtaatccaggcactttaagaggccaaggcgggtggatcacttgacgccaggagttagacaccagcctggccaacatggtgaaatcccatctctactaaaaataaaaaaattagccaggcatggtggcacacacatgtaatccaaactatttgggaggctgaggcatgagaatcgcttgaacccgggaggcagagtttgcagtgagtcaaaatcgcaccactgcactctagcctgggtgatagagtgagactccatctaaatcaatcaatcaataaaagtaaatraaattacaaatggaacattaattgctataacccgccctcagtgaggctagcatgagccaccatgatctctgttctcttcctcctatctccattatcccaacaagctaactatgccttcaccacaggaatcttccaaagatgggatgaccagggtctataagtcattagtgacaaatgtctgtaaggaaatgtcatgttacagtgacttccctttccacgaagattatcctaatttcatgaaccatgaaaaattttgggactatctccaagaatttgctgagcactttgacctcctgaaat

SEQ ID NO: 160202 - DNA, 601 bp, Human
gagcaagaccctgtctcaaaaaaaaaaaaaaagttctttgagggtgggaactgccttttgtcctcacattccttagaccttagacctagcatagtaccttgggtggtgttgaaagtgttgaaagaacaggctatataagatacgactattagccaactttttcctttagtatccctgcagacttgatctgtggggcttgtccttccgttgcccctggatgaaatctcaggcagttttctgcttattctcagataatgaaatgtcctctgatcattataagtcacccaaaaacaaaaaaaaatctcattttcataactaaaatgtcctgttcaggcaatagtcaaaatgtgcaactgtatgtaatgtaaaagcttctccctccaccgtctggcacctgctatgagctgacagcagtgtcaagaagagacagtgtgcttgacttccttcttcctctgccatcctctccctccgaaccctaaacctaccagctgcagtttctgacctttgcagaattggagttggggaaaggtcaagagggaagagagaagaaaagttctttctgaactggccccaatcctgggctagttttctctgatctcgg

SEQ ID NO: 160203 - DNA, 601 bp, Human
cacatgaaatatagatcttgtattgtcaacagtgggagaaatgctgccagtgcagccaccatccctcgaaggcagtcccagtcacggccttacaagcaccagttgctgtgctctgtagaccccaaacatgaaggtctcgctcagagtggtctccttgaagcccctcacacctggctccatgtcaacatgacagaaaaaaatgccacaattcctgtcaatttccaactcctagccacttcaacctcaaccattttagactgtcaaagtgagtgtgaggctaagtcagaatcacaaaactggyctcacacacacagtttctgcaaattcagcatagttggtttagcacctcacttggactgcgggaactattgtttactgtccagctttgggggcctcagtaggcaaagaatcctgttaaaacattttgttatacaatctacttcttgcccaggatgttcagcgtagtgtataagatgtttcttattatttgtgagtttgatttcctgaagcaactgctttaaaaaagaacactgatatgcactataagatctcttatgtttttaacaaggcaggttgtagctattcaataaatgttaccaag

SEQ ID NO: 160204 - DNA, 601 bp, Human
tcccagtcacggccttacaagcaccagttgctgtgctctgtagaccccaaacatgaaggtctcgctcagagtggtctccttgaagcccctcacacctggctccatgtcaacatgacagaaaaaaatgccacaattcctgtcaatttccaactcctagccacttcaacctcaaccattttagactgtcaaagtgagtgtgaggctaagtcagaatcacaaaactggcctcacacacacagtttctgcaaattcagcatagttggtttagcacctcacttggactgcgggaactattgtttastgtccagctttgggggcctcagtaggcaaagaatcctgttaaaacattttgttatacaatctacttcttgcccaggatgttcagcgtagtgtataagatgtttcttattatttgtgagtttgatttcctgaagcaactgctttaaaaaagaacactgatatgcactataagatctcttatgtttttaacaaggcaggttgtagctattcaataaatgttaccaagtgaatgaatgaatcaatgactgaataggaggaaaataatatattctagaagagaatttaatctttgtatattgac

SEQ ID NO: 160205 - DNA, 601 bp, Human
gtgattctggccatcactggcctcatcacaattgtttcctctgtcacctcccacaatttccattgttgctgctgctgctgtaaacaccctgtttccactattcttaccattcttagtttatgtgaatccatggttcatgtctattctcatgctgctaataaagacacacccaagactgggtaattcataaaggaaagaagtttaattgactcccagttccacatggctcaggaggcctcacaatcttggcagaagcgaaggaagagcaaagtcacgtcttacagggtggcaggcaagagasagagcatgcccaggggaactcccattcctaaaaccatcatatctcgtgagacttattcactatcaggagaacagcatgggaaagacctgcccccatgattcagttacctcccactgggtccctcccatgacacgtgagaattagaggagctacaattcaagatttgggtggggacacagccaaaccacatcagtcttttatgtctgccaaggagataatcaccaaaaatgaatcaaaagaagaaatatttgtagtcttccttacatatgtaaatatcattatagctgtgcttctatggac

SEQ ID NO: 160206 - DNA, 601 bp, Human
agcataagcaaaggactgccatagttgtgggacttccctttttccacagaccctatccctgcgtagtgagaaattataactttagacatttcagactttctgatccttcactcctctcaggaattcataagtttaaaggtcagatcctgcatagtcaagagtacaagatcccagaaggctttcagggcaaacgcgtcttggtgattggtcttgggaacactggaggagacattgctgtggaactcagtcgaacggcagctcaggtacatcatctctgaattaatgcccctaatcccatcaycagttatgatggctggaaagagatattcaaaactatgaagtacattggccaattgctaaattatgcagacacacagtaagtgggaaaaaaaaaaaacattgaaaatctttaaagccactcacggttctttctgaactatttaaaaagccatgctttacagaactgaactatctccaagaagggtctaggaaaattgtgtggatgccagacctctaagcatttttcaggagtgcttccttcagaaacaagaccatataggcaaattgcttcacccagttcaattatcttttttttacaccc

SEQ ID NO: 160207 - DNA, 601 bp, Human
tactacaaaatgatgaacatttatttatccttcttgccttactttactttttaggtacttctcagtactagaactggtacctgggttcttgggcgctcttcagattggggctatccttataatatgatggttacaagaagatgctgtagttttattgcacaagttctgccttcacgttttctaaactggattcaagaaaggaagttgaataagagatttaatcatgaggattatggattaagtattaccaaagggtacttacattttttatttagtagaaaaaatattaaatcaatatttmtcattacattttattcagaattcaaaatgttcaataattgtaatattgcctttgtttattctactctaaatccatttccctaaaacactgttcatcaggtaccacagcagtttttaaaatatatgtattctctttctggtggcaaaagtagtgattcatgaggctggaagaaaataaaagatgaaaacttccatttcctgctgttacaaatatcacatatttttgttgttgttgttgttgttgttggggtttttttgtgttgttgatgttgtttttgttcttgttgagacagggttttac

SEQ ID NO: 160208 - DNA, 601 bp, Human
tctgtatagagttgcacattggcaagtaaaagaaagcctttgaaaagcacgtaaggtcattaaatatgatttttattatacacttgacccaaatatttttctttggtaagatatctttttttgttttgtttctttttttgtctgtgtttttatccttgagatgtccttcaacttatgaggaaaactactggcaaaggatgatttgatatgtaaattttacaaagaaaatatgtttgatgtgattaggtagaatgatggtcacactgaaaatatgtatcagtataaattttttttaatggartctcactctgttgcccaagctggagtgcagtgggtgtgatcttggctcactgccacctctgccctccccgggctcaagtgattctcctgcctcagcctcccagataggtgggactacaggtgcaggccaccatgcccagctaattttttgtattaaatttttatttaaagagttccttgctaatttcctgtctgcctgatgtcattccctagaggcctaagtaatttgagacccaaaattgatcatcaaatggattgttgtaccctctatgctgacactctgagaaaagcattgctccag

SEQ ID NO: 160209 - DNA, 601 bp, Human
cgtgattgaatttacagaaacctctgctgtctttgaagatgggacagtggaagaaaacattgatgttgtgatcttcactacaggatatacattttcttttccattttttgaagaacctcttaaaagcctctgtacaaagaagatatttctatacaagcaagtctttcccttaaacctagagagagcgacattagccatcatcggccttatcggccttaaaggatccatcttatcaggcacagagctccaagcacgatgggtcacaagagtattcaaaggtaccatgactctactgaaagtyctctctttggatcgtaaaattggtgccctgccatttagctaaaatcaaacagatgtgaactaaagtaacaaaatatttttaacattagtgtacaattaattgtatatgtttgtaatatgagggtgtgctgtgtcacttaatgtgactgaataggaaaagagattttggctctgtggatgagataaatttggacaacagaatataatcaaatttgtcaggttagctgaaattattgaaggcttcatgatcctgttctagcctagtctaatctatctactcctaaatcttttcatttagtac

SEQ ID NO: 160210 - DNA, 601 bp, Human
agagcctgggtgagactgactgcgaaactgccaggccccttccacacatgaggctccttgtgtaacaaaaatgaaaatgttctaagacagggttataaagtgggttttttttagagaccagtcctcactccattgcccaggctggagtgcagtggcgtgatcatggctcactgcagcctccatctcctgggctcaagggattctcccacctcagcctcctgagtagctggaactataagcccatgccaccacacctggctaaatttttattttttgtagaaagaatatcttgctatgttgycaggctggtcttgaactcttggacttaagctgtcctcctaccttgccctcccaacgtgctggggttataggcatgagccactatgaccagcctaaaatggggtcattttaagtgtttacatctaaccaactaatagctttaacacaaacatgcacacacacacacacacacacacacgtacaatgtggagggtatacatacaatataatataaattatattatttatacagcaaaagcagatgaagagagacagggcaggccaactggcacaggtgcaggtgtctggtgagtgtggcgca

SEQ ID NO: 160211 - DNA, 601 bp, Human
cacaattctggcagtagagtaccctggttaagtgaactgggcggggaattttacctccagaaaattattttctgtgctgcatttccattctgagctttgactatcatgtgctctgaagttagagcagtgggaggctagaaatgagtgggtggagaatttaaataaaggaaaagccacatgtgactttagtgttgtttgtgatttttcccacaggactctgtaagatacctccatcccaaaaattgatgatggaggctactgaaaaggaacagctcattaaaaggtatgaaatgtagcttgytctagggcaaacttacagtatattctgttacaaaaaaaggattcagagtataaaagccattcctagagaagcagtatggcaggttggaaataactctgcattaggaatcagaaggatacatttttagtcctaactctgccaccaatcagacgtggccttagacaagtcatctggggacaccaggtcttttcagtggaacacacagcctggccccctaccagtggcaatcctgtcttcacttagtccaggaaatctattctgacttcactctcttcctacctctcaggctgctctttctct

SEQ ID NO: 160212 - DNA, 601 bp, Human; identical to SEQ ID NO: 103801

SEQ ID NO: 160213 - DNA, 601 bp, Human; identical to SEQ ID NO: 103802

SEQ ID NO: 160214 - DNA, 601 bp, Human; identical to SEQ ID NO: 103803

SEQ ID NO: 160215 - DNA, 601 bp, Human; identical to SEQ ID NO: 103804

SEQ ID NO: 160216 - DNA, 601 bp, Human; identical to SEQ ID NO: 103805

SEQ ID NO: 160217 - DNA, 601 bp, Human; identical to SEQ ID NO: 103806

SEQ ID NO: 160218 - DNA, 601 bp, Human; identical to SEQ ID NO: 103807

SEQ ID NO: 160219 - DNA, 601 bp, Human; identical to SEQ ID NO: 103808

SEQ ID NO: 160220 - DNA, 601 bp, Human; identical to SEQ ID NO: 103809

SEQ ID NO: 160221 - DNA, 601 bp, Human; identical to SEQ ID NO: 103810

SEQ ID NO: 160222 - DNA, 601 bp, Human; identical to SEQ ID NO: 103811

SEQ ID NO: 160223 - DNA, 601 bp, Human; identical to SEQ ID NO: 103812

SEQ ID NO: 160224 - DNA, 601 bp, Human; identical to SEQ ID NO: 103813

SEQ ID NO: 160225 - DNA, 601 bp, Human; identical to SEQ ID NO: 103814

SEQ ID NO: 160226 - DNA, 601 bp, Human; identical to SEQ ID NO: 103815

SEQ ID NO: 160227 - DNA, 601 bp, Human; identical to SEQ ID NO: 103816

SEQ ID NO: 160228 - DNA, 601 bp, Human; identical to SEQ ID NO: 103817

SEQ ID NO: 160229 - DNA, 601 bp, Human; identical to SEQ ID NO: 103818

SEQ ID NO: 160230 - DNA, 601 bp, Human; identical to SEQ ID NO: 103819

SEQ ID NO: 160231 - DNA, 601 bp, Human; identical to SEQ ID NO: 103820

SEQ ID NO: 160232 - DNA, 601 bp, Human; identical to SEQ ID NO: 103821

SEQ ID NO: 160233 - DNA, 601 bp, Human; identical to SEQ ID NO: 103822

SEQ ID NO: 160234 - DNA, 601 bp, Human; identical to SEQ ID NO: 103823

SEQ ID NO: 160235 - DNA, 601 bp, Human; identical to SEQ ID NO: 103824

SEQ ID NO: 160236 - DNA, 601 bp, Human; identical to SEQ ID NO: 103825

SEQ ID NO: 160237 - DNA, 601 bp, Human; identical to SEQ ID NO: 103826

SEQ ID NO: 160238 - DNA, 601 bp, Human; identical to SEQ ID NO: 103827

SEQ ID NO: 160239 - DNA, 601 bp, Human; identical to SEQ ID NO: 103828

SEQ ID NO: 160240 - DNA, 601 bp, Human; identical to SEQ ID NO: 103829

SEQ ID NO: 160241 - DNA, 601 bp, Human; identical to SEQ ID NO: 103830

SEQ ID NO: 160242 - DNA, 601 bp, Human; identical to SEQ ID NO: 103831

SEQ ID NO: 160243 - DNA, 601 bp, Human; identical to SEQ ID NO: 103832

SEQ ID NO: 160244 - DNA, 601 bp, Human; identical to SEQ ID NO: 103833

SEQ ID NO: 160245 - DNA, 601 bp, Human; identical to SEQ ID NO: 103834

SEQ ID NO: 160246 - DNA, 601 bp, Human; identical to SEQ ID NO: 103835

SEQ ID NO: 160247 - DNA, 601 bp, Human; identical to SEQ ID NO: 103836

SEQ ID NO: 160248 - DNA, 601 bp, Human; identical to SEQ ID NO: 103837

SEQ ID NO: 160249 - DNA, 601 bp, Human; identical to SEQ ID NO: 103838

SEQ ID NO: 160250 - DNA, 601 bp, Human; identical to SEQ ID NO: 103839

SEQ ID NO: 160251 - DNA, 601 bp, Human; identical to SEQ ID NO: 103840

SEQ ID NO: 160252 - DNA, 601 bp, Human; identical to SEQ ID NO: 103841

SEQ ID NO: 160253 - DNA, 601 bp, Human; identical to SEQ ID NO: 103842

SEQ ID NO: 160254 - DNA, 601 bp, Human; identical to SEQ ID NO: 103843

SEQ ID NO: 160255 - DNA, 601 bp, Human; identical to SEQ ID NO: 103844

SEQ ID NO: 160256 - DNA, 601 bp, Human; identical to SEQ ID NO: 103801

SEQ ID NO: 160257 - DNA, 601 bp, Human; identical to SEQ ID NO: 103802

SEQ ID NO: 160258 - DNA, 601 bp, Human; identical to SEQ ID NO: 103803

SEQ ID NO: 160259 - DNA, 601 bp, Human; identical to SEQ ID NO: 103804

SEQ ID NO: 160260 - DNA, 601 bp, Human; identical to SEQ ID NO: 103805

SEQ ID NO: 160261 - DNA, 601 bp, Human; identical to SEQ ID NO: 103806

SEQ ID NO: 160262 - DNA, 601 bp, Human; identical to SEQ ID NO: 103807

SEQ ID NO: 160263 - DNA, 601 bp, Human; identical to SEQ ID NO: 103808

SEQ ID NO: 160264 - DNA, 601 bp, Human; identical to SEQ ID NO: 103809

SEQ ID NO: 160265 - DNA, 601 bp, Human; identical to SEQ ID NO: 103810

SEQ ID NO: 160266 - DNA, 601 bp, Human; identical to SEQ ID NO: 103811

SEQ ID NO: 160267 - DNA, 601 bp, Human; identical to SEQ ID NO: 103812

SEQ ID NO: 160268 - DNA, 601 bp, Human; identical to SEQ ID NO: 103813

SEQ ID NO: 160269 - DNA, 601 bp, Human; identical to SEQ ID NO: 103814

SEQ ID NO: 160270 - DNA, 601 bp, Human; identical to SEQ ID NO: 103815

SEQ ID NO: 160271 - DNA, 601 bp, Human; identical to SEQ ID NO: 103816

SEQ ID NO: 160272 - DNA, 601 bp, Human; identical to SEQ ID NO: 103817

SEQ ID NO: 160273 - DNA, 601 bp, Human; identical to SEQ ID NO: 103818

SEQ ID NO: 160274 - DNA, 601 bp, Human; identical to SEQ ID NO: 103819

SEQ ID NO: 160275 - DNA, 601 bp, Human; identical to SEQ ID NO: 103820

SEQ ID NO: 160276 - DNA, 601 bp, Human; identical to SEQ ID NO: 103821

SEQ ID NO: 160277 - DNA, 601 bp, Human; identical to SEQ ID NO: 103822

SEQ ID NO: 160278 - DNA, 601 bp, Human; identical to SEQ ID NO: 103823

SEQ ID NO: 160279 - DNA, 601 bp, Human; identical to SEQ ID NO: 103824

SEQ ID NO: 160280 - DNA, 601 bp, Human; identical to SEQ ID NO: 103825

SEQ ID NO: 160281 - DNA, 601 bp, Human; identical to SEQ ID NO: 103826

SEQ ID NO: 160282 - DNA, 601 bp, Human; identical to SEQ ID NO: 103827

SEQ ID NO: 160283 - DNA, 601 bp, Human; identical to SEQ ID NO: 103828

SEQ ID NO: 160284 - DNA, 601 bp, Human; identical to SEQ ID NO: 103829

SEQ ID NO: 160285 - DNA, 601 bp, Human; identical to SEQ ID NO: 103830

SEQ ID NO: 160286 - DNA, 601 bp, Human; identical to SEQ ID NO: 103831

SEQ ID NO: 160287 - DNA, 601 bp, Human; identical to SEQ ID NO: 103832

SEQ ID NO: 160288 - DNA, 601 bp, Human; identical to SEQ ID NO: 103833

SEQ ID NO: 160289 - DNA, 601 bp, Human; identical to SEQ ID NO: 103834

SEQ ID NO: 160290 - DNA, 601 bp, Human; identical to SEQ ID NO: 103835

SEQ ID NO: 160291 - DNA, 601 bp, Human; identical to SEQ ID NO: 103836

SEQ ID NO: 160292 - DNA, 601 bp, Human; identical to SEQ ID NO: 103837

SEQ ID NO: 160293 - DNA, 601 bp, Human; identical to SEQ ID NO: 103838

SEQ ID NO: 160294 - DNA, 601 bp, Human; identical to SEQ ID NO: 103839

SEQ ID NO: 160295 - DNA, 601 bp, Human; identical to SEQ ID NO: 103840

SEQ ID NO: 160296 - DNA, 601 bp, Human; identical to SEQ ID NO: 103841

SEQ ID NO: 160297 - DNA, 601 bp, Human; identical to SEQ ID NO: 103842

SEQ ID NO: 160298 - DNA, 601 bp, Human; identical to SEQ ID NO: 103843

SEQ ID NO: 160299 - DNA, 601 bp, Human; identical to SEQ ID NO: 103844

SEQ ID NO: 160300 - DNA, 601 bp, Human
cggctgggcaggaggagcctgggacgccgccctcctcgccgctgagtgccgagcagttggaccggatccagaggaacaaggccgcggccctgctcagactcgcggcccgcaacgtgcccgtgggctttggagagagctggaagaagcacctcagcggggagttcgggaaaccgtattttatcaaggtaaatatggaaatgcaccttccataagggtaaatgtggaggctgccggcccttttgtcttgttagtgtagccggccaagttcatgtttccgtaggcttaggttgtacccccttcmacctcctttactcacaaagggggtaaaagaaagccatgatgtttcactctgcagctttatattggttaaagttgttaacgacccgcgagatgatatcatggattcatttaagtcacatagtctattgtccaggaaaggctggcgtagtaaaatcaccaaccatcctgaatgaaacctggcttgagctttaaaaagccgagaggagtggcactgtcaggacccagcccagagaaagaggcaaggaattgacctgattgaaccacttaggtgggggggcaggcactgtttttgtttgttgtt

SEQ ID NO: 160301 - DNA, 601 bp, Human
gccacgtcctacctctcagccttacctccacctcccactctcccactccagagttggacagtgtggcaaacccctccccacttctgtctcttaaaaatcaagtagatgcctctgtggcacctccttgaattgaagtccgttgcctgccacctctgtgatccagttttcctctgagctgctacgatgcatttagcacctgctgacactggacttttaggtttcttacccgttttcctcccccgttttgtaaactggggcaagaatcttgtgatttaatgaatatctgtgaaatgacatagargtgaaataggtgaataaatcatcttgataaggcagccacacctaatacttagaaaatctcgtaagcttaattttagagtaagaatttagaatctagctctttggttttgaagctaaattaaatcctattaagatcaatactaatttgcttcttgtttgaatgccctattctgaataccagtaatcagtataaacagggaatattaaaaggaatattttgagggaatgctcaaaaaccagtttcaaacctatgaggatcagatgggccagcagggcttcttgacagaccagcattgggaga

SEQ ID NO: 160302 - DNA, 601 bp, Human
tggtgtatgatatacataaatatgctaaggacagaaaactgtccctgagcaacagtgggggtctgggttgtaactgctgggttgatttacttaggttttccagagtgctgttaaatccaagtacagactaaagtaaaggtctttggcagagtcacctgttagaaggaggactggcagtgttgatctcattaatcggcgccatatgtgccagtgtcccttccaagggctggctgtaacttctaaccttttcacatatgtcttagacgttactgagctttcaaaattatgcttaagattctgttttttgtttttcttgtggcttgctttcagtttggagaacatttataaagagttgtctacagacatagaggattttgttcatcctggccatggagatttatctgggtgggccaagcaaggtaagccagcgactgctagattttttttttttttttttttttgagaccgagtctcactctgttgcccaggctagagtgcagtggtgcaatctcagcttactgcaacctctgcctcccaggttcaggcgattctcatgcctcagcctcctgagtagctgggaccacaggcatgagccaccata

SEQ ID NO: 160303 - DNA, 601 bp, Human
acagttgcctgccaccacacccagctaatattttttatttttagtagagactgggtttcaccatgttgacaaggctggtcttgaactcctgacctcaagcgatcctcccatcttggtctcccaaagtgctaggattacagatgtaagccaccgcacccgaccaggttgagtactttgcatgcagaatcttacttaactctcagaaaggctttgaggtaggcatacacttgtatgagtgacctaagatctgactggtatgaactgctaagatgtgatcatctaggtatgtaagaagtgtgcstgagagtaattgctaatctctatcccttagggaggtttacggccagtgttgctcttccgcagtatattggtaatctttaatcatggtttggtctgaaagtaaacagttgttaaagtagcttggtcattaaagccaaattgcatatctccagcccagtgtctcttctgatctatagagtgccttgttactactgccccatgaacatgccaaattcaacattttccaaacgaagtttctccttttctcatccatgcttcactaaacttcctcctctgcactccctagcagcaaaaagcacca

SEQ ID NO: 160304 - DNA, 601 bp, Human
aatggagacagtctactctggtagcaacttgatgaactacttcaacagaatctttgcaagtcacctcccaagggcctcagtttcatgctctatataacgggattacgtccacctctatgaagattattgtgtaaacacacgtaaatcaccagatatacagcaagtgtttccataaatgtggatggcattctccagacttaatagtgtctttttttgtttgttttttttttttgagacagggtcttgctctgttgcccaggttggagcgtggtggtgcaatctcggctcactgcaacctccrtctccccggctcaaacagtcctcctgcctcagcctcccgagtagctgggaatgaaggcgcccgccaccacgcccagctagtttttgtatttttggtagagatagcgtttcaccacgttggccaggctggtctcgaactcttgacctcaagtgattcgcccacctcggcctctcaaagtgctgggactacaggggtgagccaccacacccggtccaatagtgtcaaagttacttgaaaagctaccagccaaactgaactggtttttgctgaaaattcactaggattgttccgcgtgtattc

SEQ ID NO: 160305 - DNA, 601 bp, Human
ggcctccttcctccagccccacccagctaagctccccatccccaaatccagctttatctccacccacacaacccaatggccccaatcctgacccactaatctctccacagtatgacaagcccccattccagctctactattgatgtgaccttcacataacctttctgggttcagtttcagcatccacacaatggagacagtctactctggtagcaacttgatgaactacttcaacagaatctttgcaagtcacctcccaagggcctcagtttcatgctctatataacgggattacgtccayctctatgaagattattgtgtaaacacacgtaaatcaccagatatacagcaagtgtttccataaatgtggatggcattctccagacttaatagtgtctttttttgtttgttttttttttttgagacagggtcttgctctgttgcccaggttggagcgtggtggtgcaatctcggctcactgcaacctccgtctccccggctcaaacagtcctcctgcctcagcctcccgagtagctgggaatgaaggcgcccgccaccacgcccagctagtttttgtatttttggtagagatagcgtttca

SEQ ID NO: 160306 - DNA, 601 bp, Human
cacttggatgtccagttggatctattatgtgtcatgttggagtcctcatggctcctttgcccccactaccggttactctcccaatcttcccattttaggaaatgaaaccaccattcaaccagctactctgcccaaaaacttaagatttgattcctcttttcctctttcacctcaatcagcacgtttttggctcaacaagtgaaatatataagcaatccaactgcatctcaccaccttcatctaaactgtcacttctcaggctgggcgcagtggctcacagcctgtaatcccagcactttgrgaggccaaggtgggcggatcacccgaggtcagaagttcgagagcagcctggccaacatggtgaaatcccatctctactaaaaatacaaaaattagttgggcgtggtggtgggcacttataatcccagctactcaggaggctgaggcaggagaattgcttgaacctgggaggcggaggtggcagtgagctaaaatagcaccactgcactccaacctgggtgagagggagactctgtctccaaaaaaaacaataaagaaataaatacactgccacttctcagttggacactgccacactctc

SEQ ID NO: 160307 - DNA, 601 bp, Human
tcgatgtgatccaactgcctccacagcacctccacttggatgtccagttggatctattatgtgtcatgttggagtcctcatggctcctttgcccccactaccggttactctcccaatcttcccattttaggaaatgaaaccaccattcaaccagctactctgcccaaaaacttaagatttgattcctcttttcctctttcacctcaatcagcacgtttttggctcaacaagtgaaatatataagcaatccaactgcatctcaccaccttcatctaaactgtcacttctcaggctgggcgcrgtggctcacagcctgtaatcccagcactttgagaggccaaggtgggcggatcacccgaggtcagaagttcgagagcagcctggccaacatggtgaaatcccatctctactaaaaatacaaaaattagttgggcgtggtggtgggcacttataatcccagctactcaggaggctgaggcaggagaattgcttgaacctgggaggcggaggtggcagtgagctaaaatagcaccactgcactccaacctgggtgagagggagactctgtctccaaaaaaaacaataaagaaataaatacact

SEQ ID NO: 160308 - DNA, 601 bp, Human
cgctggccaagcagagccagctgcttctacccacaactggagcagacaatagtcttaagaattgcagtgagccaagatcgcaccactgcactccagtatgggcaacggggcaagactctgtctcaaaaagaaaaaaaaaaaagaagaaagccacggtgccaaggctgaggaatggggatcatgcccattcagccctggtcagtctgtgaaggagtgctgtgccaccccctcctgtccacctgtggttggttagaagcaatcttgaatgtcctaatcactgggtcagatctaaccactcccctccccaagtccaagcagacatgtgcccagcctgtgaaaactccattctcgttagacttggtccttcctcagtcctttagaccgccataccctaggcagtgaacctctttttctgccccgtagccctccccagttctttggaaagagatccacatccttcctttaatgaacttcccctccgcttcatcatgtagttcccaatcataagatcttgctcttcctggttacacggcttgacctgggtcaataaacaacttccacaggattttagatgatgatgggacaaagcagctctttcctg

SEQ ID NO: 160309 - DNA, 601 bp, Human
cacttgacatcgatctccacgtcaaagtgtccaatgttacacacaatggcatcatccttcatctgctcaaagtgcctgtcaggcagcccaagaccgtgggagattgtcagggacagaaagctgtcccaactctgccctcctccctcactccccgggaccccccatctggcacctaccggccaaggatgatgtcaatacagcctgtggtggtgacaaagatgttgccctcctgacaggcctcatccatggtggtcacctcatagcctgtgcagagacagtggctgtgggtcatctacggtgsccttgcccctccctctggccccagtggctgacaaccaacccttgccctatcctaccctccatggcagcctgcagtgcgttgatggggtcaatctcggtgatgatgacgcgggctccgaaaccccgcagggcctgggcacagcccttgcccacatcaccatagcctgctaccaccgctaccttgccggcaatcatcacatctgtggcccgcttgatgccatctatgagggactcccggcagccatagaggttgtcaaacttgctctgaaaggaaagggggtaaggagacaataggggcagg

SEQ ID NO: 160310 - DNA, 601 bp, Human
gggattacaggcatgagccactgtacctggccttttttttttttttttttttgagatggagtctcgctcttattaaccaggcaggagtgcgagggtgcgatctcggctcactgcaacctccgcctcccagcttcaagcaattctctcctgcctcagcctcccaaatagctgggattacaggtgcccgccaccacacccggctaatttttctatttttagtagagatggggtttcatcatattggtcaggctggtctcgaacccctgacctcatgtgatccgcccgcctcgacctcccaaastgctgggattacaggcatgagctaccgcacccggcccagctaatttttttgtatttttagtagagacggggtttcaaccatgttggccaggctagtctcgaactcctggcctcaggtgatccgcccatctcggccttccaaagtgctgggattacaggtgtgagccaccatgcccggccaaagctgtgtcctttgttactctgcctccatcctgaccctacatgccgtccatccaccccagcactccctaagctgaggctgccatcatcccctgcagggattctacgagcctcctctaaa

SEQ ID NO: 160311 - DNA, 601 bp, Human
cactgtcacccaggctggagtgcagtggaacaatctcggctcactacaacctccatctcccgggttcatgtgattctcctgcctcagcctcccaagtagctgggattgcaggtgcacatcaccacacccggctaacttcttgtatttttagtagagacggggtttcactatgctggccagactggtctcaaactcctgacctcgtgatctgcccacctaggcctcccaaagtgctgggattacaggcatgagccactgtacctggccttttttttttttttttttttgagatggagtctcrctcttattaaccaggcaggagtgcgagggtgcgatctcggctcactgcaacctccgcctcccagcttcaagcaattctctcctgcctcagcctcccaaatagctgggattacaggtgcccgccaccacacccggctaatttttctatttttagtagagatggggtttcatcatattggtcaggctggtctcgaacccctgacctcatgtgatccgcccgcctcgacctcccaaactgctgggattacaggcatgagctaccgcacccggcccagctaatttttttgtatttttagtagag

SEQ ID NO: 160312 - DNA, 601 bp, Human
actgcaacctctgcctaccacgtttaagcgattctcatgcctcagcctcccgagtagctgggattacaggcacccaccaccatgcccagctgatttttttgtttgtttgtttttgagacagagtctcgcactgtcacccaggctggagtgcagtggaacaatctcggctcactacaacctccatctcccgggttcatgtgattctcctgcctcagcctcccaagtagctgggattgcaggtgcacatcaccacacccggctaacttcttgtatttttagtagagacggggtttcactatgytggccagactggtctcaaactcctgacctcgtgatctgcccacctaggcctcccaaagtgctgggattacaggcatgagccactgtacctggccttttttttttttttttttttgagatggagtctcgctcttattaaccaggcaggagtgcgagggtgcgatctcggctcactgcaacctccgcctcccagcttcaagcaattctctcctgcctcagcctcccaaatagctgggattacaggtgcccgccaccacacccggctaatttttctatttttagtagagatggggtttcatca

SEQ ID NO: 160313 - DNA, 601 bp, Human
gaggttgcttaactttaaagctcttgatatccaaagccaaaatgtcttccagaaacatactacttttataatcagagaaaaaaataaactcataataattgcaactcaagtaaaacttcacaccccctataagaactcatcttccagtttcagtgccccaatgcccaatgcaaacctgttctttcccagctcagtgcatgggcctgctcctcacacagtgattcaagctgtgtccctttttgttttttgtttttagttttgtttttgagatggagtctcgctctgttgcccaggctggagwgcaatggcgcaatctcggctcactgcaacctctgcctaccacgtttaagcgattctcatgcctcagcctcccgagtagctgggattacaggcacccaccaccatgcccagctgatttttttgtttgtttgtttttgagacagagtctcgcactgtcacccaggctggagtgcagtggaacaatctcggctcactacaacctccatctcccgggttcatgtgattctcctgcctcagcctcccaagtagctgggattgcaggtgcacatcaccacacccggctaacttcttgtatttttag

SEQ ID NO: 160314 - DNA, 601 bp, Human
tttttttttttttttctgagacggagtcttactctgtcatccaggctggagtacagtggtgtgatctcagctcactgcaacctccacctcctgggttcaagcgattctcctgcctcagcctccagagtagctgggactatacgcatgagccaccatgcccagctaattttttgtatttttagtagagacagggtttgaccatgttggccaggctggtctcaaactcctgacctcaagtgatccgcctgcctcggcctcccaaagtgctggaattacaggtgtgtgccaccgtgcctggccrgaagggggtctcttgagctgggctgagaagatgaacaaggagaagggcatgtgttctgttccagacaaatgcagctgtctggacagatgagcagaagtaggagctgcagtgggtattcagggagtggtcaattatggcctgagtacagaggcccttgagaggacggacaagagataatgttgggcagaaggttggcaagactgtcaaggatgttgagggtgggcatagagtccagctttggagggcagcttggcagaaaggtgcccatcaccccaatgtagcaggtttcacctgtgatgc

SEQ ID NO: 160315 - DNA, 601 bp, Human
cctgactttccccattcgcaggatggatggatcactcatctctcaaggctgttacaaagatcagtgctactcagagtcattcgtgcagtaggtgacttaataaatggtggctgccttctctgtcattgttgaccaaggtacctagtcccttgcctgcatacagcatgtgaggcatgatgccaagagtgtcctgtccccaagccacatgttagcaatgatgaagaaaagtggtaaggacagggtcaggtgctgaggcgggagctttgcctctttcacttccaaccctgccctcatttcaaagcctgaccaatttctcaccaaactcatagccatatttctcccaactgggattagatggggatcaagtgagaatctttcaaccccacaaccagctgcacagaacaaggtatgccttgaggtccttatgggtaaaatgtttggtccagcaagacattgctccagggagattagttgttggctggccctggaggcagatgccccaggcctcttcctgcgtcttcctcaattggtagaaccagcctttcaaaagatgaagggatggtatgtagaccccatcacagcttctccagcagcaaaaggc

SEQ ID NO: 160316 - DNA, 601 bp, Human
tttctaatgaatagaagaaagcagaagtgatggtgtgtgactttggacacaagttcatagagaccctgtggcttcctccttgctctcctctggatgacttactctgggggaagccagatgccatctcctgaggatgcataagcagccctctggagaggcccatgcatgaggaattgagacctcctgtcaacagcgatgtgaagaggatcttccagacccagtcaaaccttcagatgattgcagccctggcagaaatcttgaccgcaacctcatgaaagagcctgagtcagaagcagccagmtaagctgatctcaaattcttgacccacagaaactgaaataataaatatttattatttgaagccagtaagtctgggggttagagtgttatgcagcaagataactgatacactggtttgaatagtgtttctatcacttgtgaccaaaaggattctaatccactgccatcctccttttataaaatgaggaaatcaaggttcagaaacgtgaaatgacgtgtccacggtcaccaagctagtgaatgacagagctaggatttgaacccaggtctatctggcttcaaagccccaaaatgtgtctca

SEQ ID NO: 160317 - DNA, 601 bp, Human
caccccaccgagtgattcctttctaatgaatagaagaaagcagaagtgatggtgtgtgactttggacacaagttcatagagaccctgtggcttcctccttgctctcctctggatgacttactctgggggaagccagatgccatctcctgaggatgcataagcagccctctggagaggcccatgcatgaggaattgagacctcctgtcaacagcgatgtgaagaggatcttccagacccagtcaaaccttcagatgattgcagccctggcagaaatcttgaccgcaacctcatgaaagagcytgagtcagaagcagccagctaagctgatctcaaattcttgacccacagaaactgaaataataaatatttattatttgaagccagtaagtctgggggttagagtgttatgcagcaagataactgatacactggtttgaatagtgtttctatcacttgtgaccaaaaggattctaatccactgccatcctccttttataaaatgaggaaatcaaggttcagaaacgtgaaatgacgtgtccacggtcaccaagctagtgaatgacagagctaggatttgaacccaggtctatctggcttcaa

SEQ ID NO: 160318 - DNA, 601 bp, Human
ctaggtttccagtgtttggatccgagaataaagttcttttttttgtgacagagtctcattcggacgcccacgctggagtgcagtggcgcgatctcggctcactgcaacttctacatcccaggttcaagtgattctcctgcctcagcctcccgaggagctgggattacaggcgtgcaccaccacgtccagctaactttctgtttttagtagagatggggtttcaccatgttggtaaggctgttcttgaactcctgacctcaggtgtcgaactcctgacctcaggtgatctgcctgcctcagyctcccaaagtgctgggattacaggcgtgagccaccgtgcctggcagattcgagaataaagttcttttttggattaaactggttgctttttttgattaaaatgtatctataaattctttgatactcctttaagaattagagcctaatccccaccgcctccccccaccccaccgagtgattcctttctaatgaatagaagaaagcagaagtgatggtgtgtgactttggacacaagttcatagagaccctgtggcttcctccttgctctcctctggatgacttactctgggggaagccagat

SEQ ID NO: 160319 - DNA, 601 bp, Human
atgctaccaaaatcccaatccattatctaccctttatggagaaaagtacctttataatgttttacaaagaatcgtggtctcaagtttccactttgttttagtaataaagaactttcaaaaaaaaaaccactctaaacaacaccctcctgtatagaaagctctattttaataattaatgcaatgatacccttgttggaacaatccagccgctttgaaactctggtatttacttactagatgaacaagtttctctatggaggtgcctttaacttctcaagaaatgtgtaagttaagacggctmcaaattacattttaagagagccttgtatttttagaggttctttttcatcggtcagaaaaacttacgttgacgattctgcaagaaaggttgctcgcaaaccatgcatcgcaaagctaccgaggcaaatttaaagaaccaatgaaaaagagtggaggctcgtctgaatctttaattggctatgggaatttcaatttattgcataaataatcttttagacctcaagatacacgtgacctagggacagtttacatcaatgggcaagacttaaaaatagacaccaagttcagcaagtatttgagc

SEQ ID NO: 160320 - DNA, 601 bp, Human
gagtggggtgaagcaattgagtccttttacctagctgactccgaatcaagacagctaaaagaatgtaccagaaagaaagaaaaaataaaatgctaccaaaatcccaatccattatctaccctttatggagaaaagtacctttataatgttttacaaagaatcgtggtctcaagtttccactttgttttagtaataaagaactttcaaaaaaaaaaccactctaaacaacaccctcctgtatagaaagctctattttaataattaatgcaatgatacccttgttggaacaatccagccgctytgaaactctggtatttacttactagatgaacaagtttctctatggaggtgcctttaacttctcaagaaatgtgtaagttaagacggctccaaattacattttaagagagccttgtatttttagaggttctttttcatcggtcagaaaaacttacgttgacgattctgcaagaaaggttgctcgcaaaccatgcatcgcaaagctaccgaggcaaatttaaagaaccaatgaaaaagagtggaggctcgtctgaatctttaattggctatgggaatttcaatttattgcataaataatctt

SEQ ID NO: 160321 - DNA, 601 bp, Human
cttcataaccattctccaattttgctggaggatcagggtggtggaagtcattttaaaaaccagctgcaatatactgtactaccagagagtggggtgaagcaattgagtccttttacctagctgactccgaatcaagacagctaaaagaatgtaccagaaagaaagaaaaaataaaatgctaccaaaatcccaatccattatctaccctttatggagaaaagtacctttataatgttttacaaagaatcgtggtctcaagtttccactttgttttagtaataaagaactttcaaaaaaaaaaccactctaaacaacaccctcctgtatagaaagctctattttaataattaatgcaatgatacccttgttggaacaatccagccgctttgaaactctggtatttacttactagatgaacaagtttctctatggaggtgcctttaacttctcaagaaatgtgtaagttaagacggctccaaattacattttaagagagccttgtatttttagaggttctttttcatcggtcagaaaaacttacgttgacgattctgcaagaaaggttgctcgcaaaccatgcatcgcaaagctaccgaggcaa

SEQ ID NO: 160322 - DNA, 601 bp, Human
cagtgattctcaaacaggcaattttgacttcttatcaccatgggaggggaggaggccgcgtcctagcagaggccaaaaacagttgcttcacatcctacaacccagagggcactcctcaacaaaagtgatcaggctaaaatgtcaacagtgctccccaggttgagaaactgaattttaaactcaacctctagtttagatgaccactaggtctcaccgaatgaggagtttacagctcagaaacaaatctagaaaacttaacagccttggccaagcacaatggctcatgcctgtaatcccggcrtgttgaactggatggtgaaaccccatctctaccaaaaaatacaaaaattaggtgggcatgctggtgtgtgcctgtagccccagctactcaggaggctgaggtgggggtgatcacctgagctccccaggtcgaggctgcagtgagttgtgatcgtgacactgcactcccgcctgggtgacagagccagaccctgtctcaaaaaaaaaaaaaaaaaagcctcttggccatttctacctatggccaaaataatgtgaacagataatgaccttttagagtattcacaaatggggatcttaagac

SEQ ID NO: 160323 - DNA, 601 bp, Human
acaccattttagaaggaagtccgtttaaaccagtgattctcaaacaggcaattttgacttcttatcaccatgggaggggaggaggccgcgtcctagcagaggccaaaaacagttgcttcacatcctacaacccagagggcactcctcaacaaaagtgatcaggctaaaatgtcaacagtgctccccaggttgagaaactgaattttaaactcaacctctagtttagatgaccactaggtctcaccgaatgaggagtttacagctcagaaacaaatctagaaaacttaacagccttggccargcacaatggctcatgcctgtaatcccggcatgttgaactggatggtgaaaccccatctctaccaaaaaatacaaaaattaggtgggcatgctggtgtgtgcctgtagccccagctactcaggaggctgaggtgggggtgatcacctgagctccccaggtcgaggctgcagtgagttgtgatcgtgacactgcactcccgcctgggtgacagagccagaccctgtctcaaaaaaaaaaaaaaaaaagcctcttggccatttctacctatggccaaaataatgtgaacagataatgaccttt

SEQ ID NO: 160324 - DNA, 601 bp, Human
acagcacaatgtcctagctctgcggtgctcttgaaagaaaaagtgaaaaccctgccaagggagccatctggatttgtattcctcaccatttaccatgactagaatgcttaggagtgtgcccttcagaaactgagcttttcaggcagaaaattagttttctctccagaccatataggaatgcctaaaaaagttatgccaaaatgtaaaaagaagagtcaagccaaggacccccatttttaaacttaagtgttggctgcccctcaaactgcaacttactcctcctggggtactatggtttgcmtttaggcagcatgtgaaggtgtgaagatctcttttaggagatcttgtcagagtacctcaatggccaatcagaaaacaggtattaagggtgaagaagccactttttggaaagttagatcatgcagagaaacttaatttacactttaatagccgtttctcactattgggatcattaaaagttagactgtttccttaaatactatttaacttcactacacactgttgtgaccacgggctatttaagacattcagggtactaacctatagatctgttctcacctaatttgctcgagcatcaaga

SEQ ID NO: 160325 - DNA, 601 bp, Human
aggaagggtgagggaagaagtccaacattttatcacccaccagctaccaagtatctaacagcacaatgtcctagctctgcggtgctcttgaaagaaaaagtgaaaaccctgccaagggagccatctggatttgtattcctcaccatttaccatgactagaatgcttaggagtgtgcccttcagaaactgagcttttcaggcagaaaattagttttctctccagaccatataggaatgcctaaaaaagttatgccaaaatgtaaaaagaagagtcaagccaaggacccccatttttaaactkaagtgttggctgcccctcaaactgcaacttactcctcctggggtactatggtttgcctttaggcagcatgtgaaggtgtgaagatctcttttaggagatcttgtcagagtacctcaatggccaatcagaaaacaggtattaagggtgaagaagccactttttggaaagttagatcatgcagagaaacttaatttacactttaatagccgtttctcactattgggatcattaaaagttagactgtttccttaaatactatttaacttcactacacactgttgtgaccacgggctatttaag

SEQ ID NO: 160326 - DNA, 601 bp, Human
ccagcttgggcaacacagcaagactgtcttgagaaaaagaattctaaacaaaataaatacaagaattcaaaacaaaattcatgaaagatataggaagggtgagggaagaagtccaacattttatcacccaccagctaccaagtatctaacagcacaatgtcctagctctgcggtgctcttgaaagaaaaagtgaaaaccctgccaagggagccatctggatttgtattcctcaccatttaccatgactagaatgcttaggagtgtgcccttcagaaactgagcttttcaggcagaaaatttgttttctctccagaccatataggaatgcctaaaaaagttatgccaaaatgtaaaaagaagagtcaagccaaggacccccatttttaaacttaagtgttggctgcccctcaaactgcaacttactcctcctggggtactatggtttgcctttaggcagcatgtgaaggtgtgaagatctcttttaggagatcttgtcagagtacctcaatggccaatcagaaaacaggtattaagggtgaagaagccactttttggaaagttagatcatgcagagaaacttaatttacactttaatagccg

SEQ ID NO: 160327 - DNA, 601 bp, Human
gtaaatattccaatactcagaccaggggcccattcaggaggctgagtgcaggaagatggcctgagctcaggagttcgataccagcttgggcaacacagcaagactgtcttgagaaaaagaattctaaacaaaataaatacaagaattcaaaacaaaattcatgaaagatataggaagggtgagggaagaagtccaacattttatcacccaccagctaccaagtatctaacagcacaatgtcctagctctgcggtgctcttgaaagaaaaagtgaaaaccctgccaagggagccatctggawttgtattcctcaccatttaccatgactagaatgcttaggagtgtgcccttcagaaactgagcttttcaggcagaaaattagttttctctccagaccatataggaatgcctaaaaaagttatgccaaaatgtaaaaagaagagtcaagccaaggacccccatttttaaacttaagtgttggctgcccctcaaactgcaacttactcctcctggggtactatggtttgcctttaggcagcatgtgaaggtgtgaagatctcttttaggagatcttgtcagagtacctcaatggccaatcaga

SEQ ID NO: 160328 - DNA, 601 bp, Human
ttcccaaatcattcagatgtaaatattccaatactcagaccaggggcccattcaggaggctgagtgcaggaagatggcctgagctcaggagttcgataccagcttgggcaacacagcaagactgtcttgagaaaaagaattctaaacaaaataaatacaagaattcaaaacaaaattcatgaaagatataggaagggtgagggaagaagtccaacattttatcacccaccagctaccaagtatctaacagcacaatgtcctagctctgcggtgctcttgaaagaaaaagtgaaaaccctgmcaagggagccatctggatttgtattcctcaccatttaccatgactagaatgcttaggagtgtgcccttcagaaactgagcttttcaggcagaaaattagttttctctccagaccatataggaatgcctaaaaaagttatgccaaaatgtaaaaagaagagtcaagccaaggacccccatttttaaacttaagtgttggctgcccctcaaactgcaacttactcctcctggggtactatggtttgcctttaggcagcatgtgaaggtgtgaagatctcttttaggagatcttgtcagagta

SEQ ID NO: 160329 - DNA, 601 bp, Human
gggtctcactctgttgccaaggctggaacaagccctcttcaacaaagctaagatggtccatattactcatgtggatgagggtgttgaaggacatttactgccttccttcatggtctcacttcatgatcaaaccaagatgcacaggaaataggtttgacaatttacctttaccaagaaagacgattcagcaacagtggtagagctgcctgtttgaacttaaccttggtcatcgcagtttgaaatacaaatggcagcatggagagcaggctgcccgctttttggttggacatttctttcactttgagtttgaggtacagcaaatttcccaaatcattcagatgtaaatattccaatactcagaccaggggcccattcaggaggctgagtgcaggaagatggcctgagctcaggagttcgataccagcttgggcaacacagcaagactgtcttgagaaaaagaattctaaacaaaataaatacaagaattcaaaacaaaattcatgaaagatataggaagggtgagggaagaagtccaacattttatcacccaccagctaccaagtatctaacagcacaatgtcctagctctgcggtgctcttg

SEQ ID NO: 160330 - DNA, 601 bp, Human
catcatggctccctcccaaaagttcactggcataccatatcaagtcagcaagcccccttttttgtagcagggtctcactctgttgccaaggctggaacaagccctcttcaacaaagctaagatggtccatattactcatgtggatgagggtgttgaaggacatttactgccttccttcatggtctcacttcatgatcaaaccaagatgcacaggaaataggtttgacaatttacctttaccaagaaagacgattcagcaacagtggtagagctgcctgtttgaacttaaccttggtcatckcagtttgaaatacaaatggcagcatggagagcaggctgcccgctttttggttggacatttctttcactctgagtttgaggtacagcaaatttcccaaatcattcagatgtaaatattccaatactcagaccaggggcccattcaggaggctgagtgcaggaagatggcctgagctcaggagttcgataccagcttgggcaacacagcaagactgtcttgagaaaaagaattctaaacaaaataaatacaagaattcaaaacaaaattcatgaaagatataggaagggtgagggaagaagt

SEQ ID NO: 160331 - DNA, 601 bp, Human
ccactgctaccaagaaagcaggtccaacaaatgaataaaagaaacccagccaggcagagaggttcttgtctgtaatcccagcactttgggaggctgaggcaggaggatcgcccgcggccaggagtttgagacaagcctgggcaacacagcaaagccttaaaaaaaatcacctaggctcggtggcctatgcctttactcctaacactctgggaggctgaggtgggaagatcacttgagctcaggattttgagtctgcagtgaactacgatcagaccactgaactcgagcctgggagcaggcygagaccctgagaccctgtctcaaaaagtaaaaaacagaaatgccagtttcctttactcagagctaaaagccttcacctactacccaatcccatcatggctccctcccaaaagttcactggcataccatatcaagtcagcaagcccccttttttgtagcagggtctcactctgttgccaaggctggaacaagccctcttcaacaaagctaagatggtccatattactcatgtggatgagggtgttgaaggacatttactgccttccttcatggtctcacttcatgatcaaaccaagatgca

SEQ ID NO: 160332 - DNA, 601 bp, Human
gtcaagaaatccatctaattactaagtaccgaaattataatactttcaaatgaattcacaaagcaaaacagctgaactaatgatctgtaaggatctcctggcagataaatcctactgggaatcaatacaccactgctaccaagaaagcaggtccaacaaatgaataaaagaaacccagccaggcagagaggttcttgtctgtaatcccagcactttgggaggctgaggcaggaggatcgcccgcggccaggagtttgagacaagcctgggcaacacagcaaagccttaaaaaaaatcacctaggctcggtggcctatgcctttactcctaacactctgggaggctgaggtgggaagatcacttgagctcaggattttgagtctgcagtgaactacgatcagaccactgaactcgagcctgggagcaggccgagaccctgagaccctgtctcaaaaagtaaaaaacagaaatgccagtttcctttactcagagctaaaagccttcacctactacccaatcccatcatggctccctcccaaaagttcactggcataccatatcaagtcagcaagcccccttttttgtagcagggtctcactct

SEQ ID NO: 160333 - DNA, 601 bp, Human
tctccccttcctgtaattcaggcctgcaatataatttcttagtcccccaaggaaaacagaactaaagacttctaacagaagatctcagtctactaacatagctaatagctattaaagctactcaggcatcggcttaataaaaaactaaagggctgcagcaagtgatcagattttcaccactcatctttgtgagatgggtctcagagggccccgtccctgctgacaccaaccattcttaccggtagcctgccaacacacaagcagttcacagtagaacactgcagactgcagggcattttcwggctacatagcctcaagttcctagaacaggaactgaggcttggaagaaggtcagtgcagcgcactcagcgaatggataaactgaatcatcatttcacaaggctgcaagcccatgtactaatggaatcaacatggaaccagagttaaattactgccttaaatatctaatgcatgtcaagaaatccatctaattactaagtaccgaaattataatactttcaaatgaattcacaaagcaaaacagctgaactaatgatctgtaaggatctcctggcagataaatcctactgggaatcaatac

SEQ ID NO: 160334 - DNA, 601 bp, Human
acctatctgtgttcaatctcagctttagattatggcactggtttgtgagaaacaactggttcaactaactataagcaatatattaactctgcttttttttttttttttgagacggagtctcactctgttgcccaggctggagtgcagtggcacagtctcagctcaccgcgacctccacccccggggttcaattctcccagatactcctgcctcagcctcctgagtagctgggattacaggcgcccaccaccccacccagctaatttttgtatttttagtagagacagggtttcaccatgttggtcaggctggtctctaactcctgacctcgtgatctgcccgcctcagcctcccaaagtcctgggattataggcgtgagccaccgcacccagcccaactctgcttttacaggtattggctctcattccctagccattggttctccccttcctgtaattcaggcctgcaatataatttcttagtcccccaaggaaaacagaactaaagacttctaacagaagatctcagtctactaacatagctaatagctattaaagctactcaggcatcggcttaataaaaaactaaagggctgcagcaa

SEQ ID NO: 160335 - DNA, 601 bp, Human
ctttcaaactatctgttcctagcctctagggattttgttttgttatgcttcattccactgcctaagaaactaagattttgccagcaagagggccaatatgacaaatcatcgatgattcttagcatggagccaagaagcctgcctccttgatcagattttcagctggaaagatatccacaccttgcctagtccaatatttgttaagtgagaatataaaattcaaagatgttctgtcacactctagatttgtattaatgtccacaaacattaaagattcacatgatacatatttaggaaacayatgctactttgttactgtttgaactctcaggaaacaatgttcccattggtgctccgaattgttactattctctgccatcctgaagataactaatacgtacctatctgtgttcaatctcagctttagattatggcactggtttgtgagaaacaactggttcaactaactataagcaatatattaactctgcttttttttttttttttgagacggagtctcactctgttgcccaggctggagtgcagtggcacagtctcagctcaccgcgacctccacccccggggttcaattctcccagat

SEQ ID NO: 160336 - DNA, 601 bp, Human
tatgtacttaagcagcacatgctacagtgtcttctctttcaaactatctgttcctagcctctagggattttgttttgttatgcttcattccactgcctaagaaactaagattttgccagcaagagggccaatatgacaaatcatcgatgattcttagcatggagccaagaagcctgcctccttgatcagattttcagctggaaagatatccacaccttgcctagtccaatatttgttaagtgagaatataaaattcaaagatgttctgtcacactctagatttgtattaatgtccacaaayattaaagattcacatgatacatatttaggaaacatatgctactttgttactgtttgaactctcaggaaacaatgttcccattggtgctccgaattgttactattctctgccatcctgaagataactaatacgtacctatctgtgttcaatctcagctttagattatggcactggtttgtgagaaacaactggttcaactaactataagcaatatattaactctgcttttttttttttttttgagacggagtctcactctgttgcccaggctggagtgcagtggcacagtctcagctcacc

SEQ ID NO: 160337 - DNA, 601 bp, Human
aagtgaaactccacaatctctgatctgttagattggggctagttgaacagtcatttaaatctaatagtcatttgtatacaatgtaagacatggatacaatatgcagtgctagcctgtattttcctatttgaatatcccacataaattactacagataggataaaaaagacacatatctatttaaatgacttcctagtttccattccaaaagcagaagatatgtacttaagcagcacatgctacagtgtcttctctttcaaactatctgttcctagcctctagggattttgttttgttatgyttcattccactgcctaagaaactaagattttgccagcaagagggccaatatgacaaatcatcgatgattcttagcatggagccaagaagcctgcctccttgatcagattttcagctggaaagatatccacaccttgcctagtccaatatttgttaagtgagaatataaaattcaaagatgttctgtcacactctagatttgtattaatgtccacaaacattaaagattcacatgatacatatttaggaaacatatgctactttgttactgtttgaactctcaggaaacaatgttcccatt

SEQ ID NO: 160338 - DNA, 601 bp, Human
cataaaaaacaaacccaacaacccagcctgagcaaaacggtgagacctcatctctatttcagaatttttaaaaaatttttaaaaacctgacttttgtagatttcccttgaaactactggatcacgtatccaaagttttaggtaaagtttcagttcatgatgtacttccctaccaggtcaatccttacaatacggattataatcagccttcacggtaaacaagcacggcttcatttggaaagcacattttcaactgttttaaaaaatcgcagtgcttttggtaagagagccaaggcacttcyctaaaaggagaaaagtagttacggaatccctgtgcatttcctcacctattcatcagcttcccagctggggcacatcagacactggctgcaggacaaccctgcagctgttgagctcctgcccaccagtcttcataaactcacttttggtccaaatttcacttacgactctaccagcaaagctgcctcttcaaaaggtttaatggcttacagagggcaaagggcacctggatgactgaacaacacaaaaggcaagattctaaaactcagaacccaccaggagaacagaaaaaatacagtttt

SEQ ID NO: 160339 - DNA, 601 bp, Human
ggaggctgaggtaggagaatcgcttgaacccaggaggcagaggttgcagtgagccgacatcacgcgactgcactccagcctgggcgatgagagcgaaactccgtcttaaaaaaacaaacaaacaaaaaaacacacacaaattagcctggcatggtggcgtgcgcctgtaatcccagctactcaggaggctgaggcagaagaactgcttgaactcgggaggaggaggttgcagtgagccaagatcgcaccactgcacttcagcctgggcaacagagcgagtctccaaaaaaaaaaaaaaaaactacacataaaaaacaaacccaacaacccagcctgagcaaaacggtgagacctcatctctatttcagaatttttaaaaaatttttaaaaacctgacttttgtagatttcccttgaaactactggatcacgtatccaaagttttaggtaaagtttcagttcatgatgtacttccctaccaggtcaatccttacaatacggattataatcagccttcacggtaaacaagcacggcttcatttggaaagcacattttcaactgttttaaaaaatcgcagtgcttttggtaagagagccaaggc

SEQ ID NO: 160340 - DNA, 601 bp, Human
gctttagaaccaagtccagccttgggcatgccggacctttaccatgcaaagttttacctcttttccagatcccttaggtcacttgtaagaatcaaattgaaaatatacctactctcaaataatttaagttttaaaactgacttctggctgggtgtggtggctcacgcctgcaatcccagcaatttgggatgccaaggtaggcagatcacttgaggtcaggagatcgagaccagcctgaccaacatggtgaaaccccgtctctactaaaaatacaaaaagtggccaggcacggtggctcacrcctgtaatcccagcactttgggaggtggaggcagctagatcacaaggtcaggagatcgagaacatcttggccaacacggtgaaaccccgtctctaccaaaaatacaaaaattagctgggcatggtggcgcacatctgtaatcccagctactcaggaggctgaggtaggagaatcgcttgaacccaggaggcagaggttgcagtgagccgacatcacgcgactgcactccagcctgggcgatgagagcgaaactccgtcttaaaaaaacaaacaaacaaaaaaacacacacaaattagcct

SEQ ID NO: 160341 - DNA, 601 bp, Human
ttgaagggctcagagtactccttagccctgctggccaacacttgagtctctgacttaggccacagatgttacaatgcttacagtggccgtttacaacagttaacaaagcaggctttagaaccaagtccagccttgggcatgccggacctttaccatgcaaagttttacctcttttccagatcccttaggtcacttgtaagaatcaaattgaaaatatacctactctcaaataatttaagttttaaaactgacttctggctgggtgtggtggctcacgcctgcaatcccagcaatttgggakgccaaggtaggcagatcacttgaggtcaggagatcgagaccagcctgaccaacatggtgaaaccccgtctctactaaaaatacaaaaagtggccaggcacggtggctcacgcctgtaatcccagcactttgggaggtggaggcagctagatcacaaggtcaggagatcgagaacatcttggccaacacggtgaaaccccgtctctaccaaaaatacaaaaattagctgggcatggtggcgcacatctgtaatcccagctactcaggaggctgaggtaggagaatcgcttgaacccaggag

SEQ ID NO: 160342 - DNA, 601 bp, Human
atgtgattgcagaggctataccaacgactctactgatcttaggcttatctgtcaaggtcaggcaggcccaagaacaggaataaacagagccaggcctaagaagtagccatggtctctggaggagacataggacagctcacaggacaggtctaaggtgcctttcccagagctcaaaaactgccacatttcctaagattccatttcctaaagtcacaaaccctgacttctagcactgctcaaatgaatatgctgacagttccattttcgctcacaagcccagcaaactcagtgagcctgtgarctccacatgggatacccttggaattcgaataggaggacccaagggggatgtaatcaagtaaatggagctcatttgtgcaccacagttaaagctgcaatggatgctaccagctgctttagctgcttttcgttcctctgaataattatcttctcttttcgtccctttccccatgtagaggtaatacccccgactatacctgtcttcctttctggttagtatagaaacatattttttgtttcagaatgtgatgaagacaaaaagaagaaaaccactaggttatgagtgactgcaaccacagca

SEQ ID NO: 160343 - DNA, 601 bp, Human
agattacaattaagaagatgaggtatttcactccaaatttccctttgggtccctttcttcaaaataaaaagttcaagactaaaaacttatgtacttaacctctaaaacttgaaaatctggtcaatcagctataaaaagactaaatatattcactaaaagcacatggattacttaagtttcaagtactccctttttccttaagcactgtatatttataattctgaaagccagagggagcctattacaatggctttcctccaaaaaattaagctcaagtagtcaccagaagttgattttaacmtcaactattagtaagatcaaaacagatacttttgagtcctcacatctcaacctaagtatttttcttccacatgaattcttgataactcctatgaaatatctgcttgtctggcttaattttcacatgtccatttgtgagatctctgcaaacaaagataaagcttcaaggtctgcgacttcatttgatcataactgactccagctttggcgtattttctgataagagcttccttccttctgctaagttaacactggcaaatacagcctttaaaaatacctcaaatcattaactgagatgtga

SEQ ID NO: 160344 - DNA, 601 bp, Human
gtacattaaagcagacaaggtggtggtcaatctgaaaacctgacacacaaggcacgaggaactcatagcgtaagcatctcattgccccattccttttactgtaaggagtgctaaagtaaagttgtcataacactggattacccaaagcacggaatgccaagtgaagattacaattaagaagatgaggtatttcactccaaatttccctttgggtccctttcttcaaaataaaaagttcaagactaaaaacttatgtacttaacctctaaaacttgaaaatctggtcaatcagctataaaawgactaaatatattcactaaaagcacatggattacttaagtttcaagtactccctttttccttaagcactgtatatttataattctgaaagccagagggagcctattacaatggctttcctccaaaaaattaagctcaagtagtcaccagaagttgattttaacatcaactattagtaagatcaaaacagatacttttgagtcctcacatctcaacctaagtatttttcttccacatgaattcttgataactcctatgaaatatctgcttgtctggcttaattttcacatgtccatttgtg

SEQ ID NO: 160345 - DNA, 601 bp, Human
gttcagagtaaacctgggactgtttcaaatagccaaggaatctagacaggaggggtgaattagaaaaaccaaccaaggccttacttaattagcacaatcccactgtggttacacatgagcaacaagtgtgagcatcactctgaatactcaattaactgattttctgagctggaaattgagaggaaaaaaactacctaactccatttctgcccgtcaaaaaaaaaaaaaaaaaaaagagaggagagaacagtggcagcactaataggaactgggctattagggaaaagtgacttaaataaargtacattaaagcagacaaggtggtggtcaatctgaaaacctgacacacaaggcacgaggaactcatagcgtaagcatctcattgccccattccttttactgtaaggagtgctaaagtaaagttgtcataacactggattacccaaagcacggaatgccaagtgaagattacaattaagaagatgaggtatttcactccaaatttccctttgggtccctttcttcaaaataaaaagttcaagactaaaaacttatgtacttaacctctaaaacttgaaaatctggtcaatcagctataaaa

SEQ ID NO: 160346 - DNA, 601 bp, Human
tcagttgagctgggcgcggcggctcacccctgtaatcccagcactttgggaggccaaggcgggtggttcacagggtcaggagatggagaccatcctggctaacatggtgaaaccccgtctctactaaaaatacaaaaaattagctaagcgtggtggcgggcacctgtagtcccagctacttgggaggctgaggcaggagaatggcctgaacactggaggcggagcttgcagtgagctgagatcacaccactgcactctagcctgggcgacagagcgaaactgtctcaaaaaaaaaaaaaaagaattaaaaattaaaaaaaagaaaaagaaatgtcagttgagacatttctaagtttatgtgaaactgaggggaaacccattcttcacatgcattggtatatccgaagtattcctgtaatgtaaacaacagctacaataatgtcatgtacaatacatttggccaaatacctgactgtacactaaggcctgaactaaatagaacaaaatcttgaattcttacataaatgccaaagtacaatgaacattcaagaggcattaaccaggccacacaaatatctgaaaggaaaacctggggagatgg

SEQ ID NO: 160347 - DNA, 601 bp, Human
tctgaagcgagggatcaacattcaggtccacagatacagatctcagctgaaatacattttttgcgtattagtttcaaactcatttggccctaaaaaattattccaaaaatgagtagttactaaaaagcagtttatacatagatcatttagaaatgtcagttgagctgggcgcggcggctcacccctgtaatcccagcactttgggaggccaaggcgggtggttcacagggtcaggagatggagaccatcctggctaacatggtgaaaccccgtctctactaaaaatacaaaaaattagctragcgtggtggcgggcacctgtagtcccagctacttgggaggctgaggcaggagaatggcctgaacactggaggcggagcttgcagtgagctgagatcacaccactgcactctagcctgggcgacagagcgaaactgtctcaaaaaaaaaaaaaaagaattaaaaattaaaaaaaagaaaaagaaatgtcagttgagacatttctaagtttatgtgaaactgaggggaaacccattcttcacatgcattggtatatccgaagtattcctgtaatgtaaacaacagctacaataatgtcatg

SEQ ID NO: 160348 - DNA, 601 bp, Human
aatctcttctcacatccactgtgaataacaaggctgcaacctagcactgtatgtattaccactgcatgttacttacctttgtgtgcactgtaaatttgactttgtctctctcactgagcgcatcaggtatgtcaatctgaagcgagggatcaacattcaggtccacagatacagatctcagctgaaatacattttttgcgtattagtttcaaactcatttggccctaaaaaattattccaaaaatgagtagttactaaaaagcagtttatacatagatcatttagaaatgtcagttgagcygggcgcggcggctcacccctgtaatcccagcactttgggaggccaaggcgggtggttcacagggtcaggagatggagaccatcctggctaacatggtgaaaccccgtctctactaaaaatacaaaaaattagctaagcgtggtggcgggcacctgtagtcccagctacttgggaggctgaggcaggagaatggcctgaacactggaggcggagcttgcagtgagctgagatcacaccactgcactctagcctgggcgacagagcgaaactgtctcaaaaaaaaaaaaaaagaattaaaaa

SEQ ID NO: 160349 - DNA, 601 bp, Human
cccagcactttgggaagctgaggcacgtgcatcacctgaggtcaggagtttgagccgagtgtggtggctcaggcctgtaatcccagctactctggtggctgaggcaggagaattgcttgaacccgggaggcaggggctgcagtgagccaagatggtgccacttcattccagcctgggcaacacaatgagactgtctccaaaaaaaaaaaaaaaaaaaacaaaaaaacaatgcccacagcccagggctctgccacagcagaatgctgctgccgccacaatggcactcacctgatgcttactrtgagatagattagggaggttctcacttaatagtgctaccctacgaatagcaactgtttcaagctcagggaatctcttctcacatccactgtgaataacaaggctgcaacctagcactgtatgtattaccactgcatgttacttacctttgtgtgcactgtaaatttgactttgtctctctcactgagcgcatcaggtatgtcaatctgaagcgagggatcaacattcaggtccacagatacagatctcagctgaaatacattttttgcgtattagtttcaaactcatttggccctaaaaa

SEQ ID NO: 160350 - DNA, 601 bp, Human
tctactggtagaagttcagttctaagaaataagccacaaccctaattctatttttttgtttctgtgtacttttttttgtttatatacatttttgggacagggtctggctgtcacccaggctggagtgcagtggaatgatcttggcttcttggctcactgcaacctctgccttccaggctcttaagccatcctcccacctcagcctcctgagtagctggaactacaggtgtgtgctaccacatccggctaatttttatatttttggaagagacaggtttttgccatgttgcccaggctcaarcgatctgcccatcttgtcctcccgaagtgctaggattacaggtgtgagccacccaacccagccccaaattctatttttgtaagtctgaatttaccccccacccccaacttatgacaaagaagaaaaataaattttaaaaaaacctcttagctgtaacttactatggttctaaaaattgtccctggcttccttccttttcactccagtgaatgctgattttacctcctttgatctggtaagctcaggcagagaattatgtcaccagtctttttacactacctccggaataactgaagtgtg

SEQ ID NO: 160351 - DNA, 601 bp, Human
ttttttgtatttttagtagagacagggtctcatcatgttgcccaggcacgtcttaaaattctgagctcaggtgatccacccaccttggcctcccaaagtgctaggattaaaggcatggcctccttcagcaacttttgagaaatcttatcacaaactattaccaatagcagtgtttcctagaaatcaattctactgacataggaaaaaacataccagagaaaaaccaaacctaaaggtaggtaagactaaagtcattacactgttcacacccctttacaatgtaaataatgtaagcctgtaygcaccacctcaaagctgtaacactattccttcacatactttccacttgacagtcagcaaatactccagtaggtagatgaaatctaacttttcacaatccattaaaaaaagtggatataagtctcttttaaactaatgcatagcaaggcagaaagaactagcttatttgattttctaaaagactcacaataagcccagcatagtctgttgtttcaataagagtgtcatgtagccacacaaagtcttcatgttgccttgtaacagaaaactctgggctctgaaacgtgggcagtgtggtctg

SEQ ID NO: 160352 - DNA, 601 bp, Human
ttggcaaattcttctttggtcatagacccttcaccttctcccagtttctgcatcttctctcgaggaccatcaaagtcgggcttcgtaggagcaggtggaatctgcagcagaggcaggaactcatgagcctcttgtcccagcagcgatgttttctagttggtgcctcattctactcttgctggtccacaggagacaaccactccactcctgtggggctatttaaaagtcaactcctgttttttcttaaccttccttaactcttctggacatttaaaatgaggtgtcttcctgagagttgcayattcactttgatggcaatcatttgttcagtttatccattatagacaattgttcagagcacaacagtgtctatactgcttcagtgttcgcctaaaactagtacaacgaatgctaagcaccaaagatgagccatcaagattataaagtgttcagtattccaaaggaattttttcctaatcccaaaggataatcaaggactctaattttgaatgaaagacatatctaaatataagcttcggtattaattttgtttaatgattaagcaatcatcatttggagagcttcttcagtctgcctggca

SEQ ID NO: 160353 - DNA, 601 bp, Human
tgccctagatgacacaggggtttggagagggggagctgatggttgaagaggggaggaatgagtacttttcagctaagatgaggaaatgcaaggatggattcataagaaactttccaaaaatctatttttgtttgaaaaaattaaatgacaaccagattaaaatatacttgctgcctgtagacctggacttcctctttcaaattatctatgtgatggttactgagaatgctactctataacagcactatttggcctggcccaggggcagctcactataatctcagcactatgggaggcaaargcaagctgatcacttgaactcaggagttcgagaccagccggggcaacacatgacgaaacccccaactctctagtttcttctcaacgtctagtaaccaagcttccgaaagaaaagctttgtacattatgagcaatttataaaggcacaaaagtttatttcctcactgtgccagaccagcatccttaataagtatgccctacatatgggaaaagacaactactctatcgggtattagtgtcaatggcctccaatgaatcaatgtgtgaagtacaaagaccatgtcccacactatgcaagatg

SEQ ID NO: 160354 - DNA, 601 bp, Human
gttaacaaaaattacaaagcagctttatctcaacctagacattaaaagtcaccttaaaattcctaacggtagaaacttggatctgttgtgttcagtgcctcattccccagagctggtcccgagagccactcaagtgtgtgctaaatgctttcagggcctggaggtttgagtgctgccctagatgacacaggggtttggagagggggagctgatggttgaagaggggaggaatgagtacttttcagctaagatgaggaaatgcaaggatggattcataagaaactttccaaaaatctatttytgtttgaaaaaattaaatgacaaccagattaaaatatacttgctgcctgtagacctggacttcctctttcaaattatctatgtgatggttactgagaatgctactctataacagcactatttggcctggcccaggggcagctcactataatctcagcactatgggaggcaaaggcaagctgatcacttgaactcaggagttcgagaccagccggggcaacacatgacgaaacccccaactctctagtttcttctcaacgtctagtaaccaagcttccgaaagaaaagctttgtacattat

SEQ ID NO: 160355 - DNA, 601 bp, Human
gacacagctcaactacctgaccaataccactcctgattaattctatggccctgctcatgccaccacataaaacactgcaactggaccaaacagtatttcagtataaactggtgtctagttagatactaaggcagttgccatttttgaatctgtggaataagactatggaggaaagcaatgttgtaactggatttgatgggtcaagtccatgagctcctaaatctacatgcaattactgttacttagtagccacagaacatttgtttctttaaagcaatgagaaccctttaactgcagcctragtatacagcatgagtctaatgaagctaaaagttaacaaaaattacaaagcagctttatctcaacctagacattaaaagtcaccttaaaattcctaacggtagaaacttggatctgttgtgttcagtgcctcattccccagagctggtcccgagagccactcaagtgtgtgctaaatgctttcagggcctggaggtttgagtgctgccctagatgacacaggggtttggagagggggagctgatggttgaagaggggaggaatgagtacttttcagctaagatgaggaaatgcaaggatg

SEQ ID NO: 160356 - DNA, 601 bp, Human
atggaataaaaatgccttacatcctgatcatattccaggaaaacatgaaagttgcgatctttactgagaacagggtgagaagaaagccgctgaagaaagacttcatgggaggacacagtcttcttaaacacagcgagatactcactgaaaagagatgtgcacatggcattcagttgacacagctcaactacctgaccaataccactcctgattaattctatggccctgctcatgccaccacataaaacactgcaactggaccaaacagtatttcagtataaactggtgtctagttagatamtaaggcagttgccatttttgaatctgtggaataagactatggaggaaagcaatgttgtaactggatttgatgggtcaagtccatgagctcctaaatctacatgcaattactgttacttagtagccacagaacatttgtttctttaaagcaatgagaaccctttaactgcagcctaagtatacagcatgagtctaatgaagctaaaagttaacaaaaattacaaagcagctttatctcaacctagacattaaaagtcaccttaaaattcctaacggtagaaacttggatctgttgtgttca

SEQ ID NO: 160357 - DNA, 601 bp, Human
taacgcggtgaaaccccatctctactaaaaatacaaaaaataagccgggtgtggtggtgggcacctgtaatcctagctactcgggaggctgaggcaggagaatggcgtgaacccagaaggtggagcttgcagtaagccgagatcgcgccactgcactccagcctggatgacagagcgagattctgcctcaaaaaagaaaagaaaaaagtcataattcaacaaaaagcgtaggtgggaagaaaataaattacacaaattttaatttccttaaaatgaacttagttaagtttggaattgttawgaaattaactaagggatgtttgggactgttaatttcttaaaaagaaacctaggttttggaaggggaaagaagtcaaaattttctttaagcagagttttacaaaaaatgacttacaatgaaggaaaagcagcatctaaaaaggtttccattgtgtaagaaattcaaaactttaaagcagtagaaactatcaagtacattttgaaagtataaacatttgaagtggattatcaaaatggaataaaaatgccttacatcctgatcatattccaggaaaacatgaaagttgcgatctttactgag

SEQ ID NO: 160358 - DNA, 601 bp, Human
attttctccaacagccaaaggtcacttaccttaactccagtaaaaaggacttcatcagcacttttcaccacacttttgaagaagccaccaaacatctctttagtatttttccgcctaacacttagctaaaagaagaaaattccaaagagtttatatggtatggatttttctagattctcttaaagaagttctgagtaacattttaagtaatcctctttatcagtacaggcaaatgcataaagtatctttaattctgccttaacctccaagcttaaaacacctaatggctaaacccaaacayaggtaggtcatctcattctaaaaggcttgacagattttgaaagactgactagaagctaagtcttagtggctctgaaatccttgggaaaattactgttctcttctatccatattaagtagcaaaaaccaaaacatgttaaaaagaaaaatagcataaaagtcataattcgcggccgggcgcagtggctcacgcctgtaatcccagcactttgggaggccaaggcgggcggatcacgaggtcaggagatcgagaccatcttggctaacgcggtgaaaccccatctctactaaaaatacaaaa

SEQ ID NO: 160359 - DNA, 601 bp, Human
gagaaaatgaagccaagtgtggaaaggttcaagttgcttctcctgggacagaacaaggtgctctgggaaataagtgaaaattgaataagtagatgaaaattaccaaaatctgaagaacacttacatgtcttaaaagttaaccatttgtttcacaagtatctctttcaaagaaacaaaaggtcacctattcccgatgaagtaaaaaattttctccaacagccaaaggtcacttaccttaactccagtaaaaaggacttcatcagcacttttcaccacacttttgaagaagccaccaaacatytctttagtatttttccgcctaacacttagctaaaagaagaaaattccaaagagtttatatggtatggatttttctagattctcttaaagaagttctgagtaacattttaagtaatcctctttatcagtacaggcaaatgcataaagtatctttaattctgccttaacctccaagcttaaaacacctaatggctaaacccaaacataggtaggtcatctcattctaaaaggcttgacagattttgaaagactgactagaagctaagtcttagtggctctgaaatccttgggaaaattactg

SEQ ID NO: 160360 - DNA, 601 bp, Human
gctgggaaaaatcaagggctggcagaaaatgtctacagaagaatcacttaacaaccaccagtaaaactggcaccctaagacacagcaattttacgctagtacaatggttctaccaggtggaacatggccacttagccttggatacctatctgtgtgtgaatgaggtttttttttctcgattggtttcagactgggaggaaatcctggtatctggtaggcattggccaaggatgccaatgccaaatatcccataatgcatggatacaggacagtcccatacaccttaaactggaccaagtcygagtttcctaatttctgatgatgccctctctacttagcacctgtattctgggctccctggagtggcaaagccagataccagacagtaattgtaagggtaactcagttacaaaggaatgagaaggcccgagaagtagtaaagtaaatcatacctctaacggtaacggaaacgttattttgtattcttgtctttgtgctaacgccttgaaatccagtatgtaaataaaatctaaagtttggttccttagttgtgccagctaggttgcatgtcaagtgcttctctatcacctgtagttggtga

SEQ ID NO: 160361 - DNA, 601 bp, Human
taaatgccaatgctgtgtaaaccaaggttggtttctaatgagctatgctatgggcatcacaaagcagtaaatatgctatttaattcgtcatggttctgccattagcctttcaatttcgagtcagaagtagtatcacctgttttgccaagcctggatgttaagtaaaatattgtcttacaccagaaatgcccaggatggagaaactgaaacacatacataagtgcagagtgaaaatggaagggtttttaattaatgaatgaaggtaatttcagaaaattgtacatcaaaacagctgtgtgtyagactggggtcattaaattattctcatgaccactataaccaaatctcttcaaggtccagggcaggggcacatgttctcaggatctcctgaggctgcatcacaggccaaaaaaaaagaaggtctagggcattaccaggcaaaattgcaagcaccaattgccaggggaagatgcaagataaactcttacaaactccaaaactaaagaaaacaggcttttaagtgtgacagaaactactgctttgacaacatttactgtatttgtttacatatagaagagcccaagtcccctacaattgtctt

SEQ ID NO: 160362 - DNA, 601 bp, Human
ataaaacatgatcttaccagtgtgcaagacaggaatgggtcaactcaggagtcctagcctttggtactttagcattaatttaaaagtagtgctctcacttcaactgaccccaaatagtagagaaaatggtcacaaaattacacacatgtacagcaccacactcagcctcttggtgacccttcggtcatcctgccatgcgcccaaatattcttattaaatgccaatgctgtgtaaaccaaggttggtttctaatgagctatgctatgggcatcacaaagcagtaaatatgctatttaattcrtcatggttctgccattagcctttcaatttcgagtcagaagtagtatcacctgttttgccaagcctggatgttaagtaaaatattgtcttacaccagaaatgcccaggatggagaaactgaaacacatacataagtgcagagtgaaaatggaagggtttttaattaatgaatgaaggtaatttcagaaaattgtacatcaaaacagctgtgtgttagactggggtcattaaattattctcatgaccactataaccaaatctcttcaaggtccagggcaggggcacatgttctcaggatctc

SEQ ID NO: 160363 - DNA, 601 bp, Human
ccttcaataggtacctggaaatgtacatataattttggtttaaggtcttaaatcatctataaaacatgatcttaccagtgtgcaagacaggaatgggtcaactcaggagtcctagcctttggtactttagcattaatttaaaagtagtgctctcacttcaactgaccccaaatagtagagaaaatggtcacaaaattacacacatgtacagcaccacactcagcctcttggtgacccttcggtcatcctgccatgcgcccaaatattcttattaaatgccaatgctgtgtaaaccaaggtyggtttctaatgagctatgctatgggcatcacaaagcagtaaatatgctatttaattcgtcatggttctgccattagcctttcaatttcgagtcagaagtagtatcacctgttttgccaagcctggatgttaagtaaaatattgtcttacaccagaaatgcccaggatggagaaactgaaacacatacataagtgcagagtgaaaatggaagggtttttaattaatgaatgaaggtaatttcagaaaattgtacatcaaaacagctgtgtgttagactggggtcattaaattattctcatg

SEQ ID NO: 160364 - DNA, 601 bp, Human
tttgtttgagttctcatagtcaatgagggctttggtgcgtctgtataagagatcctgggaaaaaaattaacaggtatacatactaagtatctaaaccagtctaaaaaatagcccaagtgccaatgtaccacctgagatgttagtggcaataatctacctctacaccttccctctcccagagtatttttaaatctccagcttcgcagggatgagcaatgctgatagctttgttgagagctttttttagaattccttatatgaatcaagtgattactcaagagtgaaaacagaaggacttttgttttccagtaattcagtaaataaagttaactttaaaaattaaatattgtgtatcagagataacttgaaatatacagtcactgctgggtaagtcaagttgagcgctgctaaaatacaactgggcaatgaagtagtaagaaacataaccctaccctgcaaatcctgcttctggtaatctaccttggagatccacttagtcagatataaagattctttgcaatcttacaacagagtagaagttactttagtatctgaaatgagcaattatgatgtatagattacacatttaaaactaggtgaa

SEQ ID NO: 160365 - DNA, 601 bp, Human
ctacatattatactcatgttcaatagaaatggtgaaagtcctctgctctaagaggtgaaatggataaggcaagaaagaaccctatggatgtggacatggaccggacttgtgatccctgaaacctgcatgtgtgtgcaacggcatatgtgtgcacacacacatacatttcctagctcagtccactgaagggcacagaagcagagataccccgaaacgatgagcatactcagatgctggtaactgttcccaaagaaaaagaaccctggctccttgaaaaaatggccagtttcaaggctggagyagagagtaagattagcatggcctatcactctaaaaaagacgggttaggctgttacaaccacatgccagcttaaaggtgctcctattggcaaagtctggacaggcatcaaaaataacttggtaatacaataatgaattctaaaccattttaaaaactgggagtccatgactctaataaagataaaggaaatttctgagaaaagggaaggcttttttgtagtaggatgacaagtgccaacttgggtaggaaagctagagctagagatgagggaaatcgtctttctgcaatcgtcagagtaac

SEQ ID NO: 160366 - DNA, 601 bp, Human
tccacagaatcctcttaggtaaggactacatattatactcatgttcaatagaaatggtgaaagtcctctgctctaagaggtgaaatggataaggcaagaaagaaccctatggatgtggacatggaccggacttgtgatccctgaaacctgcatgtgtgtgcaacggcatatgtgtgcacacacacatacatttcctagctcagtccactgaagggcacagaagcagagataccccgaaacgatgagcatactcagatgctggtaactgttcccaaagaaaaagaaccctggctccttgaaraaatggccagtttcaaggctggagcagagagtaagattagcatggcctatcactctaaaaaagacgggttaggctgttacaaccacatgccagcttaaaggtgctcctattggcaaagtctggacaggcatcaaaaataacttggtaatacaataatgaattctaaaccattttaaaaactgggagtccatgactctaataaagataaaggaaatttctgagaaaagggaaggcttttttgtagtaggatgacaagtgccaacttgggtaggaaagctagagctagagatgagggaaatc

SEQ ID NO: 160367 - DNA, 601 bp, Human
aaatagatgaaagatcagtgttagcaacaatgcagagaaaagtgaactcttctacaccgttgctgggaatgtaaattagtacagccaccatggaaaatggtatagaggttcctcaaaaaactaaaaatagaattaccatatgatccagcaaacccacttctgggaatataaaaggaactgaaatcagtatctcaatgggatatccgtacttccatgttcactgcagcattatttacaatagccaaaatacaaaatcaactgagaattatccatcagtggatgaagacaatgtagtatagayacattatactatccggccttttaaaataacaaaattctctcatatgggacaatgtggatggatcttagaggacattatgccaaataaaataaaccaggcacagaaagacaaacattacatgatctcacttacaggtaaaatcttaagttgaactcctagaagtagagaacagaatgatggttatcagaggatgagggtggggtgctggggaaggtgggaaagagaatgggtagaaggctgcagctaaactcaaggaataaattttgagatctactgcacaacagggtgactacagtcaat

SEQ ID NO: 160368 - DNA, 601 bp, Human
ccacaatgagattacctcacacctgctagaatgcattttctcaaatagatgaaagatcagtgttagcaacaatgcagagaaaagtgaactcttctacaccgttgctgggaatgtaaattagtacagccaccatggaaaatggtatagaggttcctcaaaaaactaaaaatagaattaccatatgatccagcaaacccacttctgggaatataaaaggaactgaaatcagtatctcaatgggatatccgtacttccatgttcactgcagcattatttacaatagccaaaatacaaaatcaaytgagaattatccatcagtggatgaagacaatgtagtatagacacattatactatccggccttttaaaataacaaaattctctcatatgggacaatgtggatggatcttagaggacattatgccaaataaaataaaccaggcacagaaagacaaacattacatgatctcacttacaggtaaaatcttaagttgaactcctagaagtagagaacagaatgatggttatcagaggatgagggtggggtgctggggaaggtgggaaagagaatgggtagaaggctgcagctaaactcaaggaat

SEQ ID NO: 160369 - DNA, 601 bp, Human
cattcttacaaatggtctccaatgctttcaggcaccagcattatttcctcacatttgtattatctctgtgactgggacacatcagacatctattaactgtggtgatacagctatcactgtctttaagtggaaaacatcactgaatcaccaagcatcgtgagtgggagagcagcagcttatgacttggagaacacgttgatgagcagcctcactctcaccctctaggtaccagtgactgggaacagggctggagtatgggtggtggtgagccacatacttcaccaatggcttgtgaaaatgyttctcaaaagaagacataccaggttcatgcaaacaacgttcagcagcactagccattagggaaatgcaaattaaaaccacaatgagattacctcacacctgctagaatgcattttctcaaatagatgaaagatcagtgttagcaacaatgcagagaaaagtgaactcttctacaccgttgctgggaatgtaaattagtacagccaccatggaaaatggtatagaggttcctcaaaaaactaaaaatagaattaccatatgatccagcaaacccacttctgggaatataaaaggaactgaa

SEQ ID NO: 160370 - DNA, 601 bp, Human
caaggtttcaccatgttgcccaggctggtcttgaactcctgggctcaagtgatccgcccaccttggcctcccaaagaactgggattacaggactgaaccactggcccggcctgcactggacactttaaatgaatgttctcttatcattctcccaataaccctggaaggatacagctccagtttacagataaaggtgcagaggtaatggttctttctcaaggtcacgctgtcagcaaatggctggacacttaagagtctcttaaccattattctctcctgacccttctggcactgacttccygggagggcaggtaggagtggtgtggaatggccagcaataataatggtaaaatgttgactaccttgggaaagaatgatagtaaatgcacaataataatcatgatggctcacatgtatatccactgttctagagctttccgtgtatgaattcatttaacccccttaataacgtgcctatgcactaagtctggctggtgggcccccattttttgcccccattttacatatgggaaaacttagtcttgggtttttgtttctgtttgttatttttttaaaggatgacttctgagaaaagtattgc

SEQ ID NO: 160371 - DNA, 601 bp, Human
tggcacaatcatagctcactgcagccacaaagtcctggctcaagcaatcatcctgcctcagcctccccagtagctgggattacaggcacatgccaccacgcctgactacaattttcttttattcagcattttccaaatagttgccaatgaacttgtcatattttttgtcatcaagaaaaagttatttatttttctgagacagggtctcattctcttgcccagcctgtagtacagtggtacgattatagctcactatagcctcagtctcctgggctcaagcaatcctcctacctcactcagctcccgagtagttggtaacacaggtgcagaccaccatacctcactaatttcttattttttgtagagatggggtctcactatattgcccaggttagtctcaagttccagggctcaagcaatcttcccacctcagcctccccaagtgctgggattacaggcatgagccaccacatccagctactttttaaaaaagtaatattatatcaagtttcccagagcaattaaattccaccctgcccaagtctctggcccatggagcaaaggttcagtgtgggaaagctctgtggaaagcagccatctt

SEQ ID NO: 160372 - DNA, 601 bp, Human
gtttctctctgtcacccaggctgaagttcagtggcacgatctcggctcactgcaacctccacctcccagattcaagcgattctcttgcctcagcctcccaagtagctgggactataggcatgtgccaccacaccaggctaatttgtttctatttttagtagagatgggtttcaccatgttggtcaggctggtcttgaactcctgacctcaaatgatccacccacctcggcctcccaaagtgctgggattataggtgtgagccaccgtgcccagccaaaaaaaaaaaaagtattattattatttttttttttttgagacagggtcttgctctgtcgcccaggttggagtacagtggcgtgatcacagctcactgcagcctcaacctccctgggctcaagcgatcctcccatctcagcctcccgagtagcaggactacagatgcaagccaccatgcttggctaatttttcttttttctttttttagtaaagattgggtctcactttgttgccctggctagtattgaactcctggcttcaagcaatcctctcacctgtgagcattaaaaaaatttgttttaattagttcttttttttttttctt

SEQ ID NO: 160373 - DNA, 601 bp, Human
cacacacaaaacagaaaatggtacctcttcttgaatccattccagtaactcagacacatccccactcctggaagacctccctctccacccaggcaagccattttgtcttagtttctccagcatcagtgtgttagcattttacaggacttattaagtaccatgtgctagctccaagaatattagatgaacatgattcctgcccccaggatgataggtacagtcaggcagagaagctttccagattagtgacattactgagacttggaacctttccctgaagtggggagaggcacgctaggcrtcatccacactcccacactggctagaggtgtggtccatgaagaccagtccacagcaaggcaacagagattcagctgaggccagtcacagccagctcaaaagccaacagacacctgacatataaaggccagtgacatgggctgggcacagtggctcacacttggaatctcagcactttggaaggctaaggcagaaagactgcttgagcccaggagttccagaccagactgggcaacatagcgagaccccatctctaaaaaaaagtaaaaaattagtggcacacaccagtagtctcagctac

SEQ ID NO: 160374 - DNA, 601 bp, Human
gagctcactacagagataaaacagaatttattctccaagccactcacatgtagagggggctgaatctgcgccagctgctttatacatagtgctcctccagcgcagatgctattattcttcccattttacagatgaggaaaccaaggctcagaaggtaatgggatcggcctaaggtcacacaactggcaaatgcgagatggagaaagtgatgtgaaagtcggcctgactccaaaattcatgtccctttccatgaagcttccctgcctcagcataaagtattggtgaggaagatacacagttrccagagttaaattttctgaatcaagccttaggctttttggtctgccaacagtctcacatattctaagtctgagctatctttgaaaaatggaccttggccacgcgtggtggctcacacctgtaatctcagcactctgggaggccaaggcaggcatatctggatcacttgaggtcaggagttagagcaccaaactggccaacatggtaaaccccttctctactaaaaatacaaaaattagctgggcgtggtggtgggcacctgtaatcccagctactctggaggctgaggcggaagaatcgc

SEQ ID NO: 160375 - DNA, 601 bp, Human
cacacctgtaatcttcgctactcaggaggctgaggcacgagaatctctagaacccgggaagtggaggttgcagtgagctgagatcatgcctctgcactccatcctgggcaacagagccagaccctgtctcaataagtaaataaataaataaaatttaaaaaataccttttttgcccttgctatttgcacaagtgataagttacaaattcaaacagcaaagaagaatataaaaataaaaggaaagccccttcaacccaacccttaagccccactccctttcccagaggcagccagtattacyggctggttgtgtagcctcccagagtattttctggtcatttgtatacgccatgtctcttttttgttcttttcctaccattaggttcccagagcccagcacaacgcccagcgtatactaggcgctcaattcattatctactgagggagagtaaataagtggcaaacgaataaagatgacaggctgggtgtggtggctcacgcctgtaatcccagcaatttgggtggccgaggcaggtggatcacttgaggtcaggagtttgagaccagcctggccaacatggtaaaaccccatctctactaa

SEQ ID NO: 160376 - DNA, 601 bp, Human
atattttatatatatagggtttctttctttcttttttccaagcagcagtagtaatcgtgcaatttaaaactatttttaaaacatcaagtccatcaacccctgtgagccactgccccacccttgggatgtgttcccttaaacttggctcgtaaagaattttctcagatgctaactcacagccaaaactcgtggctgaagtgattcatgaaatacctttgaaaaaatgtccctgtttccatttttcatccaccgtgtgaggggggaggcgggcagagagggagaacttgaacccacaaggtcytgcctccgtgggctgcagtgatgttgtgccgctttgggtatggaaggtgaaagctgaaaaccgtaaaccccagtgcagcattagatggggcaagaggcttattccctttttctgatgtcagcaaagaattaggactcttggattccctcctaagaggccccaatttttaattaaaaaaaaaccttggccgggtgtggtggctcttgcctgtaattccagcactttgggaggccaaggaggccagaagttcgagaccagcctgggcaacatggcaaaacctcatctctactaaacatacaa

SEQ ID NO: 160377 - DNA, 601 bp, Human
gtcagctgacagtcacaaggatccaaatcagtgacttcaaaccttttgcttttttttttttttttaaagaaactgggtctcgctctgccacccaggcaggagtgcagtggcgccatcatagctcactgcaccctcgacctcctgagctcaagcgatcctcccacctcagcctctagctgggactatcggcatgcaccaccacatctggctaatttattatttttattttttcttttagagacagggtctttctatgttgcctaggctggtctcaaactcctggcctcaagcaatcgtcccrcattggcctcccaaagtgctaggattacaggtgtgcgccaccacaccaggccaattccccttctatctcacgagggcacaaacacagtaggaactctgcattgttatgtagccaccatatattttcatagaatatggaattagtcatcaatcaactcaattgataaatacattctaaatttagtttatgaaaccagcttttgtaacccctaaacatctctgttggtgtctagccataaacctacagaatgaaagtcagtgtaaccctgcagcattagcctaaaataattatgctgcctta

SEQ ID NO: 160378 - DNA, 601 bp, Human
tggccacagccgctgtctggactctggtacagtgacaccctcctggagactccaggtcccattccttaccctggcaccttcaggccagggtgggaatagctcccctctatggccaagcctgggtactgcattcactctcgctggtttcccaaaccctgcccacgcctttgctgttgaagctgtcctaaattctcctctgattactgagtttggaaacactttctgcctcttactcgggccctaatggatacatctgactgcatgaaagatatgagtcataaacacatggaccccatagtcwatgtcagctgacagtcacaaggatccaaatcagtgacttcaaaccttttgcttttttttttttttttaaagaaactgggtctcgctctgccacccaggcaggagtgcagtggcgccatcatagctcactgcaccctcgacctcctgagctcaagcgatcctcccacctcagcctctagctgggactatcggcatgcaccaccacatctggctaatttattatttttattttttcttttagagacagggtctttctatgttgcctaggctggtctcaaactcctggcctcaagcaatcgtc

SEQ ID NO: 160379 - DNA, 601 bp, Human
tgaaccttgaaggcatcatgctaagtcaaagaagccagacacaaaaggacacatattgtgtgattccatttatatgaaatgtccacaacaggcagatcttctgggacagaaaggagaatggtggttgcctagggccggggcggataggaggaattggggagtgatactcatgcgcatggggtttctttcagggaaacgaaaattttccaaagttgactgtgaagatggctgcaaaattctatgtatactcctcatcattgacttgtacaccttaaaaaggtagggttttttgtttgtttggttgtttgtttgtttgtttgtttgtttttgagacaaggtctcgttctgttgcccaggctggagtgcagtggtacgatctcagctcactgcaacctctgcctcctgggttcaagcaacctctgcctcctgcctcagcctcccaagtagctgggactacaggtgcatgccatcatgcccggctaaatttttgtatttttagtagagactgagttttgccatgttggccagactggtcttgaactcctatcttcaagtgatccacccacctcagcctcccaaagtgctgtgattacaggcatga

SEQ ID NO: 160380 - DNA, 601 bp, Human; identical to SEQ ID NO: 18179

SEQ ID NO: 160381 - DNA, 601 bp, Human; identical to SEQ ID NO: 18180

SEQ ID NO: 160382 - DNA, 601 bp, Human; identical to SEQ ID NO: 18181

SEQ ID NO: 160383 - DNA, 601 bp, Human; identical to SEQ ID NO: 18182

SEQ ID NO: 160384 - DNA, 601 bp, Human; identical to SEQ ID NO: 18183

SEQ ID NO: 160385 - DNA, 601 bp, Human; identical to SEQ ID NO: 18184

SEQ ID NO: 160386 - DNA, 601 bp, Human; identical to SEQ ID NO: 18185

SEQ ID NO: 160387 - DNA, 601 bp, Human; identical to SEQ ID NO: 18186

SEQ ID NO: 160388 - DNA, 601 bp, Human; identical to SEQ ID NO: 18187

SEQ ID NO: 160389 - DNA, 601 bp, Human; identical to SEQ ID NO: 18188

SEQ ID NO: 160390 - DNA, 601 bp, Human; identical to SEQ ID NO: 18189

SEQ ID NO: 160391 - DNA, 601 bp, Human
tttcatttaccaagagctgttgccaaaaaaaaaaaaagcattcatcggctgtgacttatgggaagaaaaagagaaagggtttccctacagggagagagacagcagagaaagaagagaaagctgtgccttttgttccctgggagaatggagaatgccgaactcttcgtaccttctctccactagaaaatgtattctccaggttgcccaatggcgccaaccacatgtgaaggttatcagaaaatgggacagagggggctcattctccccatttccatgtgcctggcattctacgggcaggaakgctggtggagggaggtgctgggttgctgctggcttacctgggtaatttgaggggtatgtggggaggagaaagttgaggaatccactttcctacctttgcattcttgacattctgtgcagctccatgtcatcactgccccgaaatcctttggcaaagggattattctcaatctttaattgcgtgatctgaaggaaagaggaagagagaacaagctggttttcacttgattgctgcaagaccacctcaggacatgagctaataataaatatcatggaaatgcagcctctggcaaccaaaaga

SEQ ID NO: 160392 - DNA, 601 bp, Human
ccctggaggagaccagaactgaatttgggtctccattagttaggaggctggtggtggctagaattagcaccctggcagaagggggctgaattccgagttatgctggaaggtataatcagtaggaggtggtaactggtaaagtttgaagggatgattcaacacaccttaaatctattattcaccccctgcccttgaccttgtaaaaaggagggaagaagtaagagatgatgaaaccctttgattgcaggtgggaatgggtgatctcccttcagctcccacctgcacagcaggaactttgccygtaggactgagaggtgactttgtgtggcaatgactaagccaccttaacggcaaatcaccatcagaatgggataggaacagaaagttggcactctgagcccagggccgtgaattattgaacctctttcagctaaaacatgatatttgttgtcatcttttccactgaccctatggcccaatcaatttcaaaatgtagatgcttaaaaccaaaaataaattttaaataacaaactcagaacttgcctattttagccacaaaaagtaccttgtgagtccacaatcttgaaggaaaccaatttat

SEQ ID NO: 160393 - DNA, 601 bp, Human
agaaagtccctggaggagaccagaactgaatttgggtctccattagttaggaggctggtggtggctagaattagcaccctggcagaagggggctgaattccgagttatgctggaaggtataatcagtaggaggtggtaactggtaaagtttgaagggatgattcaacacaccttaaatctattattcaccccctgcccttgaccttgtaaaaaggagggaagaagtaagagatgatgaaaccctttgattgcaggtgggaatgggtgatctcccttcagctcccacctgcacagcaggaaytttgcctgtaggactgagaggtgactttgtgtggcaatgactaagccaccttaacggcaaatcaccatcagaatgggataggaacagaaagttggcactctgagcccagggccgtgaattattgaacctctttcagctaaaacatgatatttgttgtcatcttttccactgaccctatggcccaatcaatttcaaaatgtagatgcttaaaaccaaaaataaattttaaataacaaactcagaacttgcctattttagccacaaaaagtaccttgtgagtccacaatcttgaaggaaacc

SEQ ID NO: 160394 - DNA, 601 bp, Human
ggccaaaaataaaggaaagaacacaggtttgaagcctttcctttagcatgattgacacatattagggggacactggtgaaggacaaacctaggggggtggccaggccagatgggaaggtcatggctaaccaggcaaaagagtccaaaccttatagtgatggcaacaggagacttggacatgttctccactgcaaagagaacttgcctgatttgtgttttacaaagatctctttggtggctgcctaaagaaagtccctggaggagaccagaactgaatttgggtctccattagttaggaggytggtggtggctagaattagcaccctggcagaagggggctgaattccgagttatgctggaaggtataatcagtaggaggtggtaactggtaaagtttgaagggatgattcaacacaccttaaatctattattcaccccctgcccttgaccttgtaaaaaggagggaagaagtaagagatgatgaaaccctttgattgcaggtgggaatgggtgatctcccttcagctcccacctgcacagcaggaactttgcctgtaggactgagaggtgactttgtgtggcaatgactaagccaccttaa

SEQ ID NO: 160395 - DNA, 601 bp, Human
tgtgttcgaagggccaaaaataaaggaaagaacacaggtttgaagcctttcctttagcatgattgacacatattagggggacactggtgaaggacaaacctaggggggtggccaggccagatgggaaggtcatggctaaccaggcaaaagagtccaaaccttatagtgatggcaacaggagacttggacatgttctccactgcaaagagaacttgcctgatttgtgttttacaaagatctctttggtggctgcctaaagaaagtccctggaggagaccagaactgaatttgggtctccatyagttaggaggctggtggtggctagaattagcaccctggcagaagggggctgaattccgagttatgctggaaggtataatcagtaggaggtggtaactggtaaagtttgaagggatgattcaacacaccttaaatctattattcaccccctgcccttgaccttgtaaaaaggagggaagaagtaagagatgatgaaaccctttgattgcaggtgggaatgggtgatctcccttcagctcccacctgcacagcaggaactttgcctgtaggactgagaggtgactttgtgtggcaatgacta

SEQ ID NO: 160396 - DNA, 601 bp, Human
gtttgaggggctgattcccaggaggggtcctgggggagacatgggctgaccacacagtctatggccagggaaagcttcttgaaggaaggaaaagctacaaggagactcagtgatggttgggagatggcctggtgagaaggagggaaaagagtttgacacagacgaaatgtgtgttcgaagggccaaaaataaaggaaagaacacaggtttgaagcctttcctttagcatgattgacacatattagggggacactggtgaaggacaaacctaggggggtggccaggccagatgggaaggtcrtggctaaccaggcaaaagagtccaaaccttatagtgatggcaacaggagacttggacatgttctccactgcaaagagaacttgcctgatttgtgttttacaaagatctctttggtggctgcctaaagaaagtccctggaggagaccagaactgaatttgggtctccattagttaggaggctggtggtggctagaattagcaccctggcagaagggggctgaattccgagttatgctggaaggtataatcagtaggaggtggtaactggtaaagtttgaagggatgattcaacacacctta

SEQ ID NO: 160397 - DNA, 601 bp, Human
ctggaaggttgaggctgcagtgagtcatgatcgcaccactgccctccagcctgggcaacagagcgaggccctgtctcaatcaatcaatcaatcaataagtaagtacacaaacaaatgaacatgtgtttagaactttaggagagttggccaggggctgtgggtaatgtctgtaatcccagcactttgggagcctgaggcaggtagatcacttgagtccaggggttctaggccagcctaggcagcatggtgaaaccctgtctctacaaaaaatacaaatttaggctaggcgtggtggctcacrcctgtaatcccagcactttgggaggccgaggcgggtggattgcctgaggtcaggagtttgagaccagcctggccaacatggtgaactccgtctctactaaaacacgaaaattagccaggcgtggtggtgaacgcctgtaattccagctactcaggaggctgagggaggagactctcttgaacccgggaggccaaggttgcagtgagcggagatcgtgccactgcactccagcctggatgacagagggagattccgcctcaaaaaagtaataataataaaataaaaacatacaaatttagt

SEQ ID NO: 160398 - DNA, 601 bp, Human
gcggtgctgtgtgcctggacacccagctccttgggaggctgaagccagaagaccacctgagcctggaaggttgaggctgcagtgagtcatgatcgcaccactgccctccagcctgggcaacagagcgaggccctgtctcaatcaatcaatcaatcaataagtaagtacacaaacaaatgaacatgtgtttagaactttaggagagttggccaggggctgtgggtaatgtctgtaatcccagcactttgggagcctgaggcaggtagatcacttgagtccaggggttctaggccagcctagrcagcatggtgaaaccctgtctctacaaaaaatacaaatttaggctaggcgtggtggctcacgcctgtaatcccagcactttgggaggccgaggcgggtggattgcctgaggtcaggagtttgagaccagcctggccaacatggtgaactccgtctctactaaaacacgaaaattagccaggcgtggtggtgaacgcctgtaattccagctactcaggaggctgagggaggagactctcttgaacccgggaggccaaggttgcagtgagcggagatcgtgccactgcactccagcctggat

SEQ ID NO: 160399 - DNA, 601 bp, Human
cctctacaaaaatacaaaaattagctggatgcggtgctgtgtgcctggacacccagctccttgggaggctgaagccagaagaccacctgagcctggaaggttgaggctgcagtgagtcatgatcgcaccactgccctccagcctgggcaacagagcgaggccctgtctcaatcaatcaatcaatcaataagtaagtacacaaacaaatgaacatgtgtttagaactttaggagagttggccaggggctgtgggtaatgtctgtaatcccagcactttgggagcctgaggcaggtagatcayttgagtccaggggttctaggccagcctaggcagcatggtgaaaccctgtctctacaaaaaatacaaatttaggctaggcgtggtggctcacgcctgtaatcccagcactttgggaggccgaggcgggtggattgcctgaggtcaggagtttgagaccagcctggccaacatggtgaactccgtctctactaaaacacgaaaattagccaggcgtggtggtgaacgcctgtaattccagctactcaggaggctgagggaggagactctcttgaacccgggaggccaaggttgcagtgagcg

SEQ ID NO: 160400 - DNA, 601 bp, Human
atggccacaaagacacacatggctcttaggctgagaggtttgactcaacatgtcaattactgactttctaccaatgactagccacacttttcctccattccatctgcaaagttcctacccatcaaggacacctagtccaggcctcaagcaatctgcaataccttgacagatggttaggacagccaattcaggccaaagaagagtcatctgcctaaatatataaacagttgtgtgaccagcctgggcaacctggggagatcctgcctctacaaaaatacaaaaattagctggatgcggtgcygtgtgcctggacacccagctccttgggaggctgaagccagaagaccacctgagcctggaaggttgaggctgcagtgagtcatgatcgcaccactgccctccagcctgggcaacagagcgaggccctgtctcaatcaatcaatcaatcaataagtaagtacacaaacaaatgaacatgtgtttagaactttaggagagttggccaggggctgtgggtaatgtctgtaatcccagcactttgggagcctgaggcaggtagatcacttgagtccaggggttctaggccagcctaggcagcatg

SEQ ID NO: 160401 - DNA, 601 bp, Human
taaaaaaccagggcctagatggtttcaaacagcaatggcactctcaagcctttctttgtaggtggttgagcttttatgtgtgtttctcaaatttctgtgctttgcatattatcttgacaatgttccccaaaccttgatacgagccgttctgctattcagttaatatttcctctttaatcagccttaactcccctcccttccttgcttccttcttttcttcctttcttagaactcagtctcattctgagcaataacatctatgaaatcacaggactgatgtgtccatgggtctgtgcaccayctaaaacctgtaattcccatgatttagaaggccaggacatgaggattgcttgagaccaggagtttgaaaccaacctgggcaacatagtgagattccgtcgctacaaaaaattagctgggcatggtggtatgcacctgtagtccagctacttcagacgctaaggcaggaggattgctggagctcaggagttcgaggctgcagtgagctatgattgtgccacttcatgccagcctggatggcagggaaagaccctgtcctaaataaataaatagtttttattaaaaaaaaaactcctttgtc

SEQ ID NO: 160402 - DNA, 601 bp, Human
cctctccataaagcctactctgccccagtcccagctccagcccctttggctcctaggaagttcagaacttgtttgaatacatcttgaagactgaagcaaagtccaaagaaagagttgttctataaaaaaccagggcctagatggtttcaaacagcaatggcactctcaagcctttctttgtaggtggttgagcttttatgtgtgtttctcaaatttctgtgctttgcatattatcttgacaatgttccccaaaccttgatacgagccgttctgctattcagttaatatttcctctttaatyagccttaactcccctcccttccttgcttccttcttttcttcctttcttagaactcagtctcattctgagcaataacatctatgaaatcacaggactgatgtgtccatgggtctgtgcaccatctaaaacctgtaattcccatgatttagaaggccaggacatgaggattgcttgagaccaggagtttgaaaccaacctgggcaacatagtgagattccgtcgctacaaaaaattagctgggcatggtggtatgcacctgtagtccagctacttcagacgctaaggcaggaggattgctgg

SEQ ID NO: 160403 - DNA, 601 bp, Human
tgttggggaaagttgtcgcaggtgagccactttggctggcctggatttaacatcacacacagagaacagatgggatagtttggaagccagggtgtcccagccagcccagcttaagcttgggagtcatttgttatgcagcaataataatcagtacacacacgttacctcatttcatccttgcaacaggcctggaggtaggctctgtaatgacttcctttttacagatgaggaaacagacactcctcggtcgagtagaaaagccctggagctgctcagcgcggcagcctggaccccagctccygggcctgtttccatccatggaccctggtcccctgtgtgttgattcatccttgtatgcctagtgcttggcatacagcaaacacttaacaaatgttttagttgcataaacaaatcaacagatcaaaagctgaataagtaaatgagtctctgggcctcagtttcccattctgcaaaagagagcaggtggatcagatgctgtctcctggaatcccttctatctctacaattccacacttctaggagcagctctcctcatacctgtcatagagtcactccagctggctttcagagatcttcagaa

SEQ ID NO: 160404 - DNA, 601 bp, Human
attgcagcacgattcaaaagagccaacatatggaatcagcctgagtatccatgagtggatgaatggataaagaaaatgtggtgtgtatatatatacacacacacacacacactagaatactattcagccttaaaaataaagaaggaaatcctctcgtttgagacaacatgaatgaacctggaggacattgttaagtgaaacaagccggacacagaaagatcaacatgacatgactcacttataggtgtaatctaaaatagtcaaacctgtagcagtggagaggagaatggtggttgccagkagctggggagaagggcaatggggagatataggtcaaaggcatttgttattcaagaggcagttattcaagaggcataattcctggagagctaacgtacagcaatgtgaatacagttaagagcacagtattgtgtacttaaaattaactaagagggtacatcttaaatatttatatatatatattaaaatatatatatacacaagaaaataaaatggtaactatatgaggtgctgaatatgttaattagcttgattatggtaattatctcacatttacgtatattaaactattaagttgtat

SEQ ID NO: 160405 - DNA, 601 bp, Human
tgggcactcatcgtacaattcttccatgtttctcacacgccttcgatttttcataatagaacactgaggggaggactacaggtaattctaatgttcagtgtgagttgagtactaagtagagaaaagggttgccttttgtgtaaaatggcccatacatgggctttgtttgcagaaatacaatcacgtgttcatctgcattctctagtgctcactcattctctagaaccaagggattacccaagtgtgaccaggggacacctccatcagagccactggagaaaactgttgaagggcagtttcygacccatccctgaagccactgactcaaacctctgagagtgagacctagaaatcttttttaacaagccccccaggtaattgtgatgtctaccaaaagtttgagaaacactgctcaattgtggatgaactcaactcaatagtggtgaaaaaaatcccattaaaaaatgggcaaaagacctgaatagacatttctcaaaagaagacatacaaatagataagaggtataataaaaatgtacaacttcattactcattgaggaaatacaaatcaaagccacatgagatatatcaccttacacctg

SEQ ID NO: 160406 - DNA, 601 bp, Human
ctaagcagtgagtacatgggcactcatcgtacaattcttccatgtttctcacacgccttcgatttttcataatagaacactgaggggaggactacaggtaattctaatgttcagtgtgagttgagtactaagtagagaaaagggttgccttttgtgtaaaatggcccatacatgggctttgtttgcagaaatacaatcacgtgttcatctgcattctctagtgctcactcattctctagaaccaagggattacccaagtgtgaccaggggacacctccatcagagccactggagaaaactkttgaagggcagtttctgacccatccctgaagccactgactcaaacctctgagagtgagacctagaaatcttttttaacaagccccccaggtaattgtgatgtctaccaaaagtttgagaaacactgctcaattgtggatgaactcaactcaatagtggtgaaaaaaatcccattaaaaaatgggcaaaagacctgaatagacatttctcaaaagaagacatacaaatagataagaggtataataaaaatgtacaacttcattactcattgaggaaatacaaatcaaagccacatgagata

SEQ ID NO: 160407 - DNA, 601 bp, Human
gacacggcttagggtggggatggacaaagacgaggaacttcctctaggggagttggtttcaagcttggctgcataccataatcacctgggaaattaaaaatagatatgttgacacccaaactcacccccagggaatttgatgttatagttctggggaacagcatggacactgggagtttttaaaagcttcccaggagaaagaagtcttccacaaagagtatacactggatgatcctatttatatgaaattctataacagacaaaactaacctatagtgaaaaaagtcaggacattgattgyctctggtgaagagaaggaggcagggagtgacaagggggcaggaaatgagagaattttctggggtgatgggaatgttctatatttggataggggcttgggtttcacaggtatgtgcatgtgccaaacagtgagaggtgtacttaacatttgtacatttcaccctatataaattcaacctaaaatacaggagtgtgaacaaaaattgagtcctagttaatgatgtgcacactgtagtgtttggggtaaaatgtactcatgtctgcaatttaatttgaaatgcatcaataaaaagaaggaggg

SEQ ID NO: 160408 - DNA, 601 bp, Human
atgcaatagatccaggtataaaagctacccttgtactctctaaatttatacaaatttcaaaaaagaatgggggtgagggcacaaagaggttataaaactttcccattgtcggtttttttcttttgtttttaagacaaactctcactctgttgtccaggctggagtgaggtggcatgaacatagctcacggtgacttcaagctcctgggctcaaggggtcctcctgcttcagcctcccaggtagctggaactgtaggcatgtgccaccacacccagccaatagttgtattttttttttttttagagatggggtcttgctatattgcccaggttggttttgatctggcctcaagtgatcctcccctctgcctcccaaagcactgggataatagacatgagccaccttataaggcctaaatttcccattgttgactcaaccagggctatatgatttgaggggtgccaagaaactcaaaggcacttctctccctggccttaagtacccaccacttgtaaaaattttggtttggggccttgggtcccacttgttaaatctgtagataatatagtatcagagtggtagcatcaagctcaggctccga

SEQ ID NO: 160409 - DNA, 601 bp, Human
ctcttttttatatggccaccatcctgtgagattaaagccccacacttatgacctcatttaacctttttttttcctatcagttatcatgtttatttttttcacatgacattttaaaaatttttttgttttgggggaataggtagtgtttggttacatggattagttctttagtggtgacttctgagattttcatgaacccatcacccgagcagtgtacactgtacccaatatatagccttctatccctcatacccctcccgcccttccttccaagtccctatatcaaggggaatggtggaayggggatgagtgataaaagtccccataagcccattatatcagccacctaactaatgcttaataataagcaattgttacctccataccaactacttggcaaatcccactttataaagcatgctggtaatgagagaattggatattggctccacccgggcaatatcaagatctactgatctatcctactctttgcagaaactttagtttgcaacagtcaaatctcactgctctctgctgtatcaagcagctacacctgcatcccatggacaagctctgacaagagtctgggacccccgacccc

SEQ ID NO: 160410 - DNA, 601 bp, Human
aaaactcacgccacctaatactttaaaaaaagcacacacacagaaatgtattttctcatagttctggagatgtgggtgctagcatggtcagtttcgggtgatgcctgtcttcctcgcttctgatggccgccttccctcagtgtcctcacatgccaggcagggagggttagagtgggggatgatctctccctctctctctctctctctctctctctatctatctatcttcctcttttttatatggccaccatcctgtgagattaaagccccacacttatgacctcatttaacctttttttttcctatcagttatcatgtttatttttttcacatgacattttaaaaatttttttgttttgggggaataggtagtgtttggttacatggattagttctttagtggtgacttctgagattttcatgaacccatcacccgagcagtgtacactgtacccaatatatagccttctatccctcatacccctcccgcccttccttccaagtccctatatcaaggggaatggtggaacggggatgagtgataaaagtccccataagcccattatatcagccacctaactaatgcttaataataagcaat

SEQ ID NO: 160411 - DNA, 601 bp, Human
ggcaggtacagagaggtcaagtgacttgtcccagaccacacagctaagaggcaaagctgagtctcacccagggtcaatcctattccaaaactcacgccacctaatactttaaaaaaagcacacacacagaaatgtattttctcatagttctggagatgtgggtgctagcatggtcagtttcgggtgatgcctgtcttcctcgcttctgatggccgccttccctcagtgtcctcacatgccaggcagggagggttagagtgggggatgatctctccctctctctctctctctctctctctccatctatctatcttcctcttttttatatggccaccatcctgtgagattaaagccccacacttatgacctcatttaacctttttttttcctatcagttatcatgtttatttttttcacatgacattttaaaaatttttttgttttgggggaataggtagtgtttggttacatggattagttctttagtggtgacttctgagattttcatgaacccatcacccgagcagtgtacactgtacccaatatatagccttctatccctcatacccctcccgcccttccttccaagtccctatatcaa

SEQ ID NO: 160412 - DNA, 601 bp, Human
acctgtaattccagcactttgggaggctgaggcaggcagatcacttgagatcaggagttcaagaccagtctggtcaacatgacgaaaccttgtctctactaaaaatacaaaaattagctgggcatgtacttgggaggctgaggtaggacaatcacttgaacctgggaggtggaggttgcaatgagccaagatagcaccattgcactccagcctggatgacaagagtgaaactctgtctcagaaaagaaaagaaaagaaaagaaaagaaaagaaaagaaaagaaaagaaaagaaaagaaagmaaagaaaagaaaagaaaagaaagaaaagaaaagaaaagagaaaagaaaaaagaaaagaaagaaaagaaaaggcaggtacagagaggtcaagtgacttgtcccagaccacacagctaagaggcaaagctgagtctcacccagggtcaatcctattccaaaactcacgccacctaatactttaaaaaaagcacacacacagaaatgtattttctcatagttctggagatgtgggtgctagcatggtcagtttcgggtgatgcctgtcttcctcgcttctgatggccgccttccctcagtgtc

SEQ ID NO: 160413 - DNA, 601 bp, Human
cacctgtaattccagcactttgggaggctgaggcaggcagatcacttgagatcaggagttcaagaccagtctggtcaacatgacgaaaccttgtctctactaaaaatacaaaaattagctgggcatgtacttgggaggctgaggtaggacaatcacttgaacctgggaggtggaggttgcaatgagccaagatagcaccattgcactccagcctggatgacaagagtgaaactctgtctcagaaaagaaaagaaaagaaaagaaaagaaaagaaaagaaaagaaaagaaaagaaaagaaarcaaagaaaagaaaagaaaagaaagaaaagaaaagaaaagagaaaagaaaaaagaaaagaaagaaaagaaaaggcaggtacagagaggtcaagtgacttgtcccagaccacacagctaagaggcaaagctgagtctcacccagggtcaatcctattccaaaactcacgccacctaatactttaaaaaaagcacacacacagaaatgtattttctcatagttctggagatgtgggtgctagcatggtcagtttcgggtgatgcctgtcttcctcgcttctgatggccgccttccctcagtgt

SEQ ID NO: 160414 - DNA, 601 bp, Human
ccaaattgcaaaattgctctctggaaaggccaagtcctgcttttgattactaacacagaagtgggaaaagcaatatcatcccaataaccacttgtccctcacagcttgtttccctctaaagagcctgaaacatcatccccaacaccgatcgtgaacatctctgttaatgcctgaaatacgatgtccccaaacccctctgacaagtgtcaaaatatgggcatggaatggggaagtgacttctcaatcattatagaattacacatgcaaaggaaagaaaatgttagaatcaaacaacagcggrgcaattttcacagagctcatccatggatcaaaggaacggtcaaccaaagagacgtggttagtatgacagaaatctctaaagtcctccagatgagaagataaaactattttcttctacagcttaagaacatccatgaagaagcaaggacacaagagaattaaagtgaaagttgaaaagcccttctgtctctagaaatacaggcagcaaaaggagcctgctctttttttaatcatcatcatcatcattctcatctacattgttcttcaagtgcctcctaatgttccagccaccgtactgctt

SEQ ID NO: 160415 - DNA, 601 bp, Human
cctggggccaggaggctgaagggaatggaattagctttacagctcttgctttgtggttcaagctacgtaatggaaaaaaaaaagaaaaaaagaaaaagaagaaaaattataataacaataaaacattataaaagttgtcaaaacttgccgacaattctatttagatctatttagttccaatattttgctgtcagagctccaagaggaagggggaaatctcttttggttttatatttttaataggaacagtttttctttttaattaaagaaaataacctccaaaaaatgttggctgagagartttacaagagaatgtatcaatggactccgtggaattctccgttccagtacagccaaattgcaaaattgctctctggaaaggccaagtcctgcttttgattactaacacagaagtgggaaaagcaatatcatcccaataaccacttgtccctcacagcttgtttccctctaaagagcctgaaacatcatccccaacaccgatcgtgaacatctctgttaatgcctgaaatacgatgtccccaaacccctctgacaagtgtcaaaatatgggcatggaatggggaagtgacttctcaatcat

SEQ ID NO: 160416 - DNA, 601 bp, Human
tggccaggcaggaacacagagcatctgccaagtttccatgagtctacagacaccctcaggacacccaggggtctcctagcccagcttccctgtgccatctcagaaccaaagctggagccatccgagcagccgcaccagtcagaatctccccctggggccaggaggctgaagggaatggaattagctttacagctcttgctttgtggttcaagctacgtaatggaaaaaaaaaagaaaaaaagaaaaagaagaaaaattataataacaataaaacattataaaagttgtcaaaacttgccgrcaattctatttagatctatttagttccaatattttgctgtcagagctccaagaggaagggggaaatctcttttggttttatatttttaataggaacagtttttctttttaattaaagaaaataacctccaaaaaatgttggctgagagagtttacaagagaatgtatcaatggactccgtggaattctccgttccagtacagccaaattgcaaaattgctctctggaaaggccaagtcctgcttttgattactaacacagaagtgggaaaagcaatatcatcccaataaccacttgtccc

SEQ ID NO: 160417 - DNA, 601 bp, Human
tcaatcaatcaatcaatcaatgcttaactattaaaattaaagagtatacctgaaataatatcatgcgcaaagagctacacgtaacgcattttgaaggatcttgaattcgtccatttcatcctttctatgactctatgtgataggtattatctttgatcccattttacagatgaggaagttgaggcccagggagatgaagcaacttgttcaagatcacagagttagaaagagacacaactagaattctaatccaatcatttcctcataacttttgcattgtatcctaatgatgtctttcaakttttagaacacaatatgcttttaggggagcagggttttggggtacaagactctttctacttctaccccctcaagtgtgtgaacatctccaccctatgtccctgcctttgtttgtcatgtgaaagcacaccagagtggccaggcaggaacacagagcatctgccaagtttccatgagtctacagacaccctcaggacacccaggggtctcctagcccagcttccctgtgccatctcagaaccaaagctggagccatccgagcagccgcaccagtcagaatctccccctggggccaggaggc

SEQ ID NO: 160418 - DNA, 601 bp, Human
atttcatgcatttaatcatattattcttagagatgattcataggcttcaacacactgccagagaggcccatggcatcaaacagtttaagaacccctatcctagaaggagcatgtgtcagtaaatcccaaacttcagtcagacacaattttcaccatgacatacagccatctattctttaacttatgacattttaaaaattaatcatttatctaaataagttaagcttcactataagtgatcatatctgtgaaattacaggcttgtggtgctaattatagttattttaatgcaattaagacraatgtttatgtgcctatggtcatagcaactcaggaggctgaggcaagaggattgcttgagcccaggagtttgaggctgcagtgagctatgactgcaccattgcactccagcctgggtgacagagtgaaaccctgtctcaatcaatcaatcaatcaatcaatcaatcaatgcttaactattaaaattaaagagtatacctgaaataatatcatgcgcaaagagctacacgtaacgcattttgaaggatcttgaattcgtccatttcatcctttctatgactctatgtgataggtattatct

SEQ ID NO: 160419 - DNA, 601 bp, Human
atttcaaatataattggcttctcttgtaacctatgtattctatttcatgcatttaatcatattattcttagagatgattcataggcttcaacacactgccagagaggcccatggcatcaaacagtttaagaacccctatcctagaaggagcatgtgtcagtaaatcccaaacttcagtcagacacaattttcaccatgacatacagccatctattctttaacttatgacattttaaaaattaatcatttatctaaataagttaagcttcactataagtgatcatatctgtgaaattacagrcttgtggtgctaattatagttattttaatgcaattaagacgaatgtttatgtgcctatggtcatagcaactcaggaggctgaggcaagaggattgcttgagcccaggagtttgaggctgcagtgagctatgactgcaccattgcactccagcctgggtgacagagtgaaaccctgtctcaatcaatcaatcaatcaatcaatcaatcaatgcttaactattaaaattaaagagtatacctgaaataatatcatgcgcaaagagctacacgtaacgcattttgaaggatcttgaattcgtc

SEQ ID NO: 160420 - DNA, 601 bp, Human
gtagggataatgaatgtccccagttcaaagggctgttgatagaagaaacgggttaatgagttaaccatgaaaagactcagaaaggtacatggcacacagtaaatgctcaacaaatggcaaccatcgtcattactgttattgttttgggcagagagaatagagggagggaaaaaagagagggaaagaaaatgagaaagaaggaggaacaaggacatagaagatttaaaaagaaagaaagaaaaaagaaacaaaaaaggaaagaaagaaaagagaaagaaagaaagaaaagaaaagaaaaaawcagcatgggatctaagattacgcagctcccaattcaggccccatccctatcccttacaggctgtgtgtccatctgacacacaaccctcccctgagcttcagggctcacacaggcaaagtaagcataataaaaattccatgacatcataggtatagcatccctcagtgtgctcaaaatctggcccctcacactcttaggactggtcctccacattcccttaccttcagatttcataccaggtgttcccattttttttcctcagaaggactcagtagaaacctctcctgggaagaaggaaag

SEQ ID NO: 160421 - DNA, 601 bp, Human
caccagaaaagtcacagaataaggaaaaaaaagaggtctttgatgaataaaatgatccagttatattcatgtccatcatatttcacaaatgtatatttgggtactaatttttcatgccttatacattaggcaagtagatttaccaacagttctatacctcagcagaaaagtaaataaacacccccagttaagaaccccttttaacaatcaataaacacacatggtattttgaaatatgtcaatttagtctatgtatgtctttaaattccctaatttgaaagctagttaatctgagtatttmtttagacttaacctgtgggtgtccatctttaaggtggggctcaggtcattgcccaaagttagtaaaaactggtagctgacaacctaggaaggtcaggtataatcctaagttactctcatctggatagattgctgctagtgtcagaatttcctcctgagcttctgtccttgtggccactgatatacttaacttctccataccttagttttcccatctgtaaagtagggataatgaatgtccccagttcaaagggctgttgatagaagaaacgggttaatgagttaaccatgaaaagactca

SEQ ID NO: 160422 - DNA, 601 bp, Human
tgggcactggattcacaaaggcttgtgttgaccactgaggctgtgaggttcaacaggccactttgtagattaaaattagtgtcttttagagcaaaacagctactactttctgagtcaaccctgagataacatatgatgtgtatgattttttgacatctctgcaccaagcctatgagacaagtcgtaccctgagcccatatttacagatttttaaaaatgaggcttggaaaggttaagcaacttgtcactacttatgaaaatttttaaattgcaaaggtgaacttcatcctgattgattctrcagaccacagatgtaaactttagcctaccccatcccttctgtatctgtcttctcaagctctcacctagagaggcagtcttctctgggaagactgattaaattaatgccagtccaaagacaagaggcagattcctcctgggaatcaccttctggagcgatatctgccacatacccaatcatggctgccacctactgcgtacttgctaactatcagatgctttaggaaacatatcatttacaaagtgagaaactgaggctaggagaggctagaacacctgagtgaggtcacacaagaagcag

SEQ ID NO: 160423 - DNA, 601 bp, Human
cacgtatagaatctgcagaccaggctggggttcaagaaccactggcagtttttgtttggaacctttctgagcctcagtttccccattgataaagtgggttaataatagcatctactccatagtgttgtcgaaaaagctcgatctgggacttaggaagggcacccttaaatataatataaaacagaatctctattcagggacctgtgtcccataggacattcttaacctcctgctcatgcctaaagaggcagacatatttgcaggcatctggtctccagtccatccggcagcagacgtgccrggagtcacgccagggggcctgttggagtgatattgttcaggcctttgagattcaaggagtttggattggcttcaggtaagtctggaagtcaggcctcatccaggtcagctcctagccccatgtaaataccaatgacagctcttccctcctttaaaacgcaagattggtaaatgtcaaatagtcaaactatgttactttcctcatgtaaccccagctccagaaaaagctaccaaagcatccattcccattggttgttagcgagttattttttcctaaagggctaggcactgggcactggat

SEQ ID NO: 160424 - DNA, 601 bp, Human
attaatttaatcgattagagctcccgaattcaaacctggtgagctcttaatcagcatgtttgacccagtctcaaagacagatcttcagtggaaaatgaaattttgagattgtagcagatgagcaaaggtaaccaagacggtatagagtagtggtgaaatgcacacgtatagaatctgcagaccaggctggggttcaagaaccactggcagtttttgtttggaacctttctgagcctcagtttccccattgataaagtgggttaataatagcatctactccatagtgttgtcgaaaaagctygatctgggacttaggaagggcacccttaaatataatataaaacagaatctctattcagggacctgtgtcccataggacattcttaacctcctgctcatgcctaaagaggcagacatatttgcaggcatctggtctccagtccatccggcagcagacgtgccgggagtcacgccagggggcctgttggagtgatattgttcaggcctttgagattcaaggagtttggattggcttcaggtaagtctggaagtcaggcctcatccaggtcagctcctagccccatgtaaataccaatgacag

SEQ ID NO: 160425 - DNA, 601 bp, Human
tgccaagtgtcgtcaactgtgagtattactacagtggatcagcccccaactccagcttccccagtggccactccaagttgattttaagctcatccaaggatccaacaaacagtccatgaaagtcaagtcataacctaagaggtttgtgaaccgtgcattcaaagcctccctgccgcatccttcagggatgcatttataaggatgctgctgtaaatattgaacctaaaaagcaccatgatcctttttaacttcttcctgcctgtcttttggtctggcattaatttaatcgattagagctccygaattcaaacctggtgagctcttaatcagcatgtttgacccagtctcaaagacagatcttcagtggaaaatgaaattttgagattgtagcagatgagcaaaggtaaccaagacggtatagagtagtggtgaaatgcacacgtatagaatctgcagaccaggctggggttcaagaaccactggcagtttttgtttggaacctttctgagcctcagtttccccattgataaagtgggttaataatagcatctactccatagtgttgtcgaaaaagctcgatctgggacttaggaagggcacc

SEQ ID NO: 160426 - DNA, 601 bp, Human
aatcttggcttattgatgaaagcaggtcctgaacattctcaaattcctctcaggcctcatcacattgtaaagaaattccaactcaaggatccaaatttcaggtcagtcatgataaatgctctggatgtaatctctgtgtttattttggttatggctcagtttctttcttttttctcttctttgagagcccaataactgttcaacagcaaagacctatctccagccaagtcatgattaactttcagggttggtaaatgggctatacttaagtatcaagtcttctgatgagatgagtccacarctcggcttcagaaagttgcatattaagagtggtcagttatattgcaactatcctaaaccgaaatgagtctcttaggtaacagtaaattcttcctgattctgaccactcattatggcatggcactgtagaaaaccctagtactttggatttttctagatatttttgattccggataaagtgaatttagtaatgcatccaaggcacagatattaaggcacagagttacagctccaatgctcgctcgccatgtgactggatgaatcaccaggtcattccaatctcagttcttgattgtaaatg

SEQ ID NO: 160427 - DNA, 601 bp, Human
tagaaagtacagctgcagggcacccttagcaagaggaaaaaaaaacaaggcaaactaactattttcaagtttctgatccccttccagatttgttacaagtaaaaaaggaagaataataagaaaacggccggaacacattttggaaaatcgtaaaattatacattccagtctttaataccccaaagatctaatgcagagcactaagaaaaactcaatcttggcttattgatgaaagcaggtcctgaacattctcaaattcctctcaggcctcatcacattgtaaagaaattccaactcaagkatccaaatttcaggtcagtcatgataaatgctctggatgtaatctctgtgtttattttggttatggctcagtttctttcttttttctcttctttgagagcccaataactgttcaacagcaaagacctatctccagccaagtcatgattaactttcagggttggtaaatgggctatacttaagtatcaagtcttctgatgagatgagtccacaactcggcttcagaaagttgcatattaagagtggtcagttatattgcaactatcctaaaccgaaatgagtctcttaggtaacagtaaat

SEQ ID NO: 160428 - DNA, 601 bp, Human
gcatgtcctcaatcccagtctatcctaccatgagcagtaagtgagggaggctgacactctgtgactgagaggtggtcctcagatataaagacacaagtaagccattgactcaagactaaatcctttggctttggactggtttgtaaaatagctcccaaacccaggtagagtagcttgggtttggattccaccaatcagctccatttgtatcaatgtccaagtgacacccacagataagccaaaagtatccacaaacaaaacatatctcttagggttgtgcccacttaacagcaagtaaacktatttccactagactctttctgggccacatatgggacttataggataccaaaaaaatttgtaccaaaaataaaaaaaaaagaaaaacacactcttccaggtgttctatctacatcatgccaaccatgcagatgtttgaaaacatccagatgaatgaacggccacatttttcaccttttaactgtgcggggttttttttgtttgtttgtttgtttgtttgtttgtttggaggcttgaagacattgctatactcagcttctttttgtcctcaccacctcctcccttgattcctttccttcaa

SEQ ID NO: 160429 - DNA, 601 bp, Human
cactcatgcaatcatacagcagataattactgagctgctccaaagtgctaggtattgtgccaggtgctggagatagagtggtgaacatgatcccgtttttggtgcatgtcctcaatcccagtctatcctaccatgagcagtaagtgagggaggctgacactctgtgactgagaggtggtcctcagatataaagacacaagtaagccattgactcaagactaaatcctttggctttggactggtttgtaaaatagctcccaaacccaggtagagtagcttgggtttggattccaccaatcakctccatttgtatcaatgtccaagtgacacccacagataagccaaaagtatccacaaacaaaacatatctcttagggttgtgcccacttaacagcaagtaaacttatttccactagactctttctgggccacatatgggacttataggataccaaaaaaatttgtaccaaaaataaaaaaaaaagaaaaacacactcttccaggtgttctatctacatcatgccaaccatgcagatgtttgaaaacatccagatgaatgaacggccacatttttcaccttttaactgtgcggggttttttt

SEQ ID NO: 160430 - DNA, 601 bp, Human
ttttgaaaactgcatgtgcatacaaggctttgcatacaatttcagggggttcaaagactccctaaaacccagaccccaggttaagaagcctagacatgtctggatttgaatcaggctcctttacttaatatctgcgtgataccagcagggcatctacgctcagagactcatcatcatctctgaatcaaagtgagtaatacttaccttactgggtagctaagaactaagattgagcatgtaaagtctcctgatttccgtcaacatgaacagctcttgttgcagggctaacaccaccagtcargctcatggcagacataattcacaataataccctcaaagtattcccttcaggggaagcaatacttggggatatctaccaaagtataaacctcaacacagactcattacttatctgaaattttaccttccaaactgaaaattctctttcctcatctttctgtctctttctagtcaataaatgttaagaaattatgtctgtctttggagaagtgaagaaaaatgaaacactggggcatccatgcaactcactgtgatggctcatggccatgaaaacagaatgctgaactaaataacgagagga

SEQ ID NO: 160431 - DNA, 601 bp, Human
catgcaagcttgccgctgtgccgactctgtcctgtaggaggcacccaggccctgctgctgtggatagctagagcggtagaaggaatcttcttcactgggtgatgtctccatgtagggcttcttatagggatggtctgtggtggaacattcttcctctgtgaagacaggagagacagcagtgaggccaggagcaggcaccaggcagctaaaagtggagacagttatttggccaaagtactgaagaataagtcctgagagactgttagccctaaccgccattctgaatacaaaaaaagggggktggattgtaatggttaagaccttgggctatggagttctatgcaaacagtttgacctttctgggttcagcttcttcatctgtaagatggaaagggtaggaaatagcacttcctacaaagggcagtgttgagaattaaatgggaaaatacatgaagcacttagtccagagcccagaaacactcaataaatagcaactaaccaggtgcagttgtgcacgcctatagttccagctgctcgggaggccaaggaaaaaggatcacttgagcccaggagtttgagaccagcctgggcaacatagtga

SEQ ID NO: 160432 - DNA, 601 bp, Human; identical to SEQ ID NO: 18190

SEQ ID NO: 160433 - DNA, 601 bp, Human; identical to SEQ ID NO: 19578

SEQ ID NO: 160434 - DNA, 601 bp, Human; identical to SEQ ID NO: 19579

SEQ ID NO: 160435 - DNA, 601 bp, Human; identical to SEQ ID NO: 19580

SEQ ID NO: 160436 - DNA, 601 bp, Human; identical to SEQ ID NO: 19581

SEQ ID NO: 160437 - DNA, 601 bp, Human; identical to SEQ ID NO: 19582

SEQ ID NO: 160438 - DNA, 601 bp, Human; identical to SEQ ID NO: 19583

SEQ ID NO: 160439 - DNA, 601 bp, Human; identical to SEQ ID NO: 19584

SEQ ID NO: 160440 - DNA, 601 bp, Human; identical to SEQ ID NO: 19585

SEQ ID NO: 160441 - DNA, 601 bp, Human; identical to SEQ ID NO: 19586

SEQ ID NO: 160442 - DNA, 601 bp, Human; identical to SEQ ID NO: 19587

SEQ ID NO: 160443 - DNA, 601 bp, Human; identical to SEQ ID NO: 29976

SEQ ID NO: 160444 - DNA, 601 bp, Human; identical to SEQ ID NO: 29977

SEQ ID NO: 160445 - DNA, 601 bp, Human; identical to SEQ ID NO: 29978

SEQ ID NO: 160446 - DNA, 601 bp, Human; identical to SEQ ID NO: 29979

SEQ ID NO: 160447 - DNA, 601 bp, Human; identical to SEQ ID NO: 29980

SEQ ID NO: 160448 - DNA, 601 bp, Human; identical to SEQ ID NO: 29981

SEQ ID NO: 160449 - DNA, 601 bp, Human; identical to SEQ ID NO: 29982

SEQ ID NO: 160450 - DNA, 601 bp, Human; identical to SEQ ID NO: 29983

SEQ ID NO: 160451 - DNA, 601 bp, Human; identical to SEQ ID NO: 29984

SEQ ID NO: 160452 - DNA, 601 bp, Human; identical to SEQ ID NO: 29985

SEQ ID NO: 160453 - DNA, 601 bp, Human; identical to SEQ ID NO: 29986

SEQ ID NO: 160454 - DNA, 601 bp, Human; identical to SEQ ID NO: 29987

SEQ ID NO: 160455 - DNA, 601 bp, Human; identical to SEQ ID NO: 29988

SEQ ID NO: 160456 - DNA, 601 bp, Human; identical to SEQ ID NO: 29989

SEQ ID NO: 160457 - DNA, 601 bp, Human; identical to SEQ ID NO: 29990

SEQ ID NO: 160458 - DNA, 601 bp, Human; identical to SEQ ID NO: 29991

SEQ ID NO: 160459 - DNA, 601 bp, Human; identical to SEQ ID NO: 29992

SEQ ID NO: 160460 - DNA, 601 bp, Human
attattattatttatgccatcttttcatctggttatttttattgttatgagaaatttgtgtaatcaaaactatttctataattctatgtatctaagcttttagctctttaaaatattataaatattccgacccttctcacaaagtggcaaagcaataatctttctgttttgctgatgggcttggtcacggctggcaaagttcaaagcattatttagaccaccccgatagaaatcagtgctgcttaaaaagatgggctccttcaggagcaaagcctgtttattcccaaggggccatcaagamcttttactaagataggactgtgagaaactgtctgggcaccaaaacccaaagactcactctgacacacaaaaagagtgtgacttaggacccaagacagtatctccaggacttagtgtcagatactcagtaaggatgcaataaatcttggctgatgatgacacaatacacaatttaccagcaggtttcaatatatgacattggtttgcacattttaagtattattttcaaaatgtattcatgggaaattgccatcaccactacattttgcttccaaaatattgccaaagctgtgactgtgta

SEQ ID NO: 160461 - DNA, 601 bp, Human
tatgagaaatttgtgtaatcaaaactatttctataattctatgtatctaagcttttagctctttaaaatattataaatattccgacccttctcacaaagtggcaaagcaataatctttctgttttgctgatgggcttggtcacggctggcaaagttcaaagcattatttagaccaccccgatagaaatcagtgctgcttaaaaagatgggctccttcaggagcaaagcctgtttattcccaaggggccatcaagaacttttactaagataggactgtgagaaactgtctgggcaccaaaayccaaagactcactctgacacacaaaaagagtgtgacttaggacccaagacagtatctccaggacttagtgtcagatactcagtaaggatgcaataaatcttggctgatgatgacacaatacacaatttaccagcaggtttcaatatatgacattggtttgcacattttaagtattattttcaaaatgtattcatgggaaattgccatcaccactacattttgcttccaaaatattgccaaagctgtgactgtgtatgagaaggtgctaacagttaaatgtgtatgtaaatgtaaatggct

SEQ ID NO: 160462 - DNA, 601 bp, Human
aattcatttttcttcagtttaatttctattataatttaaaggagatcaaattttaactataaaacacctaaattcaactctcactgaaattcagtcaaaaagactgcttactataagaagtttgtttttagggaaataaggtttatttctaagttctcttttaaggcagacatatacacagagtaaaatcatttggatcatttgggtacagtctagaatgatataataaaaacaaacactgtagcacattgagctctggtatttttgctaactcacagacaaaagtggacagttttatcasttgttgaccaattccatcagtgataaggtcactggctgtcctattacagctgattcaatactgtcagatagctgtttacatgtggcactgcagagtcctttaattggtaggggaaaatttgacttcataaacatcagaggccattgtttttaaaaaaccttgataatcaatggtaatttctgaagattttctgcaccttaacctgtgtgggtcactagagcaatatgtcatacactggagcataatcataatggtaaaactgcagaggaaaaagagaaattcatgacgtgcaccaaaaaa

SEQ ID NO: 160463 - DNA, 601 bp, Human
tggtaggggaaaatttgacttcataaacatcagaggccattgtttttaaaaaaccttgataatcaatggtaatttctgaagattttctgcaccttaacctgtgtgggtcactagagcaatatgtcatacactggagcataatcataatggtaaaactgcagaggaaaaagagaaattcatgacgtgcaccaaaaaagcttgtgagaaaaacaaaccatcccttaaatttgtaaacaaaaaggaaaataactaaaaaaaaaataagagtttccaattttgccgggttacctgtgaagagtgmctttgaaaaccagagggtgtggtgttgattttaaatatacaacaaaccaggattgcactatttttagtaccatacagtttgggttcaggacaccaattatgcaccacttgacccaggacttttgagacactaaaagcagtcaggatgctgaaaacgatgcctcagcacagtggcttggcattgcatcttaccatatgttgggctaatccatctctaacccctacaatgataggaaatgatcattttaaagtatttctagcaccagcataattatggggaatttgtgtggccacaaaaata

SEQ ID NO: 160464 - DNA, 601 bp, Human
gtaccatacagtttgggttcaggacaccaattatgcaccacttgacccaggacttttgagacactaaaagcagtcaggatgctgaaaacgatgcctcagcacagtggcttggcattgcatcttaccatatgttgggctaatccatctctaacccctacaatgataggaaatgatcattttaaagtatttctagcaccagcataattatggggaatttgtgtggccacaaaaatatgagcatgaatgaaacaagagttgtgggttttcagaattgtattcccttctttggttcacctcagayccataaataaacagtgctcatttgaaagtttgctttgttctcttttttaaactaaatggaaatgataataaattcaagtctctgactagctcctaaacttttctgaaatattaggtacatagagatattcattcccatctggatatttttatagatatgtatgtatgggcccattaaaatgtccatagtgaagcaatattaggaggcattacatttctcaatattgatagacctgaggtttgtagatcaaggagatctttaatatacaagttttttcacaaattatatgcagataggccc

SEQ ID NO: 160465 - DNA, 601 bp, Human
aaaatgccaaagcttcaaggcatttcatacagcttttaaagtgttctcactgcagacactaatcgaagagtgatgtggttgagctagggagaaagccagaggtgaaggagcatgtgaagtgattgaaatacccccactgagagaaacagttctgattgcataaatatactgtcctctataattaagttaactaacaaatagaaatcgtccaaatataatactctattcaccctctgggctagggaaggcacaaccattaaggtcatggcagtggaagaacaggtttaattattctcttttycacctgaggttattcctggctcgaggtgacaagcattccctttccttgggtggatgatgtggccatctgaagaatgagccagcagggacagtcccacaggacctggacatgaatgttgtctcacatttgatttctaacccagaagttagagatccttctgcagctatattttctaaatgcaagacattaactgggtcatcagaatcaaagctaaatattgcagggaaggaaatgacagaatcttagattggaatttacatttcctttcaaaaagtagcaaaactctttagcttataatta

SEQ ID NO: 160466 - DNA, 601 bp, Human
taaatattgcagggaaggaaatgacagaatcttagattggaatttacatttcctttcaaaaagtagcaaaactctttagcttataattatatttttatatacaaaatcttaatttattctcattcaacactgaacttgttagagggatattactctacacaacctcccaaataattaaatgaataagtcataagacttttacttcacatgtataaattaacctcattttaggaactggctttaatcaaatttaaagatactaaaaattatatgcaaattaaatgctattaaattaagtgcyaatttaaattcaacaggagagctcactatgtaagagaatcatctataacaacttttatagtaagctgaatgatttctttcatgttttctaaataaaattttaaaatgtgaactatatcttagcccaaggtctgccttgaacctgctggagaagtcacaacttttttaggccgctgattcattctccataaaatttaaaaattggaccagttaattcacttgttctctcaaagttaaacaattctgtgattcattgccctagtttttacatacaaaatgtttcaatatattgtcaatgctt

SEQ ID NO: 160467 - DNA, 601 bp, Human
aagaatgttaagccagtaccaggaaaaatgccacccactaaatcccacaacatttctgctggagttccacatagcaatcttacacaagaactaggctaaggttatccatttagttatagctatttgctgtacagtgattgtaaaattgccttgtcaactacatttcccaactagattgcataacttttgggagtggctcttcgtttgttgttgtggtggttgaggactgaggaagactaggacttctttggggactctgatgaaatcaagtacacacaaaattttgccaaggatctctgamcatttaaggtcttcccagaacgtgtctgcagacacctcatgaccataggttaaaatccctgctttggggaagagccatgctactcagttttatatctcttcatgctgcctagcataatttcttatacatatatggtgcccagtacatatctggtggtttggttttgaaacttcagaggaataaatgcaacaaacttcattcattaaaagtagtaatggaaaagcgggtaaacaaaaccagaagtctttcatcctgaagagattctgaaacatcttttttcctcattctctaaaatgttat

SEQ ID NO: 160468 - DNA, 601 bp, Human
agtgagccaccgcgcccagacataaaagaaacttttattgaaatatacataataaaattatcctaattatacatctcattgaaatttcagaaattgaacacgtaagtgaaactagcactcatatcaaaaagcagtgcgtgccttgtgttccattccactcattaacaaacccctaccaaaggcaagcagtattttgactcttaatagattgactttggcctgtttttgtatattatgaatgtaggatcatacatgatttactctttgtgtgtcacttcttcactctcaaatttagagattyatccatgttgttctgtagttgtagatcatttattctcattgttagtatttcattacgtgaatgtaccaaaatgtgttattcttctgttgatgggcacttaagtagtttccaagtttgggtgattacaaagtgctgctatgaactttctagaacttattctggtgaacatatacatattcatttctcgaggccatttcacctaaaagtgaaatttcggagtcgaaatctactgaggcatatatattcaaccttagtagatggcaaccagctttccaaaacagacgtactcaggtaaactct

SEQ ID NO: 160469 - DNA, 601 bp, Human
ttcatccatgttgttctgtagttgtagatcatttattctcattgttagtatttcattacgtgaatgtaccaaaatgtgttattcttctgttgatgggcacttaagtagtttccaagtttgggtgattacaaagtgctgctatgaactttctagaacttattctggtgaacatatacatattcatttctcgaggccatttcacctaaaagtgaaatttcggagtcgaaatctactgaggcatatatattcaaccttagtagatggcaaccagctttccaaaacagacgtactcaggtaaacyctcaccatccgtgtatgagggttccggttgctccacattctcaccaacacttgcttctttcagtcttgttagccaatctagtgagttgataatatctttgtaagcgcaaattagtgctatttttctatccaataaaatttgtgaagcctcatacccatcaacagtaacctattttcctatgtaactcatgtgcagcggaacatccttaaataaagtatctgggaaaagaaaaggtgtaagagaaaatataaaagttgggatattgggcctttagttgtgaccctaccaccaataaactgc

SEQ ID NO: 160470 - DNA, 601 bp, Human
gttattcttctgttgatgggcacttaagtagtttccaagtttgggtgattacaaagtgctgctatgaactttctagaacttattctggtgaacatatacatattcatttctcgaggccatttcacctaaaagtgaaatttcggagtcgaaatctactgaggcatatatattcaaccttagtagatggcaaccagctttccaaaacagacgtactcaggtaaactctcaccatccgtgtatgagggttccggttgctccacattctcaccaacacttgcttctttcagtcttgttagccaawctagtgagttgataatatctttgtaagcgcaaattagtgctatttttctatccaataaaatttgtgaagcctcatacccatcaacagtaacctattttcctatgtaactcatgtgcagcggaacatccttaaataaagtatctgggaaaagaaaaggtgtaagagaaaatataaaagttgggatattgggcctttagttgtgaccctaccaccaataaactgctatctatttgacctcatatgagtcatataagccaatcagatttttcaactgcaaatagtatattcttctactctggg

SEQ ID NO: 160471 - DNA, 601 bp, Human
tttattgtcccacatgaaatgaaatttagcaatcactaatgatgccaaatctaattgctaaatgaaatgaagctaaatctcatttcattagtaacaataaatgaaataatctgatggagcttcacaaattctgaagtctttgtttcatgctgagatcacctgggccatttttattgtagtcttcgaagtcattcacctgccttggaaacggtgataaccatcatggaattgttcaggagtggagctgaaagagagatgtagtggtcagatttctgaactgtagctcagaaactggacacgyatcactctggccttggctgcaggtacctttccagtatgctgaggctcttccaaatcacagtgcagacgggccttctgcagagctatgtaatgattaggcttgggactgcaaagtacaggataactgtggcttagtaaacagctggccttcaacatctgtgccccagagctctgcatgatacttgtcctggtgtcacctcagcctcacttgaatctatggcatttcagaaggagctctagctgttcttggctttctgttgaacagctataagaatgagcacttttttccccctcagtagct

SEQ ID NO: 160472 - DNA, 601 bp, Human
gcaggtacctttccagtatgctgaggctcttccaaatcacagtgcagacgggccttctgcagagctatgtaatgattaggcttgggactgcaaagtacaggataactgtggcttagtaaacagctggccttcaacatctgtgccccagagctctgcatgatacttgtcctggtgtcacctcagcctcacttgaatctatggcatttcagaaggagctctagctgttcttggctttctgttgaacagctataagaatgagcacttttttccccctcagtagctctggaactgtgtcatctckcctgtgagaaaacgccagtaattctcatgacagttgatattcagtgaagttttattatattttcactaccaccattaaattcaatcaaagccattttatgacatgcagcattataatctatacatctggtgggagttcatgaaataggagtaaaactctcctttctatcattacttcaagaaatccaacttgcaatataaattaatttttttactcacacagattataaaatgtctattccaacttatcagaaacatgttttagaccatttctgaatttgaattctaacagggatgaaga

SEQ ID NO: 160473 - DNA, 601 bp, Human
tcaatcaaagccattttatgacatgcagcattataatctatacatctggtgggagttcatgaaataggagtaaaactctcctttctatcattacttcaagaaatccaacttgcaatataaattaatttttttactcacacagattataaaatgtctattccaacttatcagaaacatgttttagaccatttctgaatttgaattctaacagggatgaagaatcatgattttagaagtcccataaaataattgctatcatttattcaaaaattgcaaagtgcctgaagcaatgctagatatygctgatagtcataaatatttatcaacaacattcagaaaacgtttttttctgtgctttgcattggaatacaataatcaccaagacactctcctgggcctcaggagcttacaggaaatcagggcaacacataagtaactaggcaattttaaacagtgcaatgcgttaccagtgagacgtgcaaacttccttggtataaaaaggaaagagataccaaataccctttgaagtggcgtcagagagggcgtctcagagataattctaccaaacttcaggataatcctgaggtgcaggtgttgttat

SEQ ID NO: 160474 - DNA, 601 bp, Human
aataattgctatcatttattcaaaaattgcaaagtgcctgaagcaatgctagatattgctgatagtcataaatatttatcaacaacattcagaaaacgtttttttctgtgctttgcattggaatacaataatcaccaagacactctcctgggcctcaggagcttacaggaaatcagggcaacacataagtaactaggcaattttaaacagtgcaatgcgttaccagtgagacgtgcaaacttccttggtataaaaaggaaagagataccaaataccctttgaagtggcgtcagagagggcktctcagagataattctaccaaacttcaggataatcctgaggtgcaggtgttgttattattccaggtggagggataataaacctacttaaatttctcaagcttacacagcaagtagcaggggtaacatttgaacccaggtctctgaatacaaaccccgtattctttccactagcgtaggctccctcatgttagtaatttctttctcttaaagtctggtatagctcaattctatagatttggagtaaggatgacaagtgttttacctttgaagcacaatttcagcagaattagttagtactt

SEQ ID NO: 160475 - DNA, 601 bp, Human
ttctttccactagcgtaggctccctcatgttagtaatttctttctcttaaagtctggtatagctcaattctatagatttggagtaaggatgacaagtgttttacctttgaagcacaatttcagcagaattagttagtacttgattaaagctattcagaagagaaatagatgtttttacacccaagaattgcagaagaacaaagttacagctatgccctttgtacctattatggcgttttccttcattggcacaggcagaaaaaaatctaggaagctacattagtgctgagcctggtgatgyccccataaccacaccaggtatgttctggaccatcgtatgtcttctcgtgttagatacatgcttcttgtccaggaaaagggcaaatgcttacacatcaaaataatatagtactatgattttccctttactttataagtaattttgtgctgttccttttttatacagccattgattattattattcctaaagaaaatgaagataattacatatttttgcatttgggcagtagcatgggccattccagtaagtatgcctttcttagaaaacctcttcactttgttatcttttttaacctaaca

SEQ ID NO: 160476 - DNA, 601 bp, Human
cagttaaaagcatgtttttttttcttttcttttcctttcttttctttttttctcttgcagagtgacctttaatacctgggaaggatgaataagcacaacctacattattgctttattttagaaaagagagccagaaatggtagtacattataatatgagttaccataatctctttagctctttaattctcttctcccatttttgcttttgtaaataagacattatcaagaattagagaaattttaggtctatgtgtgagcatcttaacaaatgatagtaggaggcaaaaaataattagttrtaaagctgtaaaagggaaccaagaaagggaaaataatcgcaataacttaaaaataatcaaacaagaatatagtataaaaggagaaattttcctaccttttggaaaagcaaaaagttccgtttctacattgctgttaggctcaggagattgaataactttagataatttaaacatggaaaacatacaaattatttgatttgaaattttttttaaaaactaccttctttatagtttatttcatatatgtaataaagtacttctacaaaacacatttcaggattcaggcttcactaagatctg

SEQ ID NO: 160477 - DNA, 601 bp, Human
ttgcagattaaaggcagtgcaaaagagatactctttctgcagtacctcttggtgtactgtttcaacagtattgatctgcagttaaaagcatgtttttttttcttttcttttcctttcttttctttttttctcttgcagagtgacctttaatacctgggaaggatgaataagcacaacctacattattgctttattttagaaaagagagccagaaatggtagtacattataatatgagttaccataatctctttagctctttaattctcttctcccatttttgcttttgtaaataagacatyatcaagaattagagaaattttaggtctatgtgtgagcatcttaacaaatgatagtaggaggcaaaaaataattagttataaagctgtaaaagggaaccaagaaagggaaaataatcgcaataacttaaaaataatcaaacaagaatatagtataaaaggagaaattttcctaccttttggaaaagcaaaaagttccgtttctacattgctgttaggctcaggagattgaataactttagataatttaaacatggaaaacatacaaattatttgatttgaaattttttttaaaaactacct

SEQ ID NO: 160478 - DNA, 601 bp, Human
gatacaatgccaaggtgacatatttaacctctttgcagattaaaggcagtgcaaaagagatactctttctgcagtacctcttggtgtactgtttcaacagtattgatctgcagttaaaagcatgtttttttttcttttcttttcctttcttttctttttttctcttgcagagtgacctttaatacctgggaaggatgaataagcacaacctacattattgctttattttagaaaagagagccagaaatggtagtacattataatatgagttaccataatctctttagctctttaattctcytctcccatttttgcttttgtaaataagacattatcaagaattagagaaattttaggtctatgtgtgagcatcttaacaaatgatagtaggaggcaaaaaataattagttataaagctgtaaaagggaaccaagaaagggaaaataatcgcaataacttaaaaataatcaaacaagaatatagtataaaaggagaaattttcctaccttttggaaaagcaaaaagttccgtttctacattgctgttaggctcaggagattgaataactttagataatttaaacatggaaaacatacaaatt

SEQ ID NO: 160479 - DNA, 601 bp, Human
acaagtgggggaaactgaggctcctgagcttagcagccaacctttaccatgggttagatactgtaataaatgccttacatgctcaatctcattcaattcccatgacaattttatgactgttattatatctatttcacagatgagaagacagaggcacagaatggattagattaaaacaactagaaggtatgagtgccaggattcaagtccaggcagtctgccccagaattcccctctataaccactacaccatagcacatcgtgaagatgggaggaagcagtgggaacttgaaaaatggawttattgcagggtttgctgcagtatgtgtatcatgtgaggccatttctatttctctttctttgccttcccagttgtttttcccctgtatgccacagtaaactagccactgttttagcagctctcttgttgatttttaaaatacctattcactaaatctttaaaggaaacatttagctactgcaatgggtgtacataagttggttgtgtaataggaaggaaacaagccaggactggagacttcatttctaaagaaggattttaaagcagactaagagttatttcccagagcaggtcatgaag

SEQ ID NO: 160480 - DNA, 601 bp, Human
gtttcaataacaaaaccatgaaaaagaattgtaataactactacttattgagcatgtacattcattattttagttaatcatacaatgatcatcttggcatggtggctcacacctgtaatcccagcaccttgggagcctgaggcaagcagatcacttgaggcctggagtttgagaccagcctggccaacatgacaaaaccccatctctactaaaacaacaaaaatcagccaggcatggtagtacatgcctgtagtcccagctactcaggaggctgaggcacaagaatcacttgaactcaggwggtggaggttgcagtgagctgaggtcatgtcactgcactctagcctgggcaatagagcaagactctgtctcaaaaaaaaaaaaaatacaatgatcttatgaattagctgttatccacatttcacaagtgggggaaactgaggctcctgagcttagcagccaacctttaccatgggttagatactgtaataaatgccttacatgctcaatctcattcaattcccatgacaattttatgactgttattatatctatttcacagatgagaagacagaggcacagaatggattagattaaaaca

SEQ ID NO: 160481 - DNA, 601 bp, Human
ttaaatatcccaagtgtacattacaatatattacccatttgtacatgctgtttggccaaacactttggttgaggatgttctcactagaaagatgaagatggcattgtatttgggggcaccttatgtttggtcctatgcagttttcattattgtgatggtttgattaatgaccattttcataactacatagtaagcaccacaagagctcagcccctctctagttttgctccttgctgcatttctggaattttgcatgggatagaacactgaatacattagttgtttgagatgtaagataaamatgctaacttattttcataattgcatgacctagaaaacactggaggaactgaaacagaaacgtaataaaaagttaatgaaagataagatgttttaatactttttaccctggtgttaatcaagatgagatgagtctttataaatgtaaaaagtcacaattcttttttttccccctgtagaaatcaaatggttcacatttatgcaatgataattctgaggcctctattcattatatttgactcactgggaattctaagttcaaaaaggccattcatgtcagagttagatcaaactgaaactt

SEQ ID NO: 160482 - DNA, 601 bp, Human
taatgcctggggattaaatttgcagcatcagcagatgtttagcaacttgcagaaggattgatgatgtgctctgtattagataattacagcgtggatccagtgaacatacacattggtgttaaagatgcgtatgaagagttttaacaaaattgtttcatgaaatgtgagaaaggaaaaagtcatgttaataagtataaaatatttaaattaaagtaacatattaaatatgtatgtgaaccatagattaaatatcccaagtgtacattacaatatattacccatttgtacatgctgtttggcyaaacactttggttgaggatgttctcactagaaagatgaagatggcattgtatttgggggcaccttatgtttggtcctatgcagttttcattattgtgatggtttgattaatgaccattttcataactacatagtaagcaccacaagagctcagcccctctctagttttgctccttgctgcatttctggaattttgcatgggatagaacactgaatacattagttgtttgagatgtaagataaaaatgctaacttattttcataattgcatgacctagaaaacactggaggaactgaaaca

SEQ ID NO: 160483 - DNA, 601 bp, Human
gtggtttttaaatacgccctttaaaaagcactggaaaaacaatctagtcagtaatgaaagtgtggagaacatgaccacgagtgaggactaatgcctggggattaaatttgcagcatcagcagatgtttagcaacttgcagaaggattgatgatgtgctctgtattagataattacagcgtggatccagtgaacatacacattggtgttaaagatgcgtatgaagagttttaacaaaattgtttcatgaaatgtgagaaaggaaaaagtcatgttaataagtataaaatatttaaattaaartaacatattaaatatgtatgtgaaccatagattaaatatcccaagtgtacattacaatatattacccatttgtacatgctgtttggccaaacactttggttgaggatgttctcactagaaagatgaagatggcattgtatttgggggcaccttatgtttggtcctatgcagttttcattattgtgatggtttgattaatgaccattttcataactacatagtaagcaccacaagagctcagcccctctctagttttgctccttgctgcatttctggaattttgcatgggatagaacactg

SEQ ID NO: 160484 - DNA, 601 bp, Human
ttattgcaagttggaatcacatagttttagaaagccacacttacagtttcaagtggtttttaaatacgccctttaaaaagcactggaaaaacaatctagtcagtaatgaaagtgtggagaacatgaccacgagtgaggactaatgcctggggattaaatttgcagcatcagcagatgtttagcaacttgcagaaggattgatgatgtgctctgtattagataattacagcgtggatccagtgaacatacacattggtgttaaagatgcgtatgaagagttttaacaaaattgtttcatgawatgtgagaaaggaaaaagtcatgttaataagtataaaatatttaaattaaagtaacatattaaatatgtatgtgaaccatagattaaatatcccaagtgtacattacaatatattacccatttgtacatgctgtttggccaaacactttggttgaggatgttctcactagaaagatgaagatggcattgtatttgggggcaccttatgtttggtcctatgcagttttcattattgtgatggtttgattaatgaccattttcataactacatagtaagcaccacaagagctcagcccctct

SEQ ID NO: 160485 - DNA, 601 bp, Human
gagctagggatagacatggtcatgcctgttggggctttgagactaaccagaaatccatccagacgttaaaagtatacattaaacctgaatcaagcaaagggcacatacatttagtgctcagggaagggagtattatggagatttacatcttccactgctctgcccttgctctcgggagctggctgcctctcagtgcctcaaataggccacgatccctcttgctccagggtctttgcacaagtgttcacgctgtcagaattctctctccagcacccgctcctcccagccaccaccaccaaacacacacacacacacacacacacacacacacacacacacacgcacacacacagagttaacctctattcagacttcagatcaaggaaagccattattgatcctgagtggaggtcaggatccttatatactctcttggaacaaaggtgttttgccttcataacacttatttcagtgtatcattatatatggcatgtgttcaaataaaatgtgttttttctcacgccaccaaatcctgccgtaaaaaagagggatttgacttatattcaagtgcttccaaagtttcttcattttgagcagcaaa

SEQ ID NO: 160486 - DNA, 601 bp, Human
acaactatggaaaaatttcctttctgggaaatgtagtaaacaaaacaattattataggtactttataaacagactcagaacgttcctgttcaccttgtttttacataatagtcaaaggccttgttatcagagagcaaatctcttagtcatattttggctaacatatacgtgctgttacctgatccagtgttaacactgatgctttagagcttttaaagtattaatgagtctctggggagagctctatggtttggccctaaagtcatctgaagggtgaaaaagacgttcttctattttgagytctctgctgagtcaccatctgacatcaaggtgtcccagccctgtgagtgtatatgatatactcagagtcaatgacttaagacttttctgggcatctgaccttcaactgcccatcatccttcctaattgaacctaccaccataagagtctgagctagggatagacatggtcatgcctgttggggctttgagactaaccagaaatccatccagacgttaaaagtatacattaaacctgaatcaagcaaagggcacatacatttagtgctcagggaagggagtattatggagatttacatctt

SEQ ID NO: 160487 - DNA, 601 bp, Human
ctccagtctgaaccctccagtggttagctccttctgtggcagcctcagcaaaatttacaagtcctcttccttcccttctgggcctagggaacttgtttcaatatttttgggtttcaaggcagatgatgacaacttgatctgtttatcactttgtctaaagtttaatgaactaagaaagacataccatgtgtactagaaaaaggagaggtttgtcttgttactttctttttcttattactcttggcctatcatttcctggagtatgtacatccatgcatccaaataaggccaggtatcttckgttgaatttgtttatatcagaggaagcctgtagactgctatttttagcaattattacaactatggaaaaatttcctttctgggaaatgtagtaaacaaaacaattattataggtactttataaacagactcagaacgttcctgttcaccttgtttttacataatagtcaaaggccttgttatcagagagcaaatctcttagtcatattttggctaacatatacgtgctgttacctgatccagtgttaacactgatgctttagagcttttaaagtattaatgagtctctggggagagctct

SEQ ID NO: 160488 - DNA, 601 bp, Human
agggaacctacacaaacgaccagaatatgtttttattttcggtactatggtttattttgcattctttttctgtaattggttccacttcagtttctatgatatttcctagaaacttaaattacagtaagattaggtcgaagtagatatttgtatttgatttattttcagttcctatagttttttagaacattaatttacatttaaattttaaaagataaattttatttttgaagttctgtatattgccatgccacttaaatcaacttagcacacctgctcccctgggcacttcttgccttgytgtacttcttctttctatcttccttctctttccttttctcttaagcattaataagctgtctgaacactgaaccagactgtaaacgcagtcatccatacctctgaaaggaggaacaggattcctctttcatattggccacatcagtgactccctggaaattttagtgctggtagttattgcttcaagtctttctaattgaattttccttgtgttgcctagcattcccctggtttctgaaccctccagtctgaaccctccagtggttagctccttctgtggcagcctcagcaaaatttacaa

SEQ ID NO: 160489 - DNA, 601 bp, Human
caaaaacatcattctccgtctagatttattagggaacctacacaaacgaccagaatatgtttttattttcggtactatggtttattttgcattctttttctgtaattggttccacttcagtttctatgatatttcctagaaacttaaattacagtaagattaggtcgaagtagatatttgtatttgatttattttcagttcctatagttttttagaacattaatttacatttaaattttaaaagataaattttatttttgaagttctgtatattgccatgccacttaaatcaacttagcayacctgctcccctgggcacttcttgccttgctgtacttcttctttctatcttccttctctttccttttctcttaagcattaataagctgtctgaacactgaaccagactgtaaacgcagtcatccatacctctgaaaggaggaacaggattcctctttcatattggccacatcagtgactccctggaaattttagtgctggtagttattgcttcaagtctttctaattgaattttccttgtgttgcctagcattcccctggtttctgaaccctccagtctgaaccctccagtggttagctc

SEQ ID NO: 160490 - DNA, 601 bp, Human
tgctttcagagctatttagggccactttgaatggtgggttcattaactctgtagccatagcacttttatttgaacctagtgtaaagtttgtcctaagttttgaaaaagataaccatttaccactccccactccactaatcttcaactaagaacctattagttgactgcatgattcttctgaaaatttgcaaatttttttccctataagctgcaaatacatattttacacacattcagtggagtacagtgattatacagaagtgacagagatttgaatagaatgtggttagtaattttattwttaaatatctcagcaattatagacttgtgtcaagtactcataaaatatctattttcataaattactgttttgagaactgtttccgtttatctcaaccaggttttaggaatttaggatgacccctctccaagcagtactacagtctcactaacctcaagcaaacaggttggctgaaagggtgacacacagcattggatatcacaaaggtagcagaaacaggccaggcacggtggctcacacctgtaatcccagcactttgggaggccgaggtgggtggatcacttgaggccagaagttcaa

SEQ ID NO: 160491 - DNA, 601 bp, Human
ttgatgagcatttagttcttgtgtgaaccgctaatgcaagcattcagtcccagcagaagtccctttaggattcagatcgtggtccaagcttctcatgtaccttggtgagggccaacacatttaatatgggaaacaattgcttgcttacctcagtggtgcaaagttacttattatctaccttttctgaaagaagcagatgtaataaaccctaatggattttaaggctagagtttgaaaagttctttgaaaatagggtgaaaacctggaagcttatttatgccttcagagagaaaatgttaaraagatgccttcaagcaaggaaaagacacagcttgcccacagctggtccacagctgttaattcttctcctcccaccatgggaaaagacttttcccctcaagccaggcttaatggctcgtgcctgtagtcccagctactgaggaggctgaggcaggaggattgcttgagcccgggagtttgaggctgcagttatctcaggctatcataaccttgaatgatccaatccagagtgtttttcaaagtataataaaacatttgcttttgaaatcaatggcttcattttcagactgtaagaagacat

SEQ ID NO: 160492 - DNA, 601 bp, Human
aaactctaccagtataatataaaactcctttggattcagtggaaattgcctctcttttgctaacagagtaagtcagttgttaaattctgctagttgggagaggaatttcaagtgctttcagctctgtgaatggaccaagaattatttattggggggtagttctcttctaggattaagaaaaacaacaaataataccaaagaacagttccaagtagcctcattctcatggtgttgggaccttctggggaataatggtgtactttgatgagcatttagttcttgtgtgaaccgctaatgcaarcattcagtcccagcagaagtccctttaggattcagatcgtggtccaagcttctcatgtaccttggtgagggccaacacatttaatatgggaaacaattgcttgcttacctcagtggtgcaaagttacttattatctaccttttctgaaagaagcagatgtaataaaccctaatggattttaaggctagagtttgaaaagttctttgaaaatagggtgaaaacctggaagcttatttatgccttcagagagaaaatgttaagaagatgccttcaagcaaggaaaagacacagcttgcccac

SEQ ID NO: 160493 - DNA, 601 bp, Human
gtatttggggtatagacatttgaatatggccaggatagacgtgccataaaactaggaagcttgagtttcaaggcccctcacttgtgcagcctccatacaaagttctagacttgattttgacttttatatttttaaaaaagaaggttccaaacatatgtataaactcttggcttcacaaaccctgaatctgctcttaggatggctcacctaaagtcctggcgtttgtgacgttgcagtaacttaataatatctgaatgattggcttcatgttgttaatagtaagacaatacaccttttaaarcctagcccctgtaattatcagatagattaatcctctgctttttctgcctttaactcttctccctaccccttaatttatttgtttctctactacccctgtaatttctttcccctgaatgcctagttcttggctttatcctctgactgctcttatttgaatttcccttattagttaaactctaccagtataatataaaactcctttggattcagtggaaattgcctctcttttgctaacagagtaagtcagttgttaaattctgctagttgggagaggaatttcaagtgctttcagctctgt

SEQ ID NO: 160494 - DNA, 601 bp, Human
gagtttctcgtcttatcataccactcactaatctcactgtgtctcattccagagctccagatgggatggatccatccagggagacagttgcctgttctttttctcagacatttgccaatccttcagaaagggtccaccacaccctgtcctgtgttatagtgggagacattattttggccatatttatttttctttgctcaagtcctactatggtatctgtgctactattttctctttctcagagaaagagaacacaggattttctcatatttacatttatttatttttctgaactttttgytgtatttggggtatagacatttgaatatggccaggatagacgtgccataaaactaggaagcttgagtttcaaggcccctcacttgtgcagcctccatacaaagttctagacttgattttgacttttatatttttaaaaaagaaggttccaaacatatgtataaactcttggcttcacaaaccctgaatctgctcttaggatggctcacctaaagtcctggcgtttgtgacgttgcagtaacttaataatatctgaatgattggcttcatgttgttaatagtaagacaatacaccttttaa

SEQ ID NO: 160495 - DNA, 601 bp, Human
atttagaggatcccccaggcttatcttacccaagcttgtgcaatagccacctttcaccatctcttaatcatgcctttcagagtttctcgtcttatcataccactcactaatctcactgtgtctcattccagagctccagatgggatggatccatccagggagacagttgcctgttctttttctcagacatttgccaatccttcagaaagggtccaccacaccctgtcctgtgttatagtgggagacattattttggccatatttatttttctttgctcaagtcctactatggtatctgtgytactattttctctttctcagagaaagagaacacaggattttctcatatttacatttatttatttttctgaactttttgttgtatttggggtatagacatttgaatatggccaggatagacgtgccataaaactaggaagcttgagtttcaaggcccctcacttgtgcagcctccatacaaagttctagacttgattttgacttttatatttttaaaaaagaaggttccaaacatatgtataaactcttggcttcacaaaccctgaatctgctcttaggatggctcacctaaagtcctggc

SEQ ID NO: 160496 - DNA, 601 bp, Human
tttctttcttgctcaggcgaaactagtccattcctccttttctataatgtgtaattgagggattactttaattatatttagaggatcccccaggcttatcttacccaagcttgtgcaatagccacctttcaccatctcttaatcatgcctttcagagtttctcgtcttatcataccactcactaatctcactgtgtctcattccagagctccagatgggatggatccatccagggagacagttgcctgttctttttctcagacatttgccaatccttcagaaagggtccaccacaccctgycctgtgttatagtgggagacattattttggccatatttatttttctttgctcaagtcctactatggtatctgtgctactattttctctttctcagagaaagagaacacaggattttctcatatttacatttatttatttttctgaactttttgttgtatttggggtatagacatttgaatatggccaggatagacgtgccataaaactaggaagcttgagtttcaaggcccctcacttgtgcagcctccatacaaagttctagacttgattttgacttttatatttttaaaaaagaaggt

SEQ ID NO: 160497 - DNA, 601 bp, Human
ctgagaggcctgcccaaatttctgacccaccagatctcgagacattatgaaacagttgctttgagtcactgagtttgtaagaagccatatataattggctgtaaacattaaatatttttgtgtggaatagcactcaaatgtactcagtagtagaatcacttatggtcatcaaagtattattttattgaaaaagtacatttttgtcttagaccatttaatagtagctcattcaatggcatatacattcctgagattttactatatgccaggttctatgctaagcacttcacctgtgtaccayccatgcactcccatctgtgaccctcacctccatttcacagaactaccattcagtgagtgcttcctgaccatccctctttgccactgtgcctggtcagcagtgaggagcatggaagccaaagggcacccggaggcacagcttttcagacacattcttaaaggtctgtttctttcttgctcaggcgaaactagtccattcctccttttctataatgtgtaattgagggattactttaattatatttagaggatcccccaggcttatcttacccaagcttgtgcaatagccacctttcaccat

SEQ ID NO: 160498 - DNA, 601 bp, Human
ttgtgcaggctttttgagagccaacatttactgaatggtccctgatttttactgagtccaaagatggaactattttttaagagtttttttccatcctgtaattgaaaacaaaatttaaacgcagagtatggtcatgtcatttagaatgatccaagcaggaaaccccttcaagtttcaattataaagaagatgcctgtgttttatttttgaaggaccttgtgggacaatccagtatctagactttaaaacgccttgtgttcttccattgtgttccacgttgtcctttagactagtcactggrcatttttgtctcactgagctaattgtatttgccacatattgatcaaaaataatttcatggcctttagcttcttattttaagaactgagcaaatgtgctgattgtataaataagacagaatggagaactttcctgggaaatgagagatattttgaaaacaactgtcatactgaagactcagggaggcttaattagctgatgcttgcaaagtactttgaaaaatcaaaaccatgatgtccttgctaagtatgatgaataccatttattcttggatgagtaaaaagtcatttattttgagaca

SEQ ID NO: 160499 - DNA, 601 bp, Human
tctagggattgtcatataacctcagatggccacttgtgcaggctttttgagagccaacatttactgaatggtccctgatttttactgagtccaaagatggaactattttttaagagtttttttccatcctgtaattgaaaacaaaatttaaacgcagagtatggtcatgtcatttagaatgatccaagcaggaaaccccttcaagtttcaattataaagaagatgcctgtgttttatttttgaaggaccttgtgggacaatccagtatctagactttaaaacgccttgtgttcttccattrtgttccacgttgtcctttagactagtcactgggcatttttgtctcactgagctaattgtatttgccacatattgatcaaaaataatttcatggcctttagcttcttattttaagaactgagcaaatgtgctgattgtataaataagacagaatggagaactttcctgggaaatgagagatattttgaaaacaactgtcatactgaagactcagggaggcttaattagctgatgcttgcaaagtactttgaaaaatcaaaaccatgatgtccttgctaagtatgatgaataccatttattc

SEQ ID NO: 160500 - DNA, 601 bp, Human
tcatttgattcaatgaagaaaggagggacagaatttttaaatgtaaagaaacagaaatttgaagagtctaaattatttggccaaatgtacaaggcttaagaggtgggcaagaattagaaacgctgagctttggactcagtatccaatattctccccaaacagactagtgaacaggctacagactagaagccagaagttctggctttgggccctggctttgccaagtactaaatactaccttgaacaaattactttctctctccaaacttcatatataggatgggaataccagttccttccratgtcaaaggtagctccttgcaaggtgaggtgaggaagctctttgcaaactctgaagtaccttacacatgcaaatgattattattttcattgttctgcctgctgcctgtcatcagtaatatcattagagtcatttatatcttgtattaactacatatgtcttgtattaagtgtgatataagggaaaagaaccttagtgtttctcctccccttttccgtatcttcctcccctaggggatttcaagcttcccaggagctagttccagaacatatttacttttagttcactcattaaacacaa

SEQ ID NO: 160501 - DNA, 601 bp, Human
ttaaaagcaaagaaaatagtagaaactcatcacttcataattattttactattatctactcttttgaggttatttacatctattatatctgttggtggaaatactatataatatgtgttccgcatgtctcttcccgattctgttcagtggcgtcatgttggtagcttaaaattgatagcaacaggaggcagagaaactgtaggcatacaggggcgggtcgctggcaaaatcccaccttcaagccgaaaagcctgaaacccacagcccaaagtgagaacttccattctctcccgattggttmtttctgaatactgtctttttaccaattgaatattgccttttccaaaactacctacggcctgccccgtccccatcctgtgcccataaagaccccagaactcagccagcagagggaagaagcagcctgatgtcgagaagaagcgcctggacataggagagaggtggcttgacttcagaggagagggatcttcccttcccattccctttccagctcacctctccactgagagccgctttcgtcactgaaaaaaaaaattctccacattcgccatccttcaattcatctgtgtgacctcattcc

SEQ ID NO: 160502 - DNA, 601 bp, Human
tatctcctatttgttctgtttctctggagaaccttgactaataaaacatctaattcagttttgtgagagttagaagaaatggtactggtaaaaatgcctgatacctaggagatgctcaataaattttaattcttttttctctcatcttcctgataagttaagttgtgattcttgaataaacaacttagattctcagaaaataatgtaatttaagttttgctgtgaggtcagaaaaattgtccagtggaacattaaagtccattctggccacacatttaggctccttttaatgccaggagtrtttccgacattcatcacacataacagtggaattaggcacatggaatgctaccctattttcttacaaatggtacaacttaaaaggggagtaagaattatcaaacgtgttttgcatcataaggctcatttctttttgtttgttgcagcaacatgcataactaattaaatttgagaaaatatttcccttttaatctgtccgcatgatctcacatgatctcacaagttcccttcatttccctaaatctaaatgtagctgaatgaatcaaaaggaaagaatgtccagttggccagaacttgcatc

SEQ ID NO: 160503 - DNA, 601 bp, Human
gggacattgatattctgctgttggattgggacttaacaccatcagccctccaattcttaggccttcagacttggactagaactcaacatcattggttctcaggtcttcagacttgaacgggaactatacaattggctctcttggctttccaatttgctgactgcagatcttgggactggctccattaatgtaaactaagtcctcattatctatatctctatctatctatcatctatctatctatctatctatctatctatctatctatctacctacctacctacctacctatctcctattkgttctgtttctctggagaaccttgactaataaaacatctaattcagttttgtgagagttagaagaaatggtactggtaaaaatgcctgatacctaggagatgctcaataaattttaattcttttttctctcatcttcctgataagttaagttgtgattcttgaataaacaacttagattctcagaaaataatgtaatttaagttttgctgtgaggtcagaaaaattgtccagtggaacattaaagtccattctggccacacatttaggctccttttaatgccaggagtatttccgacatt

SEQ ID NO: 160504 - DNA, 601 bp, Human
ggacctgaatagaacaaaaaggcaggggaagggagaattccctctctctctctgcctatctgtttgagttgggacattgatattctgctgttggattgggacttaacaccatcagccctccaattcttaggccttcagacttggactagaactcaacatcattggttctcaggtcttcagacttgaacgggaactatacaattggctctcttggctttccaatttgctgactgcagatcttgggactggctccattaatgtaaactaagtcctcattatctatatctctatctatctatcatctatctatctatctatctatctatctatctatctatctacctacctacctacctacctatctcctatttgttctgtttctctggagaaccttgactaataaaacatctaattcagttttgtgagagttagaagaaatggtactggtaaaaatgcctgatacctaggagatgctcaataaattttaattcttttttctctcatcttcctgataagttaagttgtgattcttgaataaacaacttagattctcagaaaataatgtaatttaagttttgctgtgaggtcagaaaaattgtcc

SEQ ID NO: 160505 - DNA, 601 bp, Human
ttcaatccactggggacctgaatagaacaaaaaggcaggggaagggagaattccctctctctctctgcctatctgtttgagttgggacattgatattctgctgttggattgggacttaacaccatcagccctccaattcttaggccttcagacttggactagaactcaacatcattggttctcaggtcttcagacttgaacgggaactatacaattggctctcttggctttccaatttgctgactgcagatcttgggactggctccattaatgtaaactaagtcctcattatctatatctctatctatctatcatctatctatctatctatctatctatctatctatctatctacctacctacctacctacctatctcctatttgttctgtttctctggagaaccttgactaataaaacatctaattcagttttgtgagagttagaagaaatggtactggtaaaaatgcctgatacctaggagatgctcaataaattttaattcttttttctctcatcttcctgataagttaagttgtgattcttgaataaacaacttagattctcagaaaataatgtaatttaagttttgctgtgaggtc

SEQ ID NO: 160506 - DNA, 601 bp, Human
tccatggggggcaaaatcgccctgattgagaaccattggtttagcggaagcagactggtgctttcagattagagagacatgcatttgaactctggagcaacatttgccatctatatgatctttggcaagttacttagccctctaagcctcagattccccatctaaaaatggggataacatctgtgatggttaattttatatgtcaacttgactagaccatgggatgcccagatatctacttagacattattcctgggtgtgtctctgagggtgtgttctgaagaaattaacatttgaattsgtagacagaataaagcagattgctctacccaatgtgagtgggcataattcaatccactggggacctgaatagaacaaaaaggcaggggaagggagaattccctctctctctctgcctatctgtttgagttgggacattgatattctgctgttggattgggacttaacaccatcagccctccaattcttaggccttcagacttggactagaactcaacatcattggttctcaggtcttcagacttgaacgggaactatacaattggctctcttggctttccaatttgctgactgcagatct

SEQ ID NO: 160507 - DNA, 601 bp, Human
gaccttgggaaagtcacttgccctttcttagatacagttttctcaagtgatgaacaatgaagagtgagacctagatgatcctctaaccctaatattttaggattctaaaattgaaaataattccattaattgtatgaatcctaaattgctgctatcttttccccttaaactactaaacccactaaaatatattccatgatttttattgtattaaaataaaatattttatatatggtaattcatgcttaaagtaaatatgtggactctattagcgatgataatttaaaacattctatcctcytagtgaatgctaattgtaaagaatcattgaaaaacgcagtttctttcctctacattttaaattcaatgtttacttatttattcatttattccacaaatatttattagagttatggaactatagtcacttatattttattttatttatttatttttatttttgagacagggtcttgctctgttgctcaggctggagtgtaattgcaatcatagctcactgcagcctccagttcctgggctcaggtgatcctcctgcctcagactctcaagtagctggggatataggtgcaaactattatgc

SEQ ID NO: 160508 - DNA, 601 bp, Human
acaagaaaagcattaaactgtcaggagagctggattctggctctagcagtgtccctgactgccaggagaccttgggaaagtcacttgccctttcttagatacagttttctcaagtgatgaacaatgaagagtgagacctagatgatcctctaaccctaatattttaggattctaaaattgaaaataattccattaattgtatgaatcctaaattgctgctatcttttccccttaaactactaaacccactaaaatatattccatgatttttattgtattaaaataaaatattttatatatrgtaattcatgcttaaagtaaatatgtggactctattagcgatgataatttaaaacattctatcctcctagtgaatgctaattgtaaagaatcattgaaaaacgcagtttctttcctctacattttaaattcaatgtttacttatttattcatttattccacaaatatttattagagttatggaactatagtcacttatattttattttatttatttatttttatttttgagacagggtcttgctctgttgctcaggctggagtgtaattgcaatcatagctcactgcagcctccagttcc

SEQ ID NO: 160509 - DNA, 601 bp, Human
caattttccatgaaagaaaaatgtatttaagtaaaaacatggagcaacctccccccgctgccccaaaactctaatacattgaaaaacaccttaaaacaagaaaagcattaaactgtcaggagagctggattctggctctagcagtgtccctgactgccaggagaccttgggaaagtcacttgccctttcttagatacagttttctcaagtgatgaacaatgaagagtgagacctagatgatcctctaaccctaatattttaggattctaaaattgaaaataattccattaattgtatgaaycctaaattgctgctatcttttccccttaaactactaaacccactaaaatatattccatgatttttattgtattaaaataaaatattttatatatggtaattcatgcttaaagtaaatatgtggactctattagcgatgataatttaaaacattctatcctcctagtgaatgctaattgtaaagaatcattgaaaaacgcagtttctttcctctacattttaaattcaatgtttacttatttattcatttattccacaaatatttattagagttatggaactatagtcacttatattttat

SEQ ID NO: 160510 - DNA, 411 bp, Human
tccctgttctaagtcagtcttccatcttctaaagatgtgttgacacttgtcttctttgtctcctcttcttttatctcagtcactgtgagtctatattattactattcttttcctatcattattctggaattttagcagggagtggcaacatatgtatatgtttcatctccatttcacaacagatgacttccatttcatattttcttcatattttcctctgtcattatcatcatcatttttagtgtgacacataggaattcctgtgggtctttgtgggtctttggttctaactcagcaaatraagtttttttttttcctttttttttttttaatacagagtcttgctactgttgcccaggctggagtgcaatggcgcaatcttggttcactataacctctgcctcctaggct

SEQ ID NO: 160511 - DNA, 601 bp, Human
acttcttacttctatgagatcaactttttcgcttccatatgagtgagaatatgcttatatactgttaattttttatttcccgaaggcttctttttaatattgtcctgttctttattagtgtgacatatgttcttgtctccttgaggatattaatcaaatattttgaaaatttcctctgcaccctgcagtttctgtttccttcttgttccttttttccccagttagtttgttttgatctttgtttttcctgttgaaagcttttctctaatgtctgatgtatttggctgtccattaatacttygcagtgagtcactagaaagccaattagaactttatggacagggcttggagggcttccaaagaatagttccatggagcattggagggcttccaaggagcagtaacctgacagtcttgatggggcaccccaaatgtcattgacagatattacagggagattttcttttctctagaggagaaattcatacctcttaccttgagaagcaaatataaacctggttgctagcattctgtgaaatcagtgaagagactggagttctctcagtgcacacactgatttttcacttagtccctaggtttc

SEQ ID NO: 160512 - DNA, 601 bp, Human
cactgtgcctggcctgttttattgattaaaaaaaattatacctttatacttcattttcttttttaattttatttttaaattgacaaataacaattatacatattcatggggtacatagtgatgcttcactacatataatgtatagtgatcagataaggataatttgcatatccatcacctcaaacagttattatttctttgtattgggaacagtgtcttctttctagctatttgaaatatataatatcctacagtggtatagagcactagaacttattcttcctattagctatagttttaygtcctttaacaaatagctccctattcctttcttctcctcacccttcccagcctcaagtatcctctgttctacttcttacttctatgagatcaactttttcgcttccatatgagtgagaatatgcttatatactgttaattttttatttcccgaaggcttctttttaatattgtcctgttctttattagtgtgacatatgttcttgtctccttgaggatattaatcaaatattttgaaaatttcctctgcaccctgcagtttctgtttccttcttgttccttttttccccagttagtttgt

SEQ ID NO: 160513 - DNA, 601 bp, Human
tctagaatttatattagttaaatatcagaattctggggttgattctccgatttgctaatcatttttgctcttctcttcaacagtgtgtctatcattctgggaaactttctcacttttaccttacatctctcctattgatttttttttttttcctggagatagggtttcgccatgatacccaggctggtatcaaactcctgagctcaaagtgatctgcctgcctcagccccctaaagtgctaggattacagggatgagccactgtgcctggcctgttttattgattaaaaaaaattataccyttatacttcattttcttttttaattttatttttaaattgacaaataacaattatacatattcatggggtacatagtgatgcttcactacatataatgtatagtgatcagataaggataatttgcatatccatcacctcaaacagttattatttctttgtattgggaacagtgtcttctttctagctatttgaaatatataatatcctacagtggtatagagcactagaacttattcttcctattagctatagttttacgtcctttaacaaatagctccctattcctttcttctcctcacc

SEQ ID NO: 160514 - DNA, 601 bp, Human
gcccttctattttttgtcttttctttctagaatttatattagttaaatatcagaattctggggttgattctccgatttgctaatcatttttgctcttctcttcaacagtgtgtctatcattctgggaaactttctcacttttaccttacatctctcctattgatttttttttttttcctggagatagggtttcgccatgatacccaggctggtatcaaactcctgagctcaaagtgatctgcctgcctcagccccctaaagtgctaggattacagggatgagccactgtgcctggcctgtyttattgattaaaaaaaattatacctttatacttcattttcttttttaattttatttttaaattgacaaataacaattatacatattcatggggtacatagtgatgcttcactacatataatgtatagtgatcagataaggataatttgcatatccatcacctcaaacagttattatttctttgtattgggaacagtgtcttctttctagctatttgaaatatataatatcctacagtggtatagagcactagaacttattcttcctattagctatagttttacgtcctttaacaaatagc

SEQ ID NO: 160515 - DNA, 601 bp, Human
aatttatatatttcagttctggggagcattttatgtgttagttccttaatgatttttgcccttctattttttgtcttttctttctagaatttatattagttaaatatcagaattctggggttgattctccgatttgctaatcatttttgctcttctcttcaacagtgtgtctatcattctgggaaactttctcacttttaccttacatctctcctattgatttttttttttttcctggagatagggtttcgccatgatacccaggctggtatcaaactcctgagctcaaagtgatctgccygcctcagccccctaaagtgctaggattacagggatgagccactgtgcctggcctgttttattgattaaaaaaaattatacctttatacttcattttcttttttaattttatttttaaattgacaaataacaattatacatattcatggggtacatagtgatgcttcactacatataatgtatagtgatcagataaggataatttgcatatccatcacctcaaacagttattatttctttgtattgggaacagtgtcttctttctagctatttgaaatatataatatcctacagtggtata

SEQ ID NO: 160516 - DNA, 601 bp, Human
ctctgccttagtttggatacttttacatttagtttaggaactcattaggccctttgaatttggaaatttatatatttcagttctggggagcattttatgtgttagttccttaatgatttttgcccttctattttttgtcttttctttctagaatttatattagttaaatatcagaattctggggttgattctccgatttgctaatcatttttgctcttctcttcaacagtgtgtctatcattctgggaaactttctcacttttaccttacatctctcctattgatttttttttttttcctrgagatagggtttcgccatgatacccaggctggtatcaaactcctgagctcaaagtgatctgcctgcctcagccccctaaagtgctaggattacagggatgagccactgtgcctggcctgttttattgattaaaaaaaattatacctttatacttcattttcttttttaattttatttttaaattgacaaataacaattatacatattcatggggtacatagtgatgcttcactacatataatgtatagtgatcagataaggataatttgcatatccatcacctcaaacagttattatttc

SEQ ID NO: 160517 - DNA, 601 bp, Human
attagaaaaatatctgtattttaccctttacttgatacatagtttgaatagatatagaattctagattggagtatttttttctcagaattttttttaaaacattggtctattttcttataatttccagtgttgctagtaagaactctgatgtgagtttttccccaatgtttttatgaacatagtatttttttcttctttatggatgcttttatgtttttacatttggccctagtcttctgaaatattaccatctctgccttagtttggatacttttacatttagtttaggaactcattagkccctttgaatttggaaatttatatatttcagttctggggagcattttatgtgttagttccttaatgatttttgcccttctattttttgtcttttctttctagaatttatattagttaaatatcagaattctggggttgattctccgatttgctaatcatttttgctcttctcttcaacagtgtgtctatcattctgggaaactttctcacttttaccttacatctctcctattgatttttttttttttcctggagatagggtttcgccatgatacccaggctggtatcaaactcctgagc

SEQ ID NO: 160518 - DNA, 601 bp, Human
ggactggtgtatctccggctgctgggcagcttttctcctggggtccatacctggggtcaccacgccctggtaatcccctttgtcttttttcttctgtttgatttcttgcttcctaagtcccatatatttttctttcttagttttctccctcattttgatgaagcacatactccataagtttcttgagaaaccacacacaggagacagaatttttaaggtattgcatattagaaaaatatctgtattttaccctttacttgatacatagtttgaatagatatagaattctagattggagtatttttttctcagaattttttttaaaacattggtctattttcttataatttccagtgttgctagtaagaactctgatgtgagtttttccccaatgtttttatgaacatagtatttttttcttctttatggatgcttttatgtttttacatttggccctagtcttctgaaatattaccatctctgccttagtttggatacttttacatttagtttaggaactcattaggccctttgaatttggaaatttatatatttcagttctggggagcattttatgtgttagttccttaatgatttttgc

SEQ ID NO: 160519 - DNA, 601 bp, Human
tttgaggccactgacacggtttcaaatgatctgatttgtgtacagctgctttattgctgtgcaaatggggccaatatatctgaccatgaagaagagaatattctagccctgcctactttcagcatacttgcttggacagcctcccaagggtgaattaggagctgatttatgattaccatatcgtttcctgcctaaaccattggtttctgttttcattatagactctcaaaatttctcagccagcatctatttgatcttgaagaaaatgctgctggagaccgtggatatgcaccctaagtattttttttttttcagacggagtctcactctgttgcccaggctggagtgcagtggagtgatctcagctcactgcaatctctgcctcctgggttcaattgattctccttgcctcagcctcccgagtagctgggattacaggtgcccgccaccatgcccggctaatttttgtattttttagtagagacggggttttgccatgttggccaggctggtcttgagctcctgacctcaggtgatccgcccatctcagcctcccgaagtgctgggattacaggcgtgagccaccgcacctggcctaaaa

SEQ ID NO: 160520 - DNA, 601 bp, Human
aaatgaaacaagtatacagcagctcagcccaagtagtaaaactcattaatcctcatcattcttctagtgattggaggcagttgaggtgatcatcatgttttaaaaaaattaaactgagacataaataacataatctcttttaccatgctttgaaactaagacctttggagaattaaaaaattgtattaatataaatgatgttacttttaccttatggtgggaatcgtcttctgtggatactgctgtttctttttcattttcttcagcttcagcccttaaactggggattgcagtgttgtcrggtgctaccgtttcagcagttggtttggaatgatcagataataatcttgcatttgtctgaaaaaattaaaaactggtttttgttattcatgtctggatgctaatttacaaatttgctagttactcttgttgtcatcattattagtagcaatatacttcatttataccaacaatttaaaaatattctctagagtttttgaggatataagcagatgcctagaacagaatgttaagtggaagcagaatctcaattgtgtttaagaaaaagttatttatgcagagactgggtgaaaataaaaca

SEQ ID NO: 160521 - DNA, 601 bp, Human
tttatgtccaatgtaccttcagttggtgcatactccaaattcacacttaagtgaccatcactgtcctcttgatccttcaatcccagctcttggctagaactcttgccctgttctgctgactgttcatggctttcctcttttgactttagtactgatgatttttcagccttaaaagaaaaaaaagttcattcttcaaacaaatgataatgtaaccatatttatgcctaaggtaacatttaatattcattattctttttcttcacacactatcatgtaaacatgtttataatattcctcacamtctgtagccacaggtttaaactgaatttggattttataaaatgaaacaagtatacagcagctcagcccaagtagtaaaactcattaatcctcatcattcttctagtgattggaggcagttgaggtgatcatcatgttttaaaaaaattaaactgagacataaataacataatctcttttaccatgctttgaaactaagacctttggagaattaaaaaattgtattaatataaatgatgttacttttaccttatggtgggaatcgtcttctgtggatactgctgtttctttttcattttct

SEQ ID NO: 160522 - DNA, 601 bp, Human
tattttgagatatgttccatcaatacctagtttattgagagtttttagcatgaagggatactgaattttgttgaagaccttttctgcatctattgagataatcatgtggtttttgtcattagttctgtttatgtgatggcttacacgcattgatttgcgtatgttgaaccatccttgcatcccagggatgaaggtgacttgattgtggtagataagctttttgatgtgctcctggatttggtttgccagtattttattgaggattttcgcatccatgttcatcagtgatattggcctgaatttttttttttttttgtatatccttcaggttttggtatcaggatgatgctggcctcataaaatgagctagggaggagtccctctttttctattgtttggaatactttctgaaggaatagtaccagctcctctttgtacctctggtagaattcagctgtgaatctgtctggtccccagctttttttggttggtaggctattaattactgcctcaatttcagaacttgttattggtctattcagggattcaacttcttcctgatttagtcttgggagggtatatgtgtccaggaatttatcta

SEQ ID NO: 160523 - DNA, 601 bp, Human
agtgtttggttttctgttcctgtgttagtttgctgagaatgatggtttccagcttcatccatgtctctgcaaaggacatgaacttatccttttttatggctgcatagtattccatggtgtatatgtgtcatattttctttatccagtctatcactgatgggcattttggttggttccaagtctttactattgtgaacagtgctgtaataaacatatgtgtgaatgcatctttatagtagaatgatttgtaaccctttgggtatatacccagtaatgggattgctgtatcaaatggtatttrtagttctagatccttgaggaattgccacactgtcttccacaatgattgaactaatttactcccaccaacaatatgaaagcgttcctatttcttcacatcctctccagtatctgttgtttcctgactttttaatgatcgccattctaactggtgagagatggtatctcattgtggttttgatttgcatttctctaatgacgagtgattatgagctttttttcatatgttttttggctgcataaatgtcttctttttgagaagtgtctgttcatatccttcacccactttttgatggggttg

SEQ ID NO: 160524 - DNA, 601 bp, Human
tggtctggcgtgaagtctgggcatcaggatgtttttaaagctccaagatctatttggatgtgcagctaggccccagaatcactgctgtagaatcagagttgaaatttgtaggtggagggcacaagtgctattgaatagagaaaaaggtagctattagctgatactacagtaagaaataatgctaaatctcagtggcttaaagaaacagaagtcaattttgcaatcctgctacaagtccaatacaagttggcaggagggctctgctcattgcagtctccccagagctcaggatcactgccgttttttttttttttaattatactttaagttctgagatacatgtgcagaatgtgcaggtttgttacataggtatacacatgccatagtggtttgctgcacccatcaacccatcatctacattaggtatttctcctaatgctatccctctcctagtcccccagcccctgacaggccctggtatatgatgttcccctccctgtgtccatgtgttttcactgttcaactcccacttatgagtgagaacatgcagtgtttggttttctgttcctgtgttagtttgctgagaatgatggtttccagc

SEQ ID NO: 160525 - DNA, 601 bp, Human
tggttatatttacataaatgctcattttactatatataattgcatatatgcatatatatgtatgtacaaatatatgcatatacaaacattacatacgcacacacatatatacttatttgtttagagtctgtctcttcacccagaatgtaaactcatgaaggcagagattttcttttcgttgctgtatctccagtatttaggtcaatttctggcacccaggatacactcaataactatctggtgaatgaattttctctggaagcttttggaatcaatgttctgtgctttttaatcttaatakattactgatattttgagtaatggatttactttatatcatacatctatgtctggcctatgagaacaaaacaaatgcttagatttaaataagatgtttggactgactagatcaatgctaaatttatattaactttgctcaaccagagcttgctctaggtaggaattgaagagccctaattcaggccactgaccattgggaagaatggggcggtttggtggtgtctgaaaccttgtggcgtgaatggtgacatctattattctgttaagccacatgggctaaccgggcatggggaagcatagt

SEQ ID NO: 160526 - DNA, 601 bp, Human
cagacttttttattattattattataccttaagttctagagtacatcatacacagcagctttgtgtttagactcctaaccaggcatttcagtattctaaaatggaactgggaaatgtcctaaatctgtttagattttccttttgcatagatatgtagatattttatcagagagataaatctagaaatggaaaggtaaagagttcttacctatccatagggtgttggtcaagttcactaaactgccagtgcacaggatacacatacatgtggtagtttttcttaaagtcccttaagagaagrtcaatgggatggtccccagccaaaagcctcttttcatccaggtaaattttcttgacctgggattaggaaggcagaagactgtcagagaatcagacaaatgtaatggacttgtcacttgctataaactttacttgaagagtgacagtaacacgataggggaaaacaagctcaggacatcatgtgcaactaaatgaaattccttccaatcaatactacaggcctttctcatgtctacacagaatagcacctgatgtaagaaacctctggtttttagaagaaatttaaattcttttttaaact

SEQ ID NO: 160527 - DNA, 601 bp, Human
gtgggtaaggttgacagcttttgggatgttgattcacaagttttctgtcttcacaggaactgtccttcccccaccctaaatctataggggtgtacccagcagtcatgttggtacaacctggttctcatctactggccatacctgattgttttagatgtagtcacttgacccacattgggccaatcttgggaatttacgatcaagaatgagaaagttggaggagtatctgtgggaagctggaccttaacatgtaaacttgggagctgtggtgtagccatattctgctatcttcacagcagctttttttttttaatgaatattacatagctttgataattgtgataaggggacttcaaaaagttcattgagaaatggaattaaaagataaaattataaaacataaactttatcaacataagctctatcaagtttcagacttttttattattattattataccttaagttctagagtacatcatacacagcagctttgtgtttagactcctaaccaggcatttcagtattctaaaatggaactgggaaatgtcctaaatctgtttagattttccttttgcatagatatgtagatattttatcag

SEQ ID NO: 160528 - DNA, 601 bp, Human
tgtgcttatccttgttggggtcacactcctcaaagaaacgggttatgcagtgttccatgggcaccagagatgctcgcagaggagcaagttcagaatgtgtcaagactctgcaatgaaatacatggcatcctattaattgagtagcttgtgcatgaagatttaactctcaggctcaccaaggacatttttctcccataaggttgctgtatatgtgatataaatagaatacagataaaaactgccaacgaaataaagtatttgtgggtaaggttgacagcttttgggatgttgattcacaagktttctgtcttcacaggaactgtccttcccccaccctaaatctataggggtgtacccagcagtcatgttggtacaacctggttctcatctactggccatacctgattgttttagatgtagtcacttgacccacattgggccaatcttgggaatttacgatcaagaatgagaaagttggaggagtatctgtgggaagctggaccttaacatgtaaacttgggagctgtggtgtagccatattctgctatcttcacagcagctttttttttttaatgaatattacatagctttgataattgtg

SEQ ID NO: 160529 - DNA, 601 bp, Human
taactcctgacctcacgtgatccacccacctcggcttcccaaagtgctgggattacaggcatgagccaccgtgcccagcctttcatatcttaattattgaaaacatacttgctcataaaattcaagcctaacttaaggaaagaaaaggaaacatattaagacataacccagcaaaacaagcatctaaatttaatttcctccactgcaggagtaaagaaagaatactctgatctaccctcccacagctcccattcattgagggtgaagccatgggtgagttttgggttaaaggattatcccrgcactaattgtgatgtaaaatccagtctttagtgtgttggtaatggattctgagatgttctgacatctcccattgtcagaaatgggcttgcttttttattctttatgtgtaattttgaaaagtttggcccaaggcccaggttaaggtaggatatgaaataaggaaggacacaaagcctgctgagatttggcccaattctggattcacacgtctttctaggcttagctgactgttgagacctcaatgcatgttcacccttgctaccctttgaaaacagtgccataaaggtagtaagaagtg

SEQ ID NO: 160530 - DNA, 601 bp, Human
gctgggattacaggcgtgtgccaccaagcccgcctaatttttgtatttttggtagaggcggggtttcaccatgttggccaggctagtctctaactcctgacctcacgtgatccacccacctcggcttcccaaagtgctgggattacaggcatgagccaccgtgcccagcctttcatatcttaattattgaaaacatacttgctcataaaattcaagcctaacttaaggaaagaaaaggaaacatattaagacataacccagcaaaacaagcatctaaatttaatttcctccactgcaggartaaagaaagaatactctgatctaccctcccacagctcccattcattgagggtgaagccatgggtgagttttgggttaaaggattatcccagcactaattgtgatgtaaaatccagtctttagtgtgttggtaatggattctgagatgttctgacatctcccattgtcagaaatgggcttgcttttttattctttatgtgtaattttgaaaagtttggcccaaggcccaggttaaggtaggatatgaaataaggaaggacacaaagcctgctgagatttggcccaattctggattcacacg

SEQ ID NO: 160531 - DNA, 601 bp, Human
tatcttaaaatatatcttgaatatgtttacttctctctttttttcccctttggtcactcccctagttcaagttctcatcagctcttgcctgggtttaccacagtattctctcaacaattctttggccccaccacaatgtaaccaggagaatccatcttaaatacaaacccagggaaatcactggcttgtttgaaacactttggtggccccccagtactcttaggataatgtctttaaatggcttaggggaacttgcgtcatctgagttgtttaccctgttagtctcacttggagggttttctgacgattagcatgggtatgtgtcaatgcatggtatgcatgggcacaaaataaatgaggattcctgcacctgttacctgaaccccatttttacagataaggaaaatgagactcactgaggctaagcaacatgccctaattcacacagctagttaataacagctatgtgaggaatatatgagcacgtctatcacaggcagttaaaattcaggaaaacattggctaaactttatcttctcctgtagatttctcagccttgaaggaaagaagggtatacttacaaataaatttgtttttcttt

SEQ ID NO: 160532 - DNA, 601 bp, Human
aatcaatgtaggtgcccatcagtggtgggcatggtagggataatggtagttttgatggagtggtagagataatggccaaaccataattacttttgcatgaaactaacacttaggaggcaacctaatactttacaattcaacgtatctaaaatggaatttgtcatttactccaaatccacttctgttcttgtgttttctcagtggaagatgcctctatttacctctatttaccctgcctgctctgagccagggacctaggcattgcacttctcttttcagtctctcacctgtctgctctcgrctcccacatatttcctatcaaatattgtcttatttccacatgctatatatttgagtatgcttatatcttaaaatatatcttgaatatgtttacttctctctttttttcccctttggtcactcccctagttcaagttctcatcagctcttgcctgggtttaccacagtattctctcaacaattctttggccccaccacaatgtaaccaggagaatccatcttaaatacaaacccagggaaatcactggcttgtttgaaacactttggtggccccccagtactcttaggataatgtctttaa

SEQ ID NO: 160533 - DNA, 601 bp, Human
tgaaacacctcctttgcatggcactatcctggttttcttccttcatttcaggagaaacttcattctccttactgaattctttcttcctcccctatccatcatctagatgttgttgtttctcagtgcagtgttcaatcctagaccccttttcatgtaactcaatgcgttttccttgggagaattaattcccttccctggtgtcaattattctctgtatgcttataatcctcaaatatgcatttcagttccaaaaccctgtcttgatatataagcggccaacaaatatatataaagttccacrttactaatcatcaggaaaatttaaatcaaaaccatctcacaataagatgccatttcacaccagtcagaatggctgtaattaaaaagtctaaaaacaacatgctggtgaagctgcagagaaaaagaatgcttagacactggtaatgtaaattagttgagccactgtggaaagcagtttgaagatttctcaaagaacttaaaacagatctactattcaacccagcaatcccatactgggtatatttataaaaaaatcattttactaaaaagacacatgcactcatatgctcgttgcagcact

SEQ ID NO: 160534 - DNA, 601 bp, Human
tctctcttttttttttttttttttgagacggagtctcgctctttcacccaggccagactgaagtggcgcagtctcggctcactgcaagctccgcctcccgggttcacgccattctcctgcctcagcctcccgagtggctgggactacaggcgcccgccaccgcgcccggctaattttttgtatttttagtagagacggggtttcaccgtgttagccaagatggtctcgatctcttgaactcgtgatccgcctgcctcagcctcccaaagtgctgggattacaggcgtgagccaccgcgccyggcctgtaaagatttcttgagcaaatgaatgagtaaatgaaaggagtgctcaaatctcttttattctaaaaaatgctccccttttttagaaaatgctctgtagcttttctaggtctttcctgcactcaaacatccactccttaccctttctaatctcccttttcttctcaacccatagaatgtgacttccatgtctaccattccaccagaactactctaaccaaggctacccaggatatccttatttctttcaacttctttgacatctcagtcgcatttggcactgttaatctcttcctc

SEQ ID NO: 160535 - DNA, 601 bp, Human
tctagaacagtgcctgcatttatgtagaccatctgtaaagatttctctctctctcttttttttttttttttttgagacggagtctcgctctttcacccaggccagactgaagtggcgcagtctcggctcactgcaagctccgcctcccgggttcacgccattctcctgcctcagcctcccgagtggctgggactacaggcgcccgccaccgcgcccggctaattttttgtatttttagtagagacggggtttcaccgtgttagccaagatggtctcgatctcttgaactcgtgatccgccygcctcagcctcccaaagtgctgggattacaggcgtgagccaccgcgcctggcctgtaaagatttcttgagcaaatgaatgagtaaatgaaaggagtgctcaaatctcttttattctaaaaaatgctccccttttttagaaaatgctctgtagcttttctaggtctttcctgcactcaaacatccactccttaccctttctaatctcccttttcttctcaacccatagaatgtgacttccatgtctaccattccaccagaactactctaaccaaggctacccaggatatccttatttcttt

SEQ ID NO: 160536 - DNA, 601 bp, Human
actttcctctttttttcttacatccttcttccacctttccttttttactagacccttccattagcatttaaatatgtttcatatttagcctctagaacagtgcctgcatttatgtagaccatctgtaaagatttctctctctctcttttttttttttttttttgagacggagtctcgctctttcacccaggccagactgaagtggcgcagtctcggctcactgcaagctccgcctcccgggttcacgccattctcctgcctcagcctcccgagtggctgggactacaggcgcccgccaccrcgcccggctaattttttgtatttttagtagagacggggtttcaccgtgttagccaagatggtctcgatctcttgaactcgtgatccgcctgcctcagcctcccaaagtgctgggattacaggcgtgagccaccgcgcctggcctgtaaagatttcttgagcaaatgaatgagtaaatgaaaggagtgctcaaatctcttttattctaaaaaatgctccccttttttagaaaatgctctgtagcttttctaggtctttcctgcactcaaacatccactccttaccctttctaatctccctt

SEQ ID NO: 160537 - DNA, 601 bp, Human
agcttcattagttatacgtttacttatatttgcacccatagcctttgtcttctttctgttgctcagataagagattgtcctttttcttgacgttaaggctaattcctctacctatgctcaagatctcttctgaccttcacaagattctccttttactttcctctttttttcttacatccttcttccacctttccttttttactagacccttccattagcatttaaatatgtttcatatttagcctctagaacagtgcctgcatttatgtagaccatctgtaaagatttctctctctctctyttttttttttttttttgagacggagtctcgctctttcacccaggccagactgaagtggcgcagtctcggctcactgcaagctccgcctcccgggttcacgccattctcctgcctcagcctcccgagtggctgggactacaggcgcccgccaccgcgcccggctaattttttgtatttttagtagagacggggtttcaccgtgttagccaagatggtctcgatctcttgaactcgtgatccgcctgcctcagcctcccaaagtgctgggattacaggcgtgagccaccgcgcctggcctgt

SEQ ID NO: 160538 - DNA, 601 bp, Human
gggaggtccagccaagaagtgcccagtatactaatctagaaggtgagctgaaaaataatggaaataaatagaagtgtagtgctaggttattccagtttttaattgagtagcttgtgaaagaaattgttgccatacctgtggaagaagacagcatcctctagcaaatataagatcactccttaccaacatggcccaccctaacaaactattatactactctgtgtgggcactaggtaattttcctgctaataatctttatctagcccagagaatgggaaagattatggactttgattttttwttttgagtactggcttcatatgtaaaatggagataatagcttcattagttatacgtttacttatatttgcacccatagcctttgtcttctttctgttgctcagataagagattgtcctttttcttgacgttaaggctaattcctctacctatgctcaagatctcttctgaccttcacaagattctccttttactttcctctttttttcttacatccttcttccacctttccttttttactagacccttccattagcatttaaatatgtttcatatttagcctctagaacagtgcctgcat

SEQ ID NO: 160539 - DNA, 601 bp, Human
aggacagcaacatcactcatgaacttttacaaatatgtatttttaggcctcacctctggactctagaatcagaatccctaggggtggactaatggcatgtagacgtttagaaaactctgcaggtaatttggctgcagggttgagaaccactgatagaggaagagcaggttaacgggaggtccagccaagaagtgcccagtatactaatctagaaggtgagctgaaaaataatggaaataaatagaagtgtagtgctaggttattccagtttttaattgagtagcttgtgaaagaaattgtygccatacctgtggaagaagacagcatcctctagcaaatataagatcactccttaccaacatggcccaccctaacaaactattatactactctgtgtgggcactaggtaattttcctgctaataatctttatctagcccagagaatgggaaagattatggactttgatttttttttttgagtactggcttcatatgtaaaatggagataatagcttcattagttatacgtttacttatatttgcacccatagcctttgtcttctttctgttgctcagataagagattgtcctttttcttga

SEQ ID NO: 160540 - DNA, 601 bp, Human
gtcggcggcggggacccgctgcatcgccacctccccctggaagggcagccgccccgagtggcctgggcggagaggctggttcgcgggctgcgaggtaagagcgcgcgacccgcagcggcagatgcacgaaccagaacggccggcgccggccggggccatcgcccgctgcggcagctccccgggctccatctcgcatcccctctgcgttccgcctcccttggaagcgcattccccacctccgctagtgctgccctatttccggtacccagcgcggaattccactgctcttttgttggtgcayatttattggatacctccttcttcaggatatgtcaccatagtcttttttactgaaaattagtgaaagcctaattagagtgaaagagtacatctgggttttgtttttttttttcttgtagaggaaaaaatgaacattacttgtgtaactgatggtagttgcaactgcatatttgccaatgtcacaaaatctaaaggaaaatgttatagtcacccgtggtttccttcttgcctggacactccattgtcccgggctgaaaagggtagcagtacagtgcatataatgtcaagttgtgggaggagt

SEQ ID NO: 160541 - DNA, 601 bp, Human
gtgttgttacagcagtgtgattaaaaccaggtcaggcctacactgaaatcccagttccaccactcattagctgtacgaccttgagcaagttacttatcctctctgatacccaatttttggattttttttttttttaaagagatgatcataacgcttaggacttgactctttgggagaattaagtgagttaagacataaaatgtgcagcatgtatttgtcatgttattagcgcttcagaaatataaatgtaaacattttggtacttcgtttatggagattcttatactagttaattttattmaaagcatgatggggaacaaaagatccttttcggataacctgtgtgagtaaattaataaaacactaacactttttaagattcaaaactggattaattatgttattttacaccatttaaaatgtgcatttaaaaaatattcactgaagtgagagagaagttccttttaagttaataaataatggtaagttgcatgatccttttaactcagtttaagcatttgataacacacctaaccttgtttgaataaactcaataacagaatatagagaaataaaatatatatttcatatgagtatgtat

SEQ ID NO: 160542 - DNA, 601 bp, Human
gcgcttcagaaatataaatgtaaacattttggtacttcgtttatggagattcttatactagttaattttattaaaagcatgatggggaacaaaagatccttttcggataacctgtgtgagtaaattaataaaacactaacactttttaagattcaaaactggattaattatgttattttacaccatttaaaatgtgcatttaaaaaatattcactgaagtgagagagaagttccttttaagttaataaataatggtaagttgcatgatccttttaactcagtttaagcatttgataacacmcctaaccttgtttgaataaactcaataacagaatatagagaaataaaatatatatttcatatgagtatgtatgtaaatttatttcttttaaaggaaaatttcaggaaacaaaatgaataagctcatagtcataaaacctctagccaaagtgtgtcaatggtctgatttgtaggagagcagactcaggaatcgggaattttttttttttttttaagagtcggggtttcactctgtcactgaggctggagtgcggggaagcaaacgtagctcactgcggcctcaaactcctgggctcaagct

SEQ ID NO: 160543 - DNA, 601 bp, Human
ttttggtacttcgtttatggagattcttatactagttaattttattaaaagcatgatggggaacaaaagatccttttcggataacctgtgtgagtaaattaataaaacactaacactttttaagattcaaaactggattaattatgttattttacaccatttaaaatgtgcatttaaaaaatattcactgaagtgagagagaagttccttttaagttaataaataatggtaagttgcatgatccttttaactcagtttaagcatttgataacacacctaaccttgtttgaataaactcaataacagaatatagagaaataaaatatatatttcatatgagtatgtatgtaaatttatttcttttaaaggaaaatttcaggaaacaaaatgaataagctcatagtcataaaacctctagccaaagtgtgtcaatggtctgatttgtaggagagcagactcaggaatcgggaattttttttttttttttaagagtcggggtttcactctgtcactgaggctggagtgcggggaagcaaacgtagctcactgcggcctcaaactcctgggctcaagctgccctcccacctcagcttcccaagta

SEQ ID NO: 160544 - DNA, 601 bp, Human
gatccttttcggataacctgtgtgagtaaattaataaaacactaacactttttaagattcaaaactggattaattatgttattttacaccatttaaaatgtgcatttaaaaaatattcactgaagtgagagagaagttccttttaagttaataaataatggtaagttgcatgatccttttaactcagtttaagcatttgataacacacctaaccttgtttgaataaactcaataacagaatatagagaaataaaatatatatttcatatgagtatgtatgtaaatttatttcttttaaagraaaatttcaggaaacaaaatgaataagctcatagtcataaaacctctagccaaagtgtgtcaatggtctgatttgtaggagagcagactcaggaatcgggaattttttttttttttttaagagtcggggtttcactctgtcactgaggctggagtgcggggaagcaaacgtagctcactgcggcctcaaactcctgggctcaagctgccctcccacctcagcttcccaagtagttgggattacaggtgcaagctgctgctcctagctgaaaagttttaattatataaaatgtttaaataa

SEQ ID NO: 160545 - DNA, 601 bp, Human
gagagagaagttccttttaagttaataaataatggtaagttgcatgatccttttaactcagtttaagcatttgataacacacctaaccttgtttgaataaactcaataacagaatatagagaaataaaatatatatttcatatgagtatgtatgtaaatttatttcttttaaaggaaaatttcaggaaacaaaatgaataagctcatagtcataaaacctctagccaaagtgtgtcaatggtctgatttgtaggagagcagactcaggaatcgggaattttttttttttttttaagagtcrgggtttcactctgtcactgaggctggagtgcggggaagcaaacgtagctcactgcggcctcaaactcctgggctcaagctgccctcccacctcagcttcccaagtagttgggattacaggtgcaagctgctgctcctagctgaaaagttttaattatataaaatgtttaaataaattgttattcctttcttttatgaagaaatataattgatattcttgtcacttattaaataagcaacattttaaaatgtttagcacctactgtgaagatagcactgtgctagctgctatgaataaact

SEQ ID NO: 160546 - DNA, 601 bp, Human
gttaataaataatggtaagttgcatgatccttttaactcagtttaagcatttgataacacacctaaccttgtttgaataaactcaataacagaatatagagaaataaaatatatatttcatatgagtatgtatgtaaatttatttcttttaaaggaaaatttcaggaaacaaaatgaataagctcatagtcataaaacctctagccaaagtgtgtcaatggtctgatttgtaggagagcagactcaggaatcgggaattttttttttttttttaagagtcggggtttcactctgtcactgmggctggagtgcggggaagcaaacgtagctcactgcggcctcaaactcctgggctcaagctgccctcccacctcagcttcccaagtagttgggattacaggtgcaagctgctgctcctagctgaaaagttttaattatataaaatgtttaaataaattgttattcctttcttttatgaagaaatataattgatattcttgtcacttattaaataagcaacattttaaaatgtttagcacctactgtgaagatagcactgtgctagctgctatgaataaactagaatagcatatcactgttt

SEQ ID NO: 160547 - DNA, 601 bp, Human
ggtaagttgcatgatccttttaactcagtttaagcatttgataacacacctaaccttgtttgaataaactcaataacagaatatagagaaataaaatatatatttcatatgagtatgtatgtaaatttatttcttttaaaggaaaatttcaggaaacaaaatgaataagctcatagtcataaaacctctagccaaagtgtgtcaatggtctgatttgtaggagagcagactcaggaatcgggaattttttttttttttttaagagtcggggtttcactctgtcactgaggctggagtgcgrggaagcaaacgtagctcactgcggcctcaaactcctgggctcaagctgccctcccacctcagcttcccaagtagttgggattacaggtgcaagctgctgctcctagctgaaaagttttaattatataaaatgtttaaataaattgttattcctttcttttatgaagaaatataattgatattcttgtcacttattaaataagcaacattttaaaatgtttagcacctactgtgaagatagcactgtgctagctgctatgaataaactagaatagcatatcactgttttcctatggacaaa

SEQ ID NO: 160548 - DNA, 601 bp, Human
caaaatgaataagctcatagtcataaaacctctagccaaagtgtgtcaatggtctgatttgtaggagagcagactcaggaatcgggaattttttttttttttttaagagtcggggtttcactctgtcactgaggctggagtgcggggaagcaaacgtagctcactgcggcctcaaactcctgggctcaagctgccctcccacctcagcttcccaagtagttgggattacaggtgcaagctgctgctcctagctgaaaagttttaattatataaaatgtttaaataaattgttattcctttmttttatgaagaaatataattgatattcttgtcacttattaaataagcaacattttaaaatgtttagcacctactgtgaagatagcactgtgctagctgctatgaataaactagaatagcatatcactgttttcctatggacaaaaacccagaaatgtaaaataaatagccatgaatgggttgagattccccctgccccctttggatactgatgacagaaatcttatatgcactatgtaagcagtgccctaggatcagaacagaaagtaacttgcaatttttaaaggtgggagaaatgact

SEQ ID NO: 160549 - DNA, 601 bp, Human
gcatggtgtacaggagagcttggcagagagaaaggaggcaagaagacctgtgggaggcagccagtaaggaggtgaagagggcctggaccaaaggaagccaaggatgaccgaaagatttaaagatgaagcccagatttaaaagtatcctcaagtatttgtttattcttttcttagcaaattctttttagtacaaagataaaatatggcactctgagtcataaaattttctgaatttcagaagttgaatgtttttctgaatgtatcaacctgttaaagtcagttcctgtttgttattttaggygtatattcttgggcttttttttttttttcctagagaaactatgaagtactagctgtgcaagtcagggtgggctaagctgctaaaacagatacctccctccccttcaataccctgaagaacaagaagttaattttttgctcgtgtaacattttagagagggtattccaggttgaatacctggaataatgaatgaaataataagtcgactcttatttctcctaaaataattggatcttgacattgaaattggtgtgctgattgtatttaataagtgacctccaatgcagttatttcattttg

SEQ ID NO: 160550 - DNA, 601 bp, Human
gaatgaaataataagtcgactcttatttctcctaaaataattggatcttgacattgaaattggtgtgctgattgtatttaataagtgacctccaatgcagttatttcattttgccatactttatgtaatttttattttttctgccttccctttcgatgtctaaagggaagcataattagttattggaaaggttattgagacttaaaaaaagatttgaacatggctttggttgatgctaccacacagaaactgcaaacatccaactcaccgctcttagttgctgttcatgatagtctatgcrcagtgactgatgaatttagcctgtcttgaggcttcagaacttagtcttatgtcatcacgagcagagctttatcctaaattacaggttttcaatgggggggggggaggggcagttttgcccctcaggggacatttggcaatctctggagacatttttgattgtcatacctggggggatgcccctggcatctcctgggttgaggttaaggatgctgctaatctacaatgcacagtacagccaccccacacacacacactacaaagcattctcccacccaaattgccaggagtgaggactttg

SEQ ID NO: 160551 - DNA, 601 bp, Human
tcattttgccatactttatgtaatttttattttttctgccttccctttcgatgtctaaagggaagcataattagttattggaaaggttattgagacttaaaaaaagatttgaacatggctttggttgatgctaccacacagaaactgcaaacatccaactcaccgctcttagttgctgttcatgatagtctatgcacagtgactgatgaatttagcctgtcttgaggcttcagaacttagtcttatgtcatcacgagcagagctttatcctaaattacaggttttcaatgggggggggggaggggcagttttgcccctcaggggacatttggcaatctctggagacatttttgattgtcatacctggggggatgcccctggcatctcctgggttgaggttaaggatgctgctaatctacaatgcacagtacagccaccccacacacacacactacaaagcattctcccacccaaattgccaggagtgaggactttgagaaaccctgccctagactgttaaattcaaaaggaaataatggtttattgctcacagtgtgccaggcactgtgttaaactccttatattcatagttttgttttta

SEQ ID NO: 160552 - DNA, 601 bp, Human
ttttgccatactttatgtaatttttattttttctgccttccctttcgatgtctaaagggaagcataattagttattggaaaggttattgagacttaaaaaaagatttgaacatggctttggttgatgctaccacacagaaactgcaaacatccaactcaccgctcttagttgctgttcatgatagtctatgcacagtgactgatgaatttagcctgtcttgaggcttcagaacttagtcttatgtcatcacgagcagagctttatcctaaattacaggttttcaatgggggggggggaggsgcagttttgcccctcaggggacatttggcaatctctggagacatttttgattgtcatacctggggggatgcccctggcatctcctgggttgaggttaaggatgctgctaatctacaatgcacagtacagccaccccacacacacacactacaaagcattctcccacccaaattgccaggagtgaggactttgagaaaccctgccctagactgttaaattcaaaaggaaataatggtttattgctcacagtgtgccaggcactgtgttaaactccttatattcatagttttgtttttatcc

SEQ ID NO: 160553 - DNA, 601 bp, Human
gggggggaggggcagttttgcccctcaggggacatttggcaatctctggagacatttttgattgtcatacctggggggatgcccctggcatctcctgggttgaggttaaggatgctgctaatctacaatgcacagtacagccaccccacacacacacactacaaagcattctcccacccaaattgccaggagtgaggactttgagaaaccctgccctagactgttaaattcaaaaggaaataatggtttattgctcacagtgtgccaggcactgtgttaaactccttatattcatagtttygtttttatcctcacaacaacctgtgaagaaagaactctcatccgtcaccactttactgttgagggcactaagccttctaaaggttaaatgacttgcccagggccgcaactattagatgttgcagtcaggatttaattccaggcactttgtgttcaaagtgtttctcatccactgtgctatatgccagtagtgcccaaacctaactttagccagcaattgtctgcatctctttagtttatgaacatttatttattaggacatgcaggataaatcataccaacacagtccgtgtatccagaa

SEQ ID NO: 160554 - DNA, 601 bp, Human
aatacacagggccaagcacagtggctcacatctgtaatcccagcactttgagaggccaaggtgagaggattgcttgagctcaggagtttgaggccagcctaggcaatgtagtgagaccccacctctacaaaaaattaaaaacttagttgggcttggtagtatgtacctgtagtttaagaaacttgggaggctgagctgaggcaggaggattgtttgagcccgggtggtcaaggctgcagtgggccatgattgtgccagagtactccagcctgggtgatagagtgagactctgtctcaaacaaaaaaaaaaacagagacagaaaaaaagaaagaaaatatatggatgtatatcatataaaaatataaataagggaggccaagtgcagtggcatgcctgtaatcccagcactttgggaggctgaagcaggaggatcacttgaggccgagaattcgagaccagcctgggcaacgtattgagacctcatctctgcaaaaaatcaaaaaatgaggcggaaggatggcttgagcccaggagatcaagccttcagtgagctgtgatcgtaccactacactccaggctgggtaacagagagagaccctg

SEQ ID NO: 160555 - DNA, 601 bp, Human
ggcggaaggatggcttgagcccaggagatcaagccttcagtgagctgtgatcgtaccactacactccaggctgggtaacagagagagaccctgcctcaagataaataaattcatacatacatacatacatacgtacatacatacatacataagaagacttgtttctttccatttgcaatgtttcattcaaaggctagaattaaattgccgtaggccatcacaagtttagcttgaatattattattttttcaagatggagtctcactctgtcacccaggctggagtgcagtggtgtgatttyggctcactgcaacctctgtctcccgggttcaaccgattcttctgcctcagcctcccatgtagctgggattacaggcgcccgccaccacacctggctaagttttgtatttttagtagagacagggtttcaccatgttggccagactggtcttgaactcctgacctcaagtgatctacccgcctcaccctcccaaagtgctgggattataggcttgagccactgcacccagcctagcttgaagaaaatttgataggagtttgtttttttctatttataggccaagcaataccacgtataaat

SEQ ID NO: 160556 - DNA, 601 bp, Human
tgctggacttttactccacaagaaacttgctataggcccatctctttcgtcttctttccttctttcagttcgtcttcccatcctctggtagggggaggggagggatgcctgagcgagagactagctgtaggaaccatttgtctcaaagtccagaaagccacaggtgatggatttgtcctctgaatcaaagggcgttcgatgatggatttctgtcatgtctcatctaaagtcttcacgagaacagatgaggaagcagttttatgaccccagagcctcctaccaaactcctctgagaaaaggkttccttttttttttttttttttaaattagagacagagtcttgatctgtttcacaggccggagtgcagtggcacaatcatagctcactgcagcctcgagctcctaggcttcagtgatcctcccacctcagtcacccacgtagctgggactacagctgcacaccaccatgcccagctaacttttaaaacatttttgtagaggtggggtctcactttgctgcctatactggtctccagctcctagcttcaagtgatcctcctgcctcggaagttctgggattataggcatgagccactgcacc

SEQ ID NO: 160557 - DNA, 601 bp, Human
gacttttactccacaagaaacttgctataggcccatctctttcgtcttctttccttctttcagttcgtcttcccatcctctggtagggggaggggagggatgcctgagcgagagactagctgtaggaaccatttgtctcaaagtccagaaagccacaggtgatggatttgtcctctgaatcaaagggcgttcgatgatggatttctgtcatgtctcatctaaagtcttcacgagaacagatgaggaagcagttttatgaccccagagcctcctaccaaactcctctgagaaaaggtttccttttttttttttttttttaaattagagacagagtcttgatctgtttcacaggccggagtgcagtggcacaatcatagctcactgcagcctcgagctcctaggcttcagtgatcctcccacctcagtcacccacgtagctgggactacagctgcacaccaccatgcccagctaacttttaaaacatttttgtagaggtggggtctcactttgctgcctatactggtctccagctcctagcttcaagtgatcctcctgcctcggaagttctgggattataggcatgagccactgcacccagcc

SEQ ID NO: 160558 - DNA, 601 bp, Human
ctttacatatacagacaaatttcttatgcaaaatagaaggtaacccctgtacgtaagtctagaatttcagcagtccccaaaactgactgagcattagaatcactctgattttaaaatacatatgtggttttccgagatctactaacagagcctccataatgtagcctagagaaacgagttttcagatgtagtgataaatttggaaggtaagtcagagaagtaagctgaagacagagttttaggaaatatgcctaaagtcacataatgaattggttttcttgtttatttgagaatattgtckctttttgttctttttcatgcaaatcacattttatttcttatgtgagtagctatatatttaaaaattttgtttttggaatattgtagaatctctacttaagaaagtatcttagcagtcatatggtctgacctcactgaatgctaaattctctttaaaacatccgtctcagatggttactcatactgcctctgattgaacaagagtcccaggttaagggacttacttctttgaaatcgttcatttcatttttctacagctatgttagaaagttcgtccttagcagtgaagccagagtctatc

SEQ ID NO: 160559 - DNA, 601 bp, Human
cccccattcctgtgatctgtgagctgttgaccagattaaaaaggaagtgagaataaccaggcaagatttactcctagcaaaaccttactggcttctagtgactgagtcctttccctattgcttaccagctatctttttaattactagttttaaaatcttgccagcaatgtcaatatcaaatgaccaagaatatcaaactcattactctgtatgtaaatgagatagtgtacttacccctatggcttatgtattaggctgttcttgcattgccctaaatacctgagactgggtaatttataaraaaagaggtttggccaggcactgtggatcaggcctgtaatctcagcactttgtcaggctgaagcaggtgtaatggtgagccaagagttcaaacttagcctggacaacaaggtgaaaccccctctctgcaaaaaatacaaaaattatctgggcatggtggcatgcacctgtagtcccagccacccaggaggctgaggtgggaaaattgtttgaagctgggagtcagtgattgcagtgagccatgattgcaacactgcactccatccagcctgggcgacagagcaagaccctgtctcaaaaa

SEQ ID NO: 160560 - DNA, 601 bp, Human
gctatctttttaattactagttttaaaatcttgccagcaatgtcaatatcaaatgaccaagaatatcaaactcattactctgtatgtaaatgagatagtgtacttacccctatggcttatgtattaggctgttcttgcattgccctaaatacctgagactgggtaatttataaaaaaagaggtttggccaggcactgtggatcaggcctgtaatctcagcactttgtcaggctgaagcaggtgtaatggtgagccaagagttcaaacttagcctggacaacaaggtgaaaccccctctctrcaaaaaatacaaaaattatctgggcatggtggcatgcacctgtagtcccagccacccaggaggctgaggtgggaaaattgtttgaagctgggagtcagtgattgcagtgagccatgattgcaacactgcactccatccagcctgggcgacagagcaagaccctgtctcaaaaaataaataaatgaataaataaataaaataaataaataaatagaaaagaaaaagaaagaaaagagatttatttgcctcatggttctgcaggctgtaagggaagcatagctccagcatctgcttctgggg

SEQ ID NO: 160561 - DNA, 601 bp, Human
cttgccagcaatgtcaatatcaaatgaccaagaatatcaaactcattactctgtatgtaaatgagatagtgtacttacccctatggcttatgtattaggctgttcttgcattgccctaaatacctgagactgggtaatttataaaaaaagaggtttggccaggcactgtggatcaggcctgtaatctcagcactttgtcaggctgaagcaggtgtaatggtgagccaagagttcaaacttagcctggacaacaaggtgaaaccccctctctgcaaaaaatacaaaaattatctgggcatgktggcatgcacctgtagtcccagccacccaggaggctgaggtgggaaaattgtttgaagctgggagtcagtgattgcagtgagccatgattgcaacactgcactccatccagcctgggcgacagagcaagaccctgtctcaaaaaataaataaatgaataaataaataaaataaataaataaatagaaaagaaaaagaaagaaaagagatttatttgcctcatggttctgcaggctgtaagggaagcatagctccagcatctgcttctggggaggcctcaggaagctgttactcatggcag

SEQ ID NO: 160562 - DNA, 601 bp, Human
taaatgagatagtgtacttacccctatggcttatgtattaggctgttcttgcattgccctaaatacctgagactgggtaatttataaaaaaagaggtttggccaggcactgtggatcaggcctgtaatctcagcactttgtcaggctgaagcaggtgtaatggtgagccaagagttcaaacttagcctggacaacaaggtgaaaccccctctctgcaaaaaatacaaaaattatctgggcatggtggcatgcacctgtagtcccagccacccaggaggctgaggtgggaaaattgtttgamgctgggagtcagtgattgcagtgagccatgattgcaacactgcactccatccagcctgggcgacagagcaagaccctgtctcaaaaaataaataaatgaataaataaataaaataaataaataaatagaaaagaaaaagaaagaaaagagatttatttgcctcatggttctgcaggctgtaagggaagcatagctccagcatctgcttctggggaggcctcaggaagctgttactcatggcagaaggtgaagcaggagcttgcacatcatgtggcaaaagcaggagcaagagagagagaa

SEQ ID NO: 160563 - DNA, 601 bp, Human
ggccaggcactgtggatcaggcctgtaatctcagcactttgtcaggctgaagcaggtgtaatggtgagccaagagttcaaacttagcctggacaacaaggtgaaaccccctctctgcaaaaaatacaaaaattatctgggcatggtggcatgcacctgtagtcccagccacccaggaggctgaggtgggaaaattgtttgaagctgggagtcagtgattgcagtgagccatgattgcaacactgcactccatccagcctgggcgacagagcaagaccctgtctcaaaaaataaataaatgtataaataaataaaataaataaataaatagaaaagaaaaagaaagaaaagagatttatttgcctcatggttctgcaggctgtaagggaagcatagctccagcatctgcttctggggaggcctcaggaagctgttactcatggcagaaggtgaagcaggagcttgcacatcatgtggcaaaagcaggagcaagagagagagaatggggcagggaagaagccccacacttttaaatgaccagatcgcatgagaaatcactcgttacctcaaggacagtaccaagaggatggtactaaattcct

SEQ ID NO: 160564 - DNA, 601 bp, Human
tgggcgacagagcaagaccctgtctcaaaaaataaataaatgaataaataaataaaataaataaataaatagaaaagaaaaagaaagaaaagagatttatttgcctcatggttctgcaggctgtaagggaagcatagctccagcatctgcttctggggaggcctcaggaagctgttactcatggcagaaggtgaagcaggagcttgcacatcatgtggcaaaagcaggagcaagagagagagaatggggcagggaagaagccccacacttttaaatgaccagatcgcatgagaaatcactygttacctcaaggacagtaccaagaggatggtactaaattcctgagaaatccacccccatgatctgatcacctcgtaccaggccccgccttcagcattggggattatgtttcaacatgagatttggatggggacaacatccaaactatatcaccttgcatagtaggtagggttttaaaaagcagtttggcacagtaagaaaagtacagattttttttgcatcagacagacctgagttaaaatcccagcttcactgctaacatgctaggtaaatgtgggcaagttaattaacatttctaagc

SEQ ID NO: 160565 - DNA, 601 bp, Human
cccggccaagatggtgaaaccccatctctactaaaaatacaaaaactagccaggcgtggtggcaggtgcctgtaatcccagctacttgggaggctgaggcagggaattgcttaaacccttaaacccgggaggtggaggttgcagtgagccaagttcgcaccactgcattccagcctgggcgacagaacgagactctgtctcagaaaaagaaaagaaaagaatagaaaaagaatccatgggcaggcacagtggctcatgcttataatcccagtactctaggaagccaaggtgagaggatcarttgaggccaggagttcaaggccagcctgggcaacatagcaagactttgtctctattaaaaattttaaaattagccaggcatggtgacgcacacctgtagtcccaattacttgggagcctgaggcaggagaactgcttgaggctgcagtgagctatgattagaccactgcactccagcctgagctacacagtgagaccttgtgtcaaaaaagtaaaaaaataaaaattagccaggcatggtggcacatgcctgtagtcccagctactcaggaggctgaggcaagaggatgacttgagtctg

SEQ ID NO: 160566 - DNA, 601 bp, Human
caggcatggtgacgcacacctgtagtcccaattacttgggagcctgaggcaggagaactgcttgaggctgcagtgagctatgattagaccactgcactccagcctgagctacacagtgagaccttgtgtcaaaaaagtaaaaaaataaaaattagccaggcatggtggcacatgcctgtagtcccagctactcaggaggctgaggcaagaggatgacttgagtctggaagatggagactgcagtgagctgtggtcatgccactgcactccagcctgggtgacagagcaagaccctgtctcaaaaaaaaaaaaaagaaaagaaaagaaaaataaataaaatttattcaaatacaaaagtgatgtggtttgactctgtgttgccacccagatctcatctccaattgtaatccccgtgtattgacggaggttcctggtaggagatgattggatcatggggatggtttcccctctgctgttctcatgatagtgagtgagttctcatgaaatctggttgtttggtaggtgtctgtcacttaccccttctttttctctctcctgctgccttgtgaagaaggtacttccttctcctttgccttccacc

SEQ ID NO: 160567 - DNA, 601 bp, Human
atgccactgcactccagcctgggtgacagagcaagaccctgtctcaaaaaaaaaaaaaagaaaagaaaagaaaaataaataaaatttattcaaatacaaaagtgatgtggtttgactctgtgttgccacccagatctcatctccaattgtaatccccgtgtattgacggaggttcctggtaggagatgattggatcatggggatggtttcccctctgctgttctcatgatagtgagtgagttctcatgaaatctggttgtttggtaggtgtctgtcacttaccccttctttttctctctcytgctgccttgtgaagaaggtacttccttctcctttgccttccaccatgattataagtttcctgaggccttcccagccatttggaactgtaagtcaattaaacctctttcctttataaattaccgagtctcaggcagttttttatagaagtgtgaaaatggtctaatacagagacttggtaccaggagtggggtactgctataaaaaataacctgaagatatggaagcgactctggaactgggtaacaggcagcaattggaacagtttggagggctcagaagaagacaggaagatgtggga

SEQ ID NO: 160568 - DNA, 601 bp, Human
accaaagcattcgagaggtgacctggcttttcctgaaagcatacagttatatgtgctcacaaagagatggtttgaaattggaacttatgtttaaaggggaagcagagtgcaacaaaagtttagggagtttgcagcctgaccatgtggtagaaaagaaaaacccattttctggggagaaattcaagctggctggagaaatttgcataagtaacgaggagctgaatgtgagttgccaagacaatggggtaaatgtctccagggcgtttcagaaaatcttcagggcagaccctcacaacacaarcctggaggcctagaagggaaaaatggtgtgagccaggcccaggcccaggccccagctgttctgtgcagccttgggacatggcaccctgtgttccagccactccagctccagctgtggttaaaaggagccaaggtacagctggaccattgcttcagagggtacaaatcccaagcattagcagcttccatgtggtgttgggtctttgggtgcacagaagacaaaagttgagctttggaagccgctgcctagatttcagaggatgtatggaaacacctcgatgtccaggcagaagtctgctgc

SEQ ID NO: 160569 - DNA, 601 bp, Human
tcctgaaagcatacagttatatgtgctcacaaagagatggtttgaaattggaacttatgtttaaaggggaagcagagtgcaacaaaagtttagggagtttgcagcctgaccatgtggtagaaaagaaaaacccattttctggggagaaattcaagctggctggagaaatttgcataagtaacgaggagctgaatgtgagttgccaagacaatggggtaaatgtctccagggcgtttcagaaaatcttcagggcagaccctcacaacacaagcctggaggcctagaagggaaaaatggtgtragccaggcccaggcccaggccccagctgttctgtgcagccttgggacatggcaccctgtgttccagccactccagctccagctgtggttaaaaggagccaaggtacagctggaccattgcttcagagggtacaaatcccaagcattagcagcttccatgtggtgttgggtctttgggtgcacagaagacaaaagttgagctttggaagccgctgcctagatttcagaggatgtatggaaacacctcgatgtccaggcagaagtctgctgcaggggcagagccttatggagaacctctgct

SEQ ID NO: 160570 - DNA, 601 bp, Human
ttaatgaatgccctgtcgagtttcagacttgaatggggcctgtgacccctttgttttggccaatttctcctatttggaatgggaacatatacccaatgcctgtacccccattgtatcttggaagtaactaacttgcttttgattttacagactcaggcagaagggacttgccttgtctcagatgagactttggacttgaacttttgagttaatgttggaacgaattaagacattggggttctgttgggaaggcgtatttggttttgaaatgtgagaaggacatgagattttggaggggccmggggtagaatgatatggtttgactctgtgtctccacccaaatctcatctccaattgtaatccccatgtgtcaagggagggacctgatgggaggtgactgaatcataggggcagtttcccccatgctgtttgcatgatagtgagggagttctcatgagatctggttttttggtaagtgtctggggcttcccccttttccctctctctcctactgccttgtgaagaaggtacttgcttctcctttgccttctgccatgattgtaagtttcctgaggtctccccagccattcagaactgtgag

SEQ ID NO: 160571 - DNA, 601 bp, Human
aatgttggaacgaattaagacattggggttctgttgggaaggcgtatttggttttgaaatgtgagaaggacatgagattttggaggggccaggggtagaatgatatggtttgactctgtgtctccacccaaatctcatctccaattgtaatccccatgtgtcaagggagggacctgatgggaggtgactgaatcataggggcagtttcccccatgctgtttgcatgatagtgagggagttctcatgagatctggttttttggtaagtgtctggggcttcccccttttccctctctctcctrctgccttgtgaagaaggtacttgcttctcctttgccttctgccatgattgtaagtttcctgaggtctccccagccattcagaactgtgagtcaattaaacctcttcctgcctattctcaggcagttctttatagcagtatgaaaatggactactacagaaagtgtgtaactttaaactcagtagtatccaaagaagtaatgaaaatggagaaacgaacaacaaaatcatagtacaatatggtgtatgtactaggacaggaagagcccttttaagaagagatctatgtatttccatttgtt

SEQ ID NO: 160572 - DNA, 601 bp, Human
gagggacctgatgggaggtgactgaatcataggggcagtttcccccatgctgtttgcatgatagtgagggagttctcatgagatctggttttttggtaagtgtctggggcttcccccttttccctctctctcctactgccttgtgaagaaggtacttgcttctcctttgccttctgccatgattgtaagtttcctgaggtctccccagccattcagaactgtgagtcaattaaacctcttcctgcctattctcaggcagttctttatagcagtatgaaaatggactactacagaaagtgtktaactttaaactcagtagtatccaaagaagtaatgaaaatggagaaacgaacaacaaaatcatagtacaatatggtgtatgtactaggacaggaagagcccttttaagaagagatctatgtatttccatttgtttatctctgaaagaaagcaactttgccttgtattctgaaaaagaaaggaatattttattttacttgtaaaaatcttacaaggatgctagtctaaatatagttttcctaatttgccagagaatccatgaagatcgagttgataacaagatcagtgaagtaaaggtcag

SEQ ID NO: 160573 - DNA, 601 bp, Human
tgtctggggcttcccccttttccctctctctcctactgccttgtgaagaaggtacttgcttctcctttgccttctgccatgattgtaagtttcctgaggtctccccagccattcagaactgtgagtcaattaaacctcttcctgcctattctcaggcagttctttatagcagtatgaaaatggactactacagaaagtgtgtaactttaaactcagtagtatccaaagaagtaatgaaaatggagaaacgaacaacaaaatcatagtacaatatggtgtatgtactaggacaggaagagcycttttaagaagagatctatgtatttccatttgtttatctctgaaagaaagcaactttgccttgtattctgaaaaagaaaggaatattttattttacttgtaaaaatcttacaaggatgctagtctaaatatagttttcctaatttgccagagaatccatgaagatcgagttgataacaagatcagtgaagtaaaggtcagtgagttaatctcacagcagctgcaggctaattccatttccagtgaaaaacgtcttgattgctcaccacatatcttttcaccacaaacagtttcagtctta

SEQ ID NO: 160574 - DNA, 601 bp, Human
tcaactatgactggagggctcctcgccctttctgataaattgactggacaaaaactcaattttaaaatgacaagaaatagaagatgtataaatgtactttaaatgtgaccaaaatgggttgtgaaaacacaagacacaatatccaaaaatgctggcaacacagtacactgtagagtattggttgtttatttacccttgctattgtgtggctgagcttactgccactgcccagcattgcaagggcatcaaactgcctatcactagcctaggaaaagatcaaaattcaaaattctaagtacartttctactgaatgcttatcacttttgcaccattttaaagtaaaaaaatcagtaagttgaaccatcatatatccaagattgtctgtatataaatattatacatctttctctcacttttaaaacaaaataatactagccaatactaccattctcaaaagcacttgtgtcaacagcctttaccccttaaagattttcctcacaattttaaaattgttacttactattttctttgaaatgttgaccaaacctggattaaaagatttgggggttttagtgactgtatttcacaaactctcttatt

SEQ ID NO: 160575 - DNA, 601 bp, Human
gacctgtagttttggtgggccttggtgagggatttacagtaggacaccccatggtttaagtatgaaagtgacaagattcctttaagttttaagaggcctcgaaatatgaaccacagattagatggaagctactctccctgtgtctggactttttagaatttccaagagctgctgtttctggaaccagattaatacaagtcagtcttccatttatttatttatgtatttatttgagacagggtctcactctgtcacccaggctggggtgcagtggcatgaacacagctcactgcagcttggrggctcaagagatcctcctgcctcagcctcccatgtagttgggaccacaggcacctaccacccagctaattttatttgttgtagaaatgaggtctcattttgctgcccaggctgttcttgaactcttgggctcaagcgatcctcctgcaacatcttcccaaagtgctgggatcactcttccatttaacatgctatctcaacgtcaagataaactttaaaatctttagataataggctggcattttacttaaacgatctttacttcttcagaactgccattccctataaatatctggttctt

SEQ ID NO: 160576 - DNA, 601 bp, Human
accataagttatacagctaacaaaacagttagttttcctgtgcaaagtgatggcttcatcttgtggcagattacctggaatactgtggccaaggcatcttagttctactgtctttatatatctagtacagttatatttttatggcagctctgatttcttctttggcccaagggttattaagagagggaaaaaatttaatttcttaacagatatatatatctatgtcaagtcatatatttaattcaaacccttaatattcctaggtaatttttgtctactttctctgtcaaagattgaaagrtacagggttttaagtttccaactgtaattgtagttttggtaattgttttattactaacaggtattgctctgtatattttgatgttctgttattcaatacataagaattcattacagttgaatcatcatgtatagtataatttaccaatgtaaaataacctttttatcaaactgagtattcaccttataatgtcctctgtcagaggattataataccacttaaaaccttttaaaaaatattttgttcctgataattttagctttgagtggttttcttataacaattctagagatgcgtttt

SEQ ID NO: 160577 - DNA, 601 bp, Human
tatctagtacagttatatttttatggcagctctgatttcttctttggcccaagggttattaagagagggaaaaaatttaatttcttaacagatatatatatctatgtcaagtcatatatttaattcaaacccttaatattcctaggtaatttttgtctactttctctgtcaaagattgaaaggtacagggttttaagtttccaactgtaattgtagttttggtaattgttttattactaacaggtattgctctgtatattttgatgttctgttattcaatacataagaattcattacagtygaatcatcatgtatagtataatttaccaatgtaaaataacctttttatcaaactgagtattcaccttataatgtcctctgtcagaggattataataccacttaaaaccttttaaaaaatattttgttcctgataattttagctttgagtggttttcttataacaattctagagatgcgtttttattttttaaccaagatttaaagctttgtgatttagtaagagtctaaaccattcacagttcatgcttttttgtcaaatttctattatttagtattttcctctcttttatattttcctg

SEQ ID NO: 160578 - DNA, 601 bp, Human
ctgtcaaagattgaaaggtacagggttttaagtttccaactgtaattgtagttttggtaattgttttattactaacaggtattgctctgtatattttgatgttctgttattcaatacataagaattcattacagttgaatcatcatgtatagtataatttaccaatgtaaaataacctttttatcaaactgagtattcaccttataatgtcctctgtcagaggattataataccacttaaaaccttttaaaaaatattttgttcctgataattttagctttgagtggttttcttataacarttctagagatgcgtttttattttttaaccaagatttaaagctttgtgatttagtaagagtctaaaccattcacagttcatgcttttttgtcaaatttctattatttagtattttcctctcttttatattttcctgttattttccatttctattcttttgttagactggaaattttttctttgctttcttttatcctagtgatttgaaatttatgtaatatatactattctacaataccctttatttgttttcaatatttgaacctatatttttcaacattattaagaataaaatagtatt

SEQ ID NO: 160579 - DNA, 601 bp, Human
aggtgtggtggttcacacctgtaatcccagcactttgggaggctgaggtgggagcatcacctgaggtctggagttcaagaccaacctgaccaacatggtgaaaccctgtctctactaaaaataaaaaatcagctgggcatggtagcacatgcctgtaatcccagctacttgggaggctgaagtgggagaatcgcttgaacctgggagggggaggttgcagtgagccgagatcactccattgcactccagactgggcaacaacagtgaaactccgtctcaaaaaaaaaaaaaaaaaaaaggyagagtggggaagagagctgcatgaaggagagatttactaaatagtacttaatcccaaaataatttctataggtttgaatatgatccctgaaatttattataggttcaggtaagtattaatcacgggtattcagaactgtggtttaaaaaatgtatagaacatgtttccttccccttgaaactttttatcagctaattataggaattatattatacctgcaatcattaaagtccagaatgagacagtacttggtaaagtgctgaaatttataataaatgcattatagcaatccagttaagg

SEQ ID NO: 160580 - DNA, 601 bp, Human
aggcaccaaaaaatccatgggatagttggttatccccatcttactgaagaggaaactgaagctcagaaagtttaagcaacttgcacaggtcacatagcaagtaaggagcatggccaggaatcagaccctgatctcctttggtctactaagcttgcaaaggatcttcccgcctccttccaagaccattcaatattatcagtaaatgtccatggcaaggatgtagttcgagttatagggttccattcaagatatgattggtaggtgggaagcagatatgtctgtgtcaatcagtatcctggargaaggagatgatgaactcaagtggtgattaagggaagtttaatgaagggactatttacagagatgtggtggggttaagagaaccaacaaggggaagtgatgcactcaaaaagttactacctccaggctttaggggattgggggagggagtggcacagtgtgaacccagtgtggttgtgagaaaagggattccctcagcagccatggccaaggttagagtctccactgccaaactgcatccaggtggtgagggaatggagaataggggtggggtaacaaactctgacctcggtatccccaa

SEQ ID NO: 160581 - DNA, 601 bp, Human; identical to SEQ ID NO: 18407

SEQ ID NO: 160582 - DNA, 601 bp, Human; identical to SEQ ID NO: 18408

SEQ ID NO: 160583 - DNA, 601 bp, Human; identical to SEQ ID NO: 18409

SEQ ID NO: 160584 - DNA, 601 bp, Human; identical to SEQ ID NO: 18410

SEQ ID NO: 160585 - DNA, 601 bp, Human; identical to SEQ ID NO: 18411

SEQ ID NO: 160586 - DNA, 601 bp, Human; identical to SEQ ID NO: 18412

SEQ ID NO: 160587 - DNA, 601 bp, Human; identical to SEQ ID NO: 18413

SEQ ID NO: 160588 - DNA, 601 bp, Human; identical to SEQ ID NO: 18414

SEQ ID NO: 160589 - DNA, 601 bp, Human; identical to SEQ ID NO: 18415

SEQ ID NO: 160590 - DNA, 601 bp, Human; identical to SEQ ID NO: 18416

SEQ ID NO: 160591 - DNA, 601 bp, Human; identical to SEQ ID NO: 18417

SEQ ID NO: 160592 - DNA, 601 bp, Human; identical to SEQ ID NO: 18418

SEQ ID NO: 160593 - DNA, 601 bp, Human; identical to SEQ ID NO: 18419

SEQ ID NO: 160594 - DNA, 601 bp, Human; identical to SEQ ID NO: 18420

SEQ ID NO: 160595 - DNA, 601 bp, Human; identical to SEQ ID NO: 18421

SEQ ID NO: 160596 - DNA, 601 bp, Human; identical to SEQ ID NO: 18422

SEQ ID NO: 160597 - DNA, 601 bp, Human; identical to SEQ ID NO: 18423

SEQ ID NO: 160598 - DNA, 601 bp, Human; identical to SEQ ID NO: 18424

SEQ ID NO: 160599 - DNA, 601 bp, Human; identical to SEQ ID NO: 18425

SEQ ID NO: 160600 - DNA, 601 bp, Human
tgggaggccaaggcaggcggatcacttgaggtcaggagttcgagaccagcctggccaacatggcaaaatcccgtcctcactaaaaatacaaaaaaattagccaggtgtggtagcacgaacctgtaatcccagctactggggaggctgaggctggagaatcacttaaatgaacccaggagacagagactgcagtaagctgagatcaggccactgcactccagcctgggcgacagagtgagattccatccaaaacacacacacacacacacacacacacacacacacacacaaaattagattmcagtaaaattatgttctaatattgtgattacattatctttcctaaaacagccaccttcaaaaatatatataacaaagaacaaaataaatcacttctgaaagtcatgaaaaactattcacacacacacacacacaaagtcaaattatgaaatgtttcttaaagcagatgtgaatttccagactttcaagcatattttgctatctcgaaacttgtcaaaccgaatgctgcattttttttcacccttgctctcagagacttattttcactgttgatacgcacaaacctaagtgaggagattct

SEQ ID NO: 160601 - DNA, 601 bp, Human
tacagccgggcgcagtggctcacgcctgcaatcccagcactttgggaggccgaggcgggcgcatcacctgaggtcggtagtacgagaccaaactggccaacatggtgaaaccttgtctctaccaaaaatacaaaaattagccaagcgtggtggaacattcctgtagccccagctactcaagaggctgaggtgggagaatcgcttgaacccaggagtcagaggctgcagtgagctgagatcgtaccactgcacttcagactgggcaaacaccgagactctgtctcaaaaaaaaaaaaaaaaatttacatttacaatacaacgttcaggggaaaaaagctaactacaaaataacatacacaatcacctctactacataaaaatgaaaaggtaaaaagcaaaaataagaattagactgatggttgggggcagtggctcattcctgcctgtaatcctggcactttgggaggccgaggctggcgaatcacttgaggtcaggaggagttcgagaccagcctggccaacatggtgaaaccccatctctactaaaaatacaaaaattggccaggggcagtagctcacgcctgtaatcccagcactttgg

SEQ ID NO: 160602 - DNA, 601 bp, Human
gaagtaatacaagtcttctaaagaataatagagcaccgctagcaagagccataaaaatcctgaagccctctgaactagtaaaaccactcttggtaactttctctaaggaaataattacactgaagcaaaaagctatttaaaaatgttcactgcaccactatctataacaaaaaagtggaaacccaattcccaacaatagaatggttaagtaaaaaccttacagccgggcgcagtggctcacgcctgcaatcccagcactttgggaggccgaggcgggcgcatcacctgaggtcggtagtatgagaccaaactggccaacatggtgaaaccttgtctctaccaaaaatacaaaaattagccaagcgtggtggaacattcctgtagccccagctactcaagaggctgaggtgggagaatcgcttgaacccaggagtcagaggctgcagtgagctgagatcgtaccactgcacttcagactgggcaaacaccgagactctgtctcaaaaaaaaaaaaaaaaatttacatttacaatacaacgttcaggggaaaaaagctaactacaaaataacatacacaatcacctctactacataaaaatga

SEQ ID NO: 160603 - DNA, 601 bp, Human
actcctgaccccaggtgatccacccgcctcagcctcctaaagtgctgggattacaggtatgagccaccgcgcctggccttgagatcctcctttaagtcaaaatatatggctattaaatagctacaatatgagttaacatcccttatgtagaagtataaaccattgctaattagagtaacactgaaaatacaagtttacatttaaccaaaaaaaggaacaccatgactgatcccatgttttcactgtttcagaatgtggaatctttaagcaactacaggcttacatttttctcttaaaaaaraaaaaagaaaaagaaaaagaaaaccaaagcaagttttggcccaaacttaaaaagtttattttctccacatacttgaaacaaaaactaaactaattaggtaaaatacgtaagcccaaaagaaaaacaaaacatgtctctttggttagtaatagccatctacaatttacctctaatgaccctcaatgtcaattaacttttttggtctaacttcagagatggttagtatcaatgtgcacataaaagaataacaaaggatgatgccatttaaaccttataaattactaatgaagccacatgact

SEQ ID NO: 160604 - DNA, 601 bp, Human
ggctcacacctgtaacaccagcatgttaggaggcctaagtggggtggatcactcgaggccatgagttcaagatcaacatggcaaaactccacatctactgaaaatacaaaaaaactaggcaggcactgtggggcgcaccagtagttccaactacttgggaggctgaggtgggaggatggcttgaacccgggagacagaggttgcagtgagccgtatttgcaacactgcactccagccttagcaacagagccagatcctatcacaaaaataaataaataaataaataaataaataaataaaacaaattgacattgtaaagtcacttgacacaacttcagggttaaaattacaagcaatctatgtaagaatctttaaatgttaatgagaatttcaaattttcacatgaatgcaaacacaaataattaccagcaaataaaaagttaaggttgccaggcatgggaggccaaggcaggtggatcacttgaggccagaagttccagaccagcctggccaatatggtgaaaccccatctctactaaaatacaaaaattagccaggcgagatggtgcgtgcctgcagtcccagctactcaggaggctga

SEQ ID NO: 160605 - DNA, 601 bp, Human
tggctcacacctgtaacaccagcatgttaggaggcctaagtggggtggatcactcgaggccatgagttcaagatcaacatggcaaaactccacatctactgaaaatacaaaaaaactaggcaggcactgtggggcgcaccagtagttccaactacttgggaggctgaggtgggaggatggcttgaacccgggagacagaggttgcagtgagccgtatttgcaacactgcactccagccttagcaacagagccagatcctatcacaaaaataaataaataaataaataaataaataaataatacaaattgacattgtaaagtcacttgacacaacttcagggttaaaattacaagcaatctatgtaagaatctttaaatgttaatgagaatttcaaattttcacatgaatgcaaacacaaataattaccagcaaataaaaagttaaggttgccaggcatgggaggccaaggcaggtggatcacttgaggccagaagttccagaccagcctggccaatatggtgaaaccccatctctactaaaatacaaaaattagccaggcgagatggtgcgtgcctgcagtcccagctactcaggaggctg

SEQ ID NO: 160606 - DNA, 601 bp, Human
ttgacctggccagccacggtgcctcacacatgtaattaaagcactttgggaaaactaggtgggtggatcatttgaatttaagagtttgagaccagcctgggcaacatggctaaaccctgtctctacaaaatatacaaaagccaggcatggtggcatacacctgtagttccagctactcgggagactgaggtaggaggactgcttgagcccaggatgttgaggctgcagtgagccatgaccataccactatactccaacctggccaacagggtaagactcagtctcaaaaaaaaggaaattwaaaaaaaaactgatcattggcaacactgttcaataaagcctctcaaggcaatggtttcaggagaccaacattctaaagttctgatacagttaataaaaataaaccacgttcacttatattgccgacaagcctcataccacaactaatgagttttacaaagacttcattatagaatgaaattttattacattcccaaaatgtagttagctattaatcatggcacgaaactgacattttcgggctggacacagtggctcacacctgtaacaccagcatgttaggaggcctaagtggggtgga

SEQ ID NO: 160607 - DNA, 601 bp, Human
aaaaaaagaactcccctttctaaaatctgctcaagcttcagtgaaaagacatttagtcttcaattcctgatttcgaaatgtgtttcaggaatgaaaatagttaactgcacaaagtccacagcaaatgtttataaacccgaaaagaaaaatgcagtacttgtttcaaaacccgccctttataaaaaactaaaattataatcaagattaattccacttagaaaaattattaagaatattttaacatgactttaaaaagcaatatgaaaaacgtcaatgaaaaatatttgacctggccagccayggtgcctcacacatgtaattaaagcactttgggaaaactaggtgggtggatcatttgaatttaagagtttgagaccagcctgggcaacatggctaaaccctgtctctacaaaatatacaaaagccaggcatggtggcatacacctgtagttccagctactcgggagactgaggtaggaggactgcttgagcccaggatgttgaggctgcagtgagccatgaccataccactatactccaacctggccaacagggtaagactcagtctcaaaaaaaaggaaattaaaaaaaaaactgatca

SEQ ID NO: 160608 - DNA, 601 bp, Human
gagatggggtttccctgtgttgcccaggctggacttgaactcctgggctcaggtaatctgcctgcttcagcctcccaaagtgttgggattacaggtgtgagccaccatgcccagccaccagtcttccaaactttttttttttttttgagacagagtctcactctgctctgtggcccaggctggggcacagtggcacaatctgagctcactgcaaccttcacctcccgggttcaagcgattctcctgcctcagcctcccaagtagctgggattacaggcgcccgcccagccccaagtctggktttttttttttttttttttttttagacggagtctccctctgtcgtcagtgcagtggcccgatctcggctcactgcaacctctgcctcccgggttcaagcaattctcctgcctcagcctcccgagtagctgggactacaggcacacatcaccacgcccatttaatttttttgtatttttagtagagatggggtttcaccctgttggccagaatggtctcaatctcttgaccttgtaatccgccctcctcaacctcccaaagtgctgggattacaggggtgagccaccacgcccggcccttt

SEQ ID NO: 160609 - DNA, 601 bp, Human
gtggctcatccctgtaatcccagcatttctggacgccaaggtgggtggatcatctgagctccagagttcaagactagcctgaacaacatggcaaaacctcatctcttcaaaaaatacaaaaattagccaggcatggtagcgtgctcctgtactcccagctactcaggaggctgaggtgggaggatcgcttgagcccaggaaacagaggttgcagtgagccgagactgcaccactacattctagccttggtgacagagaccctgtctcaaaaaaaaaaaaaaaaaaaaaaaaaaaaaaaaaattcattgaactgttgctgctcgtggcagagcaggactagtccataggcaatgtgcccagagttggccaaaaattacattttgaattacaatgcggtatatatacattaactcaaaccaaagcttaaaacaattcttggcagctgggtgcagtggctcacacctgtaatcccagcactttgggagtcgaggtgggcagattacgaggtcaagagatcaagactatcctggccaacatggtgaaaccccatctctactaaaaatacaaaaattaggccgggcacaggggttcatgcctgtat

SEQ ID NO: 160610 - DNA, 601 bp, Human
ggggatagggtctcactctgtcgcctgggatggtatacagtggcgcaatcatagctcactgcaacctccaattcctgggtttaagtgaccctcctgagtcagcctcccaagtagctgagactatacgcatgcaccaccatgcccagctaatttatttttgtagagatggggcctcactatgttgcctaggctgatcttgaattcctgagctcaagcgaccctcctcccttggcttcccaaagtgctagaattacaggtgtgagccactgtgcccagccaaaattcctcattttcttttccrtttttcatactgttgaagtatagtccttcacccagagaagctagtgactcaagttcctggttgattaaaagaaactattaataacattttttaataccatcactagttttctttctttccagagatccaaaatacaatgatagtaactcatctctgccaccttctgagtgaatttgaataggtcatttaacctctctgggccttcatttcctcatgggtaaaatgaggacaggataacagattatctaacagggctatgtggtaatcacatgagattatgtatgccctgggagaataaac

SEQ ID NO: 160611 - DNA, 601 bp, Human
ggtgtgtgggttctcagatcaagtcacaaacacattcacagcccatgatatcgtacaacactactttttagttcaaattaattatgagtaacaacagactatctgccaaaatagggagctgcagaaaactaaccatcatttatgatgttgtttccaaatttcaaaattttaaaaaaaaaaaaattataaacaaactttttgattgaaactcactgatagagaactgccaggactaaagcatggttgattgaagaaattttattgctgacaataatcaccggattgttttcttcattattgktattatttttatttatttatttatttattttttgagacggagtcttgctttgttgcctacgctggagtgcaatggagcgatctcagctcactgcaacctccacctcccaggttcaagcgattctccttgcctcagcctactgagtagctgggattacaggtgcttgtcaccacgcctggctaacttttttgtatttttagtagagacggagttttgtcatgttggccaggctggtctcaaattcctgacctcaggcgatccacacgcctcggcctcccaaactgctgggattacaggcat

SEQ ID NO: 160612 - DNA, 601 bp, Human
catgtactgctgaagtcttgttcagtgtccttctagccccagactttgcagcctaccaacatggactgagacagggaaagcgtgggcaagtgagttccatactctaattttcctacagaagcatcctaagtggtgtgtgggttctcagatcaagtcacaaacacattcacagcccatgatatcgtacaacactactttttagttcaaattaattatgagtaacaacagactatctgccaaaatagggagctgcagaaaactaaccatcatttatgatgttgtttccaaatttcaaaatttwaaaaaaaaaaaaattataaacaaactttttgattgaaactcactgatagagaactgccaggactaaagcatggttgattgaagaaattttattgctgacaataatcaccggattgttttcttcattattgttattatttttatttatttatttatttattttttgagacggagtcttgctttgttgcctacgctggagtgcaatggagcgatctcagctcactgcaacctccacctcccaggttcaagcgattctccttgcctcagcctactgagtagctgggattacaggtgcttgtca

SEQ ID NO: 160613 - DNA, 601 bp, Human
gccacccccttccacggcattcatatcacctctgacttatgcaccaagaatgcttcctgacaggaaactcaagtctctcccaacgatctacccgttgctcataaacttatccctttctggaggccacaaaacaattgtattccccttcaaaagactatcagtggaggagaggggagtatagctgaaacaacgttggccatttactgataactgctaaagctgagtgacaggtacataagattcatccagctgttctctttctaaatacgttgaaattttacattttaaaaaccttattagygtttactttaagctcatttcattttctaactgaaacatattcttccaaatgtgtttccttactttcagtgaggaccccctccaattcttctatcacactgtgaaccaaattttttctacatacaccatgtgtatagcaatccctgtactttagcacaaactcttcccgcctggaacttcctcctctcttcatggccttactgaaaactgcttatcttccttgaagatccatctcaactctcattattttgaagccctttttcttcactgcccacccatggcagtcccctcccagtgctac

SEQ ID NO: 160614 - DNA, 601 bp, Human
gctgcagtgagccaggatcatgccactggactccagcctgagtgacagagcgagaccctgtcttaaaacaccaccaccaccaccacactcttcatatgaagttttaccccttcagtgcctttaccccttgagtccctctagagaaagggataaaaggcttggtcatgaagccatgaacaactagatccaacctagacacaccaaaaaatccaaacaactcaggtagaaaaggatcttagggctctagtcccatgctgtccaagagaactttgtacaatgatgaagatgtcctatgtcatgytgtccaatattgcagccattaggcacatgtggcagctaagcacttgaaatacgattagtatggctgaggaactgaaatatttaaattttaatcaacataattttaaatttaaagaaccatgtgtggaagtagccacaatactggacagtgcccattcccatcttctcgagttctccagacagtaagccacccccttccacggcattcatatcacctctgacttatgcaccaagaatgcttcctgacaggaaactcaagtctctcccaacgatctacccgttgctcataaacttatccctt

SEQ ID NO: 160615 - DNA, 601 bp, Human
aaatagtaccttctcaaaagaaaaaaaatagtatcttttcataaggttgtggaaattaagtaatattccatacagatcgcatagcttaaaacagtgcctggtatgttattaagtgtttaataactgctagctaatataattatttcctcatattccagcatacactagagtagtaaaggagaaaaaaaaggccagtcgcagtggcccacacctgcaatcccagcactctgggaggccaaggtgagtccaggaatttgagaccagcctggacaacatggcgaaatctcgtctctacagaaarttttaaaaattaggcaggtgtggtggctcatgcctacagttccagttacttgggagctgaggtgggaggatcacttaagcccaggaagtcgaggctgcagtgagccaggatcatgccactggactccagcctgagtgacagagcgagaccctgtcttaaaacaccaccaccaccaccacactcttcatatgaagttttaccccttcagtgcctttaccccttgagtccctctagagaaagggataaaaggcttggtcatgaagccatgaacaactagatccaacctagacacaccaaaaa

SEQ ID NO: 160616 - DNA, 601 bp, Human
caccgtgcccaaccaggaaattgcttctaatactcatgaatgattttgaggggttcaggacttcagtagagcaagtaactgcagatgtggtaaaaaagcaagagaactaaaattagaagtggggtcagaagatgtaactgaattgctgcaatctcatgataaaacttgaatagatgaggtgttgcttctcatggataagcaaagaaagtggtttcttaagatggaatctacacctggtgaagctgctgtgagcactgttgaaatgacaacaaaagattatgaatattccagaaacaggccrggcgtggtggctcacacttgtaatcccagcactttgcgaagttgaggcgggcagatcacgaagccaggagttcaagaccagcctcaccaatatggtgaaaccccgtctctactaaaaatacaaaaattagcctggcgtggtggcatgcacctgtagtcccagatactcaggaggctgaggcaggagaatcacttgaacccggaaggcagaggttgcagtaagctgagattgagccactgcactccagcctgggagacagagcgagaccccatttcaaaaaaaaaaaagaacgttccaaaa

SEQ ID NO: 160617 - DNA, 601 bp, Human
acggccgggcgcggtggctcacgcctgtaatctcaacacttcggaaggccgaggcaggcagatcacctgagatcgggagttcaagaccagcctgaccaacatggagaaaccccgcctctactaaaaatacaaaattaggtgggcatggtggtgcatgcctgtaatcccagctactcaggaggctgaggcaggagaattgcttgaacccgggaggcggaggttgcggtgagccgagatagcatgccactgcactccagcctgggtgacaagagcaaaaaaaactccatctcaaaaaaaaagaaaaaaaaaaaaagaaatacattctgtaaggctactactgccattcatagccattctctgatggcaaaataaattgaaaactttctaaaaagtattcaccattctagatgccactgagaatgccatccatgagcatgggaggaggttaaaacatcaacattaacaggagttttagaggaaattgcttttctttttttttttttttaagatagagtttcgctcctgttgcccaggctggagtgcaagggcacaatctcaactcactgcaacctccacctcccaggttcaagcgattctcctg

SEQ ID NO: 160618 - DNA, 601 bp, Human
aaatcctgtctctactgaacatacaaaattagccaggagtggtggcgcatgtctgtaatcccagctactcgggaggctgacgcaggagaactgcttgaacccgggaggcagaggttgcagtgagccaagatcaggccaccgcactccagcctgggcaataagagcgaaactccatctcaaaaaaaaaaaaaaaaaaaaaaaatgtagacagaatgatggaagaaaagggcatcactacttggtaacaccatagtaaataactgtttcaggcaaaagtgtccacagaagctaaatatagtawgggaaagtagaaacagagtatttatataaccacaaagtaactccccacaagatactgatgaaatgaccaagtgaaaaataactttatagtgaagaaacttagtagacacaactctaaccaagtgatcaaagttaacaaccccagtaatgggataaatatatacaatgcactttctgatatcatgcaatgagaaaaacacacaaatcatttctgttgtattcctgccaaaaataaatatctgaatctaatcataaggaaacctcagataaaccctagttgagggacagtctacaaaataac

SEQ ID NO: 160619 - DNA, 601 bp, Human
attcaaaagaagggaatcttttgccttggcatttggtctgtggttagagatcatgttttagctactaattttccccaataagtaacattaaagttactcaccgtagactgaggcagtcctttgttactgtttcgacctctgaaaagattaaatattatttttattaaattcaacaggctaaataagctgaaaaatatttccaaacttaaaatataattccattcaaataaaggagaggctatctgtggggagagctcacctaatattaagtctaaaggctacctaaggatggctctacctrtgcactgcttgcctggagacccacaacaggtaggggtcatagaaggaagcaaactagaaataatcaaacttcatcaaaatcaaataaataaagtaaaatagcctactggaagaaaaaaactaatgctaaacgtaaattaataataattatagccaggcatgtggcatgcacctctagtcctagctactcaggaggctgaggcaggatcaccagagtccaggagtctgaggctgcagtaggctacgatcattccactgcagtctagcctgggcgacaaagcaagactctgtctctaaataa

SEQ ID NO: 160620 - DNA, 601 bp, Human
ctcaggagatctgatggttttataaggggctttccctgctttgctcagcacttctctctcctgtcgctatgtgaagaaggatgtgtttgcttccccttccaccatgattgtaagtttcctgaggcctccccagcaatgcagagcatgagtcaattaaacctctttcctttataaattacccagtcttaggtatatctttattagcagtgtaagaatggactaatacaacaagtaattgtacattttatacagagtcattaaaaaaacacatataggctaataacatacttaaacagtcaarttatctatgacaaaattcaaaagaagggaatcttttgccttggcatttggtctgtggttagagatcatgttttagctactaattttccccaataagtaacattaaagttactcaccgtagactgaggcagtcctttgttactgtttcgacctctgaaaagattaaatattatttttattaaattcaacaggctaaataagctgaaaaatatttccaaacttaaaatataattccattcaaataaaggagaggctatctgtggggagagctcacctaatattaagtctaaaggctacctaa

SEQ ID NO: 160621 - DNA, 601 bp, Human
aaatatgaaattttggagcatttccgattagggatgctcagcctgtatttacatttgcatataaagctaacgtttattatttgttgcaaaatgtttagttaggtttatgatatcttacatgtattaagggaagattttgtttatttaatattttgcttccatagagaacagaaggaacagaaggtcaggttttcaagtgttatcagtcaaaccaactaatggtgttttgactaaacatgacataaaaaagcaagagtaaacttccatagaggaggaaggacacaaaccgtaaggatggaagacaaatcaatggttggagagagaggagggttcactgaaaagtgatttgagggattttggtgggcaatgaaactgttctattaacttgattgtggtggtagttacactgattgtatgcaattgttaaaactcacagaaatgtaccctaagaagggtgaagtataaataaatggggtaggaagccaggtcataccttcatagaagaaccctgactaggttctcccagcatatcagcatcagtgacagtgcttaagtctgatcaaccacactactccatattactaccatatacgtgtatatc

SEQ ID NO: 160622 - DNA, 601 bp, Human
tatctgttgttattggtaggggactggttccaggacctccttcagataccgaattacataatacttaagtcacttacataaaatgtaatagtatttgcatataactaagcacattctcccaaatactttaaactatccctaaattacttgtaatacctaatataatgtaaatgctatgtaaattgtcatactgtattgttttaggaataatgacaagaaaaacgtccgtacatctttggttcagacgcaaccatgcctcttttttctcaaaaaaaaaaaaaaaaaaaaaaaaaaaaaaaatttttttttttgagaaggggtctgtctggcactgttgaccaggctgagtgcaggggcattatctcagctcagtgaaacctccacctcccaggctcaaacaatcctcccacgtcagcctcccaagtcactaggactacaggcacgtaccaccacgttcggctagtttttttactttttgtagagacggagttctgccatgttgcccaggctggtcttaaacttgtgagctcaagccatctgcccacctcaaactcccaaagtgctgggattacaggcgtgagtcactgtgcctggccttttt

SEQ ID NO: 160623 - DNA, 601 bp, Human
ctatctgttgttattggtaggggactggttccaggacctccttcagataccgaattacataatacttaagtcacttacataaaatgtaatagtatttgcatataactaagcacattctcccaaatactttaaactatccctaaattacttgtaatacctaatataatgtaaatgctatgtaaattgtcatactgtattgttttaggaataatgacaagaaaaacgtccgtacatctttggttcagacgcaaccatgcctcttttttctcaaaaaaaaaaaaaaaaaaaaaaaaaaaaaaawtttttttttttgagaaggggtctgtctggcactgttgaccaggctgagtgcaggggcattatctcagctcagtgaaacctccacctcccaggctcaaacaatcctcccacgtcagcctcccaagtcactaggactacaggcacgtaccaccacgttcggctagtttttttactttttgtagagacggagttctgccatgttgcccaggctggtcttaaacttgtgagctcaagccatctgcccacctcaaactcccaaagtgctgggattacaggcgtgagtcactgtgcctggcctttt

SEQ ID NO: 160624 - DNA, 601 bp, Human
gctatctgttgttattggtaggggactggttccaggacctccttcagataccgaattacataatacttaagtcacttacataaaatgtaatagtatttgcatataactaagcacattctcccaaatactttaaactatccctaaattacttgtaatacctaatataatgtaaatgctatgtaaattgtcatactgtattgttttaggaataatgacaagaaaaacgtccgtacatctttggttcagacgcaaccatgcctcttttttctcaaaaaaaaaaaaaaaaaaaaaaaaaaaaaawatttttttttttgagaaggggtctgtctggcactgttgaccaggctgagtgcaggggcattatctcagctcagtgaaacctccacctcccaggctcaaacaatcctcccacgtcagcctcccaagtcactaggactacaggcacgtaccaccacgttcggctagtttttttactttttgtagagacggagttctgccatgttgcccaggctggtcttaaacttgtgagctcaagccatctgcccacctcaaactcccaaagtgctgggattacaggcgtgagtcactgtgcctggccttt

SEQ ID NO: 160625 - DNA, 601 bp, Human
aactaaagcattgtaggccaaatgggacaagaaattttcagttgaatataatcagtagcattcttgaccacaaaactgtagaaaatgctttacaaactaattttttaagagatcacaaaaactctatttaatttttctctaaagttctaattgttttccaacaaaaatgcattaacattctcatttttctaaaaaattaccttacttgggctattctagaaagtagatatttcttttttctttctttttttttttgaaacggagtcttgctctgtcacccaggctggagtgcagtggtgcrgtatcagctcactgcaacctctgcctcctgggttcaagcaattctgtctcagcctccctagtagctaggactataggcgcacgccaccacacacaaaaataaatttttgtatttttagtagagacggggtttcgccatgttggccaggctggtctcgaactcctgacctcaggtgatccacccgcctcagcctccctaagtgctaagattacaggaatgagccgccatacccagcccagatatttctttaaaaaaagtttgtaagatcactgtgaaaatctttgcttgaataaatctaat

SEQ ID NO: 160626 - DNA, 601 bp, Human
agacaattgttttctaccaaccgttctctacctttcttccttagccttatactttgatttctttccagatttgccacatgcccacttataaactaaagcattgtaggccaaatgggacaagaaattttcagttgaatataatcagtagcattcttgaccacaaaactgtagaaaatgctttacaaactaattttttaagagatcacaaaaactctatttaatttttctctaaagttctaattgttttccaacaaaaatgcattaacattctcatttttctaaaaaattaccttacttgggytattctagaaagtagatatttcttttttctttctttttttttttgaaacggagtcttgctctgtcacccaggctggagtgcagtggtgcggtatcagctcactgcaacctctgcctcctgggttcaagcaattctgtctcagcctccctagtagctaggactataggcgcacgccaccacacacaaaaataaatttttgtatttttagtagagacggggtttcgccatgttggccaggctggtctcgaactcctgacctcaggtgatccacccgcctcagcctccctaagtgctaagatt

SEQ ID NO: 160627 - DNA, 601 bp, Human
acaaaaaatacaaaaattagcttggtgtggtggcacacgcctgtagtcccagctactcaggaggctgaggcaggagaatcgcttgaacctgggaggcagaggctgcagtgagccgagatcgtgccactgcactccacccaggggacagaacaagactccgtctcaaaaaaaaaaaaaaaaagaatttgagaaccaagttcaggattgcccagaagtgccttgcaacgtgttactgaacactcaataatgccttgcaaatgagtaacaggaattcccactttgttcatcaatggacacttaraaagagactaaatttttaatataactacataatcgcttttaaattctcaaaaccttgtctcatactctgaatatttttaaaatacgtatgttctacttcttcaccctttttcattttcattagacaattgttttctaccaaccgttctctacctttcttccttagccttatactttgatttctttccagatttgccacatgcccacttataaactaaagcattgtaggccaaatgggacaagaaattttcagttgaatataatcagtagcattcttgaccacaaaactgtagaaaatgct

SEQ ID NO: 160628 - DNA, 601 bp, Human
atccattcaagatgtggaaaagtactatcaaatgataacagcagagactatttcaggcagttgccaattctgagacagaaaggggactgtgaggcaagaaaataaagcacaaattctttttttattctgttgcccaggctggagtgcagtggcatgatctcgcaatctctgcctcccgggttcaagcgattcttctgcctcagcctctccccaagtagctgggattatagacatgtgccatcacgtcccgctaattttttacttttttagtaaagacggggtttcaacatgttggccaggstggtctcgaactcctgacctcaaatgatctgcccaccttggtctcccaaagtgagattacaggagtgagccaccgcacctggcctagaaagcacaaattctcaaggccacagaacagagccactcctgggatctcatcacatgaaacccatagctcacaccctgactgtccagagcctcacccaggctaattataattaaaccaggatccctagaagtgagaacatttttaaaaactccccaggtgactaaacgtgaacccagcattaagaagcattgattaaaccataccttcctttac

SEQ ID NO: 160629 - DNA, 601 bp, Human
tttttttttttacttttagctttatttgtggagaaatcctttaacaaccatggaacttactggctgggcacagtggttcatgcctacaatcccagcaatttgggaggcccaggtgggtggatcacctaaggtcaggagcttgaaatcagcctggccaacatggtaaaaccccatctctactaaaaatacaaaaattacccgggtgtggtggtacgtgcctgtaatcccagttattagggaggctgaagcaagataactgcttgaacccaggaggtggaggttgcagtgcgccaagatcacrccactgtacccagcctgggcgacagagcaagactctgtctcaaaacaaacaaacaaacattaattcgacttatgacaactgagataaacaacaaaccaaaccacataatttatgtcactgcagtataatgttaagaacatgagttagagtagaaaagctagatttgtgtcctcactttagcaagtttcctaaatatgcctgtttcctcatctatgacgtggataatagctgtatctactacagaaacaacttgtgatgattatgtgaacaaatgtaggtaaatctgttagcacagagtct

SEQ ID NO: 160630 - DNA, 601 bp, Human
ataaacataaaaaatacagaagaggaaattctgaaggagggtgaaaccaacattcaagtgcagcaataaagacagaaaaagattccaaaggacctggcagttagaggttaatcgtagccttaggcaggataatggctagaagaattcaggattaaaaagaatccttttgggcccagtgcggtggctcatgcctgtaatcccagcactttgggaggccgaggcagatggatcacaaggtcaggagatcgagaccatcctagctaacacggtgaaaccccatctctactaaaaatacaaaaawttagctgggcgtggtggcaggtgcctgtagtcccagctactcgggaggctgaggcaggagaatggcgtgaacccgggaggcggagcttgcagtgagccaagatagtgccactgcactccagcctgggcaagagcgagactctgtctcaaaaacaaaaacaaaacaaaacaaaaaagaatcctttttaggatgagcaggaagtgaataggttttcatgctaaagggaaagattaactagaaaggcagatgttgaagagcccagaaacagagaagtggtataaaagagcaaggagaaaaaaa

SEQ ID NO: 160631 - DNA, 601 bp, Human
agcaattttcttaagctctaaattagctaacttaaaatttgaactgaaaattgtttagaaatggtatcagttaaaatggtgctgtattttacttcaaaatcaactaaaaaataataaaaaactcaaacttactaatcagattcctctgaaagctgagtgaagatcaatagcccatgctctacagaatcaaatatacatcaaattctacagcaaagcctgagtggtgcaaaactaacaagaacaagaaaaaatatggaaattcacttcatgaggtttgctgtatttaaaaaaacaaggtgayagattccacgtacgtaatactagattgctgattcccacactatctcctaaaaagatcaaaagaagttttagaaaagattccaatacaaagatactgtttatgggtgaacattctgttttcattttctccattaggcttctggatcaggatctattttaagtggggaggaggaggaaaagctagctacctgaaagaaatttgtgccatctcaaaatatgaaattagcctaggcctggtgtgatagcttaagcctgtaatccgagcactttgggaggctgaggcaaagaggattgcttgggc

SEQ ID NO: 160632 - DNA, 601 bp, Human
tgtcaatgcccaagattgactgaaaatgagaaatctggaagacaagttgtttaggagattataacaatatttgccttggtggaagaaaacaaggaccacacttattttctattttcactgttaaatcttttggtacacacgttttgaactttttaccatgtgtgcatatataatttttaaagtaaagttgtaaacagaaaaaaaaaatctacagtgagatactacttcttactctcccactaggatgggtataatcaaagagacagacaataacaaatgctggtgaggatgtgaaaaacakaagaaacctcagacactgctagtaggattgtaaaatgatacagctacgttggaaacagctatgtaggattgtaaaatgatacagccactatgcccaggaaatcagcctgtgcaacagtgagaccccaactctattttcaaaaaataataaaaagaaaacaaaacagcccaacagttatgtaaaaggttcaacatagatttagcatacgagccagcaattatcttgcaggtatgtgtatgtatgtatgagtatgcatacacacacacccccatgagaattgaaaacctatgtccacacgca

SEQ ID NO: 160633 - DNA, 601 bp, Human
aaaataaattattccaacacacactacagttgtccttcagcatctatgggggattggttctaataccccctagggataccaaaatccagggatgcttaagtccctgatacaaagtggtgtagtatttgcatactctcgcatactttaaacctctaggttacctataatacctaatacaaagtaaatgctacggaaatagttgtggtactgcttaaggaataatgacaagaaaaaaagtctgtacatgttcagtatagatgcttttgatttcccatataatttttttttttcttttcagacagttttttttcttttcttctcacactctgttgcgcaggctggagtgcagtgacacaatctcagctcatggaaacctctacttctcaggttcaagcaaattgcttgtctcaacctctcgagtagctgggattacacatgtgcactaccatggccagctaattttttgtacttatagtagagctagggttttgccatgttggccaggctggtcttgaactcctgacctcaggtgatccatctgcctcagcctccctaagtgctggaattacaggtgtgacccacagccccagcgtatttccca

SEQ ID NO: 160634 - DNA, 601 bp, Human
gttctccaaatgatccatttgaaaataaattattccaacacacactacagttgtccttcagcatctatgggggattggttctaataccccctagggataccaaaatccagggatgcttaagtccctgatacaaagtggtgtagtatttgcatactctcgcatactttaaacctctaggttacctataatacctaatacaaagtaaatgctacggaaatagttgtggtactgcttaaggaataatgacaagaaaaaaagtctgtacatgttcagtatagatgcttttgatttcccatataatttttttttttcttttcagacagttttttttcttttcttctcacactctgttgcgcaggctggagtgcagtgacacaatctcagctcatggaaacctctacttctcaggttcaagcaaattgcttgtctcaacctctcgagtagctgggattacacatgtgcactaccatggccagctaattttttgtacttatagtagagctagggttttgccatgttggccaggctggtcttgaactcctgacctcaggtgatccatctgcctcagcctccctaagtgctggaattacaggtgtgaccc

SEQ ID NO: 160635 - DNA, 601 bp, Human
atgaaagcaggatgctacaacgccgtggaggtgaaagggatgtatggaacagaacttaggaggctatgtttcctaaagaatagtgttctccaaatgatccatttgaaaataaattattccaacacacactacagttgtccttcagcatctatgggggattggttctaataccccctagggataccaaaatccagggatgcttaagtccctgatacaaagtggtgtagtatttgcatactctcgcatactttaaacctctaggttacctataatacctaatacaaagtaaatgctacggaartagttgtggtactgcttaaggaataatgacaagaaaaaaagtctgtacatgttcagtatagatgcttttgatttcccatataatttttttttttcttttcagacagttttttttcttttcttctcacactctgttgcgcaggctggagtgcagtgacacaatctcagctcatggaaacctctacttctcaggttcaagcaaattgcttgtctcaacctctcgagtagctgggattacacatgtgcactaccatggccagctaattttttgtacttatagtagagctagggttttgccatg

SEQ ID NO: 160636 - DNA, 601 bp, Human
caaaaaaacaaaaaacaaaaaaatgtgtataggcggggtgcagtggctgacgcctgtaatcccatcactttgggaggccgaggcgggcggatcacctgaggtccggagttcgagaccagcctgaccaacatggagaaacccccatctctactaaatatagctgtgcatggtggtgcatgcctgtaatcccagctgctcgggaggctgaagcaggagaatcacttgaacctgggaggcagaggctgcggtgagccgagatcgcaccattgcactccagcctgggtaacaagagcgaaactcygtttaaaattaaatcaacaggctgggcacagtggctcacatctgtaatcccagcactttgggaggctgaggcgggtggatcatgaggtcaagagatcgagaccatcctggccaacatggtgaaaccctgtctctactaaaaatacaaaaattaggtaggcgtggtggtacacgcctatagtcccagctactcgggaggctgaggcaggcgaattgcttgaaccttgaattgcttgaactactagggaggcggaggttgtagtgagccaagattgcgccactgcactccaacctggcgaga

SEQ ID NO: 160637 - DNA, 601 bp, Human
agcttgcagtgagcagagatcgcgccactgcactccagcctggacaacagagcgagactccatctcaaaaaaacaaaaaacaaaaaaatgtgtataggcggggtgcagtggctgacgcctgtaatcccatcactttgggaggccgaggcgggcggatcacctgaggtccggagttcgagaccagcctgaccaacatggagaaacccccatctctactaaatatagctgtgcatggtggtgcatgcctgtaatcccagctgctcgggaggctgaagcaggagaatcacttgaacctgggagrcagaggctgcggtgagccgagatcgcaccattgcactccagcctgggtaacaagagcgaaactctgtttaaaattaaatcaacaggctgggcacagtggctcacatctgtaatcccagcactttgggaggctgaggcgggtggatcatgaggtcaagagatcgagaccatcctggccaacatggtgaaaccctgtctctactaaaaatacaaaaattaggtaggcgtggtggtacacgcctatagtcccagctactcgggaggctgaggcaggcgaattgcttgaaccttgaattgcttg

SEQ ID NO: 160638 - DNA, 601 bp, Human
aaagtagctctttctaaagatgagtaaaggacttaggggaagatgtgcagaagtggagagttagcacgaaatgaggctatatcatcaggatgctgagaaaatccctggctataagtaatgcatttcaggccaacattgcatcattagctagaaaggaagcaagatctgggtatccattctgcactattaataatatccactatcgtaaattctgatttgttttacagtggttacaagtttggatttttgtttctgtttctttaaaaaaaatttgtttttgtttttgttttttcagagatgrggtctttgtcactcatgctggagtgtagtgccgcaatcactgcagccctgggctcaagcaatcctcccacctcagcctcccaagtcgctgagattacaggcatgagccactatgcccagcaagtctggattttaaaaaaaaaaaacactgttggtagtaaatagtacaatgttgtaaccaggattcctgcaaagttgagaaaaaaacaactggctctaatctacaggcaactgtgggaatttgcatgcagattttaccaatgccataagtcaaagaatattaattttccatcatccccta

SEQ ID NO: 160639 - DNA, 601 bp, Human
tgaatggtgacatcataaatctaactcatgctatattgatagacacttagcatgtttccaatttttcactattagaaataatgctatggccaggcatggtggttcacgcctataatctcagcactttgggaggccgaggtgggcagatcacctgaggtcaggagttcaagaccagcctggccaacatatggtgaaaccccgtctctactaaaaatacaaaaattagctgggtgtggtggcgcacgcctatagtcccagctgcttggaaagctgaggcagtagaatcacttgaacccaggasgtggaggttacagggagccgagatcgcaccactgcactccagtctgggtgacagagtgagactccatctctcaaaacaacagcaacaacaacaaaagaaataatgctgaaaaaaaaaaaaatcctggtcaggcatgatggctcacacctgtaatcccagcactttgggaggctgaggtgggtggattacctgagctcaggagttccagatcaccctgggcaacatggtaaaaccctgtctctgcagaaaaagaaaaaaaaaaaatcttcacatataattatttgcatgtcttatggatat

SEQ ID NO: 160640 - DNA, 601 bp, Human
acctgagattaggagttcgggaccagcctggccaacatgttgaaaccctgtctctactaaaaatacaaaaaattagccagatgtggtggcgggcgcttgtagtcccagctactcagaaggctgaagcaggagaatcgcttgaacctggaaggcagaggtttcagtgagccaagatcacgccattgcactccagcctggacaacagagcaagactccgtctcaaaaagagtttcttgggtgtaatttcagacatcttctaggcaataagaatatgaacagctctttaaaaaaaaaaaaaaawttcatggccaggtgcggtggctcatgccagtaatcgcagcactttgggaggctgaggcaggtggatcacgagttcaggagttcaagaccagcctgacaaacatggtgaaaccccttctctactaaaaacacaaaaattagctgggcatggtggcagctactcaggaggctgaggcaggagaatcgcttgaacccgggaggcggaggttgcagtgtgacagagcaagactctgtctcaaaaaaagaaaaaaaaaagcaaataggatcccagtgttctgcaatgtgctttttctcttaataa

SEQ ID NO: 160641 - DNA, 601 bp, Human
tgaacccgggaggcagagcttgcagtgagctgagatcacaccactgcactcaagtctgggcgacagagcgagactccatcttaaaagaaaaaaaaagagtttcagccgggcgcagtggctcatgcctgtaatcccagcactttgagaggccaaggtgggtggatcacctgagattaggagttcgggaccagcctggccaacatgttgaaaccctgtctctactaaaaatacaaaaaattagccagatgtggtggcgggcgcttgtagtcccagctactcagaaggctgaagcaggagaatygcttgaacctggaaggcagaggtttcagtgagccaagatcacgccattgcactccagcctggacaacagagcaagactccgtctcaaaaagagtttcttgggtgtaatttcagacatcttctaggcaataagaatatgaacagctctttaaaaaaaaaaaaaaatttcatggccaggtgcggtggctcatgccagtaatcgcagcactttgggaggctgaggcaggtggatcacgagttcaggagttcaagaccagcctgacaaacatggtgaaaccccttctctactaaaaacacaaaa

SEQ ID NO: 160642 - DNA, 601 bp, Human
taatgtatgccctacataaaaaaaaaaaaaaaaaagcacacaatacggaaagacatccagtaaaaagtaaatgtcttccaatcccagcgtgcataaataactactattaagagttctggccgggcacggtggctcatgcctggtatcccagcactttgggaggccgaggcaggaggatcacgaagtcaggagattgagaccatgctggctaacatggtgaaaccctgtctctactaaaaatacaaaaaattagccaggtgtggtggcgggagcctgtagtcccagctacttgggaggctarggcaggagaatggtgtgaacccgggaggcagagcttgcagtgagctgagatcacaccactgcactcaagtctgggcgacagagcgagactccatcttaaaagaaaaaaaaagagtttcagccgggcgcagtggctcatgcctgtaatcccagcactttgagaggccaaggtgggtggatcacctgagattaggagttcgggaccagcctggccaacatgttgaaaccctgtctctactaaaaatacaaaaaattagccagatgtggtggcgggcgcttgtagtcccagctactcagaagg

SEQ ID NO: 160643 - DNA, 601 bp, Human
gtaatgtatgccctacataaaaaaaaaaaaaaaaaagcacacaatacggaaagacatccagtaaaaagtaaatgtcttccaatcccagcgtgcataaataactactattaagagttctggccgggcacggtggctcatgcctggtatcccagcactttgggaggccgaggcaggaggatcacgaagtcaggagattgagaccatgctggctaacatggtgaaaccctgtctctactaaaaatacaaaaaattagccaggtgtggtggcgggagcctgtagtcccagctacttgggaggctrgggcaggagaatggtgtgaacccgggaggcagagcttgcagtgagctgagatcacaccactgcactcaagtctgggcgacagagcgagactccatcttaaaagaaaaaaaaagagtttcagccgggcgcagtggctcatgcctgtaatcccagcactttgagaggccaaggtgggtggatcacctgagattaggagttcgggaccagcctggccaacatgttgaaaccctgtctctactaaaaatacaaaaaattagccagatgtggtggcgggcgcttgtagtcccagctactcagaag

SEQ ID NO: 160644 - DNA, 601 bp, Human
taaagccttactggtgaaaagtataaagtccagtaaaggttgtaatccatcccagaagaatgaacacatcaaccaagcaatgctgatggcaacctcaatgctaaggcttgcctcgaagttcacctattaaccttgggtcctcctgtgctactccaggtaagactataatgtaagtctaccaccaatgcaattccttttgccaaacacatgggcaggaaatcacacttacttatggaggctttaaaattacttaagtaatgtatgccctacataaaaaaaaaaaaaaaaaagcacacaatayggaaagacatccagtaaaaagtaaatgtcttccaatcccagcgtgcataaataactactattaagagttctggccgggcacggtggctcatgcctggtatcccagcactttgggaggccgaggcaggaggatcacgaagtcaggagattgagaccatgctggctaacatggtgaaaccctgtctctactaaaaatacaaaaaattagccaggtgtggtggcgggagcctgtagtcccagctacttgggaggctagggcaggagaatggtgtgaacccgggaggcagagcttgcagtgagc

SEQ ID NO: 160645 - DNA, 601 bp, Human
agttttataaataaattttattatttccctttatttttaaagaaagggagggatgaagttggtggtaagaaatcaacaataagatgtcaactcttaaaagaactgtagcaatctgtttcaactatgtcttatttgtaaagaaatatgttactagaaattatgactacatgataaaatatttttaactttccatatattttacctttccctgacccgaattttctacattacttctaaaattagaaaaaaaaaatttaaacagaagactattaatccctatacaccccgataccactaaaayatatgtacatacccttcttaaatttctctaaaattttagtttatttatctcttctatcatgatcatcaattttaaaactcggcttaaaacagtaagcagtaacctgtaagcagtttcttaggcttagcaggctgtgagctgaaaattctattaaagggatgacttgtattagtctattaatagatgaccaaaataactgacatttgggggagaaatcagcactatatgaattgtcaaaattctacattattgattctgccatgccactagtgactactctttctaaatcagtctactgtg

SEQ ID NO: 160646 - DNA, 601 bp, Human
ttcaacaactgccatttttccaattagtaaaaagagaaaatctataatgctattctgagtgtatctccaaaactatgcttatactctctcacttctaatcatgttattctcaaaatttatttccagaccatctaagtaatgtcaaaagattaacagaatagctgaagcagatttttttttttttttttgaaatggagtctcactctatagcccaggctggagtgcagtggcgcgatctccgctcaccgcaacctacacctcccgggtcctggttcaagcaattctcctgcctcagcctccygagcagctgggattacaagaacgcgccacaatgcccagctaatttttgtatttttagtagagacgacgtttcaccatgttggccaggctggtgttgaactcctgacctcgtgatccacccgcctcagcctccccaagtgctgggattacagccgtgagccactgcgcctgaccggctgaagaagatttttaaaatttttgttttcttggtagtcttaagataattgaagaccaaggaagaaaataaaaagtacaaaggaatttaggatacaattacatgaatgtgcatcacatgaagctg

SEQ ID NO: 160647 - DNA, 601 bp, Human
taactgtgttagaatgctttatttactaagctgggtagtgggcacatgatcatattcaatattctttgtatcatttgtatgtgttaactattgtttaacaaattgaaaaactttttttttttttttttttttttgagatgcagtcttgctctgtcgcccaggatggagtggagtggtgtgatctcggctcactgcaacctctgtctcctgggttcaagcgattatcctgcctcagcctgccaagtagctgggattacaagtgtgcgccaccatgcctagctaatttttctatttttggtcragacagggtttcaccatgttgaccaggctggtctcgaactcctgaccttaggtgatctgcccacctcggcctcccaaagtgctaggattacaggtgtgagccaccgtgcccgccaacaaatgaaaacttaggttaacaactgttaatagcattaaagctgaatagatacatgtgctaaagtatgaaataataagtagtattttgaatgttaccaataagtcaagaatgaagctattgttaacatttagaaagctaaaacacaggctgaggaaaggctacctttgcctttggttcactcat

SEQ ID NO: 160648 - DNA, 601 bp, Human
cactgcaacctctacctcctgggttcaagcgaatctcctgcctcagccactacagtagtgggactagactacaggtgtgcgccaccacacccaggtaatttttgtatttttagtagacatgcggtttcaccatttggtcagactggtttcgaactcctgacctcatgtgatctgcctgcttgggactcccaaagtgctgggattacaggcgttgagagccactgtgcctggccaagaatagtctttttaacagatggtgctgggacaactaatacctacatacggaagaatgaatctgaayttacacagtaaaaatggttataagtgtatggttatgtgtcaattagaaataaaaaattaatataaagaatgaatttgaaccccaccttatgctatattaaataactgctcaaaatgggctgagcaccaagtcactctcctatgaccttttttaattttttaataacaatttgtttcacttaaaaaaaatcaaatgttattctcataatattgttataggaaaggggtcccgatccagacccccagagagggctcttggatcttgcacaagaaagaattcagggcgagtccgcagtgcaag

SEQ ID NO: 160649 - DNA, 601 bp, Human
cctctaaaacccacattattaacccaaaacagatcaaattactagcaattcttacacaaataaagctatcagcactctgcatatggctcaaaagggaaggaacaacaaacacacaaggtatttctatttctgcctaaatgaaggactacagatatttgtgaacaaatgcagtttggggctatgagcatgtcatgaagttagctctaatgaatcactgactgacagtgcagcatgcactatgcattagttactattcaaagcactgctagaagcttaaacaccagatggtcagccctcttagttactagccatgtgagtttgggcagattacttaacttctctttgcccaagctgcctaatatacacagtgcagatacaaacagaacttgcttgacagagatgttagacaagatttaacatacaagcatgaagaacagcatctggtacacaggaaatacgcaataaaacataagagaataacattatattatctgaagagaacaattagaaagttcactcttttatttttttttaattaaaatttaagttctgggacacatattttttttttccactctctttttttttctttgagacagat

SEQ ID NO: 160650 - DNA, 601 bp, Human
tcaagcaactccatagggaaaattttagtaactcaattaaaaatgggcaaaagatctgaatagacatttctcaaaagacgacatacaggctgggcgcagcagctcacgcctgtaatcctagcactttgggaggctgaggcaggtaaatcacctgaggttaggagttcaagaccagcctgggcaacaaggagaaatcccgtctctactaaaaatacaaaaattaggcagacatggtggcaggaggcaggagaattgcttgaatccgggaggtgtagggcgcagtgagccaagatcacaccaytacgctccagcctgggcaacaaagtgagactctgtctcaaaaacaaaacaaaacaaaaaaaaaaggaagacatacaaggccaggtgcagtggctcacaactataatttcagcattttgggaagccaaggtgggaggattgcttgagcccaggagttcgagaccagcctgggccaaacagcaagacctcatcgttatttatgaatggcaaacaggtatatgaaaggtattcaatactactgatcaccagaaaaatggaaattaaaactacaacaagatatcatctcaccccagttaaaatg

SEQ ID NO: 160651 - DNA, 601 bp, Human
aataacactagataacaagaggaactttggaaagtatacaaatacatgaaaattaagcaatatgctcctgaatgaccagtgggtccatgaagaaattaagaagaaaactggaaaattccttgaaacaaatgaaaatggaaacacagcttatcaaaacctataggatacagtaaaagcaacaataagaggaatgtttacagcagtaagtgcctacatcaaaaaagtggaaaaacttcatctgccaatacatcctaaagaactagaaaagcaaggacaaaacctaaaatcagtagaagaaataaaaaaaatcaaagcagaaataaataaaattgaaatgaagaaaatacaaaagatcaataaaacagtaaattgttttgaagagataaacaaaactgacaaacctttagccagactcagaaaaaaaagagaaaacccaaataataaaatgagagatgaaaaaggagacattataattgttaccaccgaaattcaaaggatcattagagactactatgagcatctatatgctgatacattggaaaaccttgaagaaatggataaattcctagacacatacaacctaccaagactgaaccacaaa

SEQ ID NO: 160652 - DNA, 601 bp, Human
ttacaggtgtgaaccactgcacccagctgtcatggtgatcttaaatcaaaaacacctacaacagatacacaaaaaatataaagcaggaaattaaaacataccaccagagaaaatcactttcaaaacaaggaagggagggagggaaaaaaggagcgaagaggaagtaaaaaagaagggggaagggagggagtaggactacaaaacaaccagataataagtaacaaaatggtagtagttaagtcctcactaatcagtaacaacactgaatgtaaatcgactaaactctccaatcaaaagatayagagtggctaaatggatttaaaaaaaaggctgggtgcggtggctcacgcctgtaatcccaggactttgggaggccaaggcaggcaaatcacctgaggttaggagttcaagaacagcctgacgaacatactgaaaccccatctctactgaaaatacaaaaaatttagctgggcttggtggcaggcgcctgtaatcccagctacttgggaggctgaggcaggagaatcgcttgaactcaggaggcggaggttgcagtgagctgagatagcgccattgccctccagcctgggcaacaatagca

SEQ ID NO: 160653 - DNA, 601 bp, Human
aaagacccagttcttgcaggattcttcacctactgactaaagcacccttgggccttaaattaacatcagtggtggccagaaaatagctgccacaggccttgggtgagaccaagtacagttccagtgacggtggccatggcagtgcttgtgtcacccttccccaaactccaagcagctcagcacaaagagagactccatttgtttggagaaatgtaagaggacaagagactgcctggtaatacagggaattctcccagatcttccccaagactaccaaggtgatacctctacagagtcacarcattactagtcttggggtgccctctaatgcatgtatggctgcagtgagcgaagacttagatgacaacacttaattccctttgaatacttgaaaaaccttctcaagaagaatgggagccggatgcagtggctaacgcctgtaatcccaacactctgagaggccaaggcggacagatcacgaggttaggagttcgagaccagcctgaccaacatggtgaaacaccatatttactaaaaatacaaaaattagccaggcgtggtggcacgcacctgtaatcccagctactcaggaggctgaggc

SEQ ID NO: 160654 - DNA, 601 bp, Human
cggataacctgaggtcgggagttcaagaccagcctgaccaacatggagaaacctcatctctactaaaaaacaaaaaaattagccagaggtggtagcgcatgccggtaatcccagctactcaggaggctgaggtaggagaattatttgaacccgggaggcggaggttgtggtgagctgagattgcgtcactatactccagcctgggcaataagagcgaaactctgccaaaaaaaaccaaaagaatcttaattttggtaagccccaccaccgtgggtaaagtcctctggggtcctaaataaamttgaaaggcagtctagaccagaaggactgcaattcctggacaagtcatggtactgtgctgggctcatagtcagtggacttggggtacatgtgacccactgagacaccagctagggtggccaagggagtgcttgtgccagccttcccccaactccaggtaccacagctcacagctctgggaggagagggaagagtagggaggactttgtcttgcaatgtggatactagttcagccacagtaaaataaagcaccaagcatagttctgaagcctcaattctaggccatagctcccagatgaca

SEQ ID NO: 160655 - DNA, 601 bp, Human
tggaaagcagcataggacagaattcagccagcacccacagagggagtatttagactagccctagtcagaggggaattgtccatcccagtgattagaatctgaatttcgggctgggcactatggtctgtaatcccagcactttgggaggccgaggcggacggataacctgaggtcgggagttcaagaccagcctgaccaacatggagaaacctcatctctactaaaaaacaaaaaaattagccagaggtggtagcgcatgccggtaatcccagctactcaggaggctgaggtaggagaattrtttgaacccgggaggcggaggttgtggtgagctgagattgcgtcactatactccagcctgggcaataagagcgaaactctgccaaaaaaaaccaaaagaatcttaattttggtaagccccaccaccgtgggtaaagtcctctggggtcctaaataaacttgaaaggcagtctagaccagaaggactgcaattcctggacaagtcatggtactgtgctgggctcatagtcagtggacttggggtacatgtgacccactgagacaccagctagggtggccaagggagtgcttgtgccagcct

SEQ ID NO: 160656 - DNA, 601 bp, Human
tgggattttgcattgaaactcagtgctgccctgtcacagtggaaagcagcataggacagaattcagccagcacccacagagggagtatttagactagccctagtcagaggggaattgtccatcccagtgattagaatctgaatttcgggctgggcactatggtctgtaatcccagcactttgggaggccgaggcggacggataacctgaggtcgggagttcaagaccagcctgaccaacatggagaaacctcatctctactaaaaaacaaaaaaattagccagaggtggtagcgcatgccrgtaatcccagctactcaggaggctgaggtaggagaattatttgaacccgggaggcggaggttgtggtgagctgagattgcgtcactatactccagcctgggcaataagagcgaaactctgccaaaaaaaaccaaaagaatcttaattttggtaagccccaccaccgtgggtaaagtcctctggggtcctaaataaacttgaaaggcagtctagaccagaaggactgcaattcctggacaagtcatggtactgtgctgggctcatagtcagtggacttggggtacatgtgacccactgaga

SEQ ID NO: 160657 - DNA, 601 bp, Human
taaaacaatagcaccaatgggggccgggcacggtggctcacgcctgtaatcccagcactttgggaggccaaggcaggcggatcacgaggtcaggagatcgagaccatcttggctcacacgctgaaaccccatctctactaaaaatacaaaaattagccaggcatggtggcaggcgcctatagtccctgctactcgggaggctgaggtaggagaatggtgtgaacctgggaagtggagctgcagtgagccaagatcacgccactgcactccagcctgggtgacagagcgagactccgtctcaaaaaaaaaaaaaaagatagcaccaatgagctgggcacagtagctcatcactgtaattccagccctttgggaggctgagacaagcagactgcttaagctcaggagttcaagaccagcctgggcaacatagtgataccctgtctcatttaaaaaataataataaaataaaataaaataacaaaaataaagaagtaaagaaaagcaccaatggctggaccaagggtgagacacacatgtacaagtgagtcagaaaatgatagactcgtcaaaaggaatatgacaataaaggaacttaaaagct

SEQ ID NO: 160658 - DNA, 601 bp, Human
aggtgtgaaagaagtttaggaaaggtgttgggatggagaatagtctaagtaaaaggaagagtatgtttaaaaatccaaagaaaagggagaagctggctctatcacataaaacaatagcaccaatgggggccgggcacggtggctcacgcctgtaatcccagcactttgggaggccaaggcaggcggatcacgaggtcaggagatcgagaccatcttggctcacacgctgaaaccccatctctactaaaaatacaaaaattagccaggcatggtggcaggcgcctatagtccctgctactcsggaggctgaggtaggagaatggtgtgaacctgggaagtggagctgcagtgagccaagatcacgccactgcactccagcctgggtgacagagcgagactccgtctcaaaaaaaaaaaaaaagatagcaccaatgagctgggcacagtagctcatcactgtaattccagccctttgggaggctgagacaagcagactgcttaagctcaggagttcaagaccagcctgggcaacatagtgataccctgtctcatttaaaaaataataataaaataaaataaaataacaaaaataaagaagtaa

SEQ ID NO: 160659 - DNA, 601 bp, Human
attatacttaaatatcttaaataactttagtaatacatttttgccatgagcacaagctacgtaatattaactatacgcatgaaatgttctgaataaggcttttttcatactttaagagtaatgcttttactataaactaacaataacagagtacctatatagcacaaccacagtcaccaaagcactcaaatgtcctagcctctaaagttcaatatttactgagtgcttaccacatgtcagaaattgtgcctgctgggtgagaaaaatatgaaatagtttctatcctcttatacttgtcatytaaataagatcagacacttcacaataaaatgagtaaatgctaagagagtctatagaaaaagcaacctataaaaaagaaaggtttctcagtaaagtgtcagctagtctaaggtgtgaaagaagtttaggaaaggtgttgggatggagaatagtctaagtaaaaggaagagtatgtttaaaaatccaaagaaaagggagaagctggctctatcacataaaacaatagcaccaatgggggccgggcacggtggctcacgcctgtaatcccagcactttgggaggccaaggcaggcggatcacg

SEQ ID NO: 160660 - DNA, 601 bp, Human
cacgcccagctaattttttttaatatttatttttagtaaagatggggtttcaccattttggccacgctgaccttaagtgatctgcctgactcagcctcccaaagtgctgggattacaggtatgagctaccacgcctggccaatcaacaaacacttgagctgaaaagacagtagctacttatgaaatatccttaaaagcaattcttaacataacagtatccttttatttatttatttatttatttttgagacagagtctcgctctgtcacccaggctggagtgcagtggcatgatctcggcycactgcagcctccaccttctgggttcaagcaattctcctgcctcagcctcccgagtagctgggatacaggcacctaccaccatgcctggctaatttttgtatttttagtacagacagggtttcacatgttggccaggctggtcttcaactcctaacctcaagtaatctacctgcttggacctcccagagtgctgggattataggtatgagctaccagtcaacataccaatattctagcatgcagtaattcttatgtgagaagatattttacatgacatacctggaaaaagtcatggctgt

SEQ ID NO: 160661 - DNA, 601 bp, Human
aatcttggctcactgcaacctctgcctcccgagtttaagccattctcttgccttagcctcctgattagctgggattacaggagactgccaccacgcccagctaattttttttaatatttatttttagtaaagatggggtttcaccattttggccacgctgaccttaagtgatctgcctgactcagcctcccaaagtgctgggattacaggtatgagctaccacgcctggccaatcaacaaacacttgagctgaaaagacagtagctacttatgaaatatccttaaaagcaattcttaacayaacagtatccttttatttatttatttatttatttttgagacagagtctcgctctgtcacccaggctggagtgcagtggcatgatctcggctcactgcagcctccaccttctgggttcaagcaattctcctgcctcagcctcccgagtagctgggatacaggcacctaccaccatgcctggctaatttttgtatttttagtacagacagggtttcacatgttggccaggctggtcttcaactcctaacctcaagtaatctacctgcttggacctcccagagtgctgggattataggtatga

SEQ ID NO: 160662 - DNA, 601 bp, Human
cgtttttattgaaacatatacacttatattgcccattccttaatcccttaaagaatacagccataaaagaacaattttttaaaaatctgagtaatatacaaccgttcctctcaaaggcaatcaaaaaatactttttttttttccttcacagagtcccactctgttgctcaggttggagtgcagcagtgcaatcttggctcactgcaacctctgcctcccgagtttaagccattctcttgccttagcctcctgattagctgggattacaggagactgccaccacgcccagctaatttttttwaatatttatttttagtaaagatggggtttcaccattttggccacgctgaccttaagtgatctgcctgactcagcctcccaaagtgctgggattacaggtatgagctaccacgcctggccaatcaacaaacacttgagctgaaaagacagtagctacttatgaaatatccttaaaagcaattcttaacataacagtatccttttatttatttatttatttatttttgagacagagtctcgctctgtcacccaggctggagtgcagtggcatgatctcggctcactgcagcctccaccttct

SEQ ID NO: 160663 - DNA, 601 bp, Human
acccaagctggagcccagtggtgcagtcacagttccctgcagcctggaccttctggtttcaattgatcctcccacctcagtctcccaagtagctaggactacaggagcacaccatgacggctggctaagatttctattttttttttgcagagataggtttttgccatgttgcccaggctggtcttaaaactcccggtcatgtgatctgcccacctcagcctctcaaagtgctggaattacacgtgagccaccaagcctagccgaaacatccttctaataggatcttaacattggttgaagwtagttgcccctctgcttcaaaagaaattctggctttggggaaataactgtaggtatatataaagcaaggttagcaatctagtaaattaatctagcaaaccctcttcttcaaatttaagttcagatttaaatcagatttcagatcaaaaagctttggaattaacttttttttttttttttgagatagggtctcactatattgcccatgctgctctcgaactcatgggttcaagtcatcctccagctgggatatcaggcatggagccactgtgtccagccaattagtctggtttttttgttt

SEQ ID NO: 160664 - DNA, 601 bp, Human
gagctcaagtgatcctcccacctcagcctctcagcctcccagggtgccaggagacaggcagatcacgagatcaggagttcgagaccagcctgaccaacacggtaaaaccccgtctctactaaaaatacaaaaattagctgggtgtggtggcgcacccctgtaattccagctactcaggaggctgaggcaggggaatcgcttgaatctgagaggcggaggttgcagtgaagctaagttagcgccactccatcagagcgacactccatctcaaaaataaataaacaaacaaacaatttaagasgaaagaatagtcttttcaacaaatgaggtggggacaacggatatccacaagcaaaaggaaaaacctggaccactactctcatctcatacacaaaaattaactcaaaagagattgtagacttaaatgttaagagctaaactataaaaatcataggagttttataggcgtttcataggagtaaatctctgtggccttgagttaggcaatgctttgtctgatatgacatcaggagcaacagcaacaaaagaaaaaacaaacagataaattgaacttcatcaaaattaaaaactgtgttacaaa

SEQ ID NO: 160665 - DNA, 601 bp, Human
gcctgtaatcccagctacttgggaggctgaggcagtggaattgcagaccaattctgggacacagaacaagactccatctcaaaaacaaacaaacaaacaaaaaggaataagctgatactaacatgaaattcaaattactacactgtttaggacacacatatgaaattatataccaagcttgtccaacttgcgtcctgggacggctttgaatgtggcccaacacaaattcataaactttcttaaaacattataagttttgctatttttttttgttttgttcatcagctatcattagtgttastgtattttatgtgtggcccaacacaattcttcttccaatatgacccagggaagccaaaagattgaacacctctgttacacgctgtttgattccatttattaaaaaaaaaaaaaaaatctaggggctggctgaggtggctcacatctgtaatcctagcactctgggaggctgaggtgagctcaagagttcgagaccaacctgggcaatataatgagacgtctccaaaaaaagatttttttacgtaaaaaaagaaaaaaaaaaacctaatcaaaaaaaaaaaaagaaaaagaaatctaaaga

SEQ ID NO: 160666 - DNA, 601 bp, Human
ttagtcccagctacttgggaggttgaggtgggaggaccacctaagcccaattggtagagactgcactgagctgaaatcatgccactgcactccagcttgggtgacagagttagacactgtctcaaaaaacaaacaaacaaaaaaacctatgacttggctgggtgtgatggctcatccagcacctcctaaagtgctggcctgtaatcctagcactttaggaggctgaggtagaaagataacttaagccctggaatttaggactagcctgggcaagatagaaagatggtgagactctgtctcaaaaaaaaacaaaaaacaaacaaaaaaacaaagaagaagaaagacaagacaagaaaagaaaagctggcaaggtggcatgtgcctgtagtcacagttacttgagaggctgaggagggaggatcctttgagaccaggaattcgcagcagcagtgagctatgattgcactactgcactccaagcctgggcaacaaagccagaccccatctcaaaaacaaaaaacaaaaccaaaaccaacttaaagatacacactaaaatgttggtggataaactgatgcaatgtctagaatttgcttcagaata

SEQ ID NO: 160667 - DNA, 601 bp, Human
ggtggcgcgcacctttagtcccagctacttgggaggttgaggtgggaggaccacctaagcccaattggtagagactgcactgagctgaaatcatgccactgcactccagcttgggtgacagagttagacactgtctcaaaaaacaaacaaacaaaaaaacctatgacttggctgggtgtgatggctcatccagcacctcctaaagtgctggcctgtaatcctagcactttaggaggctgaggtagaaagataacttaagccctggaatttaggactagcctgggcaagatagaaagatggygagactctgtctcaaaaaaaaacaaaaaacaaacaaaaaaacaaagaagaagaaagacaagacaagaaaagaaaagctggcaaggtggcatgtgcctgtagtcacagttacttgagaggctgaggagggaggatcctttgagaccaggaattcgcagcagcagtgagctatgattgcactactgcactccaagcctgggcaacaaagccagaccccatctcaaaaacaaaaaacaaaaccaaaaccaacttaaagatacacactaaaatgttggtggataaactgatgcaatgtctagaa

SEQ ID NO: 160668 - DNA, 601 bp, Human
cagaagtctactttaaatatcaacacagggatacagtcagcaaaattcagatcgtgggaaaaaaatacaagacaagctggatatgaacaagacaaaaactaagggaaaaactgtaattaaaactgtgagggctgagtgcagtggctcatgcctgtaatcctggcaccttgggagtcaaggcaggcagactgcttgagctcaggaattcgaaaccctgtctctacaaaaaatacaaaaattagccaggtatggtggcgcgcacctttagtcccagctacttgggaggttgaggtgggaggaycacctaagcccaattggtagagactgcactgagctgaaatcatgccactgcactccagcttgggtgacagagttagacactgtctcaaaaaacaaacaaacaaaaaaacctatgacttggctgggtgtgatggctcatccagcacctcctaaagtgctggcctgtaatcctagcactttaggaggctgaggtagaaagataacttaagccctggaatttaggactagcctgggcaagatagaaagatggtgagactctgtctcaaaaaaaaacaaaaaacaaacaaaaaaacaaagaaga

SEQ ID NO: 160669 - DNA, 601 bp, Human
accaaacagctggatatgggaaagtttttctttatagaaatattccaggcaataattgaagaagggatgaaaggaaaagaatgtcaccattttacaacccctaaggaaataactgatcttgggctagacaattatcatcaatggctgctaaaaaacacaccaaaaaaattaaggcgctaaagggacatattatctcctggatagataaaacatctaggaactcactgactactcctatcaggaaaaagactgattacatgactcctcactgaaagtacacacatctgtgaaacattggggaaaaaaaaaaaaaacccaatctgatcaagccttcattatttactatcagtttacaaagattacaggggacagaagtctactttaaatatcaacacagggatacagtcagcaaaattcagatcgtgggaaaaaaatacaagacaagctggatatgaacaagacaaaaactaagggaaaaactgtaattaaaactgtgagggctgagtgcagtggctcatgcctgtaatcctggcaccttgggagtcaaggcaggcagactgcttgagctcaggaattcgaaaccctgtctctacaaaaaata

SEQ ID NO: 160670 - DNA, 601 bp, Human
gtgattctggcctgccatggtggctcatgcctgtagtcccaccactttgtgaggctgacacaggcagactgcttgagctcaggagttcgacaccagcctgggcaacatggtgaaaccctgtctctgcaaaatatacaaaaattaagccaggcacggtggtgcttgcctgtagtcccagctacttgggaggctgaggtggggggattgccttagctcgggaagttgaggctgcagtatgcccagatcatcccactgcactccagcctaggtaacagagccagaccttgtctccaaaaaattaaaaaaaaaaaaaaaattccagaagtttatactgatagtaagaaccaacgacaaaaaaaccacctcactggttacctttggaggataacagaaaaccaactcattattttgaagactgccttaaaaagggaaatgattaacattttaaattacttttcctaagaaagctatacctcagggtaaccaaacagctggatatgggaaagtttttctttatagaaatattccaggcaataattgaagaagggatgaaaggaaaagaatgtcaccattttacaacccctaaggaaataactgatct

SEQ ID NO: 160671 - DNA, 601 bp, Human
aggtgatctgcccacctctgcctcccaaagaggtgggattacaggcgtcagccactgcatccagccaaggataaactttaatatgctattgaaggtatactttgttcttgaacaggaagactcaacatcatgaagacatcaatcatttcttctcaagttaatttataagtttattgtgattctggcctgccatggtggctcatgcctgtagtcccaccactttgtgaggctgacacaggcagactgcttgagctcaggagttcgacaccagcctgggcaacatggtgaaaccctgtctctrcaaaatatacaaaaattaagccaggcacggtggtgcttgcctgtagtcccagctacttgggaggctgaggtggggggattgccttagctcgggaagttgaggctgcagtatgcccagatcatcccactgcactccagcctaggtaacagagccagaccttgtctccaaaaaattaaaaaaaaaaaaaaaattccagaagtttatactgatagtaagaaccaacgacaaaaaaaccacctcactggttacctttggaggataacagaaaaccaactcattattttgaagactgccttaaaa

SEQ ID NO: 160672 - DNA, 601 bp, Human
atattagccagctgcggtgctgtgcatctatggtcccagctactcaggaggctgaggtgggaggaacttttcagccagggaggcagatgccgcggtaagccgtaactgcaccactgcactccagcctcggcgaagaagtgagaccctgtctcaaaaaaggggagggtaggggacaggaggggaagaaaagaaaccaagcccttgactctgcctgttatttgaaaaatgctaaaaatatttttatccaatacctcaaaggattggaatttagtaaaggagcagggtaaaaactaacatataracagcaatagccttcatatatggtacttcataagtaattacttagaagatgcaatggaagagaagtccctgggttacactaacattaaaaaagaacctacctaaggcatacactgaaaaaaatgtacaaaaccttaaagataaactttatttttatttatttattttctttgagacagagtgtcgctcggttgcccaagctggagtgcagtggtgcaatcttgactcactgcactctctgcctcctgggttcaagcgattctcctacctcagcctccagagtagctgggactacaggtgc

SEQ ID NO: 160673 - DNA, 601 bp, Human
tgaagcaatccattaattctgtatcataagatatacaaatggacattttattttaaattatcaacagtgaaaaatctattattttggtactttagacagctgctaagttgatctacacaaatttctctgtttagtcacaaaacgaagatgggtttttttgcttattattctcacatataaatactgcttagttttacataaaatacttctcattttcatttcagcattctgttcacattggttatatttaaagtgtgactcatgtctaaaatatatctaatatgacataatattcaaccactaaaatacagcatgatgtagaaacatagtattatcattataacaaacagcaaaaaaaatatgtaatgccagtgaccctcagatcaagtagtgaagcaaaatgttttcatgctggagaacacctttatgcttttattattataaaattctcttgcatgtcgtaggcaggatataccaaagcataatattgatgaggaagaggagaaaggtacctttctccacaaagatgctttgccattatatacatcattacattttagttaaagcaggaaagagatctgaagaccaggtacagaagtag

SEQ ID NO: 160674 - DNA, 601 bp, Human
ggcaggcggatcacgaggtcaggagatcaagaccatcctggctaacacagtgaaaccccatctctactaaacaaaatacaaaaaattagccgggcatggtggcgggcgcctgtagtcctagctactcgggaggctgaggtaggagaatggcgtgaacgcaggaggcggagcgtgcagtgagctgagatcacgccactgcactccagcctgggcgacagggagagactccatctcaaaaaaagagacatcaaagagataaggtttttgacaaaagccctttctaagatagctagaaagaggwcaaggtcaatacttttttagaataaaataattatcctattttatcatttaactgttcagtaatgttagcatatgtgtattaaacatactaaaaatttaaaaacaataatcaggatttcattttgcagtcattagtggtcctatgttttcaatgcctttggctatggctataacaattaatgaatgagaaaaggtgacataaaattgtcaccaacatctgggtgcatgttcttctgtttgcattaaatgttttaaaaacctagatatgatgtagcttaaaaagaaaagcacaattcatact

SEQ ID NO: 160675 - DNA, 601 bp, Human
actgaacaaccttgatataaatcatgtaccaaaataaaactattttacaagtttaattcaatagacacacaattttgcaaaaacattactaatggaaatgtcattatcctgaaagattatctagtaatggatccaaaaatttaggatcatagcaagaatataaacatgaatattatttcttattaaaacatgtctacataaaggggtagggtatttgagtgtatttaaatacacctggaaggatacacatcaaaatgttaaaaggcagttgtcaggtggagggattatggatgcttttcattttttttttttttaacttaactatattttcttacttatctgcattaaactaccaaaaacaaatcaaaaaaggattctggatctaattcttcctaatggctctagttagtcggaaaagttgtattattactgtttctgaaaggtaaaagcatcaccataaaacaaaattagatggattagaagagtagatgtgaggctgggcgtggtggctcacatctgtaatcccagcactttgggaggcctaggcagacaaatcacaaggtcagaagttcgagatcagcctggccaagacggtgaaacc

SEQ ID NO: 160676 - DNA, 601 bp, Human
ctttggtagagatagggtttcaccatgttggccaggctgttctcgaactcctggcctcaagcaatccacccacctcggcctcccaaagtactgggattacaggcgtgagccaccacgtccggcccttatttttacaaattgccctacaaataggaaaaatgtaccttaaaagttcatttccagaagaaagctctgcccagactttctccatgaaggagcaactatttctgtactttttgccaggtggggagaggggacctgtgctgtccaagataatgacctgagaggtcatgatctcttscttaagctcaagatatcctgaggggtctgcttcctgaatattttattttttgagacagaatttcgctctgccacccaggctggagtggagtggcacgacttcggctcactgcaacctctgcctcccaagttcaagcaattctcctgtctcagcctccctagtagctgagattataggcgcatgccagcatgcatggctgatttttgtattttttagtagagatggagttttaccatgttggctaggctggtcttgaactgctgacctcagatgatccacccgcctcagcctcccaaagca

SEQ ID NO: 160677 - DNA, 601 bp, Human
gcatttagtagagtcagacattgagtcaccccaaaataactcaaaatgtgcctaacataaaatttgaatccttaatatcctctagaacacaacatttcatacaaggtgacaatattaatggcacaaatttctaaaggatttctacaaatattagtactccttcctatttaaataccaaagtccaagactagccttatttttattttttattttgagacagagtctctctctgttgcccaggcctgagtgcagtggtacaatctcagctcactgcaacctccacctccagggttcatggaamtcttgtgcctccgcctcccaagtagctgggactacaggtgcgtgccaccatgctttggtagagatagggtttcaccatgttggccaggctgttctcgaactcctggcctcaagcaatccacccacctcggcctcccaaagtactgggattacaggcgtgagccaccacgtccggcccttatttttacaaattgccctacaaataggaaaaatgtaccttaaaagttcatttccagaagaaagctctgcccagactttctccatgaaggagcaactatttctgtactttttgccaggtggg

SEQ ID NO: 160678 - DNA, 601 bp, Human
tttaaaagccaaggaaaaaaatagcttggaagacaagagagacaaaaaaggaaccaggggccgaggtaggtgatcacgaggtcaggagttcaagaccagcctggccaagatggtgaaaccctgtctctactaaaaatacaaaaaaaattagctgggtgtggcagcaggcgcctgtaatcccagctactctggaagctgaggcagagaattgcttgaacctaggaggcggaggttgcagtgagccgagatcgcaccactgcactccagcctggacgacagagtgagactccatctcaaaagaaaaaaaaaaaaaaaggaaccaagataaggtaaagaaggaaaaaacacaggagaatcagggaaaaggagagtggagtgggaagggcagtgggttctgacccacacatattatttcactgcttttgttatatatgctcattctggctaaagatcccagagaggttaaaaataaagttaattttatttgtaatactgatttattcatcagttaaacttctatttataaaactttagtcttcataaaatcttttagattaaagataatcaaagacatatgcttctttggtccagacctagtcca

SEQ ID NO: 160679 - DNA, 601 bp, Human
ctaacttggtggcttattaacaggccctccatcatcatcatactcattaagtttacttccagctcctccaagttgtataggcactgacttggtctaaaagatttgatgtaaatttcgaacctgagtttgttgtacttgtaaaaatcttacgttcattttaaaaatgtatttatttgtttaatttttgacagagtctcgctctgttgcccaggctggagtgcaggggcaccatctcggctcactgcaacctccgcctcccgggttcaagcgattctcctgcctcagcctgccgagtagctgsaactataggcaagcatcaccatgcctggctgatttttgtatttttagtagagacgggtttcaccatgttggccaggctggtctcgaactactggcctcaagtgatccatccgcctcggcctcccaaagtgctgggattacaggcatgagccactgcgcccggccatgtttgtttatttttgagacccagtcttgctgtcacccaggctggagtgcagtggagcgatctcggctcactgcagcctccgcctcctgggttaaagtgatactcctgcttcagcctctgagtagctgggattac

SEQ ID NO: 160680 - DNA, 601 bp, Human
ctaggataaagaagccactccatgcagacctctgagttgcccttacctgaacaggactgggtgcaggatgacttccaccatgttggctttgctgctgtccagtgggggtagctgaaggctgagggtgtggagtatgtgggtgcagggtagcgttagggtgcgcatactgctgagcaagggagcccgtggaaactaaagtgaaagaaaaaggagcatgtacacaaccgatgtctgacaacctccatcgctcctctacacttcatcaactgaactttcttgatggttacaatgcataactcaygccactaccaatttctatagatgactccatttaaaccatccattgtcttgaaaaaataagtgtagctattgcttaacagactagcatttggttcatataatacagctctacatatgatattaaaatcaaattagtttgcatttactcttaacggtcactaggttttcccaaaaaggcaacttgaaggcataggcagaaactactcaaacaagtgcattttaggtgcacactctttagctcaaggccatcatcaggctaacctcaccatgctactgccctggagcaatgtcctgagggcac

SEQ ID NO: 160681 - DNA, 601 bp, Human
ttcacgagggtggacatgccatgtgttctgacgatgcgatacctggcacctgaagaaagcactcagatactaggataaagaagccactccatgcagacctctgagttgcccttacctgaacaggactgggtgcaggatgacttccaccatgttggctttgctgctgtccagtgggggtagctgaaggctgagggtgtggagtatgtgggtgcagggtagcgttagggtgcgcatactgctgagcaagggagcccgtggaaactaaagtgaaagaaaaaggagcatgtacacaaccgatgtstgacaacctccatcgctcctctacacttcatcaactgaactttcttgatggttacaatgcataactcacgccactaccaatttctatagatgactccatttaaaccatccattgtcttgaaaaaataagtgtagctattgcttaacagactagcatttggttcatataatacagctctacatatgatattaaaatcaaattagtttgcatttactcttaacggtcactaggttttcccaaaaaggcaacttgaaggcataggcagaaactactcaaacaagtgcattttaggtgcacact

SEQ ID NO: 160682 - DNA, 601 bp, Human
ttactgataaccttcacattctacttggccttcacagaaagttggctaaagctggtattacctgaggtacgtgggccatgtggggtgggttggtatacgccggctgaacgtgagaaggatggatcgtaaagacagtctgttgtgctgctgggaaactattctgtggcgactgcgtgttggaggcaggtgtcatggagggtggagttggcgcaagccccgcgtggtaaatggctgactgctgctgtggactggccagatggagagcctgggcggcctggtgctgatggtgctgcaaagcgayaggaaagaattgagaggaaaacttctttaatgaaaagcagccaagggatacccacaaagctaagctttgcacacttgggcctatgatgagggtcactggaaagtacaggagaatgtacagggtggtaagagcaaggctggaggtgcctcccatctggacaactcctttctagggtacagaagcctgattctcagtctggcagttagaaacttctgagcatacatactaaagtcaaaaaagactactgccccagggaactgatagatatcaaagacatctttaactgcctccattagcaaa

SEQ ID NO: 160683 - DNA, 601 bp, Human
tgttatgaaagtagcagagacatctaatacagccaattcacccgtaacagccccagggagggcctcaaggccagcgttagagcccaacttcagtgcagctccttctcctcattaagacaatcccctgggccctggagtgcagggacctttgtcagcagctgatgcagacagcaaccactgagatggcaagcacacctttcacctgtagcagcttacactggaggtgagctccaaagtgcttccagggctgctcttaaagaaaaatgggaccacctgggtgcttccagcttctagttacacygcaccaatgtccaaggccaagccctctcaagagtacaacttatggtcaaagcagatatatggataaccagggaaaacaattggagagatgtgtctggaactcatgtgagtaacaatcaagttgacaggccccggtagtcacttcggagagctgagactctgtgaaggccatcatccctgcctggcttccaaggtaagtgtgtaggggaatatatatgtacacatatatatagtagtgaggctatatagacatagcaaagcagacacagaaaggaaagaaggactgggttgcattccagag

SEQ ID NO: 160684 - DNA, 601 bp, Human
ccgccgggtggctgtgtcgtcattagcatcattggcgcatgggcagttggatgagaaggaaccattcctgactgtacatgagcctgaaacagagagctcttttacgcatacaggcaacatctccggcttcaacaacatgtcaactgtgttcctttcactgggctgggactctcaggaaagggcaacggtgggcctcagggcccagttctgttctctggggacaatctctagtagattatctattgacctgaagacgcgcttcacctttgggcagatcctgcaagggtcagggagcaggcamcaagtgagcctgggtagaagtcagggctgtgctgtcctaacccttgacatttctgatcattgtattctatgtatggggtaagatcttcacaaagattagacactggatccaagggcagctttctcaacttaatatcatacaagattcaatgatgcttcagaatcaggctgccatgtggggcctgaggtagttttgcagataacatccctttcaaataggaaaacagattacattaataagcagagactgtcacagtcaagtatgtgaattacttggacctctgttcatttgcctctctcc

SEQ ID NO: 160685 - DNA, 601 bp, Human
ggtcagggatgttgctaaacatcccacaatgcacaggagagccactcaacaaagaactatctgcccaaaatgtcagtagtgccaaggttaaaaaatccatggtctacagaaatcaaaagacttacttttagagatttacaactacttctattacagaataatctagatcaagctagatcaagtacattaaaattttaaaggaaaatagacacaaaaatctatttaaatgatgagggaaaacttaatgtactatatagtaattttcacgaaaccaatttgtttatgccatagatttaaacaygccctatgagactagaaaatgttggccaggtgcagtagctcactcctgtaatcccagcaatttgggaagtcgaggcgggtggatcacctgaggtcgggagttcaagaccagcctgaccaacatggagaaacctcgcctctacttaaaatacaaaattagccagccatggtggtgcatgcctataatcccagctactcaggaggccgaggcaggagaattgcttgaatccaggaggcggaggttggggtgagccaagatcgcgccattgcactccagcctgggcaacaaaagcaaaactcc

SEQ ID NO: 160686 - DNA, 601 bp, Human
aggcgcctgtaatccaagctactcgggaggctgaggcagaatggcttgcaaccaggaggtggaggttgcagtgagctgagatcgtgccactgcactccagcctgggtgactgagcaagactctgtatcaaaaaaaaaagttttgtctacatagttctcaacatatggcagtctggggacatttttagttgatgcatccagcaagaagagatagtggggacatgcgctggggctctgcagtgctacctgcatatactggtagaggtcagggatgttgctaaacatcccacaatgcacaggaragccactcaacaaagaactatctgcccaaaatgtcagtagtgccaaggttaaaaaatccatggtctacagaaatcaaaagacttacttttagagatttacaactacttctattacagaataatctagatcaagctagatcaagtacattaaaattttaaaggaaaatagacacaaaaatctatttaaatgatgagggaaaacttaatgtactatatagtaattttcacgaaaccaatttgtttatgccatagatttaaacatgccctatgagactagaaaatgttggccaggtgcagtag

SEQ ID NO: 160687 - DNA, 601 bp, Human
ccatctcgctcactgcaacctccacctccccggttcaagcaattctcctgcctcagcctcccaagtagctgggactacaggcactcaccaccatgcccggctaatttttgtatttttagtagagacggggtttcatcatgttggccaggatggtctcgatctcctgacctcgtgatccacctgcctaggcctcccaaagtgctgggattacaggcgtgagccaccacgcctggctgtgttcttcttatatagttaataaatagccaggaatcattttcttttttcatttatgagacagggyctcgctgatgcccaggctaaagtgcggtcacatgatcacaattcactgcagccttgacctcatgggctcaagcatcctccagcctcggcctcccgagtagctgccactataggcacataccaccaggcctggctgattttttttaaatgttagtagtaacaaactctcactatgttgcccaggctggtcttgaactcctggcctcaatcgagtctcagcctcctaaaatgctagattacaggcataagccaccccacctggccataaacactcttttaaagagttttgtcaggccagcct

SEQ ID NO: 160688 - DNA, 601 bp, Human
aaacattagccatgcatgctggcacatgcctgtaatcccagctactcaggaggctgagacaggagaattgcttgaacccgggaggcggaggttgcggtgagccgagatggcgcattgcactccagcctgggcgacagagggagactccgtctaaaaaaaaaaaaaaaaaaaaaggtgtatagtctttaagaaggggtgacaggccaagcatggtggctcacgtctgtaatcccagcacttcaggtggccaaggccggaggatcacttcagtccaggagttcgagaccagcctgggcaacayggtgaaaccccgtctctacaaaaaattacataaattagctgggcatggtggcagacgcctttagtccctgctacttggaaggctgaggtaggaggatcatctaagcctggggagttcaaggctgcagtgaactgtgatcacgccactgcattctagctttggtgacagtgagactctgtttcaaaaataaataaataaaaagggaagaagctagggagcccagatgtgtctaaacctacgcccaatggacagagctcaaagtctttgtaacactgtatacaaggaattcaccccaaacat

SEQ ID NO: 160689 - DNA, 601 bp, Human
gtcaggagatcgagaccatcctgactaacacggtgaaaccccgtctctactaaaaaaaaaatacaaaaaattagctgggagtggtcgtggacgcctgtagtcccagctactcaggaggctgaggcaggagaatggcgtgaacctgagaggcggagcttgcagtgagctgagatagcgccactgcactccagcctaggtgacagagcgagactccgtctcaaaaaagaaaattagctgggcatggtggcgcatgcctgtaatcccgggatcccagccattccagaggctgaggtattggttsaacctgggaggcggaggttgcagtgagctgagatcgcgccactgcactccagcctgggtgacaaagcgagactccgtctcaaaaaaaaaaattagctgggcgtggtggcgcatgcctgtaatcccgggatcccagccattccagaggctgaggtattggttgaacctgggaggcggaggttgcagtgagctgagatggagccactgcactccaggctgggtgatagagccgagactctgtcacaaaaacaaaacaaaacaacaacaaaaaggaatctctctcatgcagataccctttaga

SEQ ID NO: 160690 - DNA, 601 bp, Human
ttaataatgtattcactgggaaataagagtatatagtcttggctgggcattgtggctcacacttgtaatcttatcactttgggagaccagcctggccaacatcataaaaccctgtctctactaacaatataaaaaattggctgggcggtggggcgcgcctgtaatcccagctacttggtaggctgaggcaggagaaccgcttgacctgggaggtggtggctgcagtgagcttggatcatgctactggactccagccagggtgacacagtgagattccatctgggaaaaaaaaaaaaaaaaagtccaggcatgccaggcatggtggctcaccatttaagccaagcactttgggaggcccaggcaggcagatcatctgaggccgcgagtttaagaccagcctggccaatacaatgaaaccctgtctctactaaaactacaaaaattagctgggtattgtggccggacagggtggttcacacctgtaatcccagcactttgggaggccaaggcaggcagatcacgaggtcaggagatcgagaccatcctgactaacacggtgaaaccccgtctctactaaaaaaaaaatacaaaaaattagctg

SEQ ID NO: 160691 - DNA, 601 bp, Human
ttgggtacagagtttcaattttgcaagatgaaaagttctggagatggatggtggtgatagctacacaatgtccttaatgccactgaacatttaaaatggttagaatgataaattttatgttatgtgtattttactacaacttaaaaaaaaagcataaaaagataagccaaaattaaaaatcaagccacataatgtaagatagacaatatcatataaataacataaagaattcctacaaatctggctgggcacagtggctcacgcttgtaatcccagcactttgggatgccgagatgggcarattgcctgaggtcaggaagagaccagcctggctaacaaagcgaaaccctgactccagaacaagactccagccttactccagagcaagaactgtctcaaaaaaaaaaaaaaaatttcctacagaagaaggagaaaactacaaaccacctaattttcttttttgagatgaaatttcactcttgttgcccaggccaaaccatccaatttttaaaaaagcagttaaagaatgtaaacatggccgggcatggtggctcacgcctgtaatcccagcactttgggaagctgaggcaggcggatcacc

SEQ ID NO: 160692 - DNA, 601 bp, Human
acagattgagatacaaagtagaaatgtgactgccagaagctgggtggtagggggatagggagttagtaatattgggtacagagtttcaattttgcaagatgaaaagttctggagatggatggtggtgatagctacacaatgtccttaatgccactgaacatttaaaatggttagaatgataaattttatgttatgtgtattttactacaacttaaaaaaaaagcataaaaagataagccaaaattaaaaatcaagccacataatgtaagatagacaatatcatataaataacataaagaaytcctacaaatctggctgggcacagtggctcacgcttgtaatcccagcactttgggatgccgagatgggcagattgcctgaggtcaggaagagaccagcctggctaacaaagcgaaaccctgactccagaacaagactccagccttactccagagcaagaactgtctcaaaaaaaaaaaaaaaatttcctacagaagaaggagaaaactacaaaccacctaattttcttttttgagatgaaatttcactcttgttgcccaggccaaaccatccaatttttaaaaaagcagttaaagaatgt

SEQ ID NO: 160693 - DNA, 601 bp, Human
agagtttcggttttaaacaaaaatgaagaaagtatactcagagtttttttttttaaagggacaaataatgaatgatagagcagtcacacagattgagatacaaagtagaaatgtgactgccagaagctgggtggtagggggatagggagttagtaatattgggtacagagtttcaattttgcaagatgaaaagttctggagatggatggtggtgatagctacacaatgtccttaatgccactgaacatttaaaatggttagaatgataaattttatgttatgtgtattttactacaacttaaaaaaaaagcataaaaagataagccaaaattaaaaatcaagccacataatgtaagatagacaatatcatataaataacataaagaattcctacaaatctggctgggcacagtggctcacgcttgtaatcccagcactttgggatgccgagatgggcagattgcctgaggtcaggaagagaccagcctggctaacaaagcgaaaccctgactccagaacaagactccagccttactccagagcaagaactgtctcaaaaaaaaaaaaaaaatttcctacagaagaaggagaaaactacaaa

SEQ ID NO: 160694 - DNA, 601 bp, Human
aaaagctgctcatgggcaaggatgttatttttaacttccagagtttcggttttaaacaaaaatgaagaaagtatactcagagtttttttttttaaagggacaaataatgaatgatagagcagtcacacagattgagatacaaagtagaaatgtgactgccagaagctgggtggtagggggatagggagttagtaatattgggtacagagtttcaattttgcaagatgaaaagttctggagatggatggtggtgatagctacacaatgtccttaatgccactgaacatttaaaatggttagratgataaattttatgttatgtgtattttactacaacttaaaaaaaaagcataaaaagataagccaaaattaaaaatcaagccacataatgtaagatagacaatatcatataaataacataaagaattcctacaaatctggctgggcacagtggctcacgcttgtaatcccagcactttgggatgccgagatgggcagattgcctgaggtcaggaagagaccagcctggctaacaaagcgaaaccctgactccagaacaagactccagccttactccagagcaagaactgtctcaaaaaaa

SEQ ID NO: 160695 - DNA, 601 bp, Human
caagcaatcctcctgcttcagccgtccaaaacgctgggattaccggcttaagctattgcaagttgccaggaaacgtttaatacaaatagtctatctgggctgggcgcagcggctcatgcctgtaatcccagcactctgggcggctaaggcgcatggatcacttgagcctaggagtttgagaccagcctgggcaacatggcaaaaccctgtctccacaaaaagtaaaaaaaatcagccaggcatggtggcaaatgcctgtaatgccagctacttgggaggctgtggtgggaggatcacttawgcccaacaggttaagactgcggcgtgagctgtgatcacaacacggcaccccagcctggatgatagatagacagacagacaccatgtttcaaataaataaatagtccatcctgagatataaaaacctgacctatggtattaacaaaaggaataaaaaagagaaaacaaacattccagagacaagtggaggatgaaaggtaaatcagtgacaatattttataaaggatagtaacagaggttagaggaaaatcagaaaagagcagtatcagagcaaccaaaggaggagagttctaagatggaa

SEQ ID NO: 160696 - DNA, 601 bp, Human
tcctgggctcaagcaatcctcctgcttcagccgtccaaaacgctgggattaccggcttaagctattgcaagttgccaggaaacgtttaatacaaatagtctatctgggctgggcgcagcggctcatgcctgtaatcccagcactctgggcggctaaggcgcatggatcacttgagcctaggagtttgagaccagcctgggcaacatggcaaaaccctgtctccacaaaaagtaaaaaaaatcagccaggcatggtggcaaatgcctgtaatgccagctacttgggaggctgtggtgggagsatcacttaagcccaacaggttaagactgcggcgtgagctgtgatcacaacacggcaccccagcctggatgatagatagacagacagacaccatgtttcaaataaataaatagtccatcctgagatataaaaacctgacctatggtattaacaaaaggaataaaaaagagaaaacaaacattccagagacaagtggaggatgaaaggtaaatcagtgacaatattttataaaggatagtaacagaggttagaggaaaatcagaaaagagcagtatcagagcaaccaaaggaggagagttct

SEQ ID NO: 160697 - DNA, 601 bp, Human
aagcagctgggattacaggtgcacaccgctgtgccctactaattttttgtattttagtagagacagggtttcaccgtgttgcccaggctgatcttgaattcctgagctcaggcaatccacccgccttggcctcctaaagtgctaggattacaggcgtgagccaccgtgtctggcctcattttttaaatattctgtagaaacagggtctcactatgttgcccagatcggtctcaaactcctgggctcaagcaatcctcctgcttcagccgtccaaaacgctgggattaccggcttaagctaytgcaagttgccaggaaacgtttaatacaaatagtctatctgggctgggcgcagcggctcatgcctgtaatcccagcactctgggcggctaaggcgcatggatcacttgagcctaggagtttgagaccagcctgggcaacatggcaaaaccctgtctccacaaaaagtaaaaaaaatcagccaggcatggtggcaaatgcctgtaatgccagctacttgggaggctgtggtgggaggatcacttaagcccaacaggttaagactgcggcgtgagctgtgatcacaacacggcaccccagcc

SEQ ID NO: 160698 - DNA, 601 bp, Human
cgccgcctttaagaactgttaacactcaccgcaagggtccgtggcttcattcttgaagtcagtgagaccaagaacccaccaattccggacacaagaacaacagtataaaggttttgactttatccccataggcactggaaaacctaacagagaatgatgtaacattgtatttttaaaattaaatccagtggcatggcaccattagggttgactagaaaagctgggagaggctgggcgtggtggctcacgcctgtaatcccagcactttgggaggctgaggtgggcggatcacaaggtcagsagttcaagaccagcctgatcaacgtggtgaaaccctgtctgtacttaaaacacaaaaattagccgggtgtggcagcatgcatctgtaatcccagctactcaggaggctgaggcagaattgcttgaacacgggagatggaggttgcaatgagccaagattgtgccactgcactccagcctgggcgatatagcgagagtccatcttaaaaaaaaaaaaagaaagaaaagaaaagctgggagagactgaaggcagaaaaataaatgtacataagcaaacttttattctattttattctttaaa

SEQ ID NO: 160699 - DNA, 601 bp, Human
tgtggaagctttgttcttttgctctttgcaataaatcttgctactgctcactctttgggtccacactgcctttatgagctgtaacactcaccgcaaaggtctgcagcttcactcctgaagccagcgaaaccacgaacccaccgggaggaacgaacaactccagacgcgccgccttaagagctgtaacactcaccgcgaaggtctgcagcttcactcctgagccagcgagaccacgaacccaccagaaggaagaaactccgaacacaaccgaacatcagaaggaacaaactccggacacgcygcctttaagaactgttaacactcaccgcaagggtccgtggcttcattcttgaagtcagtgagaccaagaacccaccaattccggacacaagaacaacagtataaaggttttgactttatccccataggcactggaaaacctaacagagaatgatgtaacattgtatttttaaaattaaatccagtggcatggcaccattagggttgactagaaaagctgggagaggctgggcgtggtggctcacgcctgtaatcccagcactttgggaggctgaggtgggcggatcacaaggtcaggagt

SEQ ID NO: 160700 - DNA, 601 bp, Human
ctaataaataaaaacatatatacatagaaaaaaacaataaaatgtttttccattattcattgtaaaatgattattaactatctatacgtatacagagttgatcatggtcattctaatttatcctgtaagtatcagttaccggttattcccaagaaactctttccctgaggctagaatacccaacttccataggtccccttacttaaagtcaacaaacacacttattagctgttcaatttctcactgccttactgagccataatttattccataacagcaaggatcatgtccattttattarcataggtagcattcagtaaatatgtgaataaataaaaaatgtaaagttacactaaagaattgaaccacagatgatgtcatatatactaaatagatgccagtgagatcttcaaaagggaaaactacagaaaaaaaaaaaaattaccttcccactatcttgtttcccagttttgggcttggacattccatcatcctaattcaagacctgactacattattaacacttacatgcaacagaaatccaactttacctggaggccacctttatcaatatattcaactcttcctagtcccagaatca

SEQ ID NO: 160701 - DNA, 601 bp, Human
atttaaaaataattaactgggcacagtggtgtctacctgtagtactagctactcggaaggctgaggcaggagaatcacttgagccctggagttcagggttacagtgagctatgatcataccactgcactccagcctgggcaacaaactgagacctagtctctaataaataaaaacatatatacatagaaaaaaacaataaaatgtttttccattattcattgtaaaatgattattaactatctatacgtatacagagttgatcatggtcattctaatttatcctgtaagtatcagttaccrgttattcccaagaaactctttccctgaggctagaatacccaacttccataggtccccttacttaaagtcaacaaacacacttattagctgttcaatttctcactgccttactgagccataatttattccataacagcaaggatcatgtccattttattaacataggtagcattcagtaaatatgtgaataaataaaaaatgtaaagttacactaaagaattgaaccacagatgatgtcatatatactaaatagatgccagtgagatcttcaaaagggaaaactacagaaaaaaaaaaaaa

SEQ ID NO: 160702 - DNA, 601 bp, Human
gtccagactggtctcaaactcctgggctcaacttatcctcctgcctcagcctcctaaagtgcaaggattaccagagtgagccaccatgcccaaccaaaagaatattatttttaagagatgcatgctcaagtttttggtagtgaattatattcatgagagcaacatgatcttagctagtggggatacaagtgtactgtcctttcgacttttctcttcaaaattttattgataaaaagttaaaagttgactgggtatggtgtctcatgcctataatcccagcactgtgggaggccgaggcagrtagattgcttgagcccaggagttcaagaccagcctgggcaacacggtgaaaccccatctctacaaaaaaaaatatgaaaattagcagggcgtggtggcacgtgcctgtagtcccagctactcaggagactgaggtaggaagatcacttaagaccaggagtttgaggccgcagtgagctgtgattgagccactgcactccagcctgggtgacagagggtctcccaaatacttataacttctcttcggctccctattcaactctagccccatactacaataatttcttgcctaagctaccta

SEQ ID NO: 160703 - DNA, 601 bp, Human
tatttttgtcgagacgggcttttgtcatgttgtccagactggtctcaaactcctgggctcaacttatcctcctgcctcagcctcctaaagtgcaaggattaccagagtgagccaccatgcccaaccaaaagaatattatttttaagagatgcatgctcaagtttttggtagtgaattatattcatgagagcaacatgatcttagctagtggggatacaagtgtactgtcctttcgacttttctcttcaaaattttattgataaaaagttaaaagttgactgggtatggtgtctcatgcctrtaatcccagcactgtgggaggccgaggcaggtagattgcttgagcccaggagttcaagaccagcctgggcaacacggtgaaaccccatctctacaaaaaaaaatatgaaaattagcagggcgtggtggcacgtgcctgtagtcccagctactcaggagactgaggtaggaagatcacttaagaccaggagtttgaggccgcagtgagctgtgattgagccactgcactccagcctgggtgacagagggtctcccaaatacttataacttctcttcggctccctattcaactctagcccca

SEQ ID NO: 160704 - DNA, 601 bp, Human
aaaaaagagaggtgagtggatcacctgaggtcaggagtttgagaccagcctggccaacatggtgaaattccatctctactaaattagccgggtgtggtggtgcgcgcctgtaatcccagatacttggggggctgaggcaggagaatcacttgaacctgggaggcgaaggttgcagtgagccgagatcatgccactgcactccagcttaggtgacagagggagactccatctcaaaaaaaaaaaaaagagagaaaaagagaatacagcaggtccttggataacatcatttccttataacatktatgaggaaaaaaaaatcccacacgggctgctgtcttatgtggagcttgccatgttctccccacgtctttgtgggttttctccgggtactcaggtttcttcccaaattccaaagataaacatgctagattaactggcatggttaaactgtaccagcatgagtgagagtgggggtgtgtgtgagtgcacctggtaaaaggatgttggaaataagattatttccaggatgccaaagaagtaatccatcctttacttgctaattgcaaagagcataaaatgtacctttacaaagaaatcttgt

SEQ ID NO: 160705 - DNA, 601 bp, Human
gatcacctaaggtcaggagttcgagaccagcctgaccaacatggtgaaatcccatctctactaaatacaaaaaaaccagatgggtgtggtggtgtgtgcctgtagtcccagctacctgggaggctgaggcaggagaatcgcttgaaccccggaggcagaggtagcaataagccgcgattgtgccattgcactccaccctgcgcaacaagagagaaactctgtctcaaaaaatatattttttaaaaaaggaaattaattgtacagtacccattattaacacagagaaacaattattttaaaygttattattttcccttaacaaaaatttaaattacaaagacattctgagttttccctctaatttattaatctctttaagagcagacaggccacgtgcagtggctcacgcctgtaatcctagcactttcggaggccgaggcaggcggatcaggaggtcaggagattgagaccaccctggctaacacagtgaaacactgtttctactaaaaatacaaaaaattagcagggcgtggtggtggatgcctgtagtcccagctactcgggaggctgaggcagcagaatggcatgaacctgggaggca

SEQ ID NO: 160706 - DNA, 601 bp, Human
ggccaaggcaggtagaacacctgaggtcaggagttcgagaccagcctggtcaacatgttaagacagacatatagggaggatgccacataaagacagattattggggtgatgcatctacaagccaaggaacaccaaaaacgctggcaaaccaacagaaactaggaagaggcaaggaaggattccccagaggtttcagaggcaatctgaccctgctgacaccttgatttccaacttctagcctccacaactctgagaataaatgttttattttaaaaacccaaatatttacaatactattttaaaaaaaaaggccaagtgtggtggtacatgcctgtaatcccaacactttggaaggccaaggtggacagactgcttgagcccaggagttcaagaccaacctgggcaacatggcaaaacctgctctctactaaaaatacaaaaattagccaggtatggtggtgtgcacctgtagtcccagatactcaggaggctgaagcaggagggtcacttgaacgcaggaggttctcacagtgaggatggaagaaaattccctgcatgcttctggcagggggaagggggaaagtagccattctgaagtaat

SEQ ID NO: 160707 - DNA, 601 bp, Human
agatcacctgaggtcaagagtttgagaccagcctaaccaacatggtgaaaccctgtctctactaaaaacacaaaaaattagccaggtgtggtggtgcacgcctgtagtcccagctactcaggaggctgagggaggagaatcgtctgagcccaggaggcagaggttgcagtaagccgagatcgcaccattgcactccagcctgggagacagtgagactccatctcaaacaacaaacaaacaaacagcaaaataatctagaagggagtgggaatctgacagacaaaactagccacatgttcayaactaccgaaagtggaggccaggaggagtggtggctcacacctgtaatcccagcactttgggagactgaggcaggaggattgtttaagcccaggagttcaagaccagcctgggcagcaaagtgagatctccgtctctacaaaaaagaaaaagaaaaagcaactgggtgatgatatctattatgctattttctcaacttcagtacaagtttaaaaattttagcagaaagttaaaaagtaaaaacaggccaggcacgatggctcacgcctgtaatcccagcactttgggaggccaaggcagg

SEQ ID NO: 160708 - DNA, 601 bp, Human
tgatcttaccactggcactcctgcctgggtgactgtggtgtatcctgtctcagcgctccccccataagaaacctttaagattattaaagagaaaagaaaaacagtcaaagctactcctcaaacttcttcacatcaagtcctactctccagtatcaccttttcaattcagtctttgttgtccatgtttttcctacacaatacaatcctctgtatgtgatataacatttgtactctaagactgcttgtgacataaaaggactagaaagtaaactaaatgattacaaccattaagaagaataaygtaactgtaaaaaggtaagtcagaagtcaaggaaacctgagcatgtactgtgtcattacatattcaaaaattagtgtttcttttgttggacataataagacaattgatttggtttcataaaaatgtccttgtatgttaaagatccacaatgaattattcactgtacaatgacagaattctggggtttgctgcaaaataactcagaagatttgtttcaaaataatctagaaggggacaggtacattggctcacgctggtaatcctaacactttgggaggctgaggtgggtagatcacctga

SEQ ID NO: 160709 - DNA, 601 bp, Human
gggtaatgttgctgaacgatcaacaataatacctaatacatcgctttatcatccagacaggaggtacagtggtacaatcatagctcaccgcagcctcaaacctctgagctaaggcaattctcccgcctcagtctcccaaactgttgggattagaggcgtaaaccaccactcccagctcaatatctatatataatttacaggcaatattttaactgatgtacatgtaataactcaatcttaaaacaaacttacgtgcttaccaataaggaagctgaggcaacaaagtcacaaagctaataaycagtgaagccaggttttaaaactgattcaagagtcaagacagagcttttcttttacttatttttttttttgagatggtgtcttgctctgtcgcccaggctgaaatgcagtggggcaatctcggctcactgcaacctccaccacccgggttgaagcgattcttctgtctcaacctcctgagtagctgggactacaggcgcacagcaccacgcctggctaatttcttacatattttttagtagacacagggtttcaccacattggccaggctggtctcgaactcctgaccttatgatctgcc

SEQ ID NO: 160710 - DNA, 601 bp, Human
gacaaagtaagactccttaaaaaaaaaaaaaaaaggtggggggctgtgcgcggtggctcacgcctgtaatcccagcactttgggaggccgaggcgggtggatcacgaggtcaaaagatggagaccatcctggctaacacagtgaaaccccgtctctactaaaaatacaaaaaaaaaaaaacaaaaaaaacaaaaaaaacctactagccgggcgtggtggcgggcgcctatagtcccagctactccggaggctgaggcaggagaatggcgtgaacccaggaggcggagcttgcagtgagccragatcgcacaactgcactccccacctgggggacagagcgagactctgtctcaaaagaaaaaaaagaaaaaaggaaaaaaggaaaggcaggaggaaggggagggaaagggaaaaggaaagaaaggaaagaagaaaggaagaaaaagatatttggatagtctgatatcactgacactacaggaataatatttcaaggaaacagtgggtaatgttgctgaacgatcaacaataatacctaatacatcgctttatcatccagacaggaggtacagtggtacaatcatagctcaccgcagcctca

SEQ ID NO: 160711 - DNA, 601 bp, Human
ttgcaaggcattataacagatattggtagtataatgatcaactagaaattttctctaacctgtatcaatagttatttcattctaaggtactgaagaactaattatataatttttaaatgaagtacaggatactatgaagaacatttagcagacagaaaatctagaaagtaagaggaagcttccttgaggaaattagttttaaaagacttaactttaggaaaagccagcacttaaggcagagcgtacacgctgtgcaaaatggaggcaaacgaggacttgacaggtttaggaattgaaatgycgccaatgtgactacaatacaaagaatgaaaatgatgaaatgaggcaggagaagcagtcaaaagccagattattcagggtcatgaagaataataaaaatttgaagtgttgtaacaatcagatctgggtctcttagagatcacctggctggagtagggggaaatggctggagggggattagagagaatacttaggaaaccagtgagagatgccaataaagtccagtgcaatgaaaagaagatgaattaaggcagacaggaagtaaaatctaaaggacttagttactaactaaaagctatga

SEQ ID NO: 160712 - DNA, 601 bp, Human
tcaaaaaaaaaaaaaaaaaaattaaagcccgattttacaaaattaatttcacagtcctgtttccacagtctaagaaaaaaatgtagtatctaaaaataaataataaaataatgtgttattcacttcaatgactgcaacaaccaaggcagctgtagcttttgggtgaaattctgaagaattgtgttatcactgtaaatttttcataaggataggtcaaagattgcttttttaaactttcttctcccaactcagctaaacacatagcgggacctctggttggttttttttttttttttttttttcctgatgttccctgggggcttcaaggcatttctaatgcacaaaaggaacagagatatataaaagctatagcagctaggccaggcaggatgtttcacccctgtaattccagtactctaggaggccgaggcagatgaatcatttgaggcaagaaacttgagaccagcctggcccatatggcaaaaccctgtctctactacaaatacaaaaattaactgggcatggtagcacatgtctgtaatcccagctactcaggaggctgaggcatgagaattgcttgaacccgggaggcagaggttgc

SEQ ID NO: 160713 - DNA, 601 bp, Human
tggctgggtgcagtggctcacgactgtaatcccaacactttgggaggccaaggcgggtggatcatttgaggtcaggagtttgagactagcttggccaacatggtgaaaccccatctctactaaaaatacaaaaattagccaggtgtgctgacaggcacctgtagtcccagctactcgggagactgaggcagaagaatggcttgaacttgggaggtggaggttgcagtgagccgagattgcaccactacatgcagcctgggtgatagaccgagattctgtctcaaaaaaaaaaaaaaaaaaattaaagcccgattttacaaaattaatttcacagtcctgtttccacagtctaagaaaaaaatgtagtatctaaaaataaataataaaataatgtgttattcacttcaatgactgcaacaaccaaggcagctgtagcttttgggtgaaattctgaagaattgtgttatcactgtaaatttttcataaggataggtcaaagattgcttttttaaactttcttctcccaactcagctaaacacatagcgggacctctggttggttttttttttttttttttttttcctgatgttccctgggggc

SEQ ID NO: 160714 - DNA, 601 bp, Human
ttcccctttccctaacaacattaactataaaacctttaatttggctgggtgcagtggctcacgactgtaatcccaacactttgggaggccaaggcgggtggatcatttgaggtcaggagtttgagactagcttggccaacatggtgaaaccccatctctactaaaaatacaaaaattagccaggtgtgctgacaggcacctgtagtcccagctactcgggagactgaggcagaagaatggcttgaacttgggaggtggaggttgcagtgagccgagattgcaccactacatgcagcctggrtgatagaccgagattctgtctcaaaaaaaaaaaaaaaaaaattaaagcccgattttacaaaattaatttcacagtcctgtttccacagtctaagaaaaaaatgtagtatctaaaaataaataataaaataatgtgttattcacttcaatgactgcaacaaccaaggcagctgtagcttttgggtgaaattctgaagaattgtgttatcactgtaaatttttcataaggataggtcaaagattgcttttttaaactttcttctcccaactcagctaaacacatagcgggacctctggttgg

SEQ ID NO: 160715 - DNA, 601 bp, Human
taaaggatctgattaaagttttttgggaaaggagagggagattagaaaagctgctttttgggactgcccaaatctctggctagtaaaatgctaaataattattccttttcatacctctgtccttatttctgtctacatcacccccaaattattattatttgtttaagacacggtctcactcccatcaccctggctggaatgcagcagtgcgatctcagctcactgcacctcaacttcccaagctcaggtgattctcccacctcggcctaaccagtcgctgggacgagaggtgtgcaccacyatgcctggctaaatttttaaatttttagtagagagggggttttgccatgtttctcaggctggtcttgaactcctgggctcaagtgatccaccacctttggcctcctgccttggcctccaaaagtgctgcgattacaggtgtgaggtaccgcatccagcccccaaattataagtcagaaaaaaattgctctttttttcactctatagaaagaacattattattgtatgaaaaaatgtactaaataagctcaagaaaataccatcatcatgatgaattacattatgaaaaagcattctggtc

SEQ ID NO: 160716 - DNA, 601 bp, Human
gtttcgccacgttggccaggcttgtctcgaactcctgacctcgcgatacgcccgccttggcctcccaaagtgctgggattatagacgtgaggcaccgtgcccggcctatatcttcattttttttggttagaattccatattgttacctgattgacacaacatatctactcttatgttttttgcttttagactgactttcttaaacttgattactagatgaaacagtgtaagaatgactgtctttggcttcctcctccaacccaaaaaaaaaaccacaatttttactctttttctatgttamatattttttagtacagaacgtttagttcataaacaatacatgacttaaaacccatatttttcaaagttcacatcactccaaattaatcctgttttttaataaaaacataggatttaaaaacttactttctaattagtacttttttttacatttttctgaaaatattttttatccaaaaactaaatttaactataaatatgtacaataagaaactacttcttatgccctaaaaaatcattaacaactttggtatttgtggtagaggagaaaatgtacattttagcaacagtaaaactactc

SEQ ID NO: 160717 - DNA, 601 bp, Human
taatttttgttatttttagtcgagacggggtttcgccacgttggccaggcttgtctcgaactcctgacctcgcgatacgcccgccttggcctcccaaagtgctgggattatagacgtgaggcaccgtgcccggcctatatcttcattttttttggttagaattccatattgttacctgattgacacaacatatctactcttatgttttttgcttttagactgactttcttaaacttgattactagatgaaacagtgtaagaatgactgtctttggcttcctcctccaacccaaaaaaaaamccacaatttttactctttttctatgttaaatattttttagtacagaacgtttagttcataaacaatacatgacttaaaacccatatttttcaaagttcacatcactccaaattaatcctgttttttaataaaaacataggatttaaaaacttactttctaattagtacttttttttacatttttctgaaaatattttttatccaaaaactaaatttaactataaatatgtacaataagaaactacttcttatgccctaaaaaatcattaacaactttggtatttgtggtagaggagaaaa

SEQ ID NO: 160718 - DNA, 601 bp, Human
ataaatgttagttatgtcagcaagaaaaacgcctaaagtattacctataaaaaatcttgaaaccccctctttcataagcttgattatctgctctagtaaaataagtctcggcttttctaggacttaattatccagttttaagaatatttaaaacaaactaataaattctaacttcattgttttaaacgaaataacaccactatgaacaacaatacaatggcttcttgactttctaggaatgttattagggaaaaatagtataaaagctattttatgtttgccaattccatgtatatcaggyccaaagcgataaatctaatcatccacagatgaacactaagatattatattctgcactatacccccacgatacatgggttctgcttaaacagaaaattcagggtcattaaaagccatttaggccataaactctcacttgaactaaccataacaactttaaatgtttagtttaactgactgaaatagtacactatccaccagaatggtgaaagctctagctacctaacagattctcctttccatgaaaaattccagaggactaaatgcctcaaaagaaaaggccttcttcaatttgtttttc

SEQ ID NO: 160719 - DNA, 601 bp, Human
gtgcggtgcggtggctcacgcctgtaatctcagcactttgggaggctgaggtgggcagatcacaaggtcaggagttcaagacaagcctggccaatatggtgaaaccccgcctctactaaaaatacaaaaattagccgggcatggtggcgggcgcctgtagtaccagctactcgggaggctgaggcaggagaattgcttgaacccgggaggcggaggttgcagtgagccaagatcgtaccactgcactccagcgtgagagacagagcaagactctgtctcccaaaaaaaaaaaaaaaaaaaatgaataaacagaattggtataatatgctaaagacattctagggtcttaaaaaatctggattaaaaacaagaaaatattcaagaatattagatttttaaaaagtgttttgggtagccgggcacggtggctcactcctgtaaccccagcactttgggaggccgaggctggcagatcacgaggtcaggagatcgagaccattctggctaacacggtgaaacaccgtctctactaaaaaaatacaaaaaaaattagccgggcatggtggcgggtgcccgtagtcccagctgctcggaaggctga

SEQ ID NO: 160720 - DNA, 601 bp, Human
gggacaccaaggcaagaggattgttttaggccaggggtttgagaccagcctcggtaacttggcaagatgccatctctccaataaagaaagaaaaaaatgggctgggtgcggtgcggtggctcacgcctgtaatctcagcactttgggaggctgaggtgggcagatcacaaggtcaggagttcaagacaagcctggccaatatggtgaaaccccgcctctactaaaaatacaaaaattagccgggcatggtggcgggcgcctgtagtaccagctactcgggaggctgaggcaggagaattgyttgaacccgggaggcggaggttgcagtgagccaagatcgtaccactgcactccagcgtgagagacagagcaagactctgtctcccaaaaaaaaaaaaaaaaaaaatgaataaacagaattggtataatatgctaaagacattctagggtcttaaaaaatctggattaaaaacaagaaaatattcaagaatattagatttttaaaaagtgttttgggtagccgggcacggtggctcactcctgtaaccccagcactttgggaggccgaggctggcagatcacgaggtcaggagatcgagac

SEQ ID NO: 160721 - DNA, 601 bp, Human
tcatgcctagaatcccaagactttgggacaccaaggcaagaggattgttttaggccaggggtttgagaccagcctcggtaacttggcaagatgccatctctccaataaagaaagaaaaaaatgggctgggtgcggtgcggtggctcacgcctgtaatctcagcactttgggaggctgaggtgggcagatcacaaggtcaggagttcaagacaagcctggccaatatggtgaaaccccgcctctactaaaaatacaaaaattagccgggcatggtggcgggcgcctgtagtaccagctactygggaggctgaggcaggagaattgcttgaacccgggaggcggaggttgcagtgagccaagatcgtaccactgcactccagcgtgagagacagagcaagactctgtctcccaaaaaaaaaaaaaaaaaaaatgaataaacagaattggtataatatgctaaagacattctagggtcttaaaaaatctggattaaaaacaagaaaatattcaagaatattagatttttaaaaagtgttttgggtagccgggcacggtggctcactcctgtaaccccagcactttgggaggccgaggctggcag

SEQ ID NO: 160722 - DNA, 601 bp, Human
agcagcagaaataagcactttttttttttgagatgcagtctccctctgtcgcccaggctggagtgcagtggtgcgatctcagctcactgcaacctccgtctcatggattcaagggattctcctgcctcagcctcctgagtagctgggattataggcgcacgccaccacacccagctaatttttgtatttttagtagagatggagtttcaccacgttggtcaggctggtcttgaactcctgacctcgtgatccacctgcttcagcctcccaaagtgctgggattacaggcatcagccacccygcccaggcagatataagcacttttaaatgaccaaacttttggtcccattctcggtatcgggaaaaagaaaagaaaaaaaatgaccaaacttgtttctaaccaataaagaatatatcttttttttttttttttttgagacggagtcttgctctgttgcccaggctggagtgcaatggcacaatctcggctcactgcaagctccgcctcccgggttcacaccattctcctgcctcagcctcccaagtagctgggactacaggcgcccaccatcacgcctggctaatttttttgtatttttag

SEQ ID NO: 160723 - DNA, 601 bp, Human
ttttctttttccttcctaagaattttttttttctgattaaactccagattaaaccatctctataacccatcatacaaagttctttgttaatggccaaaataatctcttaggagcagtgtgagggcccacagatattatataaataatgctggactcgagagtctctaaaatcttatttctatcccttatgttacacgctctgacaactttcaatatatgaccacttagcattaatcatagcattatttgatcagggtaatacaactaaggaatctttatgataactatattattcatattrtaatagtttttactttaaaacattaacttcttgaagaatagcttttaatattaaaaattaacaatctttaaatttaacttaacccaaagaggagatgaggaaggaatgagaatttttaagctgtcaacaatgattccataaacctaaaagaaattttaggaagaaaagctcaagaactaaactgttcctttgtcattgaattattaaggcaaaagaagtgaagaaaattgagttaagtaacatccacaatatggcattttcccgtgagtactctacttcacaatctgattctttaaatac

SEQ ID NO: 160724 - DNA, 601 bp, Human
tctggctactttttatttgaggcggattctcactctgttgcccagactggagtgcaatggtgcgatctcggctgactgcaaccttcacctcccagttccagcaattctcctacctcagcctcctgggtagctgggactacaggtgcgcgccaccatgcctggctaattttttaatttttttttaagtagagacagggtctcagcatgctggctaagctggtctcaaactcctgacctcaaataatctacccgcctcagcctcccaaagtaatgggattacaggcatgagccgttatgcctsgtggctagttctttttaatagaatcccatagtgattcatgcatgagttgaactaaatgcctgaatcacagaacatataacaataatgaaatttaaagaaaagtagtggaaagaaaaaaaaaactgacaggtaagagaagggtacctgaagaaattttgtgacaataactgtctatacccagaattagaaatgccagcttcaaatatagttataataaatttggcttcagcactacataggcttttctttttccttcctaagaattttttttttctgattaaactccagattaaaccatct

SEQ ID NO: 160725 - DNA, 601 bp, Human
gagacagggtcgttctgttgcccaggctggagtgcagaggcacaatcttggctcactgcaacctccacctttcaggttccagcaaatcttgtgcctcagtctcctgagtaactgggtttacaggtgcccaccacaatgcccagctaatttttgtatttttagtagagatgaggtttcaccatgttggtcaggctgggcttgaacttctggcctcaggtgatccgcctgcctcagcctcccaaagtgctgggattacaggcataagccattgcgcctggcctctcttctggctactttttayttgaggcggattctcactctgttgcccagactggagtgcaatggtgcgatctcggctgactgcaaccttcacctcccagttccagcaattctcctacctcagcctcctgggtagctgggactacaggtgcgcgccaccatgcctggctaattttttaatttttttttaagtagagacagggtctcagcatgctggctaagctggtctcaaactcctgacctcaaataatctacccgcctcagcctcccaaagtaatgggattacaggcatgagccgttatgcctcgtggctagttctttt

SEQ ID NO: 160726 - DNA, 601 bp, Human
ggttcacgccattctcctgcctcagcctcccgattagctgggactacaggcgcccgtcaccacgcccgactaatttttttgtatttttagtagagacagggtttcaccgtgttagccaggatggtctcaatctcctgaccttgtgatccacccgcctcggcctcccaaagagctgggattacaggcatgagccactgcgcctggcctattcttcttttttatatatctgaaattccctgtaataaaaagtaaaataaaaaactgtgtgctaggaacattatcttcaaaattctatacactyagctcttcaaaaagtcaaacaagagactttcttcagtatattctagactctctcaaatgtatctcctcactcctccattgttatgaatggatggatgactatgaatctgaggaaaaaataaaagtggtactattttcttcaagccctttttgtttcgaatccttctctttttttttttttcctgagacagggtcgttctgttgcccaggctggagtgcagaggcacaatcttggctcactgcaacctccacctttcaggttccagcaaatcttgtgcctcagtctcctgagtaactgggt

SEQ ID NO: 160727 - DNA, 601 bp, Human
gttctattgaaatatttatttataagactatgagattttgtttcaagataatcaaagaataaattagatcacagatggccgtgagctgatagttattaaagctggctgaagaggtttcattatattctttttttttttttttgagacggagtctcgctctgtcgcccaggctggagtgcagtggcgggatctcggctcactgcaagctccgcctcccgggttcacgccattctcctgcctcagcctcccgattagctgggactacaggcgcccgtcaccacgcccgactaatttttttgtrtttttagtagagacagggtttcaccgtgttagccaggatggtctcaatctcctgaccttgtgatccacccgcctcggcctcccaaagagctgggattacaggcatgagccactgcgcctggcctattcttcttttttatatatctgaaattccctgtaataaaaagtaaaataaaaaactgtgtgctaggaacattatcttcaaaattctatacactcagctcttcaaaaagtcaaacaagagactttcttcagtatattctagactctctcaaatgtatctcctcactcctccattgtt

SEQ ID NO: 160728 - DNA, 601 bp, Human
tagtaaataaaactgttctattgaaatatttatttataagactatgagattttgtttcaagataatcaaagaataaattagatcacagatggccgtgagctgatagttattaaagctggctgaagaggtttcattatattctttttttttttttttgagacggagtctcgctctgtcgcccaggctggagtgcagtggcgggatctcggctcactgcaagctccgcctcccgggttcacgccattctcctgcctcagcctcccgattagctgggactacaggcgcccgtcaccacgcccgrctaatttttttgtatttttagtagagacagggtttcaccgtgttagccaggatggtctcaatctcctgaccttgtgatccacccgcctcggcctcccaaagagctgggattacaggcatgagccactgcgcctggcctattcttcttttttatatatctgaaattccctgtaataaaaagtaaaataaaaaactgtgtgctaggaacattatcttcaaaattctatacactcagctcttcaaaaagtcaaacaagagactttcttcagtatattctagactctctcaaatgtatctcctc

SEQ ID NO: 160729 - DNA, 601 bp, Human
tatagtaaataaaactgttctattgaaatatttatttataagactatgagattttgtttcaagataatcaaagaataaattagatcacagatggccgtgagctgatagttattaaagctggctgaagaggtttcattatattctttttttttttttttgagacggagtctcgctctgtcgcccaggctggagtgcagtggcgggatctcggctcactgcaagctccgcctcccgggttcacgccattctcctgcctcagcctcccgattagctgggactacaggcgcccgtcaccacgccygactaatttttttgtatttttagtagagacagggtttcaccgtgttagccaggatggtctcaatctcctgaccttgtgatccacccgcctcggcctcccaaagagctgggattacaggcatgagccactgcgcctggcctattcttcttttttatatatctgaaattccctgtaataaaaagtaaaataaaaaactgtgtgctaggaacattatcttcaaaattctatacactcagctcttcaaaaagtcaaacaagagactttcttcagtatattctagactctctcaaatgtatctcc

SEQ ID NO: 160730 - DNA, 601 bp, Human
ctattacaaaatatagtaaataaaactgttctattgaaatatttatttataagactatgagattttgtttcaagataatcaaagaataaattagatcacagatggccgtgagctgatagttattaaagctggctgaagaggtttcattatattctttttttttttttttgagacggagtctcgctctgtcgcccaggctggagtgcagtggcgggatctcggctcactgcaagctccgcctcccgggttcacgccattctcctgcctcagcctcccgattagctgggactacaggcgcccrtcaccacgcccgactaatttttttgtatttttagtagagacagggtttcaccgtgttagccaggatggtctcaatctcctgaccttgtgatccacccgcctcggcctcccaaagagctgggattacaggcatgagccactgcgcctggcctattcttcttttttatatatctgaaattccctgtaataaaaagtaaaataaaaaactgtgtgctaggaacattatcttcaaaattctatacactcagctcttcaaaaagtcaaacaagagactttcttcagtatattctagactctctca

SEQ ID NO: 160731 - DNA, 601 bp, Human
taataaaaacaagctgggtccatggctaatgccttgtaatcccaacactttgggaggccgaggtgggaggactgcttaaagctaggccaggagtttgagtagagcctgctcaatatagcaagtccttgtctctattttaatataaaaaactttaaatatattttttattttttaagcaaaattcaacaagagagatagacataaagacaaactattccttcatttatttatttatttatttattttattttatttattttttttttttttgagacagagtctcgctctgttgcccaggccrgagtgcagtggcgtgatctcggctcacttcaagctccacctcccgggttcacgccattctcctgcctcagcctcccaagtagctgagactacaggcgcccatcaccacgcctggctaatttttttgtgtttttagtacagacagggtttcaccatgttagccaggatggtctcgatctcctgacctcgtgatccacctgcctcaacctcccaaagtgctgggatcacaggcgtgagccactgtgcccagcccaaattattcctttaaatgggtatataaaatgcaaaattttaccaagga

SEQ ID NO: 160732 - DNA, 601 bp, Human
gtaatcccaatacttcaggaggctgaggtgggtgaaatcacttggacccaggagttcgagagcagcctgggcaacaaggtgaaaccccatctctacaaaatacaaaaaaattagtcaggcatggtggggtatgcctgtagtccaagctactcgaaggctgaggtgagaggatcgcttgagcccaggaggcagaggttgcagtgagccatgatcatgccactgtactccagcctgggcaacacagcaagaccctgtctcaaaaaataaaataaaataaaaattttgtaaaaaaaaaaaaaaagaatttaatcttcaagattatctccgtggcccagcacagtgaatcaagcacgtaatctcaacaatttgggaggccaaggtgggaagactgtttgaggctatgagtttgagaccagcctgggcaatgtagcaagaccctgtatctattaagaatataataataatgtctccttatttttatatacaaaactagtagtagcgttgtctgggaacttcagaacactcactagctttgggaagcactcaatgaataaaaacggaaatctgaacactatgtaacaacagattctcaatgttccca

SEQ ID NO: 160733 - DNA, 601 bp, Human
tggcgggcgcctgtagtcccagctactgcagtcccaactactcggatggctgaggcaggagaatggcgtaaagggagatggagcttgcagtgagctgagatcgtgccactgcactccagcctgggggacagagcgagactccgtctcaaaaacaaaacaaaacaaacacatacaaaaaaccccatgtggtttagtattttcaacaagattagaaaatataattttaaaacactattgaagatgtcagaaggattacggttcagtcaagtgagctgaagatatgtgaagtgtattttgcctyttgttttaatcttatttttttacttttattgagacagagtctcacttggttgcctgggctggagtgcggtggtgcgatctcggttcactgcaacctctgtctcccgggccgaagtgactctcccgcctcagtctccccagtagctgggactacgtgtgtgcgccaccacacccgactaatttttctattttttagtagtgacagggtttcaccatgttggccaggctggtctggaattcccagtgatccgcccgcctcagcctcccaaaatgctaggattacaggcatgagccactgcgc

SEQ ID NO: 160734 - DNA, 601 bp, Human
gtttcactttccatatcacttcttcctgatctattccacacacctgcagtttcctttgtcatagtatattaattacacttctgtgatttctgccttgtttgtccggtcttccctaaaagacactgtatccatcctacttaataaagcatctccagatgtaagcgactcacatggaatgaatgtgcacttaatattacggcaaaaatgttattataaggctaaatatcaaatacaatgcaagctaagtaagacagtaatatagggcttatgcacaacaaacatttctcccttttttcccccscagagaaggtctcactgctgtggctcactgcaacctcaacttcccagactcaggtgatccatcttaaaagtagctgtgactataggcacacaccaccacacccagccaattcttttatttctaatagtgttgggggtttcaccatattacccaggctggtcttgaactcctgggcttaagagatccacccgacataggctcccaaagtactaggattataggcgtgagccactgagcccacatcaaacattgctttgtaagagatataaccacacatttcacatcttaatacaggttgag

SEQ ID NO: 160735 - DNA, 601 bp, Human
ctcttctcccaactaattcctactcttcaagtttcactttccatatcacttcttcctgatctattccacacacctgcagtttcctttgtcatagtatattaattacacttctgtgatttctgccttgtttgtccggtcttccctaaaagacactgtatccatcctacttaataaagcatctccagatgtaagcgactcacatggaatgaatgtgcacttaatattacggcaaaaatgttattataaggctaaatatcaaatacaatgcaagctaagtaagacagtaatatagggcttatgyacaacaaacatttctcccttttttcccccgcagagaaggtctcactgctgtggctcactgcaacctcaacttcccagactcaggtgatccatcttaaaagtagctgtgactataggcacacaccaccacacccagccaattcttttatttctaatagtgttgggggtttcaccatattacccaggctggtcttgaactcctgggcttaagagatccacccgacataggctcccaaagtactaggattataggcgtgagccactgagcccacatcaaacattgctttgtaagagatataac

SEQ ID NO: 160736 - DNA, 601 bp, Human
atagtaaatggcacttttcttcatgtgaggcagggtgcagaataggtttgaggaaaaaagtaagtaaaaccagtgaatggaagcacaaatagtaagtggctgtgcttctcttaatttttctgtagaattttttctcaaattcttattattgaaatgcctattatgatgtagcaaacactgaggagatactaaggcttagagtttaagaaatctaattaaatagctaaacagagcacaatgtaaactcccacaatctgattccagattctgagtccaatcatctcattatttgtctcattayggaagaataacaaaccaacaagtgaaaatgctaaaactctaggggaacaccatgaaattaaagagttcatcagctcttactcatgaacttttggaggatcttgtattcctatctctgacacatatgacaatgaccagctgagcccatattctttgacacttagtagattaattactatgtgccaattaatgttctaagaacttcacaaaaattagcactcacacactgtaatctcaacattttgggaggctgaggcgggaggatcactttagcccaagagtttgagaccagcctgggcaa

SEQ ID NO: 160737 - DNA, 601 bp, Human
tatataatctttagaagattaggcagccaggctgggcccattaaacacagttttggctccaagtcttcttaccaactgctgttctattttgttctgttataccttctcttgtaaaagagtaaaatcagaaggaaaggtcataatagacactcactgaattgattttttctagttttatggttttctcccactccaattacttttcatacctttggtcttagtttttccatctataaaatcatgtgctaaataattaactatcatctttatcattgtcagactacacaaagcttccagcctrggcaacaggaaccctgtctctaaaaaaaatacaaacattagccaggtgtggtggtatgcgcctgtattcccagctacttgggaggctgaggtggtaggactacttgggctttagaggtcaaggctgcagtgagctgtgattgcgccactgcactccagcctgggcaacagggcaagaccctgtctcaaaacaaacaaacaaaaacaaaagcaaagctctattctaagggaattacataaagtaacttatttaatcctctgagctctatgaagtgggtatcaacccattttgcagatgagg

SEQ ID NO: 160738 - DNA, 601 bp, Human
aggccgggtgtggtggctcatgcctgtaatcccaacactttgggaggctgaggcaggtggatcacctgagctcaggagtttgagaccagcctggccaacatggtgaaacctcatctctactaaaaatacaaaaattagctgggcatgatggcgcacgcctgtagtcccagctactcgggaggctaaggcaggagaatcgcttgaacccggtaggcagaggttgcagtgagccaagatcgtgccactgcactccagcctgggtgacaagagtgaaactctgtctcaaaaaaaaacaaaaaamaaaaaacaaaaaacaaaaaaaaaaacacccaaaaaaacatagcttaaaaattctagtaccaaaaataatatataatctttagaagattaggcagccaggctgggcccattaaacacagttttggctccaagtcttcttaccaactgctgttctattttgttctgttataccttctcttgtaaaagagtaaaatcagaaggaaaggtcataatagacactcactgaattgattttttctagttttatggttttctcccactccaattacttttcatacctttggtcttagtttttccatct

SEQ ID NO: 160739 - DNA, 601 bp, Human
cttatccctgaggcattctaatacacaaagatgcaaggaactggttaaggaatctgggagtgagcataggaaagggagaatagaaaatctaatgtcctagaagccaagtgaaaacagtacaatgtctctaatactgcaaatatgtattcatatcactgaatcttagagcttttagaggccttggcgataacctaatggattaaaaacactgacacttaagaagttcaataaattggtaaaagtcacaaatcaaaagagtaacagagaagataaaaagtaagtctattccacactgctttaygttagaaagtcttgatctatatggaatatagaatatattgaaatacagatcaagaaaccagatcccaagagatgatctactgagggacaggatttactcagatatactactggaatagaaaaaaaaacaaaacaaaacctgtaactctagtctgttcatccagttactaagtaaaccactggccatacactaaatactgtcattcctatttgattttctttcaggtacctttttttctcccctttcttaacaaatcaatcacatagcttaggccgggtgtggtggctcatgcctgtaatc

SEQ ID NO: 160740 - DNA, 601 bp, Human
tttggaaaagtgtggtagtaaagctgctgttaagatgttgggaggttttgccaatagatctgcagacagggcatggggtaccagagaaagaaatgccaaggatcatgatgtgattttggcctgagaaaatgcaaggacgtatttgccaataacttagttggggaagactatagaagcaggtttcaggttaggagactatcagttcagtttatgtttgatatgttcgttatatagtcaagtaaagatgataagcaggcagcaggataggagtctcaagttcagggaagataatttgtgagtytgcagtatgtaaaggtgaagttatgatgaaatcagatgagcttaccaaggaagtgagtgcagctagaaaggagcagaaatccaagacttatccctgaggcattctaatacacaaagatgcaaggaactggttaaggaatctgggagtgagcataggaaagggagaatagaaaatctaatgtcctagaagccaagtgaaaacagtacaatgtctctaatactgcaaatatgtattcatatcactgaatcttagagcttttagaggccttggcgataacctaatggattaaaaacactgaca

SEQ ID NO: 160741 - DNA, 601 bp, Human
taattcatttttcctatgattaagactctgtatttttctctatcaaattccagttctgaaacctaaacatccacatttaaatatggatatgcactaaatgtcaattatacctcagtaaagctctgggaataaagtaatgacttcatgaatatctagtctcacctattttatctaatgtgtctttggtatattctaatatttcaattgtacagataaaaaacaagattattcacctgccttaggaaaagggaatagttgatgtaaaaaatgttttgttcctgcacatcatattaggagaaartgttttggtataaaaattcaacttctctctctatatatacacaccataatctttcaactagctatataggaagataattacaagtaatagtactgttggcttaactctgggcaaaaagagaagtcaatgggaagttttcatctgcaaactttttctttcttttttttttttatttttgagatggggtctcactccgtcgcccaggctagagtgcaatggcatgatctctgctaactgcaacttccgcctcccaggttcaagcgattctcctgcctcagcctcccaagtagctgggattac

SEQ ID NO: 160742 - DNA, 601 bp, Human
cttgtgggaatgtaaaatggtgaaaactctatgggaaacagtatggcagtccctcaaaaaaaaacaaaaaacaaaaacacacacagacaaaaacacacacaaaaaacacagagttactatataatccagtgattccacttatgggtatacatccaaaagaactgaaagcagtaactggagtattaatatataaatgttcataacaatattattcacaatagccagaaggtagaagcaacttaaggtttccatggatggatgaatggatcaacaaaatgtttggcttttgtgtatgtgtatrtgtatgtgtgtgtgtgtatgtatgtatgtatgtatgtatgtatgtatgtatatatatatcctgacttcaggtgatccatccgcctcggcctcccaaagtgctggggttacaggcaagagccaccacgcccagcctacttacttatttatttgagatggagtctccctctgttgcccaggctggagtgcagtggcacaatcttggctcactgcaacctctgcctcccaggttcaagcgattctccctagtagctgggactacagtcgcatgctaccagacttggctaacgtttttgtattt

SEQ ID NO: 160743 - DNA, 601 bp, Human
ataacaaaaaaaaaaaacctggttaaaaaatcgacaagggatgtgaacagacgtttctccaaagaagatatataaagtgtcaataaacacataaaaagatgctcaacaccactaatcattagggaaatgcaaattggaaccacaatgacctatcacttcatatccattagaatggctaccataaaaaaaatggtaattgttagccaggttgtggagaaatggaactcttgtgcactacttgtgggaatgtaaaatggtgaaaactctatgggaaacagtatggcagtccctcaaaaaaaaacaaaaaacaaaaacacacacagacaaaaacacacacaaaaaacacagagttactatataatccagtgattccacttatgggtatacatccaaaagaactgaaagcagtaactggagtattaatatataaatgttcataacaatattattcacaatagccagaaggtagaagcaacttaaggtttccatggatggatgaatggatcaacaaaatgtttggcttttgtgtatgtgtatgtgtatgtgtgtgtgtgtatgtatgtatgtatgtatgtatgtatgtatgtatatatatatcctg

SEQ ID NO: 160744 - DNA, 601 bp, Human
gcactatttaattttccaatggactttctaagcaatctaattttaaaatccatggtgtcacctgaaacaaaatcttatgtaatttttaataaaattatttatttaaaggaaatttacctgaatagcaaagaaaaattttcactcaaaggaagtatttaatactaaggcaactattaaactcataatatttattttaatttgaaagaaaaacataaaggcatgtaaaataaaagcatctaaatcttgcaagtccttcatactatcacataggtagtctaacatatatctcaacaaggcaatraacacttttcttgaaaactgataatcctgggccgggcgcagtggctcatgcctgtaatcccaacactttgggaggccgaggtgggtgaatcacaaggtcaggagatcgagaccatcctggcaaacatggtgaaactccgtctctactaaaatacaaaaaaattagccgggcgtggtggcaggcgcctgtagtcccagctactctggaggctgaggcaggagaatggcgtgaatccgggaggcagagcttgaaatgagtcaagatcactgcactccagcctgggcgacagagccagactcc

SEQ ID NO: 160745 - DNA, 601 bp, Human
gggttttaccgtgttggccaggctggtctcaaactcctgacctcaggtgaaccgtccacttctgcctcccaaagtgctgggattacaggtgtaagacaccgcaatggcccgtctttctagtctcacaataacaaggggaaattctttctctaatttcatttgatagtttgagtaatttcaaagagaatgtttaaaggcacatacatatcaaaagctacctagatgttatcagcataaagctgacttaaaccaccaaaaataacataaggaacacaaagacaaaatataaccaatgaaatayacaacacttaagtgcactatttaattttccaatggactttctaagcaatctaattttaaaatccatggtgtcacctgaaacaaaatcttatgtaatttttaataaaattatttatttaaaggaaatttacctgaatagcaaagaaaaattttcactcaaaggaagtatttaatactaaggcaactattaaactcataatatttattttaatttgaaagaaaaacataaaggcatgtaaaataaaagcatctaaatcttgcaagtccttcatactatcacataggtagtctaacatatatc

SEQ ID NO: 160746 - DNA, 601 bp, Human
gggaatacaaattagtacaaccattatggaaaaacagtatggagtttcctcaaaaaattaaaaataggaccaggcacggtggttcatgcctgtaatctctgtactttgagaggctgaggcaggaagatcgcttgaacccaggggtttgagaccagcctgggcaagatggtgaaacctcatctcttttaaatgcacaatattcttttaagacatgagtcaaaacaaaaagccaaactcagtcctcaaatgttcattcttgtctttctactcaccattttttacattttttttttttttttttggaaacgaagtctcactctgtcccccaggctggagtgcagtggtgcaatcttggctcactgcaacctttgcctcccaggttcaagcaattcttctgcctcagagcctcctgggtggctgggattacaggcgcctgctaccatgcctggctgatttttttttttttttttttggtagagacggggttttaccgtgttggccaggctggtctcaaactcctgacctcaggtgaaccgtccacttctgcctcccaaagtgctgggattacaggtgtaagacaccgcaatggcccgtctttcta

SEQ ID NO: 160747 - DNA, 601 bp, Human
taaaatttgacaaatactgttaattagggtgggcatggtggctcatgtctgtaatcccaatactttggaaggctgaggtgggcagatcacctgaacttgaggtcaggagctcgagacctacctgggcaacatggcgaaaccccatctctactaaatacacaaaaattttctggccgtgatagtgcacacctctaatcccagctatttgggaggctgaggttgcagtgagctgagatcatgccactgcactctagcctgggtgacagagtgatactccatcaaaaatagataaataaaaaayaaaccaaaatgagatatcacctagcactcgttagaacggctactataaaaacaatgaacaagtgttggtgatgatgtaaaggaaaggaaaccctcgcacactgctggtgggaatacaaattagtacaaccattatggaaaaacagtatggagtttcctcaaaaaattaaaaataggaccaggcacggtggttcatgcctgtaatctctgtactttgagaggctgaggcaggaagatcgcttgaacccaggggtttgagaccagcctgggcaagatggtgaaacctcatctcttttaaatg

SEQ ID NO: 160748 - DNA, 601 bp, Human
taaaaaacaaaaaacaaaacgaaaaaaaaaaaaaacaaaaagaaactccagggttgttttaacaggtcctccaggtgattctgatgcacattaaaatttgacaaatactgttaattagggtgggcatggtggctcatgtctgtaatcccaatactttggaaggctgaggtgggcagatcacctgaacttgaggtcaggagctcgagacctacctgggcaacatggcgaaaccccatctctactaaatacacaaaaattttctggccgtgatagtgcacacctctaatcccagctatttggraggctgaggttgcagtgagctgagatcatgccactgcactctagcctgggtgacagagtgatactccatcaaaaatagataaataaaaaacaaaccaaaatgagatatcacctagcactcgttagaacggctactataaaaacaatgaacaagtgttggtgatgatgtaaaggaaaggaaaccctcgcacactgctggtgggaatacaaattagtacaaccattatggaaaaacagtatggagtttcctcaaaaaattaaaaataggaccaggcacggtggttcatgcctgtaatctctg

SEQ ID NO: 160749 - DNA, 601 bp, Human
atgtcttaaagcaatgatctcagtgttgttcatccaaccagcagcatcagcatcccttgggaagttttctctatcccagagctactgaatcagaaactccagggtttgagtcctagccgacgccgtcgccgcgcgcgcgaggcctggaacacaccgcacgagccgctcccgcccctacccctttacgcccacgtggagccggccccgccagcgcgagcgcgccccatacaccctcccgccctgcgcctacatgctgccctggctctgcccgtgtgtggggggcgcttccggccccgcgggrgtggggaaaataggggattaaaaaaaaacagcgcgcggaaccgggccagggttgcccacccccgccacaatggcctctggggtgaagtcctgcgcttccagctgcccggccactaggccgctacgctacggaacatgaacaagctccgggcagaggagtggttctgcgacgtgaccattgtggccgacagcctcaagtttcgaggccacaaggtcatcttagccgcctgctcaccgttcctgcgggaccagttcctgcttaaccccagctcggagctgcaggtctccctgatgcacagtg

SEQ ID NO: 160750 - DNA, 601 bp, Human
agggagacagccagactgtctcctacacctccacccctagccaaaaagttaagttattgccaacaaccaacaatggatgtcttaaagcaatgatctcagtgttgttcatccaaccagcagcatcagcatcccttgggaagttttctctatcccagagctactgaatcagaaactccagggtttgagtcctagccgacgccgtcgccgcgcgcgcgaggcctggaacacaccgcacgagccgctcccgcccctacccctttacgcccacgtggagccggccccgccagcgcgagcgcgcccyatacaccctcccgccctgcgcctacatgctgccctggctctgcccgtgtgtggggggcgcttccggccccgcgggggtggggaaaataggggattaaaaaaaaacagcgcgcggaaccgggccagggttgcccacccccgccacaatggcctctggggtgaagtcctgcgcttccagctgcccggccactaggccgctacgctacggaacatgaacaagctccgggcagaggagtggttctgcgacgtgaccattgtggccgacagcctcaagtttcgaggccacaaggtcatcttagcc

SEQ ID NO: 160751 - DNA, 601 bp, Human
cgaaagtgatgggattataggtgtgagccacgacaactagccaattactctaaaccagcctttttcaactgggttcctgatttgaaccacaaaatagaaaaaattagtgactgttttctcaattttcccaagtttggtacataaatagtacttccctagatgcctacgataaaagttaatttaggctgggtgcagtggctgacgcctgtaatcccagcatttaggaaggccgaggcaggcagatcacttgaggccaggagtttgagaccagcctgggcaacatggcgaaacactgtctgcyaaaaatacaaaaattagccagatgtggtggcacatgcttgtaatcccagttacttgaggggctgaggcaggaatcgctcgaacctgggaggcgaaggttatagtgagtccagatggcgccaccgcactccagcctgagggagacagccagactgtctcctacacctccacccctagccaaaaagttaagttattgccaacaaccaacaatggatgtcttaaagcaatgatctcagtgttgttcatccaaccagcagcatcagcatcccttgggaagttttctctatcccagagctactga

SEQ ID NO: 160752 - DNA, 601 bp, Human
ggactacaggtgtgtgccaccacgccaggctagttttgtgtttttagtacagacaggatttcaccacgttggtcaggctggtctggaactcctgacctcaagtgatccaccacccacctcagcctcccagagtgctgggattacatgcatgagccaacacacctggccagcaaactgtttcttaacaggtcagatactaataacttaggtccagtctctgttgtaactaataaactcagccactgtagctagaaagcgaaatgaaaaatatttattctgttcaacaaattacaaggtcatyggaaactgtgccatgtcacataagtcccatgataggaggtgattaaaattattagcagggagggatcatcactgaaaggaaggataaaaagatggacacatacacgagcattaatcatagaatctagatggtaggaatatgggtgttcactatgtaattcttttgactttatgtgtttgaaaatactcatgttaggaaaacagcatctatatccaattaaactaggatgttaaaagtctattttcactattacacctgacaaaataatcctaccacaagaaagaaaaccatttcaaaatt

SEQ ID NO: 160753 - DNA, 601 bp, Human
ccaaataaaacaaatctacatttaaaatgtgattcactttgcattatagacaacctatgtcactcgagaaaagaccacttaacctgaagcttcgactcacaatttgtgttgacaataataaagacaagtaacattaatctactttaatctccaaattcaacaaatataactagcaagactaaaattaggttaagtgaggtattaagagatgttccaaacactggaaagcagcaaacattatacaactgaacacagattactagcttataaaaatatgtggacattagaataattttttacratgtaaccagcttttgtattacccacagcccaggctagaatacaactagattcttctgttttcttacagctgcattagtgtacagtgatttatggaaaccccacatgcaaagtcctaacttattacataacttgagatgattataaactcacaatagagtaattttattaaaagacttcccatatgcattggaaagaggtaaatttatcaaatactttggaaccaccattacttagtaaagcaaagtataaattactaactattcaattcactttaatatttcttttaaaagtaatttat

SEQ ID NO: 160754 - DNA, 601 bp, Human
caggggcggggcaggccctcccagccaggaccagccccagtctccccgcccctgagccgtgaaggaaatagggacctggccctgggccttgtgtagcgggagggggagctaggaagcagctgagggcagaatccaggagggcctggctgcgggggaatgaagcctccgccttcgcaggcaaaagcctttaaatacgggctcaggcccgggactcagagtgtaacgcgtggcagcctgagggaggggcgtgcgccgagagggagctcagatcgagcggggcgcgggtggagaagctgcggcrgcgcggcccgtaggaaggtgctgtccgaacgatcgggataggagcggtccctgcgcttgctgctgggaagtgggtaagcgccgctcccaggctggccccgccgcccgggcgggatgctcccaggtctgggcgggatgtggagggagcggggctggggtgtgcgcgctgctcccggtcgctcgctgcgctgggtcccgggcttcccgtctcacgaccttcgtctttttggggcttagggcgggaaccgcattttggaactgctgtcctggggatgtggtcgtctgggcttcttattcaaga

SEQ ID NO: 160755 - DNA, 601 bp, Human; identical to SEQ ID NO: 27231

SEQ ID NO: 160756 - DNA, 601 bp, Human; identical to SEQ ID NO: 27232

SEQ ID NO: 160757 - DNA, 601 bp, Human; identical to SEQ ID NO: 27233

SEQ ID NO: 160758 - DNA, 601 bp, Human; identical to SEQ ID NO: 27234

SEQ ID NO: 160759 - DNA, 601 bp, Human; identical to SEQ ID NO: 27235

SEQ ID NO: 160760 - DNA, 601 bp, Human; identical to SEQ ID NO: 27236

SEQ ID NO: 160761 - DNA, 601 bp, Human; identical to SEQ ID NO: 27237

SEQ ID NO: 160762 - DNA, 601 bp, Human; identical to SEQ ID NO: 27238

SEQ ID NO: 160763 - DNA, 601 bp, Human; identical to SEQ ID NO: 27239

SEQ ID NO: 160764 - DNA, 601 bp, Human; identical to SEQ ID NO: 27240

SEQ ID NO: 160765 - DNA, 601 bp, Human; identical to SEQ ID NO: 27241

SEQ ID NO: 160766 - DNA, 601 bp, Human; identical to SEQ ID NO: 27242

SEQ ID NO: 160767 - DNA, 601 bp, Human; identical to SEQ ID NO: 27243

SEQ ID NO: 160768 - DNA, 601 bp, Human; identical to SEQ ID NO: 27244

SEQ ID NO: 160769 - DNA, 601 bp, Human; identical to SEQ ID NO: 27245

SEQ ID NO: 160770 - DNA, 601 bp, Human; identical to SEQ ID NO: 27246

SEQ ID NO: 160771 - DNA, 601 bp, Human; identical to SEQ ID NO: 27247

SEQ ID NO: 160772 - DNA, 601 bp, Human; identical to SEQ ID NO: 27248

SEQ ID NO: 160773 - DNA, 601 bp, Human; identical to SEQ ID NO: 27249

SEQ ID NO: 160774 - DNA, 601 bp, Human; identical to SEQ ID NO: 27250

SEQ ID NO: 160775 - DNA, 601 bp, Human; identical to SEQ ID NO: 27251

SEQ ID NO: 160776 - DNA, 601 bp, Human; identical to SEQ ID NO: 27252

SEQ ID NO: 160777 - DNA, 601 bp, Human; identical to SEQ ID NO: 27253

SEQ ID NO: 160778 - DNA, 601 bp, Human; identical to SEQ ID NO: 27254

SEQ ID NO: 160779 - DNA, 601 bp, Human; identical to SEQ ID NO: 27255

SEQ ID NO: 160780 - DNA, 601 bp, Human; identical to SEQ ID NO: 27256

SEQ ID NO: 160781 - DNA, 601 bp, Human; identical to SEQ ID NO: 27257

SEQ ID NO: 160782 - DNA, 601 bp, Human; identical to SEQ ID NO: 27258

SEQ ID NO: 160783 - DNA, 601 bp, Human; identical to SEQ ID NO: 27259

SEQ ID NO: 160784 - DNA, 601 bp, Human; identical to SEQ ID NO: 27260

SEQ ID NO: 160785 - DNA, 601 bp, Human; identical to SEQ ID NO: 27261

SEQ ID NO: 160786 - DNA, 601 bp, Human; identical to SEQ ID NO: 27262

SEQ ID NO: 160787 - DNA, 601 bp, Human; identical to SEQ ID NO: 27263

SEQ ID NO: 160788 - DNA, 601 bp, Human; identical to SEQ ID NO: 27264

SEQ ID NO: 160789 - DNA, 601 bp, Human; identical to SEQ ID NO: 27265

SEQ ID NO: 160790 - DNA, 601 bp, Human; identical to SEQ ID NO: 27266

SEQ ID NO: 160791 - DNA, 601 bp, Human; identical to SEQ ID NO: 27267

SEQ ID NO: 160792 - DNA, 601 bp, Human; identical to SEQ ID NO: 27268

SEQ ID NO: 160793 - DNA, 601 bp, Human; identical to SEQ ID NO: 27269

SEQ ID NO: 160794 - DNA, 601 bp, Human; identical to SEQ ID NO: 27270

SEQ ID NO: 160795 - DNA, 601 bp, Human; identical to SEQ ID NO: 27271

SEQ ID NO: 160796 - DNA, 601 bp, Human; identical to SEQ ID NO: 27272

SEQ ID NO: 160797 - DNA, 601 bp, Human
gtttttttgagacaggatcttgttctgttgcccaggctggagtgcagtggtgcaatctccactcactgcagcctcaacctcccaggcttaagcaatcctcccacctcagcatcccgagtagctgggactagaggtgtgtgccaccaggctcggctagtttttgtattttttgtaggaatagggtttcaccaggttgcccagactggtctcaaactcctgggctgaagtgatcctcccacctcagactcccaaagcactgggagtacaggcgtaagcccctgcacccggccgtatttctttyttctttagaggagaggtctggctatatcacgcaggctgaccctgaactcctttcaaggcatcctcccacctcagcctcctgagtagctggaactataggcgtgcataaccattcccagctctagcaactcctatttcttttcttttccttgagctaaggaagatactgtctgtctggtcaacccttgtcccaccaagggggccaaggctgccaatggcagaatactgccccagcagcaggatttcttgtctaggcaccttcgcccacacaaccaaacagcaacacaccaagggaactgct

SEQ ID NO: 160798 - DNA, 601 bp, Human
aggtgccaccacacctggctaatttttttgtatttttagtaaagacgcggtttcaccgtgttagccaggatggtctcgatctcctgagctcatgatccgcctgccttggcctcccaaagtgctgggattacaggtgtgagccaccgcgcccggtctgttttttgtttttttgagacaggatcttgttctgttgcccaggctggagtgcagtggtgcaatctccactcactgcagcctcaacctcccaggcttaagcaatcctcccacctcagcatcccgagtagctgggactagaggtgtrtgccaccaggctcggctagtttttgtattttttgtaggaatagggtttcaccaggttgcccagactggtctcaaactcctgggctgaagtgatcctcccacctcagactcccaaagcactgggagtacaggcgtaagcccctgcacccggccgtatttcttttttctttagaggagaggtctggctatatcacgcaggctgaccctgaactcctttcaaggcatcctcccacctcagcctcctgagtagctggaactataggcgtgcataaccattcccagctctagcaactcctatttc

SEQ ID NO: 160799 - DNA, 601 bp, Human
ttgagaccagcccagggaatgtatcatgaccccatctctatttaaagaaatatatatgtatgtttttaaaagtgggacaaggcactccagaggccacgtctgcaactcactcacacaagactgggcacttcaaacccacagggcttacaaagagaggtgtcagcagcaactcaagctgctactaatatctttcaggagtgtgttgcgtttttgaaacagcaggcacaaacagggcatatgaaagcatttttggaaaccctgagttgacagtaagagctatggcttttcagtgaagtctagwtccaactgccaatgccaacccatggcagagaagccagatgccgctcctcttcagatgcaagagagcccagataaacccttcatgctaccgtttgagggaagattgctacactcccattcttacacatacactcaagtcttgtttctgcaattttcgcgtcttagttaagcaacacagatgctttctttcttttgcccagtgggggacaggcctgccagaaccccaatctgtgggagccagacgcatcccaaggcgacattcctgctcccggcacatgagtgtgtgttcataagcgtgttt

SEQ ID NO: 160800 - DNA, 601 bp, Human
cccacaagcccagtgagaaaccccaagtggttagacaagcaggtgcctgcctggctgccaagcgggcgggttggttagttcagagcagagagagaggctcgtggctaccctcggcactgacctgggttggcggaggctggggggccccgagtctcttccaggatcaggctgaggagggcgggggtggttcctccgggctgcaacaaaacatgtgcagcatccatgaggccaaggtcagaggccacaaggcttgctcagctggctggagtgtatgtttgggtgatactctggtctcaaagayctctggcttgagcttctggggcatcctgcttaaaagtgggatgagtgggccaggaacggtggctcacgcctgtaatcccagcactttgggaggctgaggtgggtggatcacctgaggtcaggagttcaagaccagcctggccaacatggcgaaaccccgtctctactaaaaatacaaaaattagccaggtgtggtggcaggcgcctgtaatcccagctactcgagaggctgaggcacgagaatcacttggaacccagagagggaggctggagtgagctaagatcgcaccagtgcactcta

SEQ ID NO: 160801 - DNA, 601 bp, Human
ccaggagaaacccgggctggcctgctggagaggccatgaggaaaatctgacccctgctgccaacagtcctggccaagggaccccctgactatgcaggtgcagctgagctcccatgagcaccacatgggtgagccccagggacagcagcagaaccacccagctgagcccagcccaaagtgcagaatcatgagtaggttaattactggggctgtaaaccactgttttgggatgctgtgttatgcagcaatagccgactgctccaaagcacatccgtcactgtgccctgcaccctcttggtcayctgagagccacctttacagaaagtaaatgcagagaccagagagggtagtgaatttgctcggtcacacagcaggtaggcagtagatgggtggggaggtcccagagataggtgggtaattgcccatgccgggctctgcctgagagactgtgcacgggtaaagcaggctgctggcacgtggtaggatagaggaaatgtgggctcccttctctgtcttggggggtggaaatctctgggactagcatggggcctatggcctggaaaagagagaggaaggtggtggagagagagtgggagagatgg

SEQ ID NO: 160802 - DNA, 601 bp, Human
cccacatccagagctaagcctgctatgaacaggtactcaggaagtatgcatcaactgccagaggtactcagtaaatgcttgctgcctgtggtgtccagtaagcgctcactgattgactacagtgcccactaagtgctctctgactgcacacatgaattcggctgcctctgggctctggggctacagcttgaaaggcctacagaggctctgtctccacctgcctcccctcgacctctgagagggcttccatggcacatggcaccgaggacaatcacagtgcctggccaataggcaggggctyggtaagtccccagggcccctttgacctgcctgcgtctgcccatcacagatatagaatggtgacacatcagatctttcctggcaccacactctctaagcgtggtcagccacacctcccacagctcacgctgcacttgtgcggtcctctcccatctggtcctgggcctggccacgtgactggcctcaacggatgggccacccacaaatgtgaaaccagcactctgcatgggagccgctctcctggctcccagccaccaggagaaacccgggctggcctgctggagaggccatgaggaaaatc

SEQ ID NO: 160803 - DNA, 601 bp, Human
ccaccccacatccagagctaagcctgctatgaacaggtactcaggaagtatgcatcaactgccagaggtactcagtaaatgcttgctgcctgtggtgtccagtaagcgctcactgattgactacagtgcccactaagtgctctctgactgcacacatgaattcggctgcctctgggctctggggctacagcttgaaaggcctacagaggctctgtctccacctgcctcccctcgacctctgagagggcttccatggcacatggcaccgaggacaatcacagtgcctggccaataggcaggrgctcggtaagtccccagggcccctttgacctgcctgcgtctgcccatcacagatatagaatggtgacacatcagatctttcctggcaccacactctctaagcgtggtcagccacacctcccacagctcacgctgcacttgtgcggtcctctcccatctggtcctgggcctggccacgtgactggcctcaacggatgggccacccacaaatgtgaaaccagcactctgcatgggagccgctctcctggctcccagccaccaggagaaacccgggctggcctgctggagaggccatgaggaa

SEQ ID NO: 160804 - DNA, 601 bp, Human
gaggctggcggttccggggagaggcgaggaactctgcagggacaaacgtggatgagacacagagcaatcctgccgggcagcagcagcggaggggacagcagacgctgggaagtgaggagggcagcggggcagtgtcctcgaggcacaaagtaggagggaccagggtgtgggggatgggactggggagacagaggctgggttgggggtgtgggcagggctgcgtagggcactgggctgggctgctgacccactcaggcagcccctcctgcttcaggccccctggaaagctcccaggccaccyctcagcctgtgggattcctcaccaccccacatccagagctaagcctgctatgaacaggtactcaggaagtatgcatcaactgccagaggtactcagtaaatgcttgctgcctgtggtgtccagtaagcgctcactgattgactacagtgcccactaagtgctctctgactgcacacatgaattcggctgcctctgggctctggggctacagcttgaaaggcctacagaggctctgtctccacctgcctcccctcgacctctgagagggcttccatggcacatggcaccgaggacaatcac

SEQ ID NO: 160805 - DNA, 601 bp, Human
gcctctttttgtccatatgtatttgggggtgagacctgccttttggggctgaggatgaaatgagatgacccctgtgaagactttagcccagggccagggacttgataggtgcataatcaggattattttgatggcagttattggtccaagggtcgatggggggccagtgagagtccaggagcagcaaagccacttctggacttctgggaacatggacggctgggcctggaggctccgggcaggtgcaggaggaatgctggccacactcgttcagtcttcagtctctgcctggcccagcttyagtcaggctggggagcaggggcaagggccagggtggtctgagagacagacccaaggcatgaggcagcacctgagggatgaccccgggccagactaaggtggagcttggtggtcagaggtccgggtgggaatcctggcatttctgggcgtgggcgatgaccctgagctggctgccttacctctcggggcctcagtttcctcttctgtaaaacagggcagtgcttaaggtcctgggacaggagagggggatgacttgaccctgcgaaggtcactgatgaccccaaagaggcgcagttttggg

SEQ ID NO: 160806 - DNA, 601 bp, Human
aaaagaaaagaaaggaagaaagaaagggagacccagagagggccagcaccaggcctatgtcacacagcacatcagaggcaggcagggctgggaccaaaccaagccgggctctgctcttctctgactgtgccctttttttttttggtgggggggcggcgggtgcgaagtctcgctctgtcgcgcaggctggagtgcagtggcgccatcttggctcactggaacctctgcctcctgggttcaagcgattctcatgcctcaacctcctgagtagctgggattacaggtgcccgccatcacaccyggcagagcctctttttgtccatatgtatttgggggtgagacctgccttttggggctgaggatgaaatgagatgacccctgtgaagactttagcccagggccagggacttgataggtgcataatcaggattattttgatggcagttattggtccaagggtcgatggggggccagtgagagtccaggagcagcaaagccacttctggacttctgggaacatggacggctgggcctggaggctccgggcaggtgcaggaggaatgctggccacactcgttcagtcttcagtctctgcctggcc

SEQ ID NO: 160807 - DNA, 601 bp, Human
cagatcctgtcaaaagaaagaaagaaagaaggaaggaaggaaggaaggaaggaaggaaggaaggaaggaaagaagaaaagaaaagaaaagaaaagaaaagaaaagaaaagaaaagaaaagaaaagaaaggaagaaagaaagggagacccagagagggccagcaccaggcctatgtcacacagcacatcagaggcaggcagggctgggaccaaaccaagccgggctctgctcttctctgactgtgccctttttttttttggtgggggggcggcgggtgcgaagtctcgctctgtcgcgcagrctggagtgcagtggcgccatcttggctcactggaacctctgcctcctgggttcaagcgattctcatgcctcaacctcctgagtagctgggattacaggtgcccgccatcacacccggcagagcctctttttgtccatatgtatttgggggtgagacctgccttttggggctgaggatgaaatgagatgacccctgtgaagactttagcccagggccagggacttgataggtgcataatcaggattattttgatggcagttattggtccaagggtcgatggggggccagtgagagtccagg

SEQ ID NO: 160808 - DNA, 601 bp, Human
tcccagcactttgggaggctgaggcgggaggatcacgagctcaggagtttgagaccagcctagccaacatggtgaaaccccgtctctacaaaaaatacaaaaaattagctgggggtagtggtgtgcgcctgtagtcccagctacttgggaggctgagacaggaggatcacttgagcccaggaggcagaggttgcagtgagccgagatcgtgccactgcactccagcctggatgacagccagatcctgtcaaaagaaagaaagaaagaaggaaggaaggaaggaaggaaggaaggaaggaargaaggaaagaagaaaagaaaagaaaagaaaagaaaagaaaagaaaagaaaagaaaagaaaagaaaggaagaaagaaagggagacccagagagggccagcaccaggcctatgtcacacagcacatcagaggcaggcagggctgggaccaaaccaagccgggctctgctcttctctgactgtgccctttttttttttggtgggggggcggcgggtgcgaagtctcgctctgtcgcgcaggctggagtgcagtggcgccatcttggctcactggaacctctgcctcctgggttcaagcgattc

SEQ ID NO: 160809 - DNA, 601 bp, Human
tgtggaggcctggtcacccaggcttggcattcacagtggtcagtgcaggcccttctgcaaacagcagcagaaacggactcaaagccattttggcaaaaatcataatttaggggtccatgaaactgaagaaatgaaattggctagtgtcaggtacagttggatccagggctccacgcaatgttctcaggtccccccggaacccctcgccccggcctggttcccatacacccagctcaaccttcctgatgctcctggtagaactcccaggaaaggccgctcattgggtcacgtgtccatctcraaccaatcactaggaacctaggacaagggagctctgattggccaggccgaggtgccacatccaccactggaactaggggtggcttctccatgtggcctgagcctggggtgggcgttgctgcttgaggcagaatgcaggttgggagggtagatctgcgaatgtccaactcagcctgtagagaaggtgcagtccagccttccttatccagatgaagaaagggagaaccaaggctgggtgcggtggctcacacctataatcccagcactttgggaggctgaggcgggaggatcacgagctcag

SEQ ID NO: 160810 - DNA, 601 bp, Human
ctcgaccccaaacaactcttatctgacctccctaatacattgtactggaacaagggattctggggtaactgcattggcacacagctggccttggagatgcataacttgtggaggcctggtcacccaggcttggcattcacagtggtcagtgcaggcccttctgcaaacagcagcagaaacggactcaaagccattttggcaaaaatcataatttaggggtccatgaaactgaagaaatgaaattggctagtgtcaggtacagttggatccagggctccacgcaatgttctcaggtccccctggaacccctcgccccggcctggttcccatacacccagctcaaccttcctgatgctcctggtagaactcccaggaaaggccgctcattgggtcacgtgtccatctcaaaccaatcactaggaacctaggacaagggagctctgattggccaggccgaggtgccacatccaccactggaactaggggtggcttctccatgtggcctgagcctggggtgggcgttgctgcttgaggcagaatgcaggttgggagggtagatctgcgaatgtccaactcagcctgtagagaaggtgcagtccag

SEQ ID NO: 160811 - DNA, 601 bp, Human
tggccagtaaatgctattgagtgagctctaggagtgcccttgctctccaccctgacaagggaggctgcgagctcttgttctgagagccctctggcctctcagaacctcagtttgctctctgaaaaatgggagcgagggcatatagggtgaaaaagggtggagggtcacagtgtgcccaccagggccagccaggactgcagacaatgaccgcttggaggctgaacttcccgccaacgctttgcctcttgcgccccctggcggctagagtgggcggggcgccctccaggcaaaaagggctatygagcattcaaatgagatgcaaattaaccagcgcccccacaagcccttggactcggggtgacgaggtgtctgacaacccagagtcttgatcagatcccttttatctatttatttatttattattttttgagacagagtctcgctctgtcacccaggctagagtgtagtggctccatcttggctcactgcaacctctgcctcccgggttcaagcaattctcctgcctcagcttcccaagtagctgggattagaggcgcgcaccaccacacccggctaattttttatatttttggtagagaca

SEQ ID NO: 160812 - DNA, 601 bp, Human
agagtagctggggattacaggcatgcaccacacccagctaatttttgtattttcagtagagacgaggtttcatcatgttggccaggctggtctccaactcctgacgtcaagtgatccgcccacctcggcctccgaaagcgctgggattacaggtgtgagcccccgcgcctggccagtaaatgctattgagtgagctctaggagtgcccttgctctccaccctgacaagggaggctgcgagctcttgttctgagagccctctggcctctcagaacctcagtttgctctctgaaaaatgggarcgagggcatatagggtgaaaaagggtggagggtcacagtgtgcccaccagggccagccaggactgcagacaatgaccgcttggaggctgaacttcccgccaacgctttgcctcttgcgccccctggcggctagagtgggcggggcgccctccaggcaaaaagggctatcgagcattcaaatgagatgcaaattaaccagcgcccccacaagcccttggactcggggtgacgaggtgtctgacaacccagagtcttgatcagatcccttttatctatttatttatttattattttttgaga

SEQ ID NO: 160813 - DNA, 601 bp, Human
cttgaactcctgggctcaagtgatcctctcgcttccatctaccaagtagctgggactataggaatgcactaccacacctggctaatttttaaatttttttttgaggtgcactgggtgtctcgcttgttgcccaggctggtctcgaactcctgggcttaagcgatcctcctgccttggcctccaaaagcgctaggattatggatatgagccattgcgcacagcctccatgggtttcttgaagaactggagaatctcaaagaaggtctaagcagtgaaagggagtgggggataagcctggggyacccagaagccttgttcagggatactgtagggaaaagaaaaaaaaaaaaaaaggctttccaggggcctgagtgtgcaggactctccgggaacccagaggagcaggtctgaaataaaaaccaggactcacaccaatggctaaggacaaaaacccagcggaagtctgattcttgtcctgaccactgtggacggagcagggggcaggtcgctgccctgtatgggtctccttttaccccatctgcagatcagggttgggatcctttctgggtgatctccagcctcgtgagcactatgcttctgt

SEQ ID NO: 160814 - DNA, 601 bp, Human
gggaaaagcacttgcaaaagtgcagaggaagagcatagaacattctctggccaggggaagatgaggaaggtgaagccagtatagcgggcagggggtgaagaggaggggcagatacaggtggagagcagtggggctgcaaagctgcctggtgtccatctcctccagagaagagaggggctggtcccccaaactcagggggaggcatgtggcagatgctggagtgtgggggacactgagacagggaacagggggcctgggaggcttgtgtctctccccacacctcagtttacccgtctgtgamatgggcagtgtgggcctctagtctgagcacaactttctctttggacatgaaaactatagagttcatactgtgtcatcagtgggtccctcctgtccccatccagtgcccagtgccatacactggggtgccccaaggacatgccagggcctgggccaggctgggggcttctgcctccactccatggtgcagaacaaggcttggggagtgtggaggtggctggggagccctgggcccccggagggctgctctgtttaccggaggccacccgcccacctctgatgcaacaggcaggctctggtt

SEQ ID NO: 160815 - DNA, 601 bp, Human
tcaatgtgaaaagaattacaggataaagatggctctgggatgggcacttctggagaagcccccggcccgtctggggcaggcaggggatccatgcactcccctaaccctgtggggtcaggcttgggccagaggagggatgggaggctgggacaggccagaattggggcaagggctgtgccagaggagtcagggagggtttctcagaagagagggcatttgtgctgggctttcaagtatgtgtaggagtttgccactaggagaaaggtttttcttgtttttttcttcaaggcaggatctcackgtgttgcccaggctggagtgcagtggcatgatcatagctcactgcagcctcgacctcctaggctcaagcaatcctcccaacttagcctccccagcagctgggactacaggcaggccaccaccaggtccagctaattttgttttttttaagagaggatgtctcactatgttgcccaggctggtcccaaactcctgggcttaagagatccttcctcctcggcctcccaaggtgctgagattacaggtgtgagccactacacaagacccgagaagggctttttcaagagggaaaagcacttgc

SEQ ID NO: 160816 - DNA, 601 bp, Human
tttctttcttcttttttttttttttttttttttgagatggagtttcactcttgttgcccaggctggagtgcaatgacacgatcttcgctcaccacaacctccgcctcctgggttcaagcgattctcctgcctcagcctcctgagtcgctgggattacaagcatgtaccatcatggccggctaattttgtatttttagtagagatggggtttctccatgttggtcaggctggtctcgaactcctgacctcaggtgatccgcccgcctcagcctcccaaagtgcttggattacaggtgtgagmcaccgcgcctggccatttttttgtttcttttctttctttttgtttttcttttagagacaggatcttgctctgtcacccaggctgcagtgcagtagctcagtcatagctcactgcagactcgaactcctcggatcaagtgatcctcctgcctcagcctcccgagtagctgggactatacacataagccaccacacctgcctaattaaaaaaacaattttttttggccagatgcggtggcttactcttgtaatcctagcactttgggaggctgaggcaggcagatcacatgagaccagcctg

SEQ ID NO: 160817 - DNA, 601 bp, Human
gggaacaagcctgcctttttagaaagcccttttcatctctggaaatcagtcctcacacactggttctccgaagtcgaaatacttttttgtatccagtttccttcactccaagagtctgagagttcttgtcccgaatgcccaaggtccaggggccctgcccttccccagggatgattcttggccaggctagcctgaggccttgattattgttttgtttctttcttcttttttttttttttttttttttgagatggagtttcactcttgttgcccaggctggagtgcaatgacacgatcttcrctcaccacaacctccgcctcctgggttcaagcgattctcctgcctcagcctcctgagtcgctgggattacaagcatgtaccatcatggccggctaattttgtatttttagtagagatggggtttctccatgttggtcaggctggtctcgaactcctgacctcaggtgatccgcccgcctcagcctcccaaagtgcttggattacaggtgtgagccaccgcgcctggccatttttttgtttcttttctttctttttgtttttcttttagagacaggatcttgctctgtcacccaggctgca

SEQ ID NO: 160818 - DNA, 601 bp, Human
gatggcttgagcccaggagttcaaggtcacagggagccgtgactgcaacactcaaggaaagacagaaagacatctgtctctagaccactctgtgccttgaatcttccagaagggcagggcgtggtggctcatgcctctaatcccagcactttggaaggccgaggtgggctgatggcttgagcccaggagttcgagaccagcttgggcaacatagggagaccttgtctctataaataaataaataaataagtgggccaggtgcggtggctcacgcctataatcccagaactttgggatgccraggtgggctgagtgcttgagtacaggaattcacgaccagcctgggcaacatgacaagaccccatatttataatttttttttttaattagctggtcacaggctggccacagtggctcacgcctgtaatcccaggactttgggaggccaaggcaggtggatcacctgtgatcaggagtttgagaccagcttggccaacatggtgaaactctgtctctactaaaaatacaaacattagctgggaatggtggcacgcacctgtaattccagctactcaggaggctaaggcagaagaatcgcttg

SEQ ID NO: 160819 - DNA, 601 bp, Human
ggctggggcgagttccctgaccccaaaagggatcccagacacatttctaagtcgtctcagaaaaatggcatctggttgagctcatgcctgtaatcccagcactttgggaggccgaggcaggaggaccatttgagctcaggagttcaagaccagcctgagcaacatagggagacccccccatctctaattaaaaaaaaaaaaaaaaagccaggcaaggtagcactcccctacaatcccagctactcgggagactgaggtgacaggatggcttgagcccaggagttcaaggtcacagggagcygtgactgcaacactcaaggaaagacagaaagacatctgtctctagaccactctgtgccttgaatcttccagaagggcagggcgtggtggctcatgcctctaatcccagcactttggaaggccgaggtgggctgatggcttgagcccaggagttcgagaccagcttgggcaacatagggagaccttgtctctataaataaataaataaataagtgggccaggtgcggtggctcacgcctataatcccagaactttgggatgccaaggtgggctgagtgcttgagtacaggaattcacgacc

SEQ ID NO: 160820 - DNA, 601 bp, Human
gcatctgcaacaccagccccaaactgattccctacttgcccatcactctccctttgcccggactgtgtccaaccccgggacacccttctaggtttgcccaagtccaggagtgtctccatgtcctctaaagacctgcagaaaacgctctttctggaggcatcaatcttttttaatatttattttaattttttcaggcagggtctcattctgtcacccgggctggagtgcagtggtgtggtctcgactcactgcagcctggccctcccggactcaagcgatcatcccacctcagcctctggartagctgggagtagcacggcgccacacctagctaatttttgtatttttttagagctggggtctccctgtgttgcccaggctggtctcaaactcctggtctcaagtgatcctgctgcctcggtcttccatagtgctgggattacaggtgtaagccaccacgcccggccaaattcaactctttctgcagcacctcagccctatcagactttttggtgtgtgtttctttattgctttctttgatgagcatctcgccctgccggcttcccagcgcctagtacatagaaggccctcaatcaccctt

SEQ ID NO: 160821 - DNA, 601 bp, Human
cttctgcccctttgggggcatctgcaacaccagccccaaactgattccctacttgcccatcactctccctttgcccggactgtgtccaaccccgggacacccttctaggtttgcccaagtccaggagtgtctccatgtcctctaaagacctgcagaaaacgctctttctggaggcatcaatcttttttaatatttattttaattttttcaggcagggtctcattctgtcacccgggctggagtgcagtggtgtggtctcgactcactgcagcctggccctcccggactcaagcgatcatcycacctcagcctctggagtagctgggagtagcacggcgccacacctagctaatttttgtatttttttagagctggggtctccctgtgttgcccaggctggtctcaaactcctggtctcaagtgatcctgctgcctcggtcttccatagtgctgggattacaggtgtaagccaccacgcccggccaaattcaactctttctgcagcacctcagccctatcagactttttggtgtgtgtttctttattgctttctttgatgagcatctcgccctgccggcttcccagcgcctagtacatagaa

SEQ ID NO: 160822 - DNA, 601 bp, Human
cccacctcagatttcccagcagctggggctacaagcgcacacctaatttttaaccagactatgccaggctaattttttttatttttttagagaaggggcttcattttatcacactggctggtcttgaacttccggcctcaagttatcctcctgcctcagcctccctaagtgctgggattacgggtgtgagccaccacacaggcctggctgccttcccaaggccgggtgctctccacccaccaggggtgaaaggcaggctgggggcatctgaggctagatttgaatgggtagtgtttgaatycaggattcttagaatgttccagctggagaaggccccatgggggtccttttttccataggtccctctggcacccatggggaaagtgaggcccagtggggagccctcagaccctccttcccacctctccctgggcctgctcctgggagggacagctcctgttcgaggggcaggagtccacggtgagtgggaccctctgtgggacgccccctctacttcactccaggatcccattttggccatgcacagagaggccagggccggggctgtaggccagtcagtccaggattcaaatcctaaacc

SEQ ID NO: 160823 - DNA, 601 bp, Human
tgccatcatagctcactgcagcctccaattcctgggcttaagcattcctcccacctcagatttcccagcagctggggctacaagcgcacacctaatttttaaccagactatgccaggctaattttttttatttttttagagaaggggcttcattttatcacactggctggtcttgaacttccggcctcaagttatcctcctgcctcagcctccctaagtgctgggattacgggtgtgagccaccacacaggcctggctgccttcccaaggccgggtgctctccacccaccaggggtgaaakgcaggctgggggcatctgaggctagatttgaatgggtagtgtttgaatccaggattcttagaatgttccagctggagaaggccccatgggggtccttttttccataggtccctctggcacccatggggaaagtgaggcccagtggggagccctcagaccctccttcccacctctccctgggcctgctcctgggagggacagctcctgttcgaggggcaggagtccacggtgagtgggaccctctgtgggacgccccctctacttcactccaggatcccattttggccatgcacagagagg

SEQ ID NO: 160824 - DNA, 601 bp, Human
gccaggctggtcttgaactcctggcctcatgtgatctgcctacttcggcctcccaaagtgctgggattacaggccaccatacctggctgggtttcctctttttaattattattatttttttttgagatggggtctcgctctgttgcccaagctggagtgcagtggtgccatcatagctcactgcagcctccaattcctgggcttaagcattcctcccacctcagatttcccagcagctggggctacaagcgcacacctaatttttaaccagactatgccaggctaattttttttatttttktagagaaggggcttcattttatcacactggctggtcttgaacttccggcctcaagttatcctcctgcctcagcctccctaagtgctgggattacgggtgtgagccaccacacaggcctggctgccttcccaaggccgggtgctctccacccaccaggggtgaaaggcaggctgggggcatctgaggctagatttgaatgggtagtgtttgaatccaggattcttagaatgttccagctggagaaggccccatgggggtccttttttccataggtccctctggcacccatggggaaagtga

SEQ ID NO: 160825 - DNA, 601 bp, Human
attccccacacacggagacccccaaacagagccgcagaaaatccatagatgcccgaaacaacagatcccccaaatacacaagtattcctcctgcgaaagtccccaaaatacatgcagttcacgatacgccaaaccccccaacccacacagctctccaaacacacacatccccaaaacacatcctattccctctgcatagacagaccccaaaaacactcagacatacccagatgccccaacacatgccaatcccccaaatgcacagacacatacagatctccctaaacacatggccgtcccrcaaatacacacagacccctttcccctgaacaatgtggagacccccgccagacgcatgcagactcttccaaacatatgcagactccccccaatccatgctggtcccccattacataggtagggcccccccatccctgcagtgataccacccacactctagctttcttcttttttgttttttttttttgtgagacagagtctcactttgtcacccaggctggagtgcagtggcgtgttctctgctccctgcaacccctgcctcctgggttcaagcgattctcctgcctcagcctccccagta

SEQ ID NO: 160826 - DNA, 601 bp, Human
acctgggcagaagtggtgaccaaagggtgcaggatgtgctggtgacctgggatagaagaggagcctggtgatcccaggcctgagcgatgtgggggtgagggggaattgggaggacaaaagaagagctcaggagtgcggaagcatcagaaactttctggcagtatctgtggtcactaagtcaatcaacaaacattaccctgaagtccttcaagccatagattatcatctccccagcctggcgaggccccttagccccccagtaatggagatggggtgctggagggaatcccacccttccacwgacccttcccctctggcctctctgcgtggtaggactcagttctcttacctgttaattgggggtgagaatccttctcccaccagctgggaagagggtagggagcaggggtctactgaactttttttttttttttttttgagatggagtctcgctctgttgcccaggctggagtgcagtggcgtgatctcggctccctgcaaccactgcttcccaggtttaagcgattgtcctgcctcagactcccgagtagctgggattacaggtgcacaccatcacacccagctaattttttatattttt

SEQ ID NO: 160827 - DNA, 601 bp, Human
atttacatgaagtttcagaacaatcaaaactcactgatgcagctgggcgcaggggctcaagcctgtaatcccagcactttgggaggccaaggcgggcagatcactggaggtcaggagtttgagacaagcctggccaacatggcgaaaacccatctctactaaaaatacaaaaattagctgggcgtgctggcatgtgcctgtaatcctagctactcgggaggctgaggcaggagaatagcttgaacccaggaggcggaggttgcagtgagccaagattgtgccattgcactccagcctgggygacagagcgagactctgtgtcaaaaaaaacaaaaaacaaaaaaccctcactgaggctgatggatatcagacagcactttggtcaccctgggcagaagctgtgattaggcagtggcccaagggggaagtcccaggggctagggaagtcctgttcctggatccaaggtttgggtacacagatatgttcagtttgtgcaaatgtgttgagctcaactctagtggtttgtgcatttttcttcatgtgatttatttcaaaaggaagatttcttttttttttttgaggtggagtctcgctctgtta

SEQ ID NO: 160828 - DNA, 601 bp, Human
gcccttaatgggagagctggtcaacactttcttgttgattctatgatcagttatagcacagcacagaaaaagggtgcactctcgctgcacacaaccacgtggatgaatctcagagaccattggccaattcgacgatcccagactccatcgagaagatgcactgtgtgattttatttacatgaagtttcagaacaatcaaaactcactgatgcagctgggcgcaggggctcaagcctgtaatcccagcactttgggaggccaaggcgggcagatcactggaggtcaggagtttgagacaagmctggccaacatggcgaaaacccatctctactaaaaatacaaaaattagctgggcgtgctggcatgtgcctgtaatcctagctactcgggaggctgaggcaggagaatagcttgaacccaggaggcggaggttgcagtgagccaagattgtgccattgcactccagcctgggcgacagagcgagactctgtgtcaaaaaaaacaaaaaacaaaaaaccctcactgaggctgatggatatcagacagcactttggtcaccctgggcagaagctgtgattaggcagtggcccaagggggaagt

SEQ ID NO: 160829 - DNA, 601 bp, Human
ttattttttgagacagagtcttgctctgtcatgtaggctggagtgcagtggcacagtcttcacctcccgggttcaagcgattctcctgcttcagcctcccaagtagctgagattacaggtgtgcaccaccacacctggctaatttttgtatttttagtagagacagggttttgccaagttggccaggctgatcttgaactcctgacctcaagggatccgctggcctcagcctcccaaagtgctgggattccaggcgtgagccactatgagaaggttttaagcagagaagggatggggcttrgtttattattttaagactcagctcatggcttccatggggagcaggtctgttggaggccagggtggagatcatgggcggctggagagaaggcaagggctgtgtccgtcttgacagagactgggggtagggccccctctgtgctaggcctgtgccttgcactttaagtcactgtactccagggtgcgttagtcctccagaagccagcaggccctacaccaactctggaggcaggcctgacaggtgcagatgaactcacgcaggagtttcactctcctgaaccccagtgacattggaaccaaa

SEQ ID NO: 160830 - DNA, 601 bp, Human
gagttccaggcagaaggaagagcaggtgccagggccctgaggagggacaagaaacagcgggagggtggggatgaggccacagaggttgggccattctaggactccttcttttgggtttccttcttttaatttaatttattattattatcattattttgagacagagtctcactctgtcgcccaggctggagtacagtggcatgatcttggctcactgcaacctctgcctcccgggttcaagtgattctcccgtttcagcctcccaagtagctgcgattacgggcatgcaccaccacacctsgctaatttttgtatttttagtagagacggggtttcaccatgttggccaggctggtcttgaactcctggcctcaagtgatctgcccgccttggcctcctaaagtgctgagattacaggcgtgagccaccacgcctggccatatttatttttttgagacagtcttgctctgttgcccaggctggagtgcggtggtgagatctcagctcattgcagccttgacctcccaggctccagtaatcctcccacctcagcctcctgaatagctgggactacaggtgagtgccaccacgccctgctagt

SEQ ID NO: 160831 - DNA, 601 bp, Human
tggggcttaggcctgagtctcttaagcctggaagacctgactcaagccccttctcactctgtctgtccccattttagacacagacaccatggctagggcagaggtcatgtgatgggggagaactgggaagtctctctctgcactgagaccctgagagctgagatagaaagtgagttccaggcagaaggaagagcaggtgccagggccctgaggagggacaagaaacagcgggagggtggggatgaggccacagaggttgggccattctaggactccttcttttgggtttccttcttttaayttaatttattattattatcattattttgagacagagtctcactctgtcgcccaggctggagtacagtggcatgatcttggctcactgcaacctctgcctcccgggttcaagtgattctcccgtttcagcctcccaagtagctgcgattacgggcatgcaccaccacacctcgctaatttttgtatttttagtagagacggggtttcaccatgttggccaggctggtcttgaactcctggcctcaagtgatctgcccgccttggcctcctaaagtgctgagattacaggcgtgagccacca

SEQ ID NO: 160832 - DNA, 601 bp, Human
ctctgagttaggtgtggctgtgtcaagctccatctcccctatggctggggttccagtcatcagggagaataaatgaataaatgatcatgaaaatgagcaggccaggtgcggtggctcagcctgaggtcccagcactttgggaggcccaggcaggaggattgattgaggtcaggagttcgaggctagcctgggcaacatggtgagacccccgactctactaaaactacaaaaattagcctagccaggcgtggtggtgggcgcctgtaatcccagctattcggaaagctgaggcaggagaatyacttgaacccaggaggcggagcttgcagtgagccgagatcgctccactgcactccagcctgggcaacaaagtgaactccatctcaaaaaaaaaaaaaaaaaaaaaaggaaggatggaaggagggatggaaggaaggagggaaggagggagggaaggagggagggagggaaggagggagggagggaaggaaggaaggaaggaaggaaggagggaaggagggagggaggggaaacaagaaacactgacagaccaggcgcggtggctcacgcctgtaatcccagcactttgggaggccgaggc

SEQ ID NO: 160833 - DNA, 601 bp, Human
ttctgggcctccctctgttctggccctctgagttaggtgtggctgtgtcaagctccatctcccctatggctggggttccagtcatcagggagaataaatgaataaatgatcatgaaaatgagcaggccaggtgcggtggctcagcctgaggtcccagcactttgggaggcccaggcaggaggattgattgaggtcaggagttcgaggctagcctgggcaacatggtgagacccccgactctactaaaactacaaaaattagcctagccaggcgtggtggtgggcgcctgtaatcccagctrttcggaaagctgaggcaggagaatcacttgaacccaggaggcggagcttgcagtgagccgagatcgctccactgcactccagcctgggcaacaaagtgaactccatctcaaaaaaaaaaaaaaaaaaaaaaggaaggatggaaggagggatggaaggaaggagggaaggagggagggaaggagggagggagggaaggagggagggagggaaggaaggaaggaaggaaggaaggagggaaggagggagggaggggaaacaagaaacactgacagaccaggcgcggtggctcacgcctgtaa

SEQ ID NO: 160834 - DNA, 601 bp, Human
aaatgtctgggaagtgtgccttggcttcccaggcagagtccacatgctctctctgggctttcccagttctgggcctccctctgttctggccctctgagttaggtgtggctgtgtcaagctccatctcccctatggctggggttccagtcatcagggagaataaatgaataaatgatcatgaaaatgagcaggccaggtgcggtggctcagcctgaggtcccagcactttgggaggcccaggcaggaggattgattgaggtcaggagttcgaggctagcctgggcaacatggtgagaccccygactctactaaaactacaaaaattagcctagccaggcgtggtggtgggcgcctgtaatcccagctattcggaaagctgaggcaggagaatcacttgaacccaggaggcggagcttgcagtgagccgagatcgctccactgcactccagcctgggcaacaaagtgaactccatctcaaaaaaaaaaaaaaaaaaaaaaggaaggatggaaggagggatggaaggaaggagggaaggagggagggaaggagggagggagggaaggagggagggagggaaggaaggaaggaaggaaggaagga

SEQ ID NO: 160835 - DNA, 601 bp, Human
gattggagtccaagaatatgcctaatttagttccctcccacgacctttgttgctgccactcctgtctggaatgctcttcctacacttcttcctatagctgactcccctcccctccctcccttcccgcctccgttttttttttctttctttctttctttttttgagatggagtctcgctctgtcgcccaggctggagtgcatggagtgcagtggcgcaatcttggctcactgcaagctccacctcccgtgttcacgccattctcctgcttcagcctcccgagtagctgggactacagtccgyttttttttttttttttaaatggaggtttgcttttgttgcccaggctccctcccctcccctcgcctcccctcccctcctttcccctctccccactctcgagacgcctcctggatcccctctcttcttgagacagaatcttgctctgttgtccagggtggagtgcagtggcactatcttgactcactgcaactccctctcctgggttaaggtgattctcctgcctcagcctcccaagtagctggcatgcaccaccacatccagctaatttttgtgtttttagtagagatggagttttgccat

SEQ ID NO: 160836 - DNA, 601 bp, Human
tgctggggtagggaggacaatgggtgtcagtggctgtggccatgatgggggacacataggcatgagaggccgaaagaggggcctctcatcaaagagccccaaagtggccaacagaagtcagagaggcttcctggaggaaggtgtcttaaggttgagaccccgagaagtgaggtgggcccagccctgggatggggaggtcagggaaggattctgggggacctgaagggagggagaatggcatccaggtgggaggagtggcccctgcggaggcctggcagtgaggacaccaaggggtaggcgrccaggccatagtgcacagagccacagaggccatccctctccgtggcgggcagtgggtttgaacaggggccataggcagaccccagtttgactccattttctctgtcacaatgggaccccaacttccccatccataaaatggggagatcccaattgaaccgaccccctggggtcatggtagagatggggtgcttaggaaatatccccctccttccttcagagttttactgtgtttgggacagaaatcattcctcttccctcctcatgttttcggggggtttgtttttttgttcgaggcaga

SEQ ID NO: 160837 - DNA, 601 bp, Human
gcgtggtggcgggcgcctgtagtcccagctactgggaaggctgaggcagaatggcttgaacctgggaggcggagcttgcagtgagctggagatcgcgccactgcactccatcccgggcgacagagcgagactccgtcacacacacaaaaaaatgcttaccacttatatacggaacaaatgacatacagagattttgcatcatcatggcactccaacataggcgaaatctcttgggtagaaaccacacagataaacacacacaaacaagaaaatttaaaagaacctgaacaagctcacaatwaattccatccagaaaccaaagaaactaaaaatcgcacacattcacgcaagggaacaaaattacccagagcgaagggaaactggaattaagggtggctagaattaatatttgatcaaggagtccaaagggaagaaacacaaactttctgatcagttaagataaggagtccccttccccgcagttcgaaaagaaagcccacattcagaaggtcaaaaacacccccagacttgagtgctgggagcactagagggggtcagtccctggtgatgagggcaggggcgtttgaacagccacaggaac

SEQ ID NO: 160838 - DNA, 601 bp, Human
caaagcttaccacttagccgggcgcggtggctcacgcctgtaatcccagcactttgggaggccaaggcgggcagatcacaaggtcaggagatcgagaccatcctggctaacacggtgaaaccccgtctctactaaaaatacaaaaaaattagctgggcgtggtggcgggcgcctgtagtcccagctactgggaaggctgaggcagaatggcttgaacctgggaggcggagcttgcagtgagctggagatcgcgccactgcactccatcccgggcgacagagcgagactccgtcacacacamaaaaaaatgcttaccacttatatacggaacaaatgacatacagagattttgcatcatcatggcactccaacataggcgaaatctcttgggtagaaaccacacagataaacacacacaaacaagaaaatttaaaagaacctgaacaagctcacaataaattccatccagaaaccaaagaaactaaaaatcgcacacattcacgcaagggaacaaaattacccagagcgaagggaaactggaattaagggtggctagaattaatatttgatcaaggagtccaaagggaagaaacacaaactt

SEQ ID NO: 160839 - DNA, 601 bp, Human
gcagaggttgcagtgagctgtgatcatgccgttgcactccagcctgggcgacagagtgagattccatctcaaaaaaaagaaaaaaaacaacaacaaaactacccacaatgactctagacttaggaaccttccactggttaattgctcagagaaaaacacactgacctattacaaccacacgaggaaagaaaaaatcacaacatacacttacaatcagaatgtatcaaagtggtgtgtgtcataaacatcactctcacaaacacctcaaagcttaccacttagccgggcgcggtggctcacscctgtaatcccagcactttgggaggccaaggcgggcagatcacaaggtcaggagatcgagaccatcctggctaacacggtgaaaccccgtctctactaaaaatacaaaaaaattagctgggcgtggtggcgggcgcctgtagtcccagctactgggaaggctgaggcagaatggcttgaacctgggaggcggagcttgcagtgagctggagatcgcgccactgcactccatcccgggcgacagagcgagactccgtcacacacacaaaaaaatgcttaccacttatatacggaacaaatg

SEQ ID NO: 160840 - DNA, 601 bp, Human
tgaagattcaaggtcacgtatattaagcctacttgaattaagatgaggagactcacaactagcttttgacccaagtacacagacagataaaagatataatctacaaataaccaccttagaaaaaccattatttattgattattttatacaaaaataattagtattccaattctgaaaaactatatactacacctttcaggatagggtacccaaactagatatggtacccaaactgacatatcagcatcaaaagaatacccacaatcagccaggcgcggtggctcatgcctgtaatcccagmactttgggaggttgaggcaggcagaccacctgaggtcaggagttcaagaccagcctggccaacatggtgaaaccccatctctgctaaaaaataaaagaattagccgggtgtggtggtgggtgcctgtaatcccagctatgcaggaggctgaagcaggagaactgcttgaaccagggaggcagaggttgcagtgagctgtgatcatgccgttgcactccagcctgggcgacagagtgagattccatctcaaaaaaaagaaaaaaaacaacaacaaaactacccacaatgactctagactta

SEQ ID NO: 160841 - DNA, 601 bp, Human
ccaatacaatcaggaaaattatttacaaaacactggcataaagcagctgtagttcaactggatacatccaaaccatcaggatgtgaagattcaaggtcacgtatattaagcctacttgaattaagatgaggagactcacaactagcttttgacccaagtacacagacagataaaagatataatctacaaataaccaccttagaaaaaccattatttattgattattttatacaaaaataattagtattccaattctgaaaaactatatactacacctttcaggatagggtacccaaactaratatggtacccaaactgacatatcagcatcaaaagaatacccacaatcagccaggcgcggtggctcatgcctgtaatcccagaactttgggaggttgaggcaggcagaccacctgaggtcaggagttcaagaccagcctggccaacatggtgaaaccccatctctgctaaaaaataaaagaattagccgggtgtggtggtgggtgcctgtaatcccagctatgcaggaggctgaagcaggagaactgcttgaaccagggaggcagaggttgcagtgagctgtgatcatgccgttgcactc

SEQ ID NO: 160842 - DNA, 601 bp, Human
tggctcatgcctgtaatcccagcactttgggaagctgaggcgggcggatcacctgaggttgggagttcgagaccagcttgattaacatggagaaaccctgtctctactaaaaatacaaaattagctgggcgtggtggcgcatgcctgtaatcccagctactagggaggctgaggaaggagaatcgcttgaacctggaaggcggaggttgcggtgagccgagatcaccccattgcactccagcctgggcaacaagagtgaaactccatctcaaaagaagaaagaaaatataaaaaaagaaayccaatacaatcaggaaaattatttacaaaacactggcataaagcagctgtagttcaactggatacatccaaaccatcaggatgtgaagattcaaggtcacgtatattaagcctacttgaattaagatgaggagactcacaactagcttttgacccaagtacacagacagataaaagatataatctacaaataaccaccttagaaaaaccattatttattgattattttatacaaaaataattagtattccaattctgaaaaactatatactacacctttcaggatagggtacccaaacta

SEQ ID NO: 160843 - DNA, 601 bp, Human
ttatttaagggcagggtttgattttaaacacaaacttaactcccacatgtcaactaccactttcatactctcctctatctcacagacaatgaaatacaatcaatgatgactcatataaatgacctcacagaatatcaaaaggtgtttaattacagtatcaattacaaggtaggcatcttaaaaaccaatctatttacattaataaacttgacggtgaaagactgactgcaaacccaatgtactaagcgaagtacttatactaactcagacttggaataacataagaaatccaatacaggcygggcgcagtggctcatgcctgtaatcccagcactttgggaagctgaggcgggcggatcacctgaggttgggagttcgagaccagcttgattaacatggagaaaccctgtctctactaaaaatacaaaattagctgggcgtggtggcgcatgcctgtaatcccagctactagggaggctgaggaaggagaatcgcttgaacctggaaggcggaggttgcggtgagccgagatcaccccattgcactccagcctgggcaacaagagtgaaactccatctcaaaagaagaaagaaaatataaa

SEQ ID NO: 160844 - DNA, 601 bp, Human
actttatttatttattgatttttttgagacagagtcttgctctgtcactcaggttggagcgcagtggcgcgatcttggctcactgcaacctccacctcccgggttcaagtgatcctcctgcctcagtctctcaagtagctaggactataggcacgcaccaccatgcccggctaatttttgtatttttagtagagacggggtttcaccatgttagtcaggctggtcttgaactcctgacctcatgatctgcccgccttggcctcccaaagtgctaggattacaggcatgagccaccaccccyggcccttcctactcttactttaatcaaccaaccttaatagtcacaaaggataaggaagacaatgatacaaagattataccttacaaggggagcatttgactaaatgccaactctatctcccagcaggacatcttggcccatggatatgaaaatacttattgactacaggtaaaagaggagacttagaattatgcaaaatctccaacttttctccaaattctcactagacctagatttgttacaccttttacaacagtggcactacactgttttcttcaagtcactgattgcatcaatatt

SEQ ID NO: 160845 - DNA, 601 bp, Human
acaggcgcctgccaccatgcctggctaatttttttgtatttttagtagagacggggtttcgccatgttggccaggctggtctcaaggtcctgacctcaagtgatctgtccgcctcggcctcccaaagtgctgggattacaggcatgagccaccatgccctgccaggaaattgggcagctcaattttctaagagctcctaaaataattggaagcccctaaaattaaaaataatcagggaactcattttacatcaaggactacacaagtgacatcagatcaatgagatacacaatggaatttycacctaccctataatcccacagcagcaagatgtatatagaaattaaccaggctactaaaaagagaattgaaaaccctagacaaagtgagcacatcccaagaagctcttaacccggcatgttttaatttaaataaaagagaaagcattcataagaacaacctcctactcttactttatttatttattgatttttttgagacagagtcttgctctgtcactcaggttggagcgcagtggcgcgatcttggctcactgcaacctccacctcccgggttcaagtgatcctcctgcctcagtctc

SEQ ID NO: 160846 - DNA, 601 bp, Human
ggttcaagtaattctcctgcctcagctttccgagtaacttaaataacaggcgcctgccaccatgcctggctaatttttttgtatttttagtagagacggggtttcgccatgttggccaggctggtctcaaggtcctgacctcaagtgatctgtccgcctcggcctcccaaagtgctgggattacaggcatgagccaccatgccctgccaggaaattgggcagctcaattttctaagagctcctaaaataattggaagcccctaaaattaaaaataatcagggaactcattttacatcaagkactacacaagtgacatcagatcaatgagatacacaatggaatttccacctaccctataatcccacagcagcaagatgtatatagaaattaaccaggctactaaaaagagaattgaaaaccctagacaaagtgagcacatcccaagaagctcttaacccggcatgttttaatttaaataaaagagaaagcattcataagaacaacctcctactcttactttatttatttattgatttttttgagacagagtcttgctctgtcactcaggttggagcgcagtggcgcgatcttggctcactg

SEQ ID NO: 160847 - DNA, 601 bp, Human
aaaaacagagtggcaaaataatgaggcaaaactgatggaacggcagggagaactgcatggagccatgaagtatagctggagacttcaatacctgtctatcagcaatagcagatccagcaggcagaaaatgaggaaggacattgttgaactgaacagtaccatcaaacaactggactgaacggaaaatcaaaacacttagaccagcaatagcaggatatacattcttctcaagttcacatggaacattcaccaaggtagcccacattctggaacataaaacatatcttttttttttttttttgagatggagtctcgctcttgttgcccaggctggagtgcaatgacacaacctcgggtcactgcaacctctgcttcctgggttcaagtaattctcctgcctcagctttccgagtaacttaaataacaggcgcctgccaccatgcctggctaatttttttgtatttttagtagagacggggtttcgccatgttggccaggctggtctcaaggtcctgacctcaagtgatctgtccgcctcggcctcccaaagtgctgggattacaggcatgagccaccatgccctgccaggaaattgggcagc

SEQ ID NO: 160848 - DNA, 601 bp, Human
atatacggtgttgaaaagaaacacattttaaatatacagttatagatacattaaaaataaaggaatgaagaaagatatgccatgctaacactaagaaaaagaaaagtaacacagctatgttcatttcagacaaagctgacttcacatcctggaaatctcagtgacacaggggcattatgtaataacaaagtgatcaattcaccaagaagacaaggcaatccttagtgtgtatgtgcataaaaacagagtggcaaaataatgaggcaaaactgatggaacggcagggagaactgcatggagycatgaagtatagctggagacttcaatacctgtctatcagcaatagcagatccagcaggcagaaaatgaggaaggacattgttgaactgaacagtaccatcaaacaactggactgaacggaaaatcaaaacacttagaccagcaatagcaggatatacattcttctcaagttcacatggaacattcaccaaggtagcccacattctggaacataaaacatatcttttttttttttttttgagatggagtctcgctcttgttgcccaggctggagtgcaatgacacaacctcgggtcactgc

SEQ ID NO: 160849 - DNA, 601 bp, Human
ggattacagacgtgagccaccaggaccagcccaagactctttacagaaagtgaaagcaagaagagactggagtgaaatgtttaaaacattataagacaaaacccccaaccacatagaattctgtatagagcaagaatatccctcaaaatggaagagaaatgaaagctttatgagataagaaaagataatctgtcactagcgtacctgccttgaaagaactgttaaaaaattccctacaaaaaagaaaaacgataaagaagggtattagagaaaaaataaatacaagtaaaatacaatctcwtttttgtaatctgacagatgagtttgtccaaaacactaacaggaacaatatatttggtaagtccagcttatggataaatgatacgtatggtagcaatgttacaaaggacaggaaaggaggaattgggaatactttttcatgaggtacttgcacaaccagtgaggtagtacagtgttctttacaagaggacttgggttacttgtaagcatgtactacaaactcaaaggcaatgagtaaaacttaaaaaacaacaaaaaactataattgatgtgctaagtggggagaaaaatggcatcaagt

SEQ ID NO: 160850 - DNA, 601 bp, Human
tttcagtagagatggggttttgccatgttggccaggtgggtgtcaaactcctggccccaagtgatctgcccacctcgacctcccaaagggctgggattacagacgtgagccaccaggaccagcccaagactctttacagaaagtgaaagcaagaagagactggagtgaaatgtttaaaacattataagacaaaacccccaaccacatagaattctgtatagagcaagaatatccctcaaaatggaagagaaatgaaagctttatgagataagaaaagataatctgtcactagcgtacctgycttgaaagaactgttaaaaaattccctacaaaaaagaaaaacgataaagaagggtattagagaaaaaataaatacaagtaaaatacaatctcttttttgtaatctgacagatgagtttgtccaaaacactaacaggaacaatatatttggtaagtccagcttatggataaatgatacgtatggtagcaatgttacaaaggacaggaaaggaggaattgggaatactttttcatgaggtacttgcacaaccagtgaggtagtacagtgttctttacaagaggacttgggttacttgtaagc

SEQ ID NO: 160851 - DNA, 601 bp, Human
ttgggaagactcgggtaggctggctaggggttttcactgaggttagggagtgggctagtgtgggagttcaagcatacaagcaggggctaatgtggattgaatgtctcaccagcaccaaatgagggtgacccaggctttcttcctaccacatctggatgtagggtacatagtagaaaaggaggaatgagattttattttatttattttatttcatttgttttgagaccgagtttcgctgttgcccaggttggagtgctgtagcgtgatctcggctcactgcaaccttcgcctcccaggttcmagcgattcttgtgcctcagcctcctgaatagctgggattacagatgtgcaccaccacacccgtctaatttttgtgtttttagtagagacagggttttgccatgttggccaggctgggcttgaactcctgggctcaagcgatctgcctgcctccgcctcccaaagtgctgggattataggtgtgagtccccatgcctggcaataatgagattttaaagctatcatccatcaaacatcacaaaaaaatgaagtcagagacttccaatttctggtctcacaagtaaggaacgtagaaattgtc

SEQ ID NO: 160852 - DNA, 601 bp, Human
gggggaactggtttttcttacatacaactgagtttttgcttatacatttttaaaatttcttttaattcctgttccactataagtactcaaatccagctggctgaatgaaaatatttctttgcagaagtattaatttcaacttgtttgtgtaatatttatcacaggctcagttcttcctttttctctctctcacatttcatggatctaggagattactaggaagttagagctcaggcctgaggaggaacgtatggcaacttacacctctacaaaatttgtataccaggagagggtttattaygcgtttacttgagactttgggaagactcgggtaggctggctaggggttttcactgaggttagggagtgggctagtgtgggagttcaagcatacaagcaggggctaatgtggattgaatgtctcaccagcaccaaatgagggtgacccaggctttcttcctaccacatctggatgtagggtacatagtagaaaaggaggaatgagattttattttatttattttatttcatttgttttgagaccgagtttcgctgttgcccaggttggagtgctgtagcgtgatctcggctcactgcaacc

SEQ ID NO: 160853 - DNA, 601 bp, Human
ttaaggaatcagagagattgaggggttgaggaggaattatttaattatttaggtgcaccgacccagttggattaacatccaaagaactgagccccaaacagagtcaagctaccttttaaccatttcgtggggtggggaggagatttgtgcagggggaagtgtattacagaagcgagaaacaaagacagttattcaattaaaacacgcattacattacttcttacttttcaaggaacgacaacatgttttacgacttgagattatctgtttagtgaccttgcagctgcacagctagagaaayagtcttcacaatgcctgggaaagggagagataaggctcactagctacagaaaaataggcagtcaatttttaaaggacttcagatctttctcttcctcagggggaactggtttttcttacatacaactgagtttttgcttatacatttttaaaatttcttttaattcctgttccactataagtactcaaatccagctggctgaatgaaaatatttctttgcagaagtattaatttcaacttgtttgtgtaatatttatcacaggctcagttcttcctttttctctctctcacatttcatgg

SEQ ID NO: 160854 - DNA, 601 bp, Human
aatcccttgtgagaaaaactcatttcctaccttattacgtaccatatcactcagcatttcattacgcatggaatcaatctggataaggttttaataaataaatacaccttcaagaactgtaggcttttcttttattcccatcaacaaacgagaggccaggaggcctgtggaaagctaaattgtcacaaggagctgctggccatgtcctgaaggactccaggccactactgcagtggagtaattaaggaatcagagagattgaggggttgaggaggaattatttaattatttaggtgcaccsacccagttggattaacatccaaagaactgagccccaaacagagtcaagctaccttttaaccatttcgtggggtggggaggagatttgtgcagggggaagtgtattacagaagcgagaaacaaagacagttattcaattaaaacacgcattacattacttcttacttttcaaggaacgacaacatgttttacgacttgagattatctgtttagtgaccttgcagctgcacagctagagaaacagtcttcacaatgcctgggaaagggagagataaggctcactagctacagaaaaataggc

SEQ ID NO: 160855 - DNA, 601 bp, Human
ctcaagctcacactggaaaagtaagagaaatgctatacaaatgaaacaaattttaagaccattaatcccttgtgagaaaaactcatttcctaccttattacgtaccatatcactcagcatttcattacgcatggaatcaatctggataaggttttaataaataaatacaccttcaagaactgtaggcttttcttttattcccatcaacaaacgagaggccaggaggcctgtggaaagctaaattgtcacaaggagctgctggccatgtcctgaaggactccaggccactactgcagtggartaattaaggaatcagagagattgaggggttgaggaggaattatttaattatttaggtgcaccgacccagttggattaacatccaaagaactgagccccaaacagagtcaagctaccttttaaccatttcgtggggtggggaggagatttgtgcagggggaagtgtattacagaagcgagaaacaaagacagttattcaattaaaacacgcattacattacttcttacttttcaaggaacgacaacatgttttacgacttgagattatctgtttagtgaccttgcagctgcacagctagag

SEQ ID NO: 160856 - DNA, 601 bp, Human
tcttgctttattgcccaggctggagttcagtggtgcgatcttggctcactgcaacctctgcctctggagctcaaatgattctcgtgccccagcctcctaagtagctgggactacaggtgtgtaccatacctatctaattttttgtatttttagtagagacggggtttcaccatgttggccaggctggtctcgaactcctgagctcaggcaatttgcccgcctcggcctcccaaagtgctaggattacaggcgtgagccactgtgcctggtcaattacttctaaatttttactgtgatcatstgaaaccttattgttctctaaaggtggactcaagctcacactggaaaagtaagagaaatgctatacaaatgaaacaaattttaagaccattaatcccttgtgagaaaaactcatttcctaccttattacgtaccatatcactcagcatttcattacgcatggaatcaatctggataaggttttaataaataaatacaccttcaagaactgtaggcttttcttttattcccatcaacaaacgagaggccaggaggcctgtggaaagctaaattgtcacaaggagctgctggccatgtcctg

SEQ ID NO: 160857 - DNA, 601 bp, Human; identical to SEQ ID NO: 39834

SEQ ID NO: 160858 - DNA, 601 bp, Human; identical to SEQ ID NO: 39835

SEQ ID NO: 160859 - DNA, 601 bp, Human; identical to SEQ ID NO: 39836

SEQ ID NO: 160860 - DNA, 601 bp, Human; identical to SEQ ID NO: 39837

SEQ ID NO: 160861 - DNA, 601 bp, Human; identical to SEQ ID NO: 39838

SEQ ID NO: 160862 - DNA, 601 bp, Human; identical to SEQ ID NO: 39839

SEQ ID NO: 160863 - DNA, 601 bp, Human; identical to SEQ ID NO: 39840

SEQ ID NO: 160864 - DNA, 601 bp, Human; identical to SEQ ID NO: 39841

SEQ ID NO: 160865 - DNA, 601 bp, Human
ttgtgttttaaatttttgttttttctttaataaaaatagctctaaatttttattaaagtggataagcctgtttttcttgaactataaagtgatatatgtattttataggcatttattgatacactttataaagtcagcatatgcctttttaacaagaaaaagtaaaatatattagtgagatgttaattttctacagttcttccttgaataaggtgattgagccattgctacttctgtcctcctaaatgtaaaattataaaacatttaacttagaagaatctgtacttgctttttaaacaacaacaacaacaacaacaacaacaaaaacacagagagcttctcgtttcataattcttccttagtgtcaggtgttttaactaaaaataacaactgtaccataattgcacctgatcaggaaagaaagatttctccattctgtacaaatataagatggtaatgtatgtaatggaaatataaacaaaattttattttacagtctattaccctgttactggaaaggttatctctgaaaggaacaaaataatgcttttgaaatttttacactgtgtgatttagtgcatttgaattgcatattacaaat

SEQ ID NO: 160866 - DNA, 601 bp, Human
ttttatggttatttggaaatgtaaaacaataggccacctattttcatccccaaacattaagacaggaattgtctttggagaatgtggcatctaaatcaccttgcaagagaaactattagtttaaattaaagtcccaaaggcaagaaaaattaacattctatttgtaataaaaattctatccattttattccattttgaggatgaagaccattttgtgttgccggggggaccataaagtgtgccatacagctttaaactctctccctgaagaagtaagctgtcttcccctgcctcgttctcttttttttttttttgtatttaacttagtttcttgcttgatggcaattcccatttcatacgagagtcacgtaattgtttattttttatagaacaactctgtgagatactgcgtgtttacttgtctttaaagaaaaaaagcatttaatgtctagttccacatctctaatcttctatgataatattcactcacatgttgaattcttgctttattttctagccctaaggtaatttgctagcccttgttctttatttcatttgttgtattgatttttggctcccttctaggctacaatgctaagca

SEQ ID NO: 160867 - DNA, 601 bp, Human
tgcctggcttcaaaggacaggctgactctcttattaggggctaatgcagctggtgactttaagttgaagccagcattcatttaccattctgaaaatcctggggcccttcagaatgatgctaaatttctctgcctgttctctgaaaatggaaaacaaagtctggatgacagcacatctatttacagcatggtttactgaatgttttaagcccactgttgagacatactgctcagaaaaaaaagatccctttcaaaatattactgctcattgacaatgcacctggtcacccaagagctctgaygtacatggagataaatgttatttttgtgcctgttaacacaacatccgtggatgaaggaataatttcgaagccttattatacatttcataaggctatagctgccatagatagtgatttctttggtggatttgggcaaactaaattgaaaacctggaaaggatttaccattctagatgccattaagaatattcatgattcatgggagaaggtcaaaatatcaactttttttttattatactttaagttctagggtacatgtgcacaacatgcaggtttgttacataggtatacatgtgccat

SEQ ID NO: 160868 - DNA, 601 bp, Human
agctggtgactttaagttgaagccagcattcatttaccattctgaaaatcctggggcccttcagaatgatgctaaatttctctgcctgttctctgaaaatggaaaacaaagtctggatgacagcacatctatttacagcatggtttactgaatgttttaagcccactgttgagacatactgctcagaaaaaaaagatccctttcaaaatattactgctcattgacaatgcacctggtcacccaagagctctgacgtacatggagataaatgttatttttgtgcctgttaacacaacatccrtggatgaaggaataatttcgaagccttattatacatttcataaggctatagctgccatagatagtgatttctttggtggatttgggcaaactaaattgaaaacctggaaaggatttaccattctagatgccattaagaatattcatgattcatgggagaaggtcaaaatatcaactttttttttattatactttaagttctagggtacatgtgcacaacatgcaggtttgttacataggtatacatgtgccatgttggtttgctgcacccattaacttgtcatttacattaggtatttct

SEQ ID NO: 160869 - DNA, 601 bp, Human
agcattttgctaggcctctgaagaaaaaatgtggaattttgtcaaagactcttaagtattttttaaaataagtatgtgtttgttgtttttacttcttgtaaagagaaaagaaaataactctgtaaaatgggaaagtaagacctagtttgtcatttccaagacaacagaatttacttacattctaaacaaaggagggggagaacaccgtaggaaaaatcttacatacctatgaaggtcccatcgtgtgtgacattggagagagatcttttacttaaagtatttgctttttcttattttcttrtcacagatacatatgataagaaatatatatgtatatttatgtgtgtgtgcacatgtatgtgtgtgttttgagacagggttttgctttgtcacccaggctggagtgcagtagtgggatccatgctcacggcagcgttgaacccccgcactcaagcagtcctcccacctcagcttcctgaatagctaggattgcaggcatacttcaccatgtccaactaatttatttttactttttgtatacatggggtctcactatgttgtccaggctggtctcaaacttctggcctcaagcagtccttct

SEQ ID NO: 160870 - DNA, 601 bp, Human
aagtaaaaatcagattggtgttttaaaaagatcagtgtggagacagtgtgaaaggaaaaaaatgttggcacacctaattaccaagaaaggtggtgtgttgacagtgctggagaatatggcatatagagagagtaataaatgtttacattataggaatatggcatacatagggaataataaatctttagagttccagggcctaggaaatgtgaaagggaaatgactaagggtgaaaggataactgaacaatgttgaagggtccagttaagattataaattatgaatttgtagtgataccagstaacatacttaataacataatttactgttttaaaatcagggaacaggcaaagtatatggctagattcatccagtgctaggatttaatagcaaggtgagataaatagatagggtttagggtactgcagtaatactagagttgttgaaatcattggtctttttttcttccagtgtaggtaagcatgacatgaattatggaaagagggctgatagggaaagaaggaggagttgaaagaatagaggtttcaatgaggtttaaaaaatgtttaataagtataaaagacatggtagaagagaagac

SEQ ID NO: 160871 - DNA, 601 bp, Human
tgaacaatgttgaagggtccagttaagattataaattatgaatttgtagtgataccaggtaacatacttaataacataatttactgttttaaaatcagggaacaggcaaagtatatggctagattcatccagtgctaggatttaatagcaaggtgagataaatagatagggtttagggtactgcagtaatactagagttgttgaaatcattggtctttttttcttccagtgtaggtaagcatgacatgaattatggaaagagggctgatagggaaagaaggaggagttgaaagaatagagktttcaatgaggtttaaaaaatgtttaataagtataaaagacatggtagaagagaagactgatcagaaagtgatttccaaatataagctttcaatcatagggtagttctacctatgatgataggccttgggtgtcatattgtggtggattgttaaagagcagtggaaattattaaagtcagggagtgtgaggccaagttattaaccactgtatgtagattcagagttgttcaggatgatggcaggagttgaaggggagaggcaaactgggagtaagctccagtgtactggagggttgttgt

SEQ ID NO: 160872 - DNA, 601 bp, Human
tttaataagtataaaagacatggtagaagagaagactgatcagaaagtgatttccaaatataagctttcaatcatagggtagttctacctatgatgataggccttgggtgtcatattgtggtggattgttaaagagcagtggaaattattaaagtcagggagtgtgaggccaagttattaaccactgtatgtagattcagagttgttcaggatgatggcaggagttgaaggggagaggcaaactgggagtaagctccagtgtactggagggttgttgtggtactaatgatgagaatggggraaatacaatgttaccagatggcagaggctgaaaagagagaagctgtttttgaatgaaggcagaagacaaaatgtctcagatatttttgagctaagaaaatacaactttagctccaagcctgggtcttggggtagaaaatgaagaaaagagagttgagaagttctgcatgagagtacttcaagggaagtctcctgagaataatctagctaaaagtgaaagataggagctagagttttgtgagtgtctgaatttaagagattcaaagggtacggtaaaaagtgttcaaaactaggtctgagg

SEQ ID NO: 160873 - DNA, 601 bp, Human
atgagtcacattctgaatcagatggaagtgtgagatttcattatgcaactcagaacggcatgcaatttaaaacttacaaattgtttatttccagaactttccatttaatattctcagaccacagttgactgtgaaaatttccaaaaccgtggaaatgaaattatggaaagtaaaactgctgataaggggcaactgctgtagttctctggggggggaaatgaggttctggaaccatggctgatcatcatgaaggttagactgatagaaacctagaatggattaggtgcctctgtacattaastatgttgtggaatttttgtcaaaatattaaaactgcttctatacatatctgtctcctttactaaactataaactctttcagagcagagtctgtgtcttgttagccatttgcttagcatgttctaggcacttacctaagtatttaatgatgagtcattgcatgaatctagtaactttcttttgagtggctaacctctcaaaattaatagtgtaacttaaatgtatgtgtaatggtgataatatcgtactcccttattagcatatatttctttgaaaaagcaaggaattttctcaagatata

SEQ ID NO: 160874 - DNA, 601 bp, Human
tatttaatgatgagtcattgcatgaatctagtaactttcttttgagtggctaacctctcaaaattaatagtgtaacttaaatgtatgtgtaatggtgataatatcgtactcccttattagcatatatttctttgaaaaagcaaggaattttctcaagatatatggtataggtttcctcatactttttatgatgtaatatgtattggtttactgatattttttcagtctcatgtgtattttaagagccattatagttgactgttggaaaattgggttttgtggctgggcatggtggctcacrcctgtaatcccagcactttgggaggccggggtgagcagatcacttgaggtcaggagttcaagaccagactggccaacgtggtgaaaccctgtctctactaaaagtacaaaaatcagcccaacatggtggtgcacacctataatcccagctactcgggaggttgaggcacaggaatcgcttgaactcggtaggcgaaggtttcagtgagccaaaatcatgccactgccctccagcctgggcaacagagtgagaatgtctcaaaaaaaaaaaaaaaaaaaaagagagaaattggcgtttgaa

SEQ ID NO: 160875 - DNA, 601 bp, Human
gttggaaaattgggttttgtggctgggcatggtggctcacacctgtaatcccagcactttgggaggccggggtgagcagatcacttgaggtcaggagttcaagaccagactggccaacgtggtgaaaccctgtctctactaaaagtacaaaaatcagcccaacatggtggtgcacacctataatcccagctactcgggaggttgaggcacaggaatcgcttgaactcggtaggcgaaggtttcagtgagccaaaatcatgccactgccctccagcctgggcaacagagtgagaatgtctcaaaaaaaaaaaaaaaaaaaaagagagaaattggcgtttgaactacacaggtcctcttataagcagattcttttcaataaaagttacaccaagtgtgcctgcctctccttccgtcttctccacctcttccatccctgctacctctgaggcggcaagaccaaaccctcctcttcatcttcctccacagcctactcagtgcaaagaccgtgaggatgaagacttttatgatgatccacttccacttaatgaatagtaaaatattttgtcttctgtatgattttcttaataacatttgtttttct

SEQ ID NO: 160876 - DNA, 601 bp, Human
aataggctattagttaagttttgggggagtcaaaagatatttgcgggttttcgacttactttatttattcttttatcagcaataattaaatccaacacatatacttactcatttttattggttgatttggtggcctaaagtatgtttctctttttagattagtgttgataggttttgtgttttttgtagccagagtatctggagaagagctgtttgaaaatgtccccgttacgtgattctcttttcagaatgattcagtgtaggggggaggagccaagatggccgaataggaacagctccrgtctacagctcccagcgtgagcaacgcagaagacgggtgatttctgcatttccatctgagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggacctgtctgttagaaggaaaactaacaaacagaaaggacatccacaccaaaaacccatctg

SEQ ID NO: 160877 - DNA, 601 bp, Human
caatatcttagccatcttccccaataaatcaaaaacctctaccaaaagttacataaaattattcattgtcatttcagcattaggccatcttttaacctttgggtaattaatatcaaatttctacttggtcagcaatatctcccttttttcttccccattctcaacccctttcttgaacctcattcgataactgctgaatttcttttctttctaggattatacttgaaaggaaattgtgatttattcccattaaactttaaaaacattttggctttatttaagccaacatgattctatttgsatttgctttctttttcactacagatcttaatcacttctgtttcttttatgccctgtgtttctacatttatttattttttctttattaatgcttaaattctttccctcctcagctccagcacccatttcccttccttttcttgcttcacaacccttctcctttggggaagttataagattagagtgagatgaccctcagctccactcactaggttacaggattcattattaatcctacagattagttttagtcatgtgagccatggtgattttggtctctttttcttttttggaaggtagg

SEQ ID NO: 160878 - DNA, 601 bp, Human
ggaaggtaggtggaagaaaagacttttgtgttgctctgaattgtgtggtgtgtgcctgtaagagctagaattagtatagtcgtttttctactctgatacaagctagtctgatgacagtgccacacacagacgaggagaaagttgaggagatctcagagaaatgaagcaggagccttgattaacctgtttatgaagctcattctacttccagactttacaatgatgtgatctctgagctgataaattcttctactggagtacagtacagtagtttctattacttccagtatatcctaactgrtatatacaaattgtaacatttttttaaaaatctaaagtacagtaagcatattgttggtcagcctaaataacagagagaggctctcttaacagaaatgatatttaggaatagggcattgccatgggaatacatgtgccatgataaactatgcatgtttcagggaagtacaggaaaacaaaggtttttaatagaaaaaaatgagaaggattacataattgttttgagataattatccttggctacaaggatcacactggtctgaggttggacagacagttgctgggcagatgtctttccaga

SEQ ID NO: 160879 - DNA, 601 bp, Human
ctagcagagacaaatataatcctgtctgaccagtaaacttaggcaaaaatgtatgctgataattttgaatacatttttattaagttttaaaaccagcttatttatcaaagtttttttaagtcacgtgaactaaaagacatttggcttaattactatgtatttcatgtaagcgctcatttatttaagccaatctgaatagaattccttaagggatttctggccaagtacatcagattttactatgtagacataacatacaacataaaatatgtgcatgtgcataaacacacctaagcatatatacatacacacaaaaattttggggtaaaactgtttctatagcagtttaaaaaaacaaaaaaaacctcttttacccttcccccacctttgactcagtttcacatgagtttagggttaaatattcaatgtttacatttttagctaggactggctgaattgtatgagaaaaacaaaatttctaagtggcattgaattttcggtaacaagtctgtcttttgtttgccagtctgatttgcttgactagtcagcgtagcagggaaatcgtttagtgtgtttttggttttttgtttttcacccccgc

SEQ ID NO: 160880 - DNA, 601 bp, Human
ggatttctggccaagtacatcagattttactatgtagacataacatacaacataaaatatgtgcatgtgcataaacacacctaagcatatatacatacacacaaaaattttggggtaaaactgtttctatagcagtttaaaaaaacaaaaaaaacctcttttacccttcccccacctttgactcagtttcacatgagtttagggttaaatattcaatgtttacatttttagctaggactggctgaattgtatgagaaaaacaaaatttctaagtggcattgaattttcggtaacaagtctrtcttttgtttgccagtctgatttgcttgactagtcagcgtagcagggaaatcgtttagtgtgtttttggttttttgtttttcacccccgcatggcagaaaaaggaatttttatgctagacagagatactttatattgtttctttgagctcaagactttcaagtgtttgatctgagatcctaacttttgtgagcactatatagttctttttcttttagactatgaatccttcagttaactgtttctttaccctaagcaattgttagtcaggcaaacctaaatttacatttccaaaagatac

SEQ ID NO: 160881 - DNA, 601 bp, Human
ctttcaagtgtttgatctgagatcctaacttttgtgagcactatatagttctttttcttttagactatgaatccttcagttaactgtttctttaccctaagcaattgttagtcaggcaaacctaaatttacatttccaaaagatacttaagtcgttagttgtcatcgagctgttatactttgtaaagctattaatttgaaagtcctttaatacttttttttttttaatcttggctggaattccataagcagtgagttttatatcaacaccagtaggaaaatcagcagaatcaaagtaagcaaaaaaaaaaaaaaaaagagatggggaaggtagaaggctttacatgtcagcttaatatttgcaggttttttgtttttttaaaaagagagtttgaataatgactgtttgagctctggattttcctcgatatacttggtccatcagttaaaaaatgagaataggccataagatgtagcctgctgaagtcccctagaacctgacatgccttaatgtttgagaattccattccttttcttattaatctctcaaaagtacggaaaatcccataaattctgtcagggtatgtcaggactgttgtttt

SEQ ID NO: 160882 - DNA, 601 bp, Human
aattgttagtcaggcaaacctaaatttacatttccaaaagatacttaagtcgttagttgtcatcgagctgttatactttgtaaagctattaatttgaaagtcctttaatacttttttttttttaatcttggctggaattccataagcagtgagttttatatcaacaccagtaggaaaatcagcagaatcaaagtaagcaaaaaaaaaaaaaaaaagagatggggaaggtagaaggctttacatgtcagcttaatatttgcaggttttttgtttttttaaaaagagagtttgaataatgacygtttgagctctggattttcctcgatatacttggtccatcagttaaaaaatgagaataggccataagatgtagcctgctgaagtcccctagaacctgacatgccttaatgtttgagaattccattccttttcttattaatctctcaaaagtacggaaaatcccataaattctgtcagggtatgtcaggactgttgttttaggtgctggtgactgtcctactggcttttaattaatcattctgtgtccatcaggctacaaggatcaataataagagtgaggccagtctcaggttggtcatgc

SEQ ID NO: 160883 - DNA, 601 bp, Human
tttattttcctgggaaagtggagtaaattttatatcatacttgtataaagtagtatttccttaaatagattccttggattactcattttcttagatgccctattaagaagtgacttacttgataaacagtgtatactcctattggctcacagtaaacattagcaaattgacgacttcaaaaaatcttgcagatgctaaatctctttatctttatttacttcatattttcccccagggtatctgacaatagaatggagatagatcttttgctgaaaatattttttcactatgttttattgtrtcctcattctcttagtctgcagtaagaaatctgtatttcttataggtaaatattcatatcttcagtaattcaacttcttggtgaacaatctagttatatactctgcttataccacagtcattaacacatttcctcatggtgtttacattctcaataaatatatcttattttttaaccatgtaactcttaaattttttagcaactgctttatgacctacttagtggtaattttaaagaaaatagtcaaactagcagatctccctgcttattctagtgatgatttccacacacataacttct

SEQ ID NO: 160884 - DNA, 601 bp, Human
ctgatcacatcagctgccatttagttaacaagaaatttttagggttctctattatttgtatgtatatccaagaatctaaaggacatagaggagctacatatagaaacaaatttcaattgaatgttttaatgagccttataacctctagctttaaacacatgccatttctcttcattgttcacaaataataattttatttctttgagcttttctttatttttaacatattttaataggtcattctttcagtaacatacatgaagtagcttgtttttataggcccattatttgtattttaacgaggaaaggaaagaagtgggggcctcttgaatttctgtatcaccaaatagagttcagaatactatgggtttttgcagtgtactatttctcttcttcattaatggtgatgtgaatgagttgcatgaaaaacataggagtcataggaaccatgtaatcccttgactatcacttttcattccgtataaaatgataggaggtgagttttttgcctaattgccattttttaaagttgctatggcattatagggaaccatagagtttatataaagtgatagctcttagaattcagaagagatgtaga

SEQ ID NO: 160885 - DNA, 601 bp, Human
agtataaaatctgaaattttggataacagatttttgtgaaatggattgccattcctatattctcttacttaataatattcctcataatgctctgtcacaatttcatgacaactctgctttgaagagtttcttacagtaatactctagtagatgacagctatgttcgaaagacataatagaatttttaatgtttatacttttaatcagaggctgataaagggcatatcactaacctccactggttaaaataaataggatacattggtatggtgtttattactccatgaccacattacttttytaagtgattggctgagaaagtggaccagagtcttgttgagtgtttttgtttgtttgtttgtttttgagacagggtcttactgtgtcgcccaggctgaagtgtagtggcaggatcacggttcactgcagccttgacctcccagggtcaagcaatcctcctatctcagcctcctgagtagctggaccataggcatgtgccaccatgcctggctaatttttaaattattattattttttgtaaagacaaggtctccctatgttgcccaggcttgtctcgaactcctggattcaagggatcctc

SEQ ID NO: 160886 - DNA, 601 bp, Human
caactctgctttgaagagtttcttacagtaatactctagtagatgacagctatgttcgaaagacataatagaatttttaatgtttatacttttaatcagaggctgataaagggcatatcactaacctccactggttaaaataaataggatacattggtatggtgtttattactccatgaccacattacttttttaagtgattggctgagaaagtggaccagagtcttgttgagtgtttttgtttgtttgtttgtttttgagacagggtcttactgtgtcgcccaggctgaagtgtagtggmaggatcacggttcactgcagccttgacctcccagggtcaagcaatcctcctatctcagcctcctgagtagctggaccataggcatgtgccaccatgcctggctaatttttaaattattattattttttgtaaagacaaggtctccctatgttgcccaggcttgtctcgaactcctggattcaagggatcctcccgccttggcctcacaaagggctgggattacaggcatgagccactgattctggcctttgagtgttcttttcaaaagaaatacgtaacttcagaaatgcaacctgacac

SEQ ID NO: 160887 - DNA, 601 bp, Human
aataaataggatacattggtatggtgtttattactccatgaccacattacttttttaagtgattggctgagaaagtggaccagagtcttgttgagtgtttttgtttgtttgtttgtttttgagacagggtcttactgtgtcgcccaggctgaagtgtagtggcaggatcacggttcactgcagccttgacctcccagggtcaagcaatcctcctatctcagcctcctgagtagctggaccataggcatgtgccaccatgcctggctaatttttaaattattattattttttgtaaagacarggtctccctatgttgcccaggcttgtctcgaactcctggattcaagggatcctcccgccttggcctcacaaagggctgggattacaggcatgagccactgattctggcctttgagtgttcttttcaaaagaaatacgtaacttcagaaatgcaacctgacacaacatagtacactgattgggcatatatttctttttagaaattgacgatgaaaaagattgtatgaaccagagaatatgaggttggaagttaatttgttcatctttactctgctgtgcacagaggagaaatattagcata

SEQ ID NO: 160888 - DNA, 601 bp, Human
gtatacctcgagacctcagtgttggaagcttaacctccgtcattttgtaagaatgattatttattttttttttttttgagagggagtcgcccaggctggagtgcaatggtgcgatctcagctcactgcaagctccacctcccgggttcaagcaattctcctgcctcagccccctgagtaggtggaattacaggcacgtaccaccacacccggctaattttttgtatctttagtagagacggggtttcaccatgttagccaggctggtctcgaactcctgacctcgtgatctgcccaccttkgtctcccaaagtgctgggattacaggcgtgagccactgcgcccggccagtactttctttaaaaacaagggcagtacaaagagtgagtgaaaaatataaatgtcagtttgacaacccacatataaaagtcactcattcttttatattcatgcctcatagttttccttgtttttcaaaagaaaaatataaaaagctaagagttaatacagggaagttattagagaaaattcaaacatgaatatgttatgatttagtctaataaacactgaggtggactctactactcagtgtttttatttgg

SEQ ID NO: 160889 - DNA, 601 bp, Human
acggggtttcaccatgttagccaggctggtctcgaactcctgacctcgtgatctgcccaccttggtctcccaaagtgctgggattacaggcgtgagccactgcgcccggccagtactttctttaaaaacaagggcagtacaaagagtgagtgaaaaatataaatgtcagtttgacaacccacatataaaagtcactcattcttttatattcatgcctcatagttttccttgtttttcaaaagaaaaatataaaaagctaagagttaatacagggaagttattagagaaaattcaaacatgratatgttatgatttagtctaataaacactgaggtggactctactactcagtgtttttatttggcttgaaaattttggtttaaaagagagttttaataaaatagtttcttcaggtaggtaaaagtggagaaagtagatgttaggttttttaatatttgaggatatgtgagggggatataaatcttggtgtatataaaaagaaaataattttcatcacagcctgtactttatgatgctgctgaaagaatatgtaattcaagtaggtttgagaaagtaaaagaaagaaagtaaagcgttaaca

SEQ ID NO: 160890 - DNA, 601 bp, Human
atataaaagtcactcattcttttatattcatgcctcatagttttccttgtttttcaaaagaaaaatataaaaagctaagagttaatacagggaagttattagagaaaattcaaacatgaatatgttatgatttagtctaataaacactgaggtggactctactactcagtgtttttatttggcttgaaaattttggtttaaaagagagttttaataaaatagtttcttcaggtaggtaaaagtggagaaagtagatgttaggttttttaatatttgaggatatgtgagggggatataaatcttggtgtatataaaaagaaaataattttcatcacagcctgtactttatgatgctgctgaaagaatatgtaattcaagtaggtttgagaaagtaaaagaaagaaagtaaagcgttaacactctaaatttacaaaagaataaaaaataatcgacaattatttaatgaatgtattactacagtcaaagggaaaaacattagtcttaggtggaaatcaactttttatttttattgatattgaaatagagcagtacctattccttaaacctctgtattgaatttctacattaacctatacatgtt

SEQ ID NO: 160891 - DNA, 595 bp, Human
cattaacctatacatgttttgcaaagaaaaaaaagtgaattctatgttgtgtaggcaaatacacatatacagaaacacttaatggctcctgctttctacagcataatggcatccactaacgttgatttctattcactgtcattctgcatgtatcttggtttcagcctctttcccttgcagtactgcccctttccccgaaccaaaattttcagttctccgagttcaaattgcctagagagagaatctgattttttgcctgtttctttttaagttcatcgccattgttctttttaggaaatcyttcaaagtagaccatcttttaggctattgagtcagaatccagccagctgtgaaagatagcaggtgtgaatgtagaggtataggtagtaggaacccctttgaagaaggacgactgtcagccattctgaagcctctccaacataatatgtataacattttaaacatattcttttttattattattattctttaagttctagggtacatgtgcacaacgtgcaggtttgttacatatgtacacatgtgccatgttggtgtgctgcacccattaactcgtcatttacattaggtatat

SEQ ID NO: 160892 - DNA, 601 bp, Human
ctctgtctataaaaaaataaaaaattggccgggcgtggtggctcacggctgtaatctcagcactttgggaggccaaggcaggtggatcacgaggtcaggagttcaagaccagcgtggccaacatagtgaatccccatctctactaaaaatacaaaaattagctggctgtggtggcacttgcctgtagtcccagctactcgggaggctgaggcagaagaatcatttgaacccagggggcagaggttgcagtgagccgagactgtgccattgcactccagcctgggtgacaaagcaaggctcmgtctcaaaaataaatacataaataaaattatctaggcctggtggtacacacctgtagctccagctatgcaggaggctgaggtcagggaggatcccttaagctcaggagttcgaggctacagtgagccattatcatgccattacattccagtctgggtgatagggtgacaccttgtctcaagaagaaaaagatttgaaatctatgaagggtctaaagtaaccattaactaaagaggtagataagcagattgatgtgtcatctcctatagatggtcattgaattcatgaacatgtacagcat

SEQ ID NO: 160893 - DNA, 601 bp, Human
acaagattattcttttgatgaaactgaagtccattattatagtatttatcatatctatttatcttatgggatatacaatataaagttctatggatatcctttaagttatgaagttaatttttttcattttattatgaatatttataaccaacttatcctcatttagttcaatggaagtcatagctaaatgattaagcatagtaaatacagcccatatttttatacttttaaactttagttcaggaaaatgaagtttgaagtcttaaaagtgaataaatgtaagaagtgattcattacttamtataaatcatgtgatgaaaatgtatttattgtgccatgctttcatatgcatataatttccatagactgcatgctttcttacccttttattcaaaattaaattctgtcaacttctttgtgatttttctagaatgattgcaggacaattacagtgtttatacttgaattacaagaataatataaaagccttgtaaatgtgatgttgtgtggttgatttgggaatttacttgaaatgcatttctcattttattttctgacaactggaaatttttcctttttaaacaagtttttagtggcttct

SEQ ID NO: 160894 - DNA, 601 bp, Human
tacttaaatggccttatagttttaaaaagctttatgttaaattcccatcctgtatttataattcctggggataaattggtgatttgagactagtgttctgttttgtggatattactgcctgaggtcagaaaataattgttacttgatctactggttaaaagatattagtagaggctagaagaaaatgattacgtgaaattaaatatttgtgcctttttatacaccgaggaagaataatgtacaaatcaaataaaaatgttttaaaattaaacaaatatacctctttatagaaataaaatgwatgcttattatataactggtactattattggaaagatatgtacacttaagcttatatgatatgctatcatacataagataaaaagttgtattcttccttgctgatgagtaaatattaaaatgaggtagtaatcagtcttgccaaagccagtgtttatgaagtgaaatattgtttattcattgacatcaagtataaatgggaaggatgctgaaacatatgcatgtatccgtttgtatattggcgattcttgtgctacactattttaatataaagtctttatttttatgtaaaaattcttta

SEQ ID NO: 160895 - DNA, 601 bp, Human
tagggttttgtttacatttttaaaattttcttatttgtaaccaagttgaagtactgagaactttctcaacttttaatcagccttttccttgctacaagtagggtgcattttccttggcggtgaggaaatatgaaaaataaatgctacgtaaaagtgaataattcagggccaggcatagtggctcacgcttgtaatcccatcattttgggagggcgaggcaggtggatcacttgaggtcaggagttcaagagcagtctggtcaacatggtgaaaccccatctctactttttaaaaagaaaasaaaacaaaacaaaactagccaggcatggtggcatatacctgtaattccagctttgggaggctggggcatgagaattgcttgaacccaggaggcagtgatttaagatcacagcactgtactccagcctaggtgacggagtgagactctgtctcaaaaaaaaaaaaaaaaagagtgaataatttacatttttcctgctgagtaaaatgtttttacccgttgagaaactatgctgtcatcagttcagattaaattctaaataactatatatgcatttgctctcacacacacacatatatatat

SEQ ID NO: 160896 - DNA, 601 bp, Human
tggcacataggcgatttctatatctttatattcttttacctttggggaataaatattcaaaaagttaaaataatctcctgcatttagcaaaatgttgttaactgtttcttagatggaatatgtagattcagggaaccaagagaaattagaaagcttaagtgaataaaactaccttgaaatcatagttttttacgtaggagggaatttaaaagtcatctcagccacccctgccaaattttacagataaaaaaactgagacctgaaaattcaagtgacttatcagaatcaacagctaaattgrtgatagtgttgatctgaaaaccagatctcaggttcattgtttccgtaaatatatctgaggaagttatcactgtcaaatacataaatgcactgtcattaaatacatttatgcttcagtgtgaataattctgagcacgcaggttttggaatatgttttaaggattttactaaaagctgttcttaagccaacattttgtttaatttgtttaaagaacacaaaaataaaatttacctaattgaaagaacatagagtagaaccaagtgatggaggaaaaactttttacatttttccaagtataaa

SEQ ID NO: 160897 - DNA, 601 bp, Human
gtaaatatatctgaggaagttatcactgtcaaatacataaatgcactgtcattaaatacatttatgcttcagtgtgaataattctgagcacgcaggttttggaatatgttttaaggattttactaaaagctgttcttaagccaacattttgtttaatttgtttaaagaacacaaaaataaaatttacctaattgaaagaacatagagtagaaccaagtgatggaggaaaaactttttacatttttccaagtataaaagctttatttaaaaaaaaaaaagtatgatgtgagggctgggtgcrgtggctcacacctgtaatcccagcattttggggaggctaaggctggaggatcactggagtccaggagttcaagacccaccagagcaacatagggagatcccatctctacaaaaaagtaaaagaattagcctggcgtggtggcacacacctgtaatcccagctactccagaggctgagacttgagcccagaaagtcaaggctgcagtgaactctgatcaggccactgcattccagcctgggtgacagagcaagaagaccctgtctcaaaaaaagaaaaaaaaagtatgtatgtgaataaac

SEQ ID NO: 160898 - DNA, 601 bp, Human
gggaataaaggatgttcagatttgattggattcttagtaatacctaaggaaacccaattaaaaatttgagagtttgactcttcccagtaaaccagctagacaaatacaggtatgttcttcaagtttgcagacaagtatctattgctttgtattgttttctttacacacaaggtgtataaagaaaaattaaaattgagccaggcatcatggctcacacctgtaatcccagcactttgggaggctgaggtgagcagatcctttgagctcaggagtttgaaaccagcctgggcaacatggcggraccccctatcccctctctacaaaaaagtgcaataattggcctgttgtggtggcatgcacctatagaccctgctacttgggaggctgatgtgggaggatcgcttgagcctgggagatcgaggctgcagtgagtggagattgtgccactgcattccagcctgggcaacagagcaagaccctgtctcaaaaaaataaaataatactgtccttctaattgttctgaataaattcactttttcctgcaataatgatataaggaatttatacacatctaactttttttaaatgttactttttatca

SEQ ID NO: 160899 - DNA, 601 bp, Human
aaggatgttcagatttgattggattcttagtaatacctaaggaaacccaattaaaaatttgagagtttgactcttcccagtaaaccagctagacaaatacaggtatgttcttcaagtttgcagacaagtatctattgctttgtattgttttctttacacacaaggtgtataaagaaaaattaaaattgagccaggcatcatggctcacacctgtaatcccagcactttgggaggctgaggtgagcagatcctttgagctcaggagtttgaaaccagcctgggcaacatggcggaaccccctatcccctctctacaaaaaagtgcaataattggcctgttgtggtggcatgcacctatagaccctgctacttgggaggctgatgtgggaggatcgcttgagcctgggagatcgaggctgcagtgagtggagattgtgccactgcattccagcctgggcaacagagcaagaccctgtctcaaaaaaataaaataatactgtccttctaattgttctgaataaattcactttttcctgcaataatgatataaggaatttatacacatctaactttttttaaatgttactttttatcacttttgt

SEQ ID NO: 160900 - DNA, 601 bp, Human
gacacaccagttttcctttgatcagtgtttgcatggtatatcttttaccaaccttttaatattatttaatattcttaaagtgggttaattatagacagcatggttgggtcttgcttttttacccaatctgaccatctctcccttttaagtgacatttagattatatgtatttaatatgatctttctgtggttggcttcaaatctaccatcttcctagttgtttctttttttctcccacaaaggcgggtttatttccgaacctagttgttttctgattgtctgaactgttctttgttcctcyttccctctttgtccgcctttttttggattcttcacatttagctccattactggcttcttgtgtttttttattgtttgtttttgaggtggagtcttgctctgccacccaggttagcgtgctgtggcgcgatctcggctcactgcaacctccgcctcctaggttcaagcaattcttctgcctcagcatcatgaatagctgggactataggtgcacgccaccatgcccagctaatttttgtatgttttttaaatagagatggggtttcaccatgttggccaggctgacctcgaactcctgacc

SEQ ID NO: 160901 - DNA, 601 bp, Human
gccatacacaaggaggaaacgtagtaaaatccaaagttaggatgcactgtacgacatgccacaatagttagattcagtggctgtattttaggtcttttcctcacccttagtgtataacttgtacctgataatagtgtttaacttgataacattttttttttctcatttgtgagacatgataaccatgacacaaattttattgctgcttgcttttgattacagaagggtaatggaagtgcagtaactctttagatttaaagccctgctcttagctaatgtgaagaatgatcatacttgtgcyggaaactgctttgtgtgaaagatcatcattaaaggatttaataggactttaaagagtgggctgcactttttccagtggttggatgcttcataattaaatgaggaaaattgagatgtaaattatatttttagaagtgacagctcaggatgcttcataggttagctgttacttatgagaagagtgaaagatgagcttacacttagggatacacaagtttaggatagggaaccttttgagaattatttttaagtgaacaataatactcattatgataatgtaacatgaaggtatagagttaac

SEQ ID NO: 160902 - DNA, 601 bp, Human
agatttaaagccctgctcttagctaatgtgaagaatgatcatacttgtgctggaaactgctttgtgtgaaagatcatcattaaaggatttaataggactttaaagagtgggctgcactttttccagtggttggatgcttcataattaaatgaggaaaattgagatgtaaattatatttttagaagtgacagctcaggatgcttcataggttagctgttacttatgagaagagtgaaagatgagcttacacttagggatacacaagtttaggatagggaaccttttgagaattatttttaartgaacaataatactcattatgataatgtaacatgaaggtatagagttaactatggaaaaccaatttatatggacttgtgcaatgatagctgttgtatttaaaatgatttgttttctaaatactactggaaaaataagtcagttgtaagatacttctaaagatgacttatgtcactggttttgctaaaggaacacattattatcatttattcctttgaatccttaaattctattaaatatttttaaaaaaatgcttttactgtgtttctcaggctgacttgtccaaagaaagaaaaaagct

SEQ ID NO: 160903 - DNA, 601 bp, Human
agttgtaagatacttctaaagatgacttatgtcactggttttgctaaaggaacacattattatcatttattcctttgaatccttaaattctattaaatatttttaaaaaaatgcttttactgtgtttctcaggctgacttgtccaaagaaagaaaaaagctgtataatcaatcattcctatagtggtggttaatattttttgaacccagatcactattattgtaatacatgctttgcttttcttctcatatttggtaataatgtaatttctagtatacagattgtgtttatgccttgcaamcaattctcaataacacatgagcaaaaagctgtgttatagacaattcagaggaggggggtggaaggagaggaggagaagaaaagcactgtggctctgaaacacaaataggtaatttgcttttaattgtattgtgtttttattgcatcaaatttgttgaataagtttgtattttaatttattgaattatggaatttttgaacatttactagcttagtgtggataagaagccagctttcattcacagttcattgcaaataggtgccacatagtttctaagccctagtttcctagtatatgaaa

SEQ ID NO: 160904 - DNA, 601 bp, Human
aatacatgctttgcttttcttctcatatttggtaataatgtaatttctagtatacagattgtgtttatgccttgcaaacaattctcaataacacatgagcaaaaagctgtgttatagacaattcagaggaggggggtggaaggagaggaggagaagaaaagcactgtggctctgaaacacaaataggtaatttgcttttaattgtattgtgtttttattgcatcaaatttgttgaataagtttgtattttaatttattgaattatggaatttttgaacatttactagcttagtgtggatargaagccagctttcattcacagttcattgcaaataggtgccacatagtttctaagccctagtttcctagtatatgaaattcctaatatatgaatacaaggcttagtttagctattctctaagatgtcttcttctaagtaagtcctaagcatacatgatttatatttcaaaagcccagtttactcaggaattagaatcaaatactattcgagctttgcaatttaggatgggatgtactataccttcatattattgaaggtctgaacatttagatttgtaatcctaatgttcagttttctgag

SEQ ID NO: 160905 - DNA, 601 bp, Human
tttgtctttcgcttaaaagtcatactcctgataacattcatgataccatggatgtcagctattatcctttgaaaaacatttgcaagttttctttgggcaataaaaaagatgatcaaatgaatcatttgtttatgtcaataagaatatcaacttatcctacacaaacaggacccctacttaatcttttcaaaaaacagcaccgccacctactgaattgtaacatctacatagtaactgaaataggtagactcaatctggaatgatctcttaggcttaagtagagtttcttctcaaataagcrtgatgagatgttaggagctttattagtgttatttctctgaaaatatcagagtgccaaaatctaggattcctaccaagcttttatctaatttttttcctgttatcacttctgctaagcacatcattgaacttcagaatatttaccatgtttcccactcacctcccaatctcttataaaaatgagatagccctggtgggcgctgtagctcacacctgtaatcccagcactttgggaggccgaggcggatggatcgcctgaggtcaggagttcgagaccaacctgtccaacatggtgaaaccc

SEQ ID NO: 160906 - DNA, 601 bp, Human
atcacttgatgccaggagtttgagaccagcctgggtgacatagggaaaccatctctgcaaaaaatttaaaaattagcctggcatggtggcacaggtgtatagtcccagctacctgggaagctggggtgggaggatcgcttcagcacaggatgttgagtcaggttgcagtgagccatgatcacaccactgcactccagcttgggtgacagagcaagactccatctcagtttaaaaaaaaacacaaatagaactactgtatgagccagctgtctccttactgggtatttatcaaaaggaaagraagtcagtattgaagaaacattacacacccatgtttactgcagcactgttcacaatagatatgggatcaacctagatgcctaaatacatgaagaggtaaaatgtgatgtatatgtatatacacacacacacacaatggaatactattcagccaccgaaaagaatgaaatcctgttttcttgcaacaacatggatggaactggaagacattatgttaagtgaaataaaccaggaatagaaagttaaacactgtatgttctcacacatgtggaagcttaaagttgattttatagaagtaaaa

SEQ ID NO: 160907 - DNA, 601 bp, Human
aaaaaaattaatcacaccaaattgcatttattctgaaagtgtaacacaatttaatatttgaaatgcaactagtataattcatcaccttaaaatatttaaggggagaaaccatgatcttctcagattttaaaaaaagcttttcataaaattaagtgttcattcattatttttaaaaacttaggaaaacaggactaggaaggtcttcaatctgaaaaagatatctatgagaaggctgaagaaaacatcacaatcaatggtgaaataaaaaagcatttgctttgagattgggacaagaaggatgatccccgcttccatttaacattgtattgtaagaagtatccagtgcattaaagagaataaaagaaaaaaaattaagataaagcaataaaactctcattcatttatgatgtgattatgcatatttaattcaaaagaatctatagatcagttttatagatctttttttaaatcagaattttgttaggttactgccaaaaaacaaacaagaatttctatataccaaaaaagaaaaaacagaaaataaaatgtgaaaaatacgttggatagcccttttagctggaactgccaccttccagtaatt

SEQ ID NO: 160908 - DNA, 601 bp, Human
ggactaggaaggtcttcaatctgaaaaagatatctatgagaaggctgaagaaaacatcacaatcaatggtgaaataaaaaagcatttgctttgagattgggacaagaaggatcatccccgcttccatttaacattgtattgtaagaagtatccagtgcattaaagagaataaaagaaaaaaaattaagataaagcaataaaactctcattcatttatgatgtgattatgcatatttaattcaaaagaatctatagatcagttttatagatctttttttaaatcagaattttgttaggttaytgccaaaaaacaaacaagaatttctatataccaaaaaagaaaaaacagaaaataaaatgtgaaaaatacgttggatagcccttttagctggaactgccaccttccagtaatttaacaaaataatgaacacaaagggaaagagaagcatctgatatgtattctgtaggccttttagaaaatacggagttgttcctttagccacatacattcaaatctacaggaaaggtgatattgtagacatcagaggaatgcatcctgttcaaaaagggaatgccccacaaattttaccatggaaaacca

SEQ ID NO: 160909 - DNA, 601 bp, Human
ccaacaattctgctcttagaaatatacccagaagcttgtgcacatgtataccaggaactgttacaggaatgttcaaagcagcattatttataatgaaaaattggaaacaaccaaaatccattaacagtagaatgaataaatcataggatattaatataatggaaaaatatagagttatgaaaaggaatgaagacagctgtaaccattactgtggatgaatctcataatgttgaaaggaaaaagccaacactgaaaaatacatattgtatgattcaatttatataaagttaaaaacaaaaagtaaaactaaactgtagtttttaggaatgattatttacttggtaaaatgatgaaagtatagaagtgattaccataataaccaggatgatttgagacaaatgaaggaaggggtttgttatcagaaacagaaatgcagagataggcttcctgagttgttggcaatgaatttcttgatctaggtgatagatacatggttatttgctttctaataatatattaaacttaacttggatattttatgcacttctctgcatttgtggttttctttcactctttaaaaaaagttttaaaatacctatat

SEQ ID NO: 160910 - DNA, 601 bp, Human
taggctctctgcaagaagaagaatatggctctattctgcctgaccctgcaggcagtcagacctttggttgtcttctcttgttctgtaaaatcactgttattctgtttgttttcaaggtgcactgatttcatattgttcaaacacccatgttttacaatcagacttcatatttttcaagcacacatgttctacaatcagtttgtacaatagtgatcctgaggtgatgtacattctcagcttacaaagataacaggattaagagattaaagtaaagacaggcataagaaattatgagtattayttgggaactgataaatgtccatgaaatcttcacaatttatgtttttctgccacggtgccagccagtcccaccatttggggtccctgacttcccacaacatatatctgctcaggagatagatggagacagatatggaggcaaatataagctcttcagtgaaataagtgttataatgaaagaatacttaaagatattagaagtataataaaaagtgttgatgtgggggtggagtttcctatgaagatcagttttaaaaatgtaattgggatgtaaattctgtctctaaaataccttatgtta

SEQ ID NO: 160911 - DNA, 601 bp, Human
tccgcctcccaggttcacgccattctcctgcctcagcctcctgagtagctgtgactacaggcgcctgccactgcacctggctaatttttttttgtattttttagtagagacggggtttcatggtgttagccaggatggtctcgatctcctgaccttgtgatccgcccatctcggcctcccaaagtgctgggattacaggcgtgagccaccgcacctggccctcttagtttcttataattctttataatggactgcttataccagagctcctattttatctcaaagtttgattattttgttyacgttgttctttagatgctattaaactacagctggttgaagcaggcctagtagagtgtctactagagattgttcagcaaaaagtggatagtgacaaagaagatgatattactgagctcaaaactggttcagatctcatggttttattacttcttggaggtgagttgtaatttatgccagccaaagaatgtggttgtcagatgtttttaaaatttattgtctcttctgtaaatactaccctagacattttctcatattcctatctcacctgctattgaggtgatgattttgacatcttaaa

SEQ ID NO: 160912 - DNA, 601 bp, Human
gctattaaactacagctggttgaagcaggcctagtagagtgtctactagagattgttcagcaaaaagtggatagtgacaaagaagatgatattactgagctcaaaactggttcagatctcatggttttattacttcttggaggtgagttgtaatttatgccagccaaagaatgtggttgtcagatgtttttaaaatttattgtctcttctgtaaatactaccctagacattttctcatattcctatctcacctgctattgaggtgatgattttgacatcttaaacatgccattgatacaascagacataatgaacctgaaaaagaagtgtcttcactatcttccagtatttgaagagctgtcacatagaagagatagctttggcaccaagggactaaagaaaagctagatggctccctgggacttggactagaaaaaatgctagactctattgtctagtatctattaaatgtttattataaaaagaatcattacttttcccattatgaatgtaacagtttgtgaggtgtgagtttccagttggatattcacctaagaatgtgaatttgttactcctagttatttttctcttgcttaactat

SEQ ID NO: 160913 - DNA, 601 bp, Human
taatgtgcctttggaagtcatgaaatcactgtattatggaaaatacaacaaaagatagttaaaactattcttttatcctactttctaaaaataaatttctgattagatgaaatagtacaattacatgatgatccaatccatttgaattcatttggtttacataggatagtaacatttattaatgtctataacatttatattaacacagttggatcaaaaacggaattgtgctttttgttgtaagagggtaacattttcagatttcctttacaaactatgtaagtaagtgttttggattggrtctaaaaagccatgatactgtcataaaaattattatattgtctgttatccgcttatacacaaataggatacggacacacacataaacaactgaattccattcttaaaattgacaaaaaagtgacaagattgtttctaaatggaaaaataaaacatggatcttaaagatacttaataaacctgtattgaattgaatgtttatcaacaggaatgctaataccattttaaccatagtctctctttttctccagttataaataaagcaaagatgttatcagctggggtcacagaggcagttttg

SEQ ID NO: 160914 - DNA, 601 bp, Human
ttgtaagagggtaacattttcagatttcctttacaaactatgtaagtaagtgttttggattggatctaaaaagccatgatactgtcataaaaattattatattgtctgttatccgcttatacacaaataggatacggacacacacataaacaactgaattccattcttaaaattgacaaaaaagtgacaagattgtttctaaatggaaaaataaaacatggatcttaaagatacttaataaacctgtattgaattgaatgtttatcaacaggaatgctaataccattttaaccatagtctstctttttctccagttataaataaagcaaagatgttatcagctggggtcacagaggcagttttgaaatttcttaaatctgaaatgcctcctgttcagttcaaacttctgggaacattaagaatgttaatagatgcacaaggtaaaagaaatgttttccccaacttgcatttttcatatgatagtcttaatgtgcctctagttgaaaaaggacttgtttttagcttttaggattatgtaatcataaaaaatagcaaataaaagatttaaaagttggttttggaactccatttgttaattttt

SEQ ID NO: 160915 - DNA, 601 bp, Human
ttgaaatttcttaaatctgaaatgcctcctgttcagttcaaacttctgggaacattaagaatgttaatagatgcacaaggtaaaagaaatgttttccccaacttgcatttttcatatgatagtcttaatgtgcctctagttgaaaaaggacttgtttttagcttttaggattatgtaatcataaaaaatagcaaataaaagatttaaaagttggttttggaactccatttgttaatttttatgcttgttataattatttatttatacatattatttatttatttatttatttatttatttrtttatttatttatttttgagacagagtcttgttctgtcacccaggctggagtgcagtggtgcgacctcagctcaccgcaacttccgcctcctgggttcaagcaattttcctgcctcagcctcctgagtagctaggattacaggcatgctccacaactcctggctaattgttttggaatttcactagacatggggcttgttgctcaggctgctcttgaactcctggcctcaagcgatccacccacttcagcctcccaaagtgctgggattacaggtgtgagccaccatgtccagcctataa

SEQ ID NO: 160916 - DNA, 601 bp, Human
tcaggagagaatagcaaaatggcttccttggtacccctttgaccccttctccatcataactgctctctcacgcccatttgttcatttaacagttaatatttgagttcttgcagtgtaaatactaaaaaatagtgtttctataaaggaattaactatccgttgaggggacagaaataaaaacagctagcttaagtacagctttaaagctacgtatgctattcgggtgtaacagaggaaagaaagactaacacactgtctgggtaatctgggatggtgccatagaaggagtgctattttaggsgttaactaggaatctcaggaggaaagggaaagagaatgaaggaaagggccttttcaggcaaagacagcaggatgtacaaaagcacagagatgtaaaacagcataattttttaaagaaactgcaaataaagcagtattgctagaacacagagtgtagaaagagacagtagccagagaggttgaaaactgggaattaagtgaattatataccaagttaagatatatggacttgattctgtagagaattcgggagcacttaaagggttttaagcagcaagttgccattatttgagggtttttt

SEQ ID NO: 160917 - DNA, 601 bp, Human
tttcatatgggttattcaactagaagcagcgaggatggaaaagaagagacagacctgagaaaaatatgggtggtagaattgacagattcaacagtagaattaaaggaggaggtagttttagagctaattccaagtttggggtttaccaccagattgggttatcatgccattcaacaaaataaaacactataggaagaggtgcagctaacactccctaaacttgcccactcgcccatgctctttggagtcattacccttaatctttttgctctactccaagagaatctccaccattggtttkcaggggtatacaatcatttggatttccctgggccatattggaaaacgaattgtcttgggccacacataaaatgcactaacactaacaatagctgatgagcttaaaaaaacaaaaatcacaaaaaaaactcaaacacctgtggcatttgaagaagaagagaaatctaaaagtttagaaaaccagctgagtgcggtggctcacgcctgtaatcccagtactttgggaggccaaggtaggtggatcattgtggtcaggagttccagaccagcctggccaacatggtgaaaccccatctctact

SEQ ID NO: 160918 - DNA, 601 bp, Human
caagactctgtctccaaaaaaaaaaaaaaaacaaagaaaacttttggaaaacatatttgggagaataatcaaggaagacttctccagtcttgctagagacctagacgtccaaatacaagaagctcaaagaatacctgggaaattcattgcaaaaagatcattgcctaggcatattgtcatcaggttatctaaagttaagacaaaggaaagaatcttcagagctgtgaagcaaaagcacgaggtaacctataaaggaaaacctatcaacttaacagtggatttctcagcagaacccctacawgctagaaaggattggggccctatcttcagtctccttaaagaaagcaattatcagccaagaattctgtatccagtgaaactaagcttcataaatgaaggaaagatacagtgtgtttcagacaaacaaatactgagagaattcaccactaccaagccagcactacaagagctgccaaaaggagccctaaatcttaaatcctggaaacacatcaaaacagaacctctttaaagaataaatctcacaggacctacaaaacaaaaatacaattaaaaaaaaagtggggggtatacaggcaacaga

SEQ ID NO: 160919 - DNA, 601 bp, Human
attcagcaaagtttccagatacaaaattaatgtacacaaattagctctcctatcaccaagagcaactaagctgagaatccaatcaagaactcaacccttttacaatagctgcaaaaaataaaataaaataaaatacttaggaatattcctaaccatggagatgtagttttacaaggaaaactacaaaacactgctaaagaaaatcatagatgacacaaatgaaaacacatccaatgctcaccgatgggtagaatcaatattgtgaaaatgaccatactgccaaaagcaatctacaaattcratgtaggtcccattaaaataccaccatcattcttcacagaactagaaaaaacaattctaaaattcatatggaaccaagaaagagcctgcatagccaaggcaagactaaacaaaacaaatctggaggcatcacattacctgatttcaaagtatactataaggccacagtcatcaaaacaacatggtagtggtacaaaaataggcacacagaccaattgaacagaatagagaaccgagtaataaccccaaatacttacagccaactgatctttgacaaagcaaacaaaaacaaaatggggaa

SEQ ID NO: 160920 - DNA, 601 bp, Human
agatgacacaaatgaaaacacatccaatgctcaccgatgggtagaatcaatattgtgaaaatgaccatactgccaaaagcaatctacaaattcgatgtaggtcccattaaaataccaccatcattcttcacagaactagaaaaaacaattctaaaattcatatggaaccaagaaagagcctgcatagccaaggcaagactaaacaaaacaaatctggaggcatcacattacctgatttcaaagtatactataaggccacagtcatcaaaacaacatggtagtggtacaaaaataggcacayagaccaattgaacagaatagagaaccgagtaataaccccaaatacttacagccaactgatctttgacaaagcaaacaaaaacaaaatggggaaagggcaccatattcaacaaatggtgctgtgattattggcatggaagaataaaactgttgcctcatttccaacttaatacaaaaaaaaaatcaacttgagatggatcaaggacttaaatctaagacctgaaactaaaaattctagaagataatatcagaaaaagccccttctagatgttggcttaggcaaggatttcatgatcaagaa

SEQ ID NO: 160921 - DNA, 601 bp, Human
ggaaccaagaaagagcctgcatagccaaggcaagactaaacaaaacaaatctggaggcatcacattacctgatttcaaagtatactataaggccacagtcatcaaaacaacatggtagtggtacaaaaataggcacacagaccaattgaacagaatagagaaccgagtaataaccccaaatacttacagccaactgatctttgacaaagcaaacaaaaacaaaatggggaaagggcaccatattcaacaaatggtgctgtgattattggcatggaagaataaaactgttgcctcatttccracttaatacaaaaaaaaaatcaacttgagatggatcaaggacttaaatctaagacctgaaactaaaaattctagaagataatatcagaaaaagccccttctagatgttggcttaggcaaggatttcatgatcaagaacccaaagcaaatgcaataaaaacaaaggtaaatagctgggacttaattaaactaaagagcttttgcatggcaaaaggaacagtcggcagagtaaacagacaacccacagagtggaagaaaatcttcacaatctatacatctgacagaggactaatatccagaa

SEQ ID NO: 160922 - DNA, 601 bp, Human
ataaggccacagtcatcaaaacaacatggtagtggtacaaaaataggcacacagaccaattgaacagaatagagaaccgagtaataaccccaaatacttacagccaactgatctttgacaaagcaaacaaaaacaaaatggggaaagggcaccatattcaacaaatggtgctgtgattattggcatggaagaataaaactgttgcctcatttccaacttaatacaaaaaaaaaatcaacttgagatggatcaaggacttaaatctaagacctgaaactaaaaattctagaagataatatcrgaaaaagccccttctagatgttggcttaggcaaggatttcatgatcaagaacccaaagcaaatgcaataaaaacaaaggtaaatagctgggacttaattaaactaaagagcttttgcatggcaaaaggaacagtcggcagagtaaacagacaacccacagagtggaagaaaatcttcacaatctatacatctgacagaggactaatatccagaatctacaataaactcaaacaaactagcaagaaaaaaactaataatcccatcagaaaataggctaagcacatgaatagacagtaatga

SEQ ID NO: 160923 - DNA, 601 bp, Human
acatggtagtggtacaaaaataggcacacagaccaattgaacagaatagagaaccgagtaataaccccaaatacttacagccaactgatctttgacaaagcaaacaaaaacaaaatggggaaagggcaccatattcaacaaatggtgctgtgattattggcatggaagaataaaactgttgcctcatttccaacttaatacaaaaaaaaaatcaacttgagatggatcaaggacttaaatctaagacctgaaactaaaaattctagaagataatatcagaaaaagccccttctagatgttkgcttaggcaaggatttcatgatcaagaacccaaagcaaatgcaataaaaacaaaggtaaatagctgggacttaattaaactaaagagcttttgcatggcaaaaggaacagtcggcagagtaaacagacaacccacagagtggaagaaaatcttcacaatctatacatctgacagaggactaatatccagaatctacaataaactcaaacaaactagcaagaaaaaaactaataatcccatcagaaaataggctaagcacatgaatagacagtaatgaagatatacaaatggccaacttat

SEQ ID NO: 160924 - DNA, 601 bp, Human
catgcaagaatgtccataatcaaataaaaaaataatagatgttggcatggatgcagtgaatagggaatacttctacactgctggtgggaatgtaaactaatacaaccactatggaaaacagtgtggagattccttgaagaactaaaagtagatttaccatttgatccagcaatcccactactgggtatctgcccagtagaaaagaagtcattatacaaaaaatatacttgcacacatgtttatagcagcacaattcacaattggaaaaatgtggaaccaacccaatgcccatcagttaacragtgaataaagaaactatggggccaggcatggtggctcacgcctgtaatcccaacactatgggaggacgaggcaggcagatcaccaagtcaggagatcaagaccatcctggctaacatggtgaaacctcgtctctactaaaaatacaaaaaattagccaggcatggtggcgggcgcctgtagtcccagctacgctggaggcttaggcaggaggatggcgtgaacccgggaggtggagcttgcagtgagccgagatggcaccactgcactccagcctgggtaacagtgcaagacgtgtctc

SEQ ID NO: 160925 - DNA, 601 bp, Human
atctttcctacaattgagagtatactgctgctaagcagccaaggagccttgattctcacactttaatgagcagaactataaagtgtgttaattgcatgagttctatgtcagagctgttattttctaacttaaccagtgttacagtagacatgactgcttttgagcagcagttcaagtttgtttcatcaaattataatcccaagaaatcttctacaaagaaagagttgcataggtagattagttatgcaaatagtaattatttttttctttgcctttgagattcacagcacacattaatactaaagaaacctctttaattttatttgaatccactgattgccaaactgtttgaccatggatcctttctgcaggtggcatctgttattacactggacgtactttggaaaaatgctgttctagaataagtttttaaaataattaaacaccaggttcaaatgtattacattcctgtagatccttagccagctgtgtgaatcacagctctctccttgtgttgttcttaaactttgaagatcatacctcaccctgaattccgtcttggagttcaacccttcaaaagtttgcactgactcacaaggtt

SEQ ID NO: 160926 - DNA, 601 bp, Human
gttagaaaaagctttctaaaacagattgatggggaaaaatgtattagatgccagaacacagctaccataaaaacttagttcttggactctatttagcaagtttgatcactaaacaagtttgggctcaaagcaaagatactttctaaaaatagttttctcaaaaaatttttatgaaatggaagcataaagcaaaccctttaaaaatattttagcaaatttggaaaatatttccaactacaattaattttgaagctgactcaggctttttaaaatgtccagaccttcaaattattaaaaataktgaaaatagagaaaattatttttaaaatattattgagacctcctactaaatcagatttagttcaagagttctaagacaacggaacccttggtggaatgaagaccaaaaagggtactagaaataaaggtgaacattttttttttcatctaacttttgccagatggtcttatatgttttctgtgtaataactttgtaataacaaaaacctatgagatatatacttacatcattccagtgacatggagatagtactgaggtaagagaggttcagtaatttgctcagtcagtgggatttattga

SEQ ID NO: 160927 - DNA, 601 bp, Human
aaaatattttagcaaatttggaaaatatttccaactacaattaattttgaagctgactcaggctttttaaaatgtccagaccttcaaattattaaaaatattgaaaatagagaaaattatttttaaaatattattgagacctcctactaaatcagatttagttcaagagttctaagacaacggaacccttggtggaatgaagaccaaaaagggtactagaaataaaggtgaacattttttttttcatctaacttttgccagatggtcttatatgttttctgtgtaataactttgtaataacaaaaacctatgagatatatacttacatcattccagtgacatggagatagtactgaggtaagagaggttcagtaatttgctcagtcagtgggatttattgaatccagagcttgatgtctcctctgtcatggagagaagacagagctctaagcaccatgagaaatgagggcagatggagaattttaagttctgctcagtctttttgcatgtaattcagttttcatatttgtaagattaaatcaaggggtaaaaagtacttaaaattttttcataaaagctttacctggaacatctgcagaac

SEQ ID NO: 160928 - DNA, 601 bp, Human
agtggtgtgatcatagttcactgcagccttgagctccctggctcaagcagtctcccacctcagcaccctgagtagctgggactgcagatgtgtgccaccatgactggctaatttttttattttttgtagagatggggtctcgctatgttgccaggctggtctcaagcgatcctcctgttttggcctgtcagagcactgggattaacgtcctgagccaccgtgcccagctgagaacttttttaaattccaagttttattcttgtttgtcaatcctaaggtaggtcaacatttaaggcagtgrcatttttacttctttggctttggtagcttctaagccttctgttttttaatatgaactgcagtggtcttttctacttaggcaatttaagttgtcatcttttgatgaatgtatttaaagctaaaagctttttccttttcttctgtggagaaaaaaactatgattaaatcaaatgattcatacaggacactgtcgcaaaaccactcaacaatgagttgactgattttaatgcatgttccttatgtttaaaattaaagtctataattctctgatattatttattgtaggatgtaattaaaacca

SEQ ID NO: 160929 - DNA, 601 bp, Human
caccgtgcccagctgagaacttttttaaattccaagttttattcttgtttgtcaatcctaaggtaggtcaacatttaaggcagtgacatttttacttctttggctttggtagcttctaagccttctgttttttaatatgaactgcagtggtcttttctacttaggcaatttaagttgtcatcttttgatgaatgtatttaaagctaaaagctttttccttttcttctgtggagaaaaaaactatgattaaatcaaatgattcatacaggacactgtcgcaaaaccactcaacaatgagttsactgattttaatgcatgttccttatgtttaaaattaaagtctataattctctgatattatttattgtaggatgtaattaaaaccattgtgcagagtggtggcatcaagcatctagttaccatggcaactagtgaacatgtaataatgcagaatgaagctcttgttgctttggcattaatagcagctttagaattgggtaagtaccccagtgacaaacttattttcttctatttttatcttggatgaaaggaagtatagaagtggagttgaagtcagacagaaccttgactggaagcattt

SEQ ID NO: 160930 - DNA, 601 bp, Human
tgttctatggacacctgaaaagagtgtgtattatgcagttattgggtactgttgtataaatgtgaatttgattctgttggtactagtgtcaagtttcctttattcttgctggttttgcagttaattgttctgtcaattgtcgagaggaagggtgttgaagtctcccactgtagatttacctatttctcctttcagttctgtcaatttttgcttaacataattttcagctctgttgttaggtacctacacctttaggattgctgtgctttcttaagggattgacccttttatcattatatartgtacctctctctggtatttttctttgctctcgtcaactttatctgactttaacatagctacttctgcttgtttttttattattactattttattttctttcatgtgccactacaagaagccatcctactttcttttgaataacattcacatgatcttttctcactcttttagtttcaatctgctgtatttgaagtgagtttcctgtatacagcacaaagttgtcattttctaatctactctaccagtcccttttgtgtatttagaccatttacatttaatggatgactgatatggctta

SEQ ID NO: 160931 - DNA, 601 bp, Human
tcttactgtggtttttatttgcgtttccctaatgattactgatgggaatctttttatgtgtttgtgggccatttgtatatcttctttggagaaatgtctattcaagtctttgcccatttttagaattgaagggtgttgttgttgttgttgttgaattgtaagagttttgttttttttgagacggagtttcgcacttgttgcccaggctgcagtgcaatggtgcaatctcggctcaccgtaacttccacctcccaggttcaagcgattctcctgcctcagcctcctgagtagctgggattayaggcatgcaccacctgtagagatggggtttctccatgttggtcaggctggtctcaaactcccgacctcaggtgatccacccaccttggcctcccaaagtgctgggataacaggcgtgagccaccacgcctggcccaagttgtaggattttgtaccagtaccccactatcttgattattgtagctttgtagtaagttttgatatcagttagtatgagaactccagctttgttcattttcaagattgttttggagatttagggtcccttgagattccatatgaattttaggatggatttttc

SEQ ID NO: 160932 - DNA, 601 bp, Human
cacagtgctgcgtgccgccaccaaggggaaagctcttcaaccaggttcagagccaagtcgctgagagttgcttctcatccttagcacatttcctaccaggggcaggatgagttaattttcgggatggggatctaactggctggcggtttaaagggcccttctatttagcagccatgagggctgctagagttcctatctcccattgaagaaggggcttcttcaagcagacagaccaaacatcatttcaaaatgaggactgcatttgaaatctactgaagggggtgataccgggggcctgaarcctggggtttgagctcacttctagggtgaccaattcttctgtttgcctgggactgtggggtttcctacgacaggattttcagtgctaaaactggaaaagtcctgggcaaatggagatgagctgctcactctagtttgaccccattctttctgtgttctcaccaactttcagtctttcattttgcagattgagagaatcaaggtactaataaaacctgctgtccccatctcccaaacccgtgggactcaaaagagctgacgtcagtatcccatggcaccttaagcctccccatcagggcac

SEQ ID NO: 160933 - DNA, 601 bp, Human
gaatttctgagacagcataattgaaatattcaattccaccatccccataaatatagaaatatttgtcagaccttatattctgaaggctggttcaggaaatatgggcctaataccatttacagctgctatttattgaactcttactatgtgccaggcacagagttaatctcatggatcactgcatctaaccttcacagagagactctctatggaaggggctactgctatatgcccattttacagccagggaaacaaaggctggaagaagttatgaacttttccaaagtcatgcagccaaaasttgccgtgctgacactgcagcctgtctgtctggctgggaagaactatggaaaacgcgtttctgatcaatgctggttaaccttccagggaccactcagcctggacttggggaggcccaaatgcaagggcatgcccaacccctctgtagtcaagatcaataatattttaaggaaggccgggcacggtggcgcatgccagcactttgggaggccgaggtgggctgatcacgaggtcaggagtttgagaccatcctgaccaacatggtaaaaccccgactctactaaaaatacaaaaattagcc

SEQ ID NO: 160934 - DNA, 601 bp, Human
cataacctctccggcaggtctctgagctccatgctcctgatgacaactggaacaaaatgattgccagaagttctctagactcaggaatttctgagacagcataattgaaatattcaattccaccatccccataaatatagaaatatttgtcagaccttatattctgaaggctggttcaggaaatatgggcctaataccatttacagctgctatttattgaactcttactatgtgccaggcacagagttaatctcatggatcactgcatctaaccttcacagagagactctctatggaaggkgctactgctatatgcccattttacagccagggaaacaaaggctggaagaagttatgaacttttccaaagtcatgcagccaaaagttgccgtgctgacactgcagcctgtctgtctggctgggaagaactatggaaaacgcgtttctgatcaatgctggttaaccttccagggaccactcagcctggacttggggaggcccaaatgcaagggcatgcccaacccctctgtagtcaagatcaataatattttaaggaaggccgggcacggtggcgcatgccagcactttgggaggccgaggt

SEQ ID NO: 160935 - DNA, 601 bp, Human
gctgggattataggcatgagccaccgcgcccggccaacccttgctttcttgataatttctttgagtagatcagctccagattctactgggagtgagcggggagcagttgaaggagatggcaaaggaggaaggaagcgcagagaacattcctcttacaataaactttccatttctggaggcttctcagccactcaatatggggtgcatttgccaggcccaactcaccccataacctctccggcaggtctctgagctccatgctcctgatgacaactggaacaaaatgattgccagaagttcyctagactcaggaatttctgagacagcataattgaaatattcaattccaccatccccataaatatagaaatatttgtcagaccttatattctgaaggctggttcaggaaatatgggcctaataccatttacagctgctatttattgaactcttactatgtgccaggcacagagttaatctcatggatcactgcatctaaccttcacagagagactctctatggaaggggctactgctatatgcccattttacagccagggaaacaaaggctggaagaagttatgaacttttccaaagtcat

SEQ ID NO: 160936 - DNA, 601 bp, Human
gggtgacagagtgagactccgtctcaaaaaagaaaaagaaaaagaaaatacactctccaggaggtatttgcacactcatgttcattgcagcattattcacaactgccaagaggtggaagcaacctacatgttcatcaacagatgaatggataaagaaatttggtggccgggcacagtggctcacgcctgtagtcccagcactttgggaggctgaggcaggcagatcacaaggtcaagaaattgagactatcctggccaacatggtgaaaccccgtctctattaaaaatacaaaaattagcygggcgtggtggcgtgtgcctgtagtcccagctacttgggaggctgaggcaggagaatcacttgaatacgggaggcggaggttgcagtgagccgagatcgcgccactgcactccagcctggcaacagagtgagactccgtctcaaaaaaaaaaaaaagaagaaagaaatttggtatatccatacaatggaatgttattgtcttcagaaagaaggaggccaggcatggtggctcacacctataattccagcactttgggaggccaaggtgggaggactgctagaagccctgagttcaacacc

SEQ ID NO: 160937 - DNA, 601 bp, Human
tttgtatttttagtagaaatgggatttcaccattttggccaggatggttttgatttcttgagctcatgatccgcccacctcggcctcccaaagtgctgggattacaggcgtgagccaccgcacccggccaactgcctccactttttatgtctgtacttgttggtgtaagataggaaatcagggatctgcttgtggctagaaacaacttcctgtctcagtggaaaagctctaccagccgacaggaccctgagctaggaaagctctggggtcaggcacacatctgggtgctgctttcactaawggggttttcaactgaagggtctgtgccacagtttgaaccttgtcccttgttcctgtccccgtacagtcctgtacagtccctataagggcagaattgtgcttccctccccaattcctatgttgaagccctaaccccagtaccttagagtgtgtctgtatttggacatagggcctttaaagaagggattaagttaaaatgaggctgttagggtgggtcccaatccaatctgcctgatatgcttataagaaggggagattaggggctcatgcctgtaatcccagcactttgggaggccaaggc

SEQ ID NO: 160938 - DNA, 601 bp, Human
tccagcccatgcctcttttctcctttcctctgtcaaacagctcccttctttagagattcactcctaaaactgcctccactttttttttttttttttgagacagagtctggctctgtcacccaggctggagtgcaatggtgtgatccagctcactgcaacctccacttcccaggttcaagcgattctcctgcctcagcctcctgagtagctgggactgtaggcgcatgccaccacgcccagctaatttttgtatttttagtagaaatgggatttcaccattttggccaggatggttttgatytcttgagctcatgatccgcccacctcggcctcccaaagtgctgggattacaggcgtgagccaccgcacccggccaactgcctccactttttatgtctgtacttgttggtgtaagataggaaatcagggatctgcttgtggctagaaacaacttcctgtctcagtggaaaagctctaccagccgacaggaccctgagctaggaaagctctggggtcaggcacacatctgggtgctgctttcactaaaggggttttcaactgaagggtctgtgccacagtttgaaccttgtcccttgttcct

SEQ ID NO: 160939 - DNA, 601 bp, Human
caaagtgctgggattacaggtgtgagccaccgtgcccagcctaccattgccttttttttttttttttgagacggaatctcactctgtctccccagctggagtgcagtggcacgatcttggctcacagcaacctctacctccctggttcaagcgattttcctgcctcagcctcctgattagctgggactacaggtgtgagccaacacgcccagctaatttttgtatttttagtagagacagggtttcatcatgttggtcaggctggtctcaaactcctgacctcaagtgatccacccacctyggcctcccaaatagctgggattacaggcgtgagccaccgcatccagcccatgcctcttttctcctttcctctgtcaaacagctcccttctttagagattcactcctaaaactgcctccactttttttttttttttttgagacagagtctggctctgtcacccaggctggagtgcaatggtgtgatccagctcactgcaacctccacttcccaggttcaagcgattctcctgcctcagcctcctgagtagctgggactgtaggcgcatgccaccacgcccagctaatttttgtatttttag

SEQ ID NO: 160940 - DNA, 601 bp, Human
tcattttataggtgagcttagagaaggtaaggaactcctgtaaggacacacggcaagttaggggcagaattgggcctagaacccagattttcttgttaggaagctctttccaccctattgggctgtctcctattttatcctcttaattattccattaggtaggtaaggtacacattagcccgttgaacatatgagcaattaagatccagagactaaatgacttgcccaaggcccctgggaccagtctagggctatagcctcatgtcacgctgccctcgggggaggatgagtatggaggctrtgcctatcttagggacattgtctgagtctgggttcagatctctctccctgggactccccagagagggaaaaagaagggaatatttggagcatgacatcagtaggtgaaaccttggcaaatcctcggaaaacggtgtctgtggcttcctgcactgtcacagcatagacactttgatgtccccgtaagctctcctactttcagcctcagaaggaggggtcaaagcccgtcgaaatagacaagactgggatggagccagcccgagactggttggatgttcacatccaggatctccctggcttc

SEQ ID NO: 160941 - DNA, 601 bp, Human
gtctcactttggtcacccaggctggagattggtcactgcaatggcgggatctcggctcaccgcaacctctgcctcctgggttcaagcgattctcctgcctcagcctctggagtagctgggattatgggtgcctgccgccacactaggctaatttttgtatttttagtagagatggggtttctccacgttggccaggctcgtctcgaactcctgacctcaggtgatccacctgcctcggcctcccaaagtgctgagattacaggcatgagccactgcacctggcctaggccactattgctgyagccttcagagttccacaattccaggcacaacaactagatgtgtcacatggcaatccacatcactcctgcgctgcttctctcttgggggccgcagatgcctcttccagaactgcggagggaggatgctggccctcagtgggctgcctctgtgattaggaaggagttgccccaccccagcccctgcatagccctcaccctctgctggagcagggctgtgagggaacagtcaaatgcccagagaaatgcaaacggtgtgcatgtgattgcggtttccaccatgagcttccacaccatccagg

SEQ ID NO: 160942 - DNA, 601 bp, Human
gtacaactttgttagggaggcttcctctcctctgtgggcctcagtttccccatgtgtagaagtatgggattggaccggattctgtttctgccagggagctggtgtcagaattccttcctggaacataagccttgatgccctacactccctactctctcttccattgagaacccttagccttgatgaagtctgaggctcttccaacttcacgtattcttgtctcagctcctagttcctcccttcagtcagatctgaggtcttgctgtgtgctctgttccaaagccctccccagccttcccamagctcaatgatcagggctctgctgggccgtttctctctccctgccttgagctgtgtggagggaagttatatatgcagacgtgtcggaggacctgttggtgaacctgggccttagcactcataggtgagtgaggcaccgaggaagagcttttggatcttgggcaagtcctttaggttcttggagcttcaatttcctcatttgcaaagcaggaatagctacacccgctgtgcttatcaggctgagaagtaacaggagctggatagcgggcgttaacacctagcacagtgcctggcatgtcac

SEQ ID NO: 160943 - DNA, 601 bp, Human
catgaaagtaactcatgctgggtggggcgcaggtggctcaggcctgtaatcccagcactttgggaggccgaggcgggcggatcataaggtcaggagatcgagaccatcctggctaacatggtgaaaccccgtctctactaaaaatacaaaaaattagccaggcgtggtggcgggcgcctgtagtcccagctactgggaaggctgaggcaggagaatggcatgaacctgggaggcggagcttgcagtgagccacgagtaccactgcactccagcctgggcaacagagaaagactctgtctcaaaaaaaaaaaaaaaaagaaaagaaaaagaaactaactcatgcttcccaagatggtctgttcccaggatagtacaactttgttagggaggcttcctctcctctgtgggcctcagtttccccatgtgtagaagtatgggattggaccggattctgtttctgccagggagctggtgtcagaattccttcctggaacataagccttgatgccctacactccctactctctcttccattgagaacccttagccttgatgaagtctgaggctcttccaacttcacgtattcttgtctcagctccta

SEQ ID NO: 160944 - DNA, 601 bp, Human
tgggaagcaagctatgaaagttgaagtggaagttacgctctctttgttctgcaacagtattacaaattgcaatatattcagcaagatggaaacactatgagcacttgcatgccgtttctgggagctgttcggtcaccctgctcatgggcacagttcctgtgcaccctgccacatgaaagtaactcatgctgggtggggcgcaggtggctcaggcctgtaatcccagcactttgggaggccgaggcgggcggatcataaggtcaggagatcgagaccatcctggctaacatggtgaaacccygtctctactaaaaatacaaaaaattagccaggcgtggtggcgggcgcctgtagtcccagctactgggaaggctgaggcaggagaatggcatgaacctgggaggcggagcttgcagtgagccacgagtaccactgcactccagcctgggcaacagagaaagactctgtctcaaaaaaaaaaaaaaaaagaaaagaaaaagaaactaactcatgcttcccaagatggtctgttcccaggatagtacaactttgttagggaggcttcctctcctctgtgggcctcagtttccccatgtgtaga

SEQ ID NO: 160945 - DNA, 601 bp, Human
cccacatctaccctcctccaagacctgcttaggtgtgcacaggtgccccatgatgtcccccaaataacttcccccaccccagttctgcaaatagggcagctgactactgccagccaagctatgccccatccctggccacctctcctctcctgtctcttattgccctgatttagcctctggggttccagtgccgatttccagcagaggaaacaggaagaagaagtctgggttgggaactgacggtctcagctaactccctgtgtgaacctgggggcaatacctactaatggtgggtgggatrgatattggctctgggagggcggttgtcccttgtcaacttcccagagtgggatcaacgttcaccactgttggaaatgatgaagggaccagaagtatgggaagcaagctatgaaagttgaagtggaagttacgctctctttgttctgcaacagtattacaaattgcaatatattcagcaagatggaaacactatgagcacttgcatgccgtttctgggagctgttcggtcaccctgctcatgggcacagttcctgtgcaccctgccacatgaaagtaactcatgctgggtggggcgcaggtg

SEQ ID NO: 160946 - DNA, 601 bp, Human
tgctaaataatcctgttatacagaagagccagcctcagacaggcccaggaaattgcccagtgtgcctgacagcttttaggtgacagaagggagatttgaacccagatccatctgattagagccaaggctctccatatctcctggctggctggctcaggttggggcctggagctggaccatggcagctgggcttgtcaccccttccagaggtcctggggtcaccaccctgtttgctacccacatctaccctcctccaagacctgcttaggtgtgcacaggtgccccatgatgtcccccaaayaacttcccccaccccagttctgcaaatagggcagctgactactgccagccaagctatgccccatccctggccacctctcctctcctgtctcttattgccctgatttagcctctggggttccagtgccgatttccagcagaggaaacaggaagaagaagtctgggttgggaactgacggtctcagctaactccctgtgtgaacctgggggcaatacctactaatggtgggtgggatggatattggctctgggagggcggttgtcccttgtcaacttcccagagtgggatcaacgttcacca

SEQ ID NO: 160947 - DNA, 601 bp, Human
aaaaaagaaaaatctaaaagtgctggacaaatatattctccaatttatcagctccacgagatgccattgaagggctgggatagaaacagatgcacttcttgaaggtttctgtgtgtgcccagaggcatctgcggctttaacctcaccacacagcggcctatgagtggatactgttcttaccccctttagcactcttaacatgggtttgtgtgataatttgattaatagctgtctccccagggaaacactttttctcaccctagcatctagccatagttgcttctgtacctggcacaactgmcccctaccgcgcccccaaccagttctgcacataattctcctagagagaagaggaaaaagtacttgctaagtatttgctaaataatcctgttatacagaagagccagcctcagacaggcccaggaaattgcccagtgtgcctgacagcttttaggtgacagaagggagatttgaacccagatccatctgattagagccaaggctctccatatctcctggctggctggctcaggttggggcctggagctggaccatggcagctgggcttgtcaccccttccagaggtcctggggtcaccacc

SEQ ID NO: 160948 - DNA, 601 bp, Human
aaagctacactgtcctttttattccttctggtgtcttacccatattagaattgggaagattttttatttttggtttccaatctcaggtacctgcctcccaccctccccccaccccaaactttcttttattcccaaagcataagaagctactcttggctgtttaatgacctctactccccagcccaccccccagcatgacattactggtggccataagcttgaggggtgagatgctctaaaacaaagcctcaaactatggtccccagatcagcagcatcagcattacctgagagcttgttasaaatgcaaatcctagcctcattccagacctactaagtcagaaactctggggatggcactcagcaatctatttttacaaaccctccagatgcgtctggtgcacagtcaagtccgctgctctaagacctcaccactcaaaggagtgcctgggtgccagcagcatcagtagcaccagggagctgttcagacctgaaggatctcaggcctgccccagacctacctacggaatcagaatctgccccagagggccaagtctggaaagccatctggagccctctgaagcaggctgcatgttagattc

SEQ ID NO: 160949 - DNA, 601 bp, Human
agccgagtcaggtagttatgatgggcaaactctgcctccagctctcgcagctgctccttggtgaaggccgtcctctccttgcgggctttgctgctgccctccggcttccctctgttctcctggttgtctggggagagaggaccccaaacaggaagacatgggctgagggagactccattccctttcttttgcccttgagcaactaggcagtctttaccagtctcccttatttttacaggatgctgagaaaaaagctacactgtcctttttattccttctggtgtcttacccatattagaaytgggaagattttttatttttggtttccaatctcaggtacctgcctcccaccctccccccaccccaaactttcttttattcccaaagcataagaagctactcttggctgtttaatgacctctactccccagcccaccccccagcatgacattactggtggccataagcttgaggggtgagatgctctaaaacaaagcctcaaactatggtccccagatcagcagcatcagcattacctgagagcttgttacaaatgcaaatcctagcctcattccagacctactaagtcagaaactctggg

SEQ ID NO: 160950 - DNA, 601 bp, Human; identical to SEQ ID NO: 30375

SEQ ID NO: 160951 - DNA, 601 bp, Human; identical to SEQ ID NO: 30376

SEQ ID NO: 160952 - DNA, 601 bp, Human; identical to SEQ ID NO: 30377

SEQ ID NO: 160953 - DNA, 601 bp, Human; identical to SEQ ID NO: 30378

SEQ ID NO: 160954 - DNA, 601 bp, Human; identical to SEQ ID NO: 30379

SEQ ID NO: 160955 - DNA, 601 bp, Human; identical to SEQ ID NO: 30380

SEQ ID NO: 160956 - DNA, 601 bp, Human; identical to SEQ ID NO: 160932

SEQ ID NO: 160957 - DNA, 601 bp, Human; identical to SEQ ID NO: 160933

SEQ ID NO: 160958 - DNA, 601 bp, Human; identical to SEQ ID NO: 160934

SEQ ID NO: 160959 - DNA, 601 bp, Human; identical to SEQ ID NO: 160935

SEQ ID NO: 160960 - DNA, 601 bp, Human; identical to SEQ ID NO: 160936

SEQ ID NO: 160961 - DNA, 601 bp, Human; identical to SEQ ID NO: 160937

SEQ ID NO: 160962 - DNA, 601 bp, Human; identical to SEQ ID NO: 160938

SEQ ID NO: 160963 - DNA, 601 bp, Human; identical to SEQ ID NO: 160939

SEQ ID NO: 160964 - DNA, 601 bp, Human; identical to SEQ ID NO: 160940

SEQ ID NO: 160965 - DNA, 601 bp, Human; identical to SEQ ID NO: 160941

SEQ ID NO: 160966 - DNA, 601 bp, Human; identical to SEQ ID NO: 160942

SEQ ID NO: 160967 - DNA, 601 bp, Human; identical to SEQ ID NO: 160943

SEQ ID NO: 160968 - DNA, 601 bp, Human; identical to SEQ ID NO: 160944

SEQ ID NO: 160969 - DNA, 601 bp, Human; identical to SEQ ID NO: 160945

SEQ ID NO: 160970 - DNA, 601 bp, Human; identical to SEQ ID NO: 160946

SEQ ID NO: 160971 - DNA, 601 bp, Human; identical to SEQ ID NO: 160947

SEQ ID NO: 160972 - DNA, 601 bp, Human; identical to SEQ ID NO: 160948

SEQ ID NO: 160973 - DNA, 601 bp, Human; identical to SEQ ID NO: 160949

SEQ ID NO: 160974 - DNA, 601 bp, Human; identical to SEQ ID NO: 30375

SEQ ID NO: 160975 - DNA, 601 bp, Human; identical to SEQ ID NO: 30376

SEQ ID NO: 160976 - DNA, 601 bp, Human; identical to SEQ ID NO: 30377

SEQ ID NO: 160977 - DNA, 601 bp, Human; identical to SEQ ID NO: 30378

SEQ ID NO: 160978 - DNA, 601 bp, Human; identical to SEQ ID NO: 30379

SEQ ID NO: 160979 - DNA, 601 bp, Human; identical to SEQ ID NO: 30380

SEQ ID NO: 160980 - DNA, 601 bp, Human
acagcaccacacagttatcttccacttacctacttgtcaatggacaggcggaagccccgcctctctttccacaaccggaccccaaatctcagccccagtagtgagcccgccccatgttacgtcaccaagaggcacgaggtcacgcccccgggttagcgggcgcgaccctccacgcaacccacgcctctcccttaaagagcgcacgggcccgagcctgatccccgaccccgggccaggctgggtcgaggtcacatcgcatcaggatgtggttctcccacaccagctcgacccccgacgctaytcaccttcacctccaggatatggcgctgcctccagcagaattcggccccctccgtgtcacgtgacccgggagcgtggccgtgcccgggtggcccacttggctcagcggcgccccgtagtccggcccgatgcgcatgcgcacagtcggagccccgctccggggccacccgaaagagccttgcctctactggccgcctccctcatagaccccgcctccccttgcctttcattggctcgcactgcagacctcacacccattttatgttttaaaaccaggaggccacgcccctcagcggcttca

SEQ ID NO: 160981 - DNA, 601 bp, Human
ggctcggggtgaagccatgcctctccgtgacaaggtcacgcccctcgcggggctagccccagtcctttacatcaccaccactcccacccaaactagccaccacaagtcaaggtggcgacgacagcaccacacagttatcttccacttacctacttgtcaatggacaggcggaagccccgcctctctttccacaaccggaccccaaatctcagccccagtagtgagcccgccccatgttacgtcaccaagaggcacgaggtcacgcccccgggttagcgggcgcgaccctccacgcaacccmcgcctctcccttaaagagcgcacgggcccgagcctgatccccgaccccgggccaggctgggtcgaggtcacatcgcatcaggatgtggttctcccacaccagctcgacccccgacgctattcaccttcacctccaggatatggcgctgcctccagcagaattcggccccctccgtgtcacgtgacccgggagcgtggccgtgcccgggtggcccacttggctcagcggcgccccgtagtccggcccgatgcgcatgcgcacagtcggagccccgctccggggccacccgaaagagccttg

SEQ ID NO: 160982 - DNA, 601 bp, Human
cagggcttagttgacaggctgccagccaccatgtgcctggcacgggagtgagctgctggcacagactgtgccgaggcctcccaactccagctgcctcacagccctacacatccaaggcttgctttaaatctcctaagtcctgaaggtcagtggcatcactcctggctagcagaggaagcagtagagaagggtttggggagggagaggtcaagcttggtccctgctaggagagaaagggttgaggagggggtctggggaaggggtaaatttcaaacagaggtgcaaggagtttagggggacrcctgtggggtcagctctctccaaacatgtcacctagggcaaaccaccacacaatctctctgagcctcagcttcctcttgcagaaaatgaagacagaaagaacagcacctactttcaaggaaaaggtaaggggtaggtaagaaagtctacagtactgagctcagcagagggcaactgttatgaaactgtcactgccaccccctcgctggagcctgccctctgccccatttatcccatccaggttagggagcacagagtgctgtccatctgttctgtgaaaagagtcactggggaaggaggt

SEQ ID NO: 160983 - DNA, 601 bp, Human
gatcccagcctccctgatgccctcctgatggacgctaaacaggcccagggcttagttgacaggctgccagccaccatgtgcctggcacgggagtgagctgctggcacagactgtgccgaggcctcccaactccagctgcctcacagccctacacatccaaggcttgctttaaatctcctaagtcctgaaggtcagtggcatcactcctggctagcagaggaagcagtagagaagggtttggggagggagaggtcaagcttggtccctgctaggagagaaagggttgaggagggggtctggrgaaggggtaaatttcaaacagaggtgcaaggagtttagggggacgcctgtggggtcagctctctccaaacatgtcacctagggcaaaccaccacacaatctctctgagcctcagcttcctcttgcagaaaatgaagacagaaagaacagcacctactttcaaggaaaaggtaaggggtaggtaagaaagtctacagtactgagctcagcagagggcaactgttatgaaactgtcactgccaccccctcgctggagcctgccctctgccccatttatcccatccaggttagggagcacaga

SEQ ID NO: 160984 - DNA, 601 bp, Human
ctgggctcctgatcccagcctccctgatgccctcctgatggacgctaaacaggcccagggcttagttgacaggctgccagccaccatgtgcctggcacgggagtgagctgctggcacagactgtgccgaggcctcccaactccagctgcctcacagccctacacatccaaggcttgctttaaatctcctaagtcctgaaggtcagtggcatcactcctggctagcagaggaagcagtagagaagggtttggggagggagaggtcaagcttggtccctgctaggagagaaagggttgaggarggggtctggggaaggggtaaatttcaaacagaggtgcaaggagtttagggggacgcctgtggggtcagctctctccaaacatgtcacctagggcaaaccaccacacaatctctctgagcctcagcttcctcttgcagaaaatgaagacagaaagaacagcacctactttcaaggaaaaggtaaggggtaggtaagaaagtctacagtactgagctcagcagagggcaactgttatgaaactgtcactgccaccccctcgctggagcctgccctctgccccatttatcccatccaggttag

SEQ ID NO: 160985 - DNA, 601 bp, Human
ctcagcacagcggccacgttctctccgccatgccggacgcttgccttgtccacctgggcccaaggacaggtggagcaataaagttaaaggccagggcagagggcagctgggaaagggggcaatccccctgccccaggtaagggggcaggagcagggtgagaggtcaagagaagcttggtcttggttaggcatatattatactacatgccaggctcaaaccaaggcataacatcttatcagatcctcttgtcattacatccctcttacagctgaggacatcaaggcttgcccaagtaagackgaaagttcaatagaacccacgctcttaagtgccccactgttacactgcctgtctccaggatggcagggcaatcagggagagaggagagggttatataacccagggggtttggccaggggcacaacgcacgcagagcagatggcagggagccatctgctgtgactcctccctgccctccagtatccttgcagagcctggcagctgggctcctgatcccagcctccctgatgccctcctgatggacgctaaacaggcccagggcttagttgacaggctgccagccaccatgtgcctggcacg

SEQ ID NO: 160986 - DNA, 601 bp, Human
agttcattcctgcctcaggacctttgcacatgctgttccttctacctggaatgctctccccccagctgtctcctcccagtccacatgtgaatcaaaggaggatgggtgtgggctggaagctgcaggagagaacgggggataaaggagggaatggcaggggtggggctattcaccaggagaccactcggcccacgaggcccttgggtggcttggctggcaccatctccttctggaccatgaagtaggggtacagcacgtcaacgggcagctccacaaacaccggacctgcagggacagggargacgctgagtccataacatgtccccagcccctcggccccagcactgctcagcatcaccatcctccacctacctggggtgcccgactgggcggcagccatcgcggccctcagggtgggcacaatgtcccgcaccctccgcacagacacacaaaacttacagagtggccggaaaagggacagctgatcaacagcctggagcgcaccccggttctggcaaagacagaggtgtggcagggttatcgcatgagcccttcaagcccccctaggcccccactggcccccaaggactgggtacctgca

SEQ ID NO: 160987 - DNA, 601 bp, Human
tctcccctttgctgcctccacgagggccgccttgctttccctacccacccagttcattcctgcctcaggacctttgcacatgctgttccttctacctggaatgctctccccccagctgtctcctcccagtccacatgtgaatcaaaggaggatgggtgtgggctggaagctgcaggagagaacgggggataaaggagggaatggcaggggtggggctattcaccaggagaccactcggcccacgaggcccttgggtggcttggctggcaccatctccttctggaccatgaagtaggggtamagcacgtcaacgggcagctccacaaacaccggacctgcagggacagggaggacgctgagtccataacatgtccccagcccctcggccccagcactgctcagcatcaccatcctccacctacctggggtgcccgactgggcggcagccatcgcggccctcagggtgggcacaatgtcccgcaccctccgcacagacacacaaaacttacagagtggccggaaaagggacagctgatcaacagcctggagcgcaccccggttctggcaaagacagaggtgtggcagggttatcgcatgagcc

SEQ ID NO: 160988 - DNA, 601 bp, Human
ctgccacttcttagctgtgtgactttgggcaagtgacttcacctttctgagcttcctcctctgtaaatgtaagaatgaacctcccttccgaggttcaaggatcatcctttaggaggaggaaaacggagaggacgatgggaaaggtggtgggggaaagggaggagaagaggaaggaagagggaggaggaagaggaggaagaagagatgatggaggaggagaagaaagggaaaaggaggaggaggagggctgtcctgagcctctcccctttgctgcctccacgagggccgccttgctttcccyacccacccagttcattcctgcctcaggacctttgcacatgctgttccttctacctggaatgctctccccccagctgtctcctcccagtccacatgtgaatcaaaggaggatgggtgtgggctggaagctgcaggagagaacgggggataaaggagggaatggcaggggtggggctattcaccaggagaccactcggcccacgaggcccttgggtggcttggctggcaccatctccttctggaccatgaagtaggggtacagcacgtcaacgggcagctccacaaacaccggacctgcagg

SEQ ID NO: 160989 - DNA, 601 bp, Human
ttttttttgtatttttagtagagatggggtttcaccatgttagccaggatggtctcgatctcctgacctcgtgatctgcccacctcggcctcccaatgtgctgggattacaagtgagagccaccgcacccggcctgggctctgccacttcttagctgtgtgactttgggcaagtgacttcacctttctgagcttcctcctctgtaaatgtaagaatgaacctcccttccgaggttcaaggatcatcctttaggaggaggaaaacggagaggacgatgggaaaggtggtgggggaaagggargagaagaggaaggaagagggaggaggaagaggaggaagaagagatgatggaggaggagaagaaagggaaaaggaggaggaggagggctgtcctgagcctctcccctttgctgcctccacgagggccgccttgctttccctacccacccagttcattcctgcctcaggacctttgcacatgctgttccttctacctggaatgctctccccccagctgtctcctcccagtccacatgtgaatcaaaggaggatgggtgtgggctggaagctgcaggagagaacgggggataaaggagggaat

SEQ ID NO: 160990 - DNA, 601 bp, Human
gggccctggagacacaaagatagatcctgcccagccctcccctcagggggcgctctatccagcgaaagacagacacatgggcattggcaggaaacagtcggagctcagagtcagaagcctctgctttcaccgttaaggacaggccaagacagcacagaagcagcccaggatggaaccgtgggaagccccgcaagtaaagaaaaggcaagggaggctgaggcaggaggattgctcgaggccaggagttcaaggctgtggtgagctatgatcataccactgcactccagcctgggtgatagastgaggccctgtctcaaaacaaaacaaaacaaaaaaggcaagataagagatagccttgtgagaggcagcccaagagagaggggcaaggagaacaaggggagggactgactgggaagccagggggcaaagtgcattaagaatgaggctatatgaccaaaatggtgaaacctcatctctactaaaaatacaaaaattagctgggtatggtggactgcacctgtattcccagctactccgggggctgaggcaggagaatcacttgaacccgggaggtggaggttgcagtgagccaagatcgcac

SEQ ID NO: 160991 - DNA, 601 bp, Human
ctgtctttttatttatttatttttttgagacacagtttcactctgttgcccaggatagagtgtaatggcatgatctcagctcactgcagcctccacctcccaggttcaaacgattctcccgcctcagcctccagagtagctgggattacaggcgcgtgccaccatgcctggctaacttttgtattttcagtagagacagggtttcaccatgttggccaggctagtcttgaactcctggcctcaagtgatccgcctgcctcggcctccctaagtgttgggattgctgctgtgagccaccgcrtccagccaaagggccgcccttgagtcgccatgagcacccaagattaaggccccagtactgactcagggagagggtcagggggccctctcccctcagggagagggtagggtcctcagacacaaaagagaggcaattcacctgctgcggggaagcctgggggatgtccaggggcagcggtccctcgggctgaggctcccaggctcctgcaaagaggttggccaggtaattctctaaatacctgcaaaagggagggggaagaaaccaagttgccagaattaactaactacaaggattccagga

SEQ ID NO: 160992 - DNA, 601 bp, Human
agggcagggctggcgcttctcaccgaagcttgtcggcagacgttggggtgagcagggcctgactccccagcaccatcagaggcctcttggcccggctcaggatctccacacagcgctgaacctggagcgagaggtggggatcaaagggctgtctttttatttatttatttttttgagacacagtttcactctgttgcccaggatagagtgtaatggcatgatctcagctcactgcagcctccacctcccaggttcaaacgattctcccgcctcagcctccagagtagctgggattacaggygcgtgccaccatgcctggctaacttttgtattttcagtagagacagggtttcaccatgttggccaggctagtcttgaactcctggcctcaagtgatccgcctgcctcggcctccctaagtgttgggattgctgctgtgagccaccgcgtccagccaaagggccgcccttgagtcgccatgagcacccaagattaaggccccagtactgactcagggagagggtcagggggccctctcccctcagggagagggtagggtcctcagacacaaaagagaggcaattcacctgctgcggggaag

SEQ ID NO: 160993 - DNA, 601 bp, Human
catgaatgagcccagccaaaaccacagctaccacctaccttataggtggatcttgagaaatcagaaatgcatttttagccattgagtttggggatggttgttacagggcagtagctatctgatacacctattatgcgtctggttgggttcaaagcgctttatgtgaaaatgtgtatcaagtacaataggtgcccactagaccttcctcctccttcgtgtgaagctgggtaacagggtgagggggttcctgggggaaggagggaaaggaagaggctcaggcccacctgctaggacaatgacrtccgccttcttcagggccgcactgcggttctcccggatgtggagggggtggttgcggcctaacagcccccgtgccatccctccaaggaagcagggaacacccaaggtctccacggcagccctgggagtccaggcagagcagaggtcagtgtggccggggcctcccgcctccccaagagcacccgaggactggggactgggaacgtgaaaacaagggcagggctggcgcttctcaccgaagcttgtcggcagacgttggggtgagcagggcctgactccccagcaccatcagaggcctctt

SEQ ID NO: 160994 - DNA, 601 bp, Human
ctccactcactctcttgaataaccgcactctcctagccccatagttttctcatccttcaccaagtcggccagcccaggctagcctactggaggatgagaaacaagggggccatggagacaggggtgaagaactctatgaccccagctgaggccatcccagacgagctgcagggccagccaatccccatacaggtgagcaagcccagcctggatcagcacagctgccttcctgcctaacccaagtgcagactcatgaatgagcccagccaaaaccacagctaccacctaccttataggtggrtcttgagaaatcagaaatgcatttttagccattgagtttggggatggttgttacagggcagtagctatctgatacacctattatgcgtctggttgggttcaaagcgctttatgtgaaaatgtgtatcaagtacaataggtgcccactagaccttcctcctccttcgtgtgaagctgggtaacagggtgagggggttcctgggggaaggagggaaaggaagaggctcaggcccacctgctaggacaatgacatccgccttcttcagggccgcactgcggttctcccggatgtggagggggt

SEQ ID NO: 160995 - DNA, 601 bp, Human
tgccagaaccaggggagggcagcccaggtgaaaagggaagacaaggcccaagaaacaagggttaaggagcacaaggcaggtgacaaacccaagctggcctcgtcccctccctccacctccttctgcctgggaaacactcaatgaaaagagctacatccaccaagcacatctctcaaatccaggcacgtggaagcgcacagcgaacgttactgaagtgaactaacaaacagccccgtgatgtatctttcaccaccccatttttcaaatgatcaaatggaggctctgagaaggtgaggctctsccgctgttcatctccagttcaggcctcctcgcttctgtcctggccattttgagcagcccccctggcctccacccagcccccttccggcctgccgtccatggctgctgagtggaccttcccaacacagatgcaacggtgctacttctctgcttaatacaagagtgtcctgtcgcctaggctgcaggggagtcaacatcctcagaatgatgaaccaagttcaagtccaaggggactaaaataaggggaggggagagatacggcaggaagacaggctaaggggccaacgagtgtgctctctgt

SEQ ID NO: 160996 - DNA, 601 bp, Human
gacgaatgtatcaaattcgatgaggctgtagccaaaagctccgtccccaaacaggcaccagacctagtcgggaggggacccaggatggttagggtggatcaggacctagagagcagcaagtctcccaactccagtgcctcacctcagcatctggccggcacagcttggccccaagtgcaaatcctgcaccaactcccagagtcccaaaggcccctaagaggaccaagagcaggtgggtgtgaaggcgtcctgatggatggtgcccactgccccaggcgggggcccttccttaccaggatcragccagcgcagggggccgcggggctgtaccagatgggcagcagtgcccacgaagtccccaccatccaccaccagaattgagttgtcaggtagcgtttcctccaccagctgcagcacctgcactgggttcaggtgctgggccacaggcatcgctgccttctccctgcgacaggacagcgaaggtcaccagggttggcagcagggtctgccgggaacccccttcccacatccactccacccaggccccaccgaaaggtctgctccttctgccggtcggcttcccgcagctcctccacccagt

SEQ ID NO: 160997 - DNA, 601 bp, Human
gtccgtgtctgtgcaaatgtaaatgtgtaaatgtgtgtgtatatatccaggatatgtgacggtagacattcacttgtgaacaggtataggtgtctgtatacaggggcatatacacatgaatctgcacaggtgttttcctggacatctataggtgtgatttgtgtgtatcttactattttcaaacatgggagtgtacgtgttcttaagctcataagtgtgtgcacgtgtactcaagagaatgcatgtagagatgtgaatgtgtttataagttccaacatacatgcacaagtgtgcatgtttttgtttgcacctataagttcaatgcacgcatatgtgtgtgtgcatagtaaagtgtttgtacattgtatatgtatatatgtgagtgtgtgtgtacacatggatatgcatgtaacattgtgtgcacacacagttgtgtttgcacacatgtgtattcatctgtgtggtgtgtctttatgtggggggttgagggtgactggtgggactgggacgtgtgtgcaggtgagaatgaaggggtgcagcaaagagatgtgtagaggccaggaatttccctgaagtccccgcctttccctgaagtccccgc

SEQ ID NO: 160998 - DNA, 601 bp, Human
gtctgggtcgctcagccccaggcagggtccatccatcccaagaagggtagggcaagggtgggagtgagggagagaaatatcctatgagtgtgtgtatttgtgtgtgcactgatgtgtgcagacattgtagaaatgtatgcatgtatgggttaccatattgatattgtgtaaatgtgtgtccgtgtctgtgcaaatgtaaatgtgtaaatgtgtgtgtatatatccaggatatgtgacggtagacattcacttgtgaacaggtataggtgtctgtatacaggggcatatacacatgaatctrcacaggtgttttcctggacatctataggtgtgatttgtgtgtatcttactattttcaaacatgggagtgtacgtgttcttaagctcataagtgtgtgcacgtgtactcaagagaatgcatgtagagatgtgaatgtgtttataagttccaacatacatgcacaagtgtgcatgtttgtgtttgcacctataagttcaatgcacgcatatgtgtgtgtgcatagtaaagtgtttgtacattgtatatgtatatatgtgagtgtgtgtgtacacatggatatgcatgtaacattgtgtgcac

SEQ ID NO: 160999 - DNA, 601 bp, Human
gcataagccaaccatactcccatcccaccctctacccactaagctgtcacctccatctcactcaccttccacaccttaatcgacaccccactccctgcacatccataccatagcccagccaccctccctggttgcccttccaagactttctctcacttctttgtgatactaagccccttgcaggctggcattttacctccaaggaaaaggacaggaagcctactgagatgagtggtgtggggtcatatggggtctggaacctgggaccgattgggacctgggctttgtttggccaaggacsctggaccagacacaggctccatgtttgaggtgccgcgtcaaggaagtggtcccatgcttgggatggccttggctctgggttcaagctgaggctctagacgggtcttggaggccaacactggcctgggctctctcacctgtgaccaggctggagacaatgagaggtaacaccagcatctgcagcatcctcatcagaagctctccaggaaaagagaagtacttgatctggcggtaggtgagctgatatgggcgcagggcaaaggccaggctgacccctagggccaaaagaaggggtccatgg

SEQ ID NO: 161000 - DNA, 601 bp, Human
tttgtggacccctgcataagccaaccatactcccatcccaccctctacccactaagctgtcacctccatctcactcaccttccacaccttaatcgacaccccactccctgcacatccataccatagcccagccaccctccctggttgcccttccaagactttctctcacttctttgtgatactaagccccttgcaggctggcattttacctccaaggaaaaggacaggaagcctactgagatgagtggtgtggggtcatatggggtctggaacctgggaccgattgggacctgggctttgyttggccaaggacgctggaccagacacaggctccatgtttgaggtgccgcgtcaaggaagtggtcccatgcttgggatggccttggctctgggttcaagctgaggctctagacgggtcttggaggccaacactggcctgggctctctcacctgtgaccaggctggagacaatgagaggtaacaccagcatctgcagcatcctcatcagaagctctccaggaaaagagaagtacttgatctggcggtaggtgagctgatatgggcgcagggcaaaggccaggctgacccctagggccaaaag

SEQ ID NO: 161001 - DNA, 601 bp, Human
gagcaagattttgttaaaaacaaaagaaaacaaaacagttatatgtggattttttactgtgtgggggttggtgcccctaacacccaaattgttcaagggtcaaccctagttgcaaaagagaccatatggcccttgaagctgaaaatgtttactatccagccctctaaagcaaaagtttgtggacccctgcataagccaaccatactcccatcccaccctctacccactaagctgtcacctccatctcactcaccttccacaccttaatcgacaccccactccctgcacatccataccatakcccagccaccctccctggttgcccttccaagactttctctcacttctttgtgatactaagccccttgcaggctggcattttacctccaaggaaaaggacaggaagcctactgagatgagtggtgtggggtcatatggggtctggaacctgggaccgattgggacctgggctttgtttggccaaggacgctggaccagacacaggctccatgtttgaggtgccgcgtcaaggaagtggtcccatgcttgggatggccttggctctgggttcaagctgaggctctagacgggtcttggaggc

SEQ ID NO: 161002 - DNA, 601 bp, Human
aaagttacatgtgagccgggcgtggtggctcatgcctgctatcccagcactttgggaggccgaggtgcgcagatcatgaggtcaggaaatcgatatcatcctgaccaatatggtgaaaccccaactctactaaaatacaaaaaattagctgggcgtgttggtgcgtgcctgtagtcccagctactcgggaggctgaagtggaggaattgcttgaacctgggaggtggagattgcagtgagccaagatggtgccactgcaccccagcctggtaacagagcaagattttgttaaaaacaaaakaaaacaaaacagttatatgtggattttttactgtgtgggggttggtgcccctaacacccaaattgttcaagggtcaaccctagttgcaaaagagaccatatggcccttgaagctgaaaatgtttactatccagccctctaaagcaaaagtttgtggacccctgcataagccaaccatactcccatcccaccctctacccactaagctgtcacctccatctcactcaccttccacaccttaatcgacaccccactccctgcacatccataccatagcccagccaccctccctggttgccct

SEQ ID NO: 161003 - DNA, 601 bp, Human
aggcttccagtcaatagtaggctattagtagttaagcttttcgggagtcaaaagttacatgtgagccgggcgtggtggctcatgcctgctatcccagcactttgggaggccgaggtgcgcagatcatgaggtcaggaaatcgatatcatcctgaccaatatggtgaaaccccaactctactaaaatacaaaaaattagctgggcgtgttggtgcgtgcctgtagtcccagctactcgggaggctgaagtggaggaattgcttgaacctgggaggtggagattgcagtgagccaagatggtrccactgcaccccagcctggtaacagagcaagattttgttaaaaacaaaagaaaacaaaacagttatatgtggattttttactgtgtgggggttggtgcccctaacacccaaattgttcaagggtcaaccctagttgcaaaagagaccatatggcccttgaagctgaaaatgtttactatccagccctctaaagcaaaagtttgtggacccctgcataagccaaccatactcccatcccaccctctacccactaagctgtcacctccatctcactcaccttccacaccttaatcgacaccc

SEQ ID NO: 161004 - DNA, 601 bp, Human
ggcggtgcttgcagtgagcggagattgtgccactgcactccagcctgggcaacggagcgacactctgtctcaaaaaaaaaaagaatatagtatataatacttacagcatacaaaatatgagttagtcaactgtttatgctctctgtaaggcttccagtcaatagtaggctattagtagttaagcttttcgggagtcaaaagttacatgtgagccgggcgtggtggctcatgcctgctatcccagcactttgggaggccgaggtgcgcagatcatgaggtcaggaaatcgatatcatcctgrccaatatggtgaaaccccaactctactaaaatacaaaaaattagctgggcgtgttggtgcgtgcctgtagtcccagctactcgggaggctgaagtggaggaattgcttgaacctgggaggtggagattgcagtgagccaagatggtgccactgcaccccagcctggtaacagagcaagattttgttaaaaacaaaagaaaacaaaacagttatatgtggattttttactgtgtgggggttggtgcccctaacacccaaattgttcaagggtcaaccctagttgcaaaagagaccatatgg

SEQ ID NO: 161005 - DNA, 601 bp, Human
ggcatggtggcgggtgcctgtagttccagctactcaggaggctgaggcaggagaatggcatgaacccaggaggcggtgcttgcagtgagcggagattgtgccactgcactccagcctgggcaacggagcgacactctgtctcaaaaaaaaaaagaatatagtatataatacttacagcatacaaaatatgagttagtcaactgtttatgctctctgtaaggcttccagtcaatagtaggctattagtagttaagcttttcgggagtcaaaagttacatgtgagccgggcgtggtggctcaygcctgctatcccagcactttgggaggccgaggtgcgcagatcatgaggtcaggaaatcgatatcatcctgaccaatatggtgaaaccccaactctactaaaatacaaaaaattagctgggcgtgttggtgcgtgcctgtagtcccagctactcgggaggctgaagtggaggaattgcttgaacctgggaggtggagattgcagtgagccaagatggtgccactgcaccccagcctggtaacagagcaagattttgttaaaaacaaaagaaaacaaaacagttatatgtggattttttact

SEQ ID NO: 161006 - DNA, 601 bp, Human
atcctgctgattttttttattttatatagagatggagtctcactgtgttgcccaggctgatctcgaactcctgggctcaagcaattctcctgcctcaacctcccaaagcactgtgattacaggcataagtcacctcacctggcctgattttcttaataacattctattctctagcttactgtactttaagaatatagtataatggccgggcggggtggctcacacctgtaatcccagcactttgggaggccaaggcgggcggatcacgaggtcaggagatcgagaccatcctggctagcayggtgaaaccctgtctctactaaaaatacaaaaaattagccgggcatggtggcgggtgcctgtagttccagctactcaggaggctgaggcaggagaatggcatgaacccaggaggcggtgcttgcagtgagcggagattgtgccactgcactccagcctgggcaacggagcgacactctgtctcaaaaaaaaaaagaatatagtatataatacttacagcatacaaaatatgagttagtcaactgtttatgctctctgtaaggcttccagtcaatagtaggctattagtagttaagctttt

SEQ ID NO: 161007 - DNA, 601 bp, Human
cctctattgagtcttgttttctcttgttttgcaccataacctaactatttttttttgagacggactctccttcgccatggtgcgatctcagctcagtacaacctccatctccccagttcaaacaattctgctgcctcagccttccgagtggctgggattacaggcacctgccaccatgcccagctaatttttgtatttttagtagagacggggtttcaccatgttggccaggctggtctcgaactcctgaactcagacgatccactcacctcagccttccaaagtgctgggattacaggcrtgagccactgcgcctggcccataacctaactttcattccacttgtcatcccactattaatcccaaaatcacaccttcctccaacccacctcacggcgcaccctttgtggcacatattcttggtgctccactcctacaccctttcccaagccaatctgctgatccttcagccccgagagcactgagtacaatagctcaggctgcccacttctcctgagaattgccctcagcaaaatgggagctgccttgcccatagaaaccccaggggagacctagagccaaagaatgactgtgcagggat

SEQ ID NO: 161008 - DNA, 601 bp, Human
ttaagtatccaccccaaagtggacatggggtcatatgttacatgcaactttcttcaatatgcatgcatcagggccacctacatgaatattcatagctcctcctgtaacctgttgaatatgcatgtttagccaacccattcagcataaagctcctactccaacccctcctccttagaagtgcccgtctctgctcttgaccggacgcatgcttcccagcctgtgggatgacctctttgcaggctataatcttttacaataaataaagtctcctttttcaaatgtgtatattgtggttttttargttggcacacctgatcaggtccatgaaggcatcagctgtggggatggtctcgatccggccctcccggtgcagcccctccttggagcccttcccgggatggatgatggtgaccatgaggatgccgatgaagaccgcgatgatggtggtcaccatgtagtacacagctgcccgcatccccatccgccccgtggccttgttgtccagggatgccatacctgaaggacagatgatgtggcccccgcagctccatgcatacccaacgccagctctcctagcatccgttccaccctccccatatca

SEQ ID NO: 161009 - DNA, 601 bp, Human
accatgggctggttctggctcattgacagaggctgtgcatttgggtaccttcgtgtcctgaaaagaccttttgatgtataaagcctaaatgtgatacatttaaatgttaagtaaatgttaagtatccaccccaaagtggacatggggtcatatgttacatgcaactttcttcaatatgcatgcatcagggccacctacatgaatattcatagctcctcctgtaacctgttgaatatgcatgtttagccaacccattcagcataaagctcctactccaacccctcctccttagaagtgcccrtctctgctcttgaccggacgcatgcttcccagcctgtgggatgacctctttgcaggctataatcttttacaataaataaagtctcctttttcaaatgtgtatattgtggttttttaggttggcacacctgatcaggtccatgaaggcatcagctgtggggatggtctcgatccggccctcccggtgcagcccctccttggagcccttcccgggatggatgatggtgaccatgaggatgccgatgaagaccgcgatgatggtggtcaccatgtagtacacagctgcccgcatccccatccg

SEQ ID NO: 161010 - DNA, 601 bp, Human
gaccatgggctggttctggctcattgacagaggctgtgcatttgggtaccttcgtgtcctgaaaagaccttttgatgtataaagcctaaatgtgatacatttaaatgttaagtaaatgttaagtatccaccccaaagtggacatggggtcatatgttacatgcaactttcttcaatatgcatgcatcagggccacctacatgaatattcatagctcctcctgtaacctgttgaatatgcatgtttagccaacccattcagcataaagctcctactccaacccctcctccttagaagtgccygtctctgctcttgaccggacgcatgcttcccagcctgtgggatgacctctttgcaggctataatcttttacaataaataaagtctcctttttcaaatgtgtatattgtggttttttaggttggcacacctgatcaggtccatgaaggcatcagctgtggggatggtctcgatccggccctcccggtgcagcccctccttggagcccttcccgggatggatgatggtgaccatgaggatgccgatgaagaccgcgatgatggtggtcaccatgtagtacacagctgcccgcatccccatcc

SEQ ID NO: 161011 - DNA, 601 bp, Human
actacagctttgattggacaagagactgatttcagtaactttctcctgataacaccactgaccatgggctggttctggctcattgacagaggctgtgcatttgggtaccttcgtgtcctgaaaagaccttttgatgtataaagcctaaatgtgatacatttaaatgttaagtaaatgttaagtatccaccccaaagtggacatggggtcatatgttacatgcaactttcttcaatatgcatgcatcagggccacctacatgaatattcatagctcctcctgtaacctgttgaatatgcatgtttagccaacccattcagcataaagctcctactccaacccctcctccttagaagtgcccgtctctgctcttgaccggacgcatgcttcccagcctgtgggatgacctctttgcaggctataatcttttacaataaataaagtctcctttttcaaatgtgtatattgtggttttttaggttggcacacctgatcaggtccatgaaggcatcagctgtggggatggtctcgatccggccctcccggtgcagcccctccttggagcccttcccgggatggatgatggtgaccatgaggatgcc

SEQ ID NO: 161012 - DNA, 601 bp, Human
tcagtatgagttgttgcaagtagagtcagaaatcatatcaaaatgagtacagtcacctgtaaactaaaagtaacacctaagccaccaccaccaccaacagctgaacagactctcttgtggccaagtggaccccagaacaactttaaaactgagttcctggccatgatgggacaggaggtcagacacgcctccttacactctctcccttttataatctagacacaacaactaacccacattaatgttattaatgcattaaattaaaacagaaatcataagactgatagaacaggctctttgsggcaataagataccaaattataaggaggatctaagaccatgccacgcaggggttaagtcatggaccctacgctcaaagaataaattgtgttctagctgtcaaaaggttcttctttttctctaggagttaaacaaacactagtcttatgataagcaatattaaaataattacaactcatcagctcacagacaaggactaatggggcccctgttccaccagccataactacagctttgattggacaagagactgatttcagtaactttctcctgataacaccactgaccatgggctggttct

SEQ ID NO: 161013 - DNA, 601 bp, Human
tgaagctggaagccatcattctcagcaaactgacatagaaacagaaaactaaacactgcatgttctcactcataagtgggagttgaacaatgagaatacatggacacagggaagggaacatcacaccctggggccttttgggggctgtgggggcaaagggagggggagcattaggacaaatacctaatgcatgcggggcttaaaacctagatgacgggttgataggtgctgcaaaccaccatggcgcatgtatacttatgtaagaaacctgcacgttctgcacatgtatcccagaacttaragtaaaaaataaaataaaatataaattaaaaaatcatgctgctctaagagaatcattcaccctccaatgatgcttaggcaaataccagctgttctgaccccaccttaagggtcatatcctaagatcatattctagcagcagctgctgttggagaatatatacaaggctccagggcagaaattgggtaccacaagtggatactatgggtgctgctatgtccaggctgcgggagcctgtcccctttgtctctccttcagtatgagttgttgcaagtagagtcagaaatcatatcaaaatgag

SEQ ID NO: 161014 - DNA, 601 bp, Human
gccttgatctcctgggttcaagcaatcctcccacctcagcctcccaagtagctgagacaggcatgtccagctaatttttttttaatcttttttttttttttgaaagacagagagtctcattctgttgcccaggctggtcttgaacttttggcctcaagtgatcctcccaccttggcctccctaagtgctgggattacaagcctgatccaccattctcggacctaagtgcttctccctaacccccccagatcaccatggaaaatacatcctttctcctagactcctcaagaacccctgcccrttgctctgtcaggcccttcctcccgcctcttgcccttggaccatcccttcagccccaagctcccaccaccctccgaatctccttgatcaaactgtgtacttccccctgacctgtttgaagcaggcctccacaaggtttggtggaaacatatttctgcagaaaaacatgagaagaaggaaagtggttagaccatggaagggcatctagggtgataacagtaatactaacaccaagaacaacaatagtgcagccaacatatgaatgcttcctctaggctgggcactgagcaagcatcttact

SEQ ID NO: 161015 - DNA, 601 bp, Human
aagctccctgagcaatgcttaaccagagttgagggcctctcccctcaaccatctgtggtcaaaatttctggaatctctacaccagccttgttgcctcctctagccctgtgctcaggaagtccttggcctaagtcctctttttttttttttctttttttgatatggggtcttgctctgtcacccatgttggagtgcagtggtgtgaccactggagccttgatctcctgggttcaagcaatcctcccacctcagcctcccaagtagctgagacaggcatgtccagctaatttttttttaatcttttttttttttttgaaagacagagagtctcattctgttgcccaggctggtcttgaacttttggcctcaagtgatcctcccaccttggcctccctaagtgctgggattacaagcctgatccaccattctcggacctaagtgcttctccctaacccccccagatcaccatggaaaatacatcctttctcctagactcctcaagaacccctgcccgttgctctgtcaggcccttcctcccgcctcttgcccttggaccatcccttcagccccaagctcccaccaccctccgaatctccttgat

SEQ ID NO: 161016 - DNA, 601 bp, Human
gtagtatagattctgaatttttcacaagctccctgagcaatgcttaaccagagttgagggcctctcccctcaaccatctgtggtcaaaatttctggaatctctacaccagccttgttgcctcctctagccctgtgctcaggaagtccttggcctaagtcctctttttttttttttctttttttgatatggggtcttgctctgtcacccatgttggagtgcagtggtgtgaccactggagccttgatctcctgggttcaagcaatcctcccacctcagcctcccaagtagctgagacaggcrtgtccagctaatttttttttaatcttttttttttttttgaaagacagagagtctcattctgttgcccaggctggtcttgaacttttggcctcaagtgatcctcccaccttggcctccctaagtgctgggattacaagcctgatccaccattctcggacctaagtgcttctccctaacccccccagatcaccatggaaaatacatcctttctcctagactcctcaagaacccctgcccgttgctctgtcaggcccttcctcccgcctcttgcccttggaccatcccttcagccccaagctc

SEQ ID NO: 161017 - DNA, 601 bp, Human
caatgcatagaagaatgagtgaatgaacagatgaacaaagcagtgaatgaatcattgcagaaggacatgaatgaatgaaagagtgagatattccatgaactaaccaatgcatagaagaatgaatgaatgaacagatgaacaaggaagtcaactagtgatgaaatcatcccagaaagacatgaatgaatgagttggtgagtgggtaagtgaatcacccaatacgtaaatgaatgaccaaaagtccccagcaagcccttcggcagcttccccacagcctgacttcccagctctggctccaccwtcccgtgggcacagaccaggactcaccagataatgatgcccaccagcctcataatagcctcattgaggctgtcgaagaagtccctgaggactctgcccttgtgtttcatgccaccaatgaccagcccaaaggccacagagaagaccacgaggcccagggcgttgatgccattggcggagccaggcacgggtacagtctcctcaaagctcagcatctcctgcagggtacccaaggcccgagtgacattttccaggaagctggttccgttctccactgagaatggaggaggcatggaggcac

SEQ ID NO: 161018 - DNA, 601 bp, Human
ttgatcaagggtacaaaatttcagttaaataggagaaataagttcaagagatctattggacaacatggtaggtatagttaaaaacaatgtattgtgtacttgcaaatcacaaagagagtagattttaagtggtctctcccttttttttttttttttgagactgggtctcattctgtcacccaggcaaccacaactcactgcagcctctacatcccaggctcaatctgtcctcccgcctcagcctcccaagcagctgggactacagctgcatgccaccacacccagctaattttttttgtaytttttgtggtcttgtcatgttgcccaggctggtctcaaattcctgggctcaagtgattctcccaccttggcctcccaaagtgctgagattataggcatgagccaccacaccctgcctagatcttaagtgttctcaccacaaaaaaataagcatgtgaggtaacgtctatgttagttagctcaactgaaccattccacaatgtagagatatttcaaaacattatgttgcacatgaaaatatatacagtttttatttgtcaattaaaaatacattaattttgcaaaataaataaatgaatga

SEQ ID NO: 161019 - DNA, 601 bp, Human
acaaataccacatgatctcacttatctgtggaatctaaacaatcaaactcacagaagcagggagtaaaatggtggttaccagggactcgcaggaaagggagattggggagatgttgatcaagggtacaaaatttcagttaaataggagaaataagttcaagagatctattggacaacatggtaggtatagttaaaaacaatgtattgtgtacttgcaaatcacaaagagagtagattttaagtggtctctcccttttttttttttttttgagactgggtctcattctgtcacccaggcaaycacaactcactgcagcctctacatcccaggctcaatctgtcctcccgcctcagcctcccaagcagctgggactacagctgcatgccaccacacccagctaattttttttgtattttttgtggtcttgtcatgttgcccaggctggtctcaaattcctgggctcaagtgattctcccaccttggcctcccaaagtgctgagattataggcatgagccaccacaccctgcctagatcttaagtgttctcaccacaaaaaaataagcatgtgaggtaacgtctatgttagttagctcaactga

SEQ ID NO: 161020 - DNA, 601 bp, Human
aagaataacaaatgcatagatgaatgagtgagtccaagaatgaattagaatgaataaatgacttaactgagtaaataaacagatgaatccatcaatgatttaactaatgcatggatgagtttgtaaataaatttacgagtgaatgaatacatgagtgagttaactgatgcatggaagaatgaatagatgaataagaaaatgaatgaaccgatagaaaaatgagaatgaataagtgaataaattggtgaatgaagagatacatggggaagtaaatgggtgaataaatcactgcagaaaggtmtgaatgaatgaatagtaactaaccaatgcataggagatgaataaatccctgtcacttgtgacaacacagatgaacctggaggacattatgctaattgaaataaccaagacacagaaagacaaataccacatgatctcacttatctgtggaatctaaacaatcaaactcacagaagcagggagtaaaatggtggttaccagggactcgcaggaaagggagattggggagatgttgatcaagggtacaaaatttcagttaaataggagaaataagttcaagagatctattggacaacatggt

SEQ ID NO: 161021 - DNA, 601 bp, Human
gaaataagcaaatgaaacaagttagtaactgagtgaacaaatacgtgaacaaatgagtgaatgaagagaatacttgaataaatgaatgaaagaataacaaatgcatagatgaatgagtgagtccaagaatgaattagaatgaataaatgacttaactgagtaaataaacagatgaatccatcaatgatttaactaatgcatggatgagtttgtaaataaatttacgagtgaatgaatacatgagtgagttaactgatgcatggaagaatgaatagatgaataagaaaatgaatgaaccgayagaaaaatgagaatgaataagtgaataaattggtgaatgaagagatacatggggaagtaaatgggtgaataaatcactgcagaaaggtatgaatgaatgaatagtaactaaccaatgcataggagatgaataaatccctgtcacttgtgacaacacagatgaacctggaggacattatgctaattgaaataaccaagacacagaaagacaaataccacatgatctcacttatctgtggaatctaaacaatcaaactcacagaagcagggagtaaaatggtggttaccagggactcgcagg

SEQ ID NO: 161022 - DNA, 601 bp, Human
ccaacattttttaaatgttcctttactacagaacctaccaccttgtgttatattgatctacaatgtgtctgtctcccctaagattttgtgagcttgttgaggacaaggtatgagtgcactgtatctctgtactccagaggtcaagacaaagtctgcctgggaaaatgcctgctgagtgaataaagatatttctgaagtaataaaggaatctagagaaggaatgatggaaggaaggaaggaaggaagggattaacaactggatgaataagtaaggaaataagcaaatgaaacaagttagtarctgagtgaacaaatacgtgaacaaatgagtgaatgaagagaatacttgaataaatgaatgaaagaataacaaatgcatagatgaatgagtgagtccaagaatgaattagaatgaataaatgacttaactgagtaaataaacagatgaatccatcaatgatttaactaatgcatggatgagtttgtaaataaatttacgagtgaatgaatacatgagtgagttaactgatgcatggaagaatgaatagatgaataagaaaatgaatgaaccgatagaaaaatgagaatgaataagtgaata

SEQ ID NO: 161023 - DNA, 601 bp, Human
ttcttttaaagactaacttccttcaagcctccttactttatgctaataactctttgttaagccctatcctatgtaggtgttagacacgctcacaggcacatagtacattctacgtccttgtactttaaccaagatatctgtgctggatgtgctcacaggcatgtcccagcttgcagcctataccccttccttatttgggaatgttattacttttctaagtccttttgtaagcaacttcctcttttcctctgttttccattgcttttacctatttagaaaagttttaaattattagccagtygggatttagtttagattgtaaagtctggctccagccaatggagacagacacagtagcagggacaaactgcataagggataaaaattgcttcttccctcctttgttcaggtgtgctcttgccattgttccatctgtgatgaacaccctttctgcagaagtaaaaattgccttgctgagataattaaatttatgtttgagtgctatttctttatggcactggggaacaagcattctgtttctaaataaacattttacatatgacactatacaactttccaattgtttgggatgatgtacaaa

SEQ ID NO: 161024 - DNA, 601 bp, Human
cagcaaaggagagtcactggatgggactgcttctgagcagatggtcagagagggcttttctgaagaggtgacatttaagctgagacttgcatgatgagaaggtaccctgtgtatctggaagaaatcattgcaggcacaatgcagactctgagatgggcatgcactaggagtgctggaggaccagagagaagaccaatgtggctggagtattgagtaaaaaggagaatagagaagatgaaagaagcaagttcatcaggggctcacctgtttccccccataatccagcccacgggtcaatcgwgtgagtttctgccattggcaccatcatctcatttcgaggcttcaatggctactcctctttctttagaaattgaagtttatggctgggcatggtggctcatgcctgtaatcccagcactttgggaggccgaggagggcagatcacttgaggtcaggagttcgagaccagcctggccaacatggtgaaatcccatctctattaaaaataaaaaaattagtcaggtgtggtagtgcacacctgtagtcccagctactcgggaggctgaggcagaagaatcacttgaacccaggaggcagaggt

SEQ ID NO: 161025 - DNA, 601 bp, Human
gatgcccacaggtgcatacctgtgtgagggagccacatacctgtcagggctccctcctgacctcccttgcaggtctgaaggtggcatccccaaggctttgcccatatagggccctggagccacacaatacccatgatacggcaccctactccatcccagtcttccccgtacactaatgaatgccaccgggccccatgaatgaagcccacctcctcctcctcctgctcttccacatctccccaccatggtagaaaagttcctacaactccaggatatacaagctttcaggtctctcctgtayctactccccattcaagctctctcaatcctgccccaaataatcactaccttcagtttccttccttagacattgccaagacattccctgtctctggccttctaagcttcccttatcttctgcccccaactgtttgttccacatttgaaatgtgtatgcccctattctcttccctatcagtgcctgttatcactcattcaccagcctaagcatttccctctcaaaccacttgtcctatcaaaatcaccgatgtattcattcattccacagatattgactgagtacctactgagtaccaggcac

SEQ ID NO: 161026 - DNA, 601 bp, Human
agctcaggagttcaagacaagccatagccaacatggcaaaaccccgtctctaccaaaaacaacaacaacaaaaaaaaaaacttagccgggagggctaaaaaattagccgggaggactggaatcaggcacctgtgattccagctacttgggaggctgaggtgggaggatcacttgagcctgggaagtggaggttgcagtgagtggagatcacaccactgcactctagcctgggtgatagagtgaggcctcatgtcaaacgaaaaagaaaaagaaaaaaaagatatttttggccgggcgtggyggcttacacatgtaatcccagcactttgagaggccaaggtgggcagatcacatgaggccaggtgttcgagaccagcctggctaacatggcaaaaccccatctctactaaaaatacaaaaattagccaggtgtggtggtgcatgcctgtagtcccagctacttgggaggctgaggcaggagaatcacttgaacctaagaggcggagcttgcagtgagccaggattacaccactgcactccagcctgggtgacagagtgagactctgtctcaaaaaaaagaaaaaaaaaattcttccatctt

SEQ ID NO: 161027 - DNA, 601 bp, Human
cggttggaatcctggactcataagagagtctctgggtgtccaactcagcggtgactatgtgagtttaattctaggatacagtgacatcagtcttacctagccatagaccaagaggcacattccctgaccagcgttatgggcaattttaaaaattatatttttgatcaggtgcagtggttcgtgcctgtaatcacagcactttgggagagcgagacgggcagatcacttgagctcaggagttcaagacaagccatagccaacatggcaaaaccccgtctctaccaaaaacaacaacaacaamaaaaaaaacttagccgggagggctaaaaaattagccgggaggactggaatcaggcacctgtgattccagctacttgggaggctgaggtgggaggatcacttgagcctgggaagtggaggttgcagtgagtggagatcacaccactgcactctagcctgggtgatagagtgaggcctcatgtcaaacgaaaaagaaaaagaaaaaaaagatatttttggccgggcgtggcggcttacacatgtaatcccagcactttgagaggccaaggtgggcagatcacatgaggccaggtgttcgaga

SEQ ID NO: 161028 - DNA, 601 bp, Human
tagttcgttctacctatccatttccaaaaaggacaggaccaaaggtctgctgacttcagggagggcccctactccagactcccctgtttgcaccagcattgacctcagctgtgctaactttctctatccatctacccgccatgtcttatcggagaaaagtgacctaattgattggcgagtttagtcaaagaagtgggcatctcatttggggtaagtctgtccacaaggcgtgtgttctgtggtcagctttacatcatacggttggaatcctggactcataagagagtctctgggtgtccarctcagcggtgactatgtgagtttaattctaggatacagtgacatcagtcttacctagccatagaccaagaggcacattccctgaccagcgttatgggcaattttaaaaattatatttttgatcaggtgcagtggttcgtgcctgtaatcacagcactttgggagagcgagacgggcagatcacttgagctcaggagttcaagacaagccatagccaacatggcaaaaccccgtctctaccaaaaacaacaacaacaaaaaaaaaaacttagccgggagggctaaaaaattagccgggagg

SEQ ID NO: 161029 - DNA, 601 bp, Human
gagaatagggcgtggcaaggcagggcggggctcagagcagggcatgggctgggcgtggcctgggcagaaatgagcccaaggagcgttccccttgagaacattgagcaggccaggtggggggctcctcaagatgcagaagacaagggtataacatttcagaggctgataactgtacaaaggaaaggagcaactcctcatgatacaggaagaaaacagcaatgagggtctcccaagctgaagatctcttcacccacttaaagccaatagctaaggccaatgactacacactagtttatggcastagttcgttctacctatccatttccaaaaaggacaggaccaaaggtctgctgacttcagggagggcccctactccagactcccctgtttgcaccagcattgacctcagctgtgctaactttctctatccatctacccgccatgtcttatcggagaaaagtgacctaattgattggcgagtttagtcaaagaagtgggcatctcatttggggtaagtctgtccacaaggcgtgtgttctgtggtcagctttacatcatacggttggaatcctggactcataagagagtctctgggtgtcca

SEQ ID NO: 161030 - DNA, 601 bp, Human
tccctccccaaccctcccagccaagctgatgaccgcttaagtctcacctgctggcaggtcctacccaagccccctcacctgatggttgtgatctgacccaggttgagctcgtagttgttaacttgagcaatgaagatggcagccagggcctcgtagagggcagtgccatccatgttgaccgtggcgcccacgggcaggacgaacctggtgatgcggcggtccacacccaggccctcctccaggcagcggaaggtgatgggcagcgttgccgagctgggggaaagagcccaggactgaggayggggcgtggcctggtgggggcggggctgggaacagggtgtggcctagtggggcagggcagagaatggggcgtggccgaagaaaggctggggaacagggcgtgacctagtggggtacggctgagaatgggtagggctgggtcacatgggcggggctgagaacaggggaggagtaggtgaggcggggctcagagcaggacgtggccaggtgaggaagagctgagaatagggcgtggcaaggcagggcggggctcagagcagggcatgggctgggcgtggcctgggcagaaatgagcccaagg

SEQ ID NO: 161031 - DNA, 601 bp, Human
ataatgactaagttggaaccactggatgatgggacctataaatacaggaataaataaatgtatagagcctacaaatataagaatctatatacaagaacctcgggttatcaggatgcaccagccatgctttggaaaacactggacaaatggatctcccacgtgagagggaaactgacaggaacgtcttggcagctcctgacagcctcaggtggcaactttacctttcacctacctcatccggcattgggctcttcccacatcccgcttccaacatccgtgggctcctctgagctccagctgmggccccctcctccctccccaaccctcccagccaagctgatgaccgcttaagtctcacctgctggcaggtcctacccaagccccctcacctgatggttgtgatctgacccaggttgagctcgtagttgttaacttgagcaatgaagatggcagccagggcctcgtagagggcagtgccatccatgttgaccgtggcgcccacgggcaggacgaacctggtgatgcggcggtccacacccaggccctcctccaggcagcggaaggtgatgggcagcgttgccgagctgggggaaagagccca

SEQ ID NO: 161032 - DNA, 601 bp, Human
gcgtgatgtcttccgtgggcaagccgaccgacgtaagcacaatgaccatggtgaccagacccgcctgggggatgccagcagccccaacactggctgctgtggccgtgatgctgcagggggagggagaacatggggagcagatggagggaagaaggcgatgaggaagagagaggaaaaggacagagagaagggaagagatcagctccccaaggcattttaaattaaatacccaagccagacacagagagaaaaatactgcttgatgcctcgcctcgcctcgcctcacctcgatccccacccrccccgcccctcccctcctcgcctcaccttgcccctgcctcgcctcctctctctctctcccaggctgaagtgcagtggtgttatctcagctcactgcaactcactactcaatcccaccttaacctcctgagtagctgggaccacaggcacatgccacaacgcctggttaatttttagtagagatggggtttcaccatgttggccaggctggtctcgaactcctgaccacctcgaactcctgatccacccacctcggcctcccaaagtgccagaattacaggtgtgagccaccgcgcctgac

SEQ ID NO: 161033 - DNA, 601 bp, Human
gctgaggcaggagaatggcgtgaacccagcaggcaatctcatctcactgctacctccacctcccaggttcaagcgattctcccacctcagcctcctgagcagctgggattacaggcacgtgccaccacgcccagctaattttgttttttgtttgtttgtatttttagtagagacaccgcacccggcctggatcaccttttggtgacttctacataaaacaggtaaaagaggagtttttctgcctgataggtaaagcccccattgcttgtctccaaccctacttcccaaagataactgtggratttggggtccagaggccatggattggaggcctctccaaggcctccttttcacttgaaaattctggaccactgcatctttgctggaataaaagtccacaggtcgaggacgttgcaggggaaagcagtgtgtgcagaagcaggagcaccagggtccagcctagagaacactcacaggaaccagtccacggcaatgatgagcgtgatgtcttccgtgggcaagccgaccgacgtaagcacaatgaccatggtgaccagacccgcctgggggatgccagcagccccaacactggctgctgtgg

SEQ ID NO: 161034 - DNA, 601 bp, Human
ttcaaggccagcctgggcaacacagcaaaacgtaatctcaaaaaaaaaaaataacaaatcccagcactttgggaggccgaggcaggtggatcacgaggtcaggagatcgagaccatcctggctaacatggtgaaaccccatctctactgaaaatacaaaaaaccaaaaaattagccaggcatggtggtgggcgcctgtaatcccagctacttgggaggctgaggcaggagaatggcgtgaacccagcaggcaatctcatctcactgctacctccacctcccaggttcaagcgattctcccrcctcagcctcctgagcagctgggattacaggcacgtgccaccacgcccagctaattttgttttttgtttgtttgtatttttagtagagacaccgcacccggcctggatcaccttttggtgacttctacataaaacaggtaaaagaggagtttttctgcctgataggtaaagcccccattgcttgtctccaaccctacttcccaaagataactgtgggatttggggtccagaggccatggattggaggcctctccaaggcctccttttcacttgaaaattctggaccactgcatctttgct

SEQ ID NO: 161035 - DNA, 601 bp, Human
gttcaaggccagcctgggcaacacagcaaaacgtaatctcaaaaaaaaaaaataacaaatcccagcactttgggaggccgaggcaggtggatcacgaggtcaggagatcgagaccatcctggctaacatggtgaaaccccatctctactgaaaatacaaaaaaccaaaaaattagccaggcatggtggtgggcgcctgtaatcccagctacttgggaggctgaggcaggagaatggcgtgaacccagcaggcaatctcatctcactgctacctccacctcccaggttcaagcgattctccyacctcagcctcctgagcagctgggattacaggcacgtgccaccacgcccagctaattttgttttttgtttgtttgtatttttagtagagacaccgcacccggcctggatcaccttttggtgacttctacataaaacaggtaaaagaggagtttttctgcctgataggtaaagcccccattgcttgtctccaaccctacttcccaaagataactgtgggatttggggtccagaggccatggattggaggcctctccaaggcctccttttcacttgaaaattctggaccactgcatctttgc

SEQ ID NO: 161036 - DNA, 601 bp, Human
ttgcttaagctaaggagttcaaggccagcctgggcaacacagcaaaacgtaatctcaaaaaaaaaaaataacaaatcccagcactttgggaggccgaggcaggtggatcacgaggtcaggagatcgagaccatcctggctaacatggtgaaaccccatctctactgaaaatacaaaaaaccaaaaaattagccaggcatggtggtgggcgcctgtaatcccagctacttgggaggctgaggcaggagaatggcgtgaacccagcaggcaatctcatctcactgctacctccacctcccagsttcaagcgattctcccacctcagcctcctgagcagctgggattacaggcacgtgccaccacgcccagctaattttgttttttgtttgtttgtatttttagtagagacaccgcacccggcctggatcaccttttggtgacttctacataaaacaggtaaaagaggagtttttctgcctgataggtaaagcccccattgcttgtctccaaccctacttcccaaagataactgtgggatttggggtccagaggccatggattggaggcctctccaaggcctccttttcacttgaaaattctgg

SEQ ID NO: 161037 - DNA, 601 bp, Human
accacacccagctaatttttgtatttttgtagagatgggacttgccatgttgcccaggctggtcttgaactcctgaactcaagcagtccacctgctttggcctcccaaagtgctgggattacaggcacatgtcactgtgtcctacccgtaaacctcctgtttttaaaaattgagatttaaatatatatttgcagctgggagtagcagctcacacctgtagtcccaactacttgggaggctgaagcaagaggattgcttaagctaaggagttcaaggccagcctgggcaacacagcaaaacrtaatctcaaaaaaaaaaaataacaaatcccagcactttgggaggccgaggcaggtggatcacgaggtcaggagatcgagaccatcctggctaacatggtgaaaccccatctctactgaaaatacaaaaaaccaaaaaattagccaggcatggtggtgggcgcctgtaatcccagctacttgggaggctgaggcaggagaatggcgtgaacccagcaggcaatctcatctcactgctacctccacctcccaggttcaagcgattctcccacctcagcctcctgagcagctgggattacagg

SEQ ID NO: 161038 - DNA, 601 bp, Human
cggctcactgcaacctccacctcccaggttcaagcgattctcctgtctcagcctcctgagtagctgagattataggcgcccaccactaggcccggctaatttttgatatttttagtagagatggggtttcaccatgttggccaggctggtcttgaactcctgacctcaggtgatctgcccacctcggcctcccaaagtgctgggattacaggcgtgagccaccacacccggcctgtttttgtgtttttgaaacagagtgttgctctgtcacacaggctggagtacagtcatgtgatcttgrctcactgcagcctcaacctcccaggttcaagagttcctcccacctcagcctcccaagcagctgggactacaggtgcgccaccacacccagctaatttttgtatttttgtagagatgggacttgccatgttgcccaggctggtcttgaactcctgaactcaagcagtccacctgctttggcctcccaaagtgctgggattacaggcacatgtcactgtgtcctacccgtaaacctcctgtttttaaaaattgagatttaaatatatatttgcagctgggagtagcagctcacacctgtagt

SEQ ID NO: 161039 - DNA, 601 bp, Human
cagggcaggcctgagtcaatacaggtgtagactagggcaggctgaagattataaaattggaactcaggctcagctgacagctcccatgtgggaatgaaagtccaggcttcctttaatgtaaacctcctggttttgttgttgttgctggtttttgtttttgtttttgttttttgagatggtgtttcactcctgttgcccaggctggagtgcagtggtgcgatctcggctcactgcaacctccacctcccaggttcaagcgattctcctgtctcagcctcctgagtagctgagattataggcrcccaccactaggcccggctaatttttgatatttttagtagagatggggtttcaccatgttggccaggctggtcttgaactcctgacctcaggtgatctgcccacctcggcctcccaaagtgctgggattacaggcgtgagccaccacacccggcctgtttttgtgtttttgaaacagagtgttgctctgtcacacaggctggagtacagtcatgtgatcttgactcactgcagcctcaacctcccaggttcaagagttcctcccacctcagcctcccaagcagctgggactacaggtgcg

SEQ ID NO: 161040 - DNA, 601 bp, Human
tggcatgcccagtagtaatcccagctactcgggaggctgaggcaggagaatcacttgaacctgggaggcagaggttgcagtgagctgagatcgagccactgcactccagcttgggtgacagagcaagactctgtctcaaaaaaaaaaaaaaaaaaaaagaaagaaaaagaaagaaaagaaaaaaatgaacatctcatgcagacaattaagggttatgaactgaaaagcacatagaatccggaatggtaaaccagggcaggcctgagtcaatacaggtgtagactagggcaggctgaagatkataaaattggaactcaggctcagctgacagctcccatgtgggaatgaaagtccaggcttcctttaatgtaaacctcctggttttgttgttgttgctggtttttgtttttgtttttgttttttgagatggtgtttcactcctgttgcccaggctggagtgcagtggtgcgatctcggctcactgcaacctccacctcccaggttcaagcgattctcctgtctcagcctcctgagtagctgagattataggcgcccaccactaggcccggctaatttttgatatttttagtagagatggggt

SEQ ID NO: 161041 - DNA, 601 bp, Human
gcccacggtcagttgggcaacagatgtgtcaccaggactcccctccccagcccccttccctcctctctgggggggcagagctggaggcccctcacatagcactctcgttgcctccccgtccccgggatgcccccttctcctgtgccatgagggacttgtagggtttccccaggctggggagggtaagctcagcttcctgaagctccagctcccgctgagacaagtgctcgatgacggccgctccaattgagtcccccagtacgttggtcattgtgcgaagccggtcactggtacaggggaraaagaagctgccattaatgggggcttgaaaagcttcacagaaagagggtgcagcagaggggggtccctgtgccagggagtcagagggctcccattgcagtacaatccatgaccacatgtccccaagcaggttcttccccctctctgccctgtttctcctactaacaaacaggatggaccaggtctgagatgttcatgtttgatcttagatgtgatattttttaaaaaatgaggctgggtgtggtttacagaaaaaagatcatatcattaaaaagatatgatcccagcactttgggaggct

SEQ ID NO: 161042 - DNA, 601 bp, Human
gccactctttgagaatgtgagaaacatgagttgaccactcttcttgttgaagctgaagcttcccttctccccaaacctaggagaaacgtttcttcccctcccttgctcacgccgtccttcaagccctcagcatatgctcagagagaaacagagaccttatatacctttcattcctgctcctttatttcacttttccctcccccctaaatgagtcaagcagaacgtgtgttcagcccacggtcagttgggcaacagatgtgtcaccaggactcccctccccagcccccttccctcctctctgggggggcagagctggaggcccctcacatagcactctcgttgcctccccgtccccgggatgcccccttctcctgtgccatgagggacttgtagggtttccccaggctggggagggtaagctcagcttcctgaagctccagctcccgctgagacaagtgctcgatgacggccgctccaattgagtcccccagtacgttggtcattgtgcgaagccggtcactggtacaggggagaaagaagctgccattaatgggggcttgaaaagcttcacagaaagagggtgcagcagaggggggtccct

SEQ ID NO: 161043 - DNA, 601 bp, Human
agatcaagttcttctcaacacattaaaggttctgagaagtcctgcaataaacaatttcatgttgattttttaaaagatgaagttcttaccactggggtgctcagtacgctgcttctgttctggaaagaactgttgacccccaatattcttcttcctcagacgggatctcagtattagcttcagaaactctgagacctctgcaagtgaggaggtaatagaggaatgctcagaacactcttggggaggatgaggagacctgcaaatccacaaaatacgacaactggaagggatcttcaaaatcacacacacactcattgtctatatttggaaactgaggctcagatgggagcagtgacttcccccaagttcataccaagctagaaaagagctggaccccaggttgggttgctgtatttgggaactaaaaataaaggacacccaattcaatttgaatttcacatcaacaacaaataattatgtagtataagtatatcccatgcaatatttgggatatacttatactaaaaaggtatttggtttttatttgaaatttaagtgtacctgagcatcttctattatacctggcaaccctaagcccaag

SEQ ID NO: 161044 - DNA, 601 bp, Human
tcttaccactggggtgctcagtacgctgcttctgttctggaaagaactgttgacccccaatattcttcttcctcagacgggatctcagtattagcttcagaaactctgagacctctgcaagtgaggaggtaatagaggaatgctcagaacactcttggggaggatgaggagacctgcaaatccacaaaatacgacaactggaagggatcttcaaaatcacacacacactcattgtctatatttggaaactgaggctcagatgggagcagtgacttcccccaagttcataccaagctagaamagagctggaccccaggttgggttgctgtatttgggaactaaaaataaaggacacccaattcaatttgaatttcacatcaacaacaaataattatgtagtataagtatatcccatgcaatatttgggatatacttatactaaaaaggtatttggtttttatttgaaatttaagtgtacctgagcatcttctattatacctggcaaccctaagcccaagcctctcttgttttgtttgttcatttttgagacagggtctcacttattgcccaggctggagtgcagtgacaagatcatagttca

SEQ ID NO: 161045 - DNA, 601 bp, Human
ctggggtgctcagtacgctgcttctgttctggaaagaactgttgacccccaatattcttcttcctcagacgggatctcagtattagcttcagaaactctgagacctctgcaagtgaggaggtaatagaggaatgctcagaacactcttggggaggatgaggagacctgcaaatccacaaaatacgacaactggaagggatcttcaaaatcacacacacactcattgtctatatttggaaactgaggctcagatgggagcagtgacttcccccaagttcataccaagctagaaaagagctgsaccccaggttgggttgctgtatttgggaactaaaaataaaggacacccaattcaatttgaatttcacatcaacaacaaataattatgtagtataagtatatcccatgcaatatttgggatatacttatactaaaaaggtatttggtttttatttgaaatttaagtgtacctgagcatcttctattatacctggcaaccctaagcccaagcctctcttgttttgtttgttcatttttgagacagggtctcacttattgcccaggctggagtgcagtgacaagatcatagttcactgcagcc

SEQ ID NO: 161046 - DNA, 601 bp, Human
atttgggaactaaaaataaaggacacccaattcaatttgaatttcacatcaacaacaaataattatgtagtataagtatatcccatgcaatatttgggatatacttatactaaaaaggtatttggtttttatttgaaatttaagtgtacctgagcatcttctattatacctggcaaccctaagcccaagcctctcttgttttgtttgttcatttttgagacagggtctcacttattgcccaggctggagtgcagtgacaagatcatagttcactgcagcctcaacttcccaggctcaagckatcctcccacttcagcctccaaagtagctgggaccacagatgcacagcagcacacccagctatatttttcattttttgtagagacagagtctcactatgttgcccaggctggtctcgaactcttgggctcaagcaatcctcccacctcggcctcccaaagtgctgggatcacaggcatgagccaccacacccagcctgcatgcctcttttgactacatctgcttctccttgaacctctccatgctgatttctgtcttctcttggccccaggagaaatatgatatgtcaggtgcccgcctg

SEQ ID NO: 161047 - DNA, 601 bp, Human
agttaaattaaattaaaaagccccactgcacatggcataccacaaaagcatcctttcttttttttttttttttagacggagtcttgctctgtcacccaggctggagtgcgatggcacaatcttggctcactgcaacccccacctcccaggttcaagcaattcttctgcctcagcctcccaagtagctgggattacaggtgcacgccaccatgcctggctaatttttgtatttttagtagagatgggatttgaccatgttggtcaggctggtctcaaactcctgacctcaggtgatctgccytcctcagcctcccaaagtgctgggattacaggtgtgagccaccgtgcccagcccttacctttctttttaagaggcgacatctcgctctgtctcccaggctagagtgtagtggtgcaatcatggctcactgcagcctcaagctcccaggttcaagtgatcctcctgcttcagccccccaaaacactgggaatacaggtgtgagccaccctgcccagcccctttccttacctttctctctgactttgcctcctcctcttcttgttgtttcagaacaaagggaccccggtgaaacagtaggtg

SEQ ID NO: 161048 - DNA, 601 bp, Human
cttggctcactgcaacccccacctcccaggttcaagcaattcttctgcctcagcctcccaagtagctgggattacaggtgcacgccaccatgcctggctaatttttgtatttttagtagagatgggatttgaccatgttggtcaggctggtctcaaactcctgacctcaggtgatctgccctcctcagcctcccaaagtgctgggattacaggtgtgagccaccgtgcccagcccttacctttctttttaagaggcgacatctcgctctgtctcccaggctagagtgtagtggtgcaatcmtggctcactgcagcctcaagctcccaggttcaagtgatcctcctgcttcagccccccaaaacactgggaatacaggtgtgagccaccctgcccagcccctttccttacctttctctctgactttgcctcctcctcttcttgttgtttcagaacaaagggaccccggtgaaacagtaggtggagatgagattgtgatggtcatcaaagacagcccacaaaccatcccaacatacacagatgccttgcacgtttattccacggtagagggtatgagctcccagctggcccagggatccctct

SEQ ID NO: 161049 - DNA, 601 bp, Human; identical to SEQ ID NO: 37072

SEQ ID NO: 161050 - DNA, 601 bp, Human; identical to SEQ ID NO: 37073

SEQ ID NO: 161051 - DNA, 601 bp, Human; identical to SEQ ID NO: 37074

SEQ ID NO: 161052 - DNA, 601 bp, Human; identical to SEQ ID NO: 37075

SEQ ID NO: 161053 - DNA, 601 bp, Human; identical to SEQ ID NO: 37076

SEQ ID NO: 161054 - DNA, 601 bp, Human; identical to SEQ ID NO: 37077

SEQ ID NO: 161055 - DNA, 601 bp, Human; identical to SEQ ID NO: 37078

SEQ ID NO: 161056 - DNA, 601 bp, Human; identical to SEQ ID NO: 37079

SEQ ID NO: 161057 - DNA, 601 bp, Human; identical to SEQ ID NO: 37080

SEQ ID NO: 161058 - DNA, 601 bp, Human; identical to SEQ ID NO: 37081

SEQ ID NO: 161059 - DNA, 601 bp, Human; identical to SEQ ID NO: 37082

SEQ ID NO: 161060 - DNA, 601 bp, Human; identical to SEQ ID NO: 37083

SEQ ID NO: 161061 - DNA, 601 bp, Human; identical to SEQ ID NO: 37084

SEQ ID NO: 161062 - DNA, 601 bp, Human; identical to SEQ ID NO: 37085

SEQ ID NO: 161063 - DNA, 601 bp, Human; identical to SEQ ID NO: 37086

SEQ ID NO: 161064 - DNA, 601 bp, Human; identical to SEQ ID NO: 37087

SEQ ID NO: 161065 - DNA, 601 bp, Human; identical to SEQ ID NO: 37088

SEQ ID NO: 161066 - DNA, 601 bp, Human; identical to SEQ ID NO: 37089

SEQ ID NO: 161067 - DNA, 601 bp, Human; identical to SEQ ID NO: 37090

SEQ ID NO: 161068 - DNA, 601 bp, Human; identical to SEQ ID NO: 37091

SEQ ID NO: 161069 - DNA, 601 bp, Human; identical to SEQ ID NO: 37092

SEQ ID NO: 161070 - DNA, 601 bp, Human; identical to SEQ ID NO: 37093

SEQ ID NO: 161071 - DNA, 601 bp, Human; identical to SEQ ID NO: 37094

SEQ ID NO: 161072 - DNA, 601 bp, Human; identical to SEQ ID NO: 37095

SEQ ID NO: 161073 - DNA, 601 bp, Human; identical to SEQ ID NO: 37096

SEQ ID NO: 161074 - DNA, 601 bp, Human; identical to SEQ ID NO: 37097

SEQ ID NO: 161075 - DNA, 601 bp, Human; identical to SEQ ID NO: 37098

SEQ ID NO: 161076 - DNA, 601 bp, Human; identical to SEQ ID NO: 37099

SEQ ID NO: 161077 - DNA, 601 bp, Human; identical to SEQ ID NO: 37100

SEQ ID NO: 161078 - DNA, 601 bp, Human; identical to SEQ ID NO: 37101

SEQ ID NO: 161079 - DNA, 601 bp, Human; identical to SEQ ID NO: 37102

SEQ ID NO: 161080 - DNA, 601 bp, Human; identical to SEQ ID NO: 37103

SEQ ID NO: 161081 - DNA, 601 bp, Human; identical to SEQ ID NO: 37104

SEQ ID NO: 161082 - DNA, 601 bp, Human; identical to SEQ ID NO: 37105

SEQ ID NO: 161083 - DNA, 601 bp, Human; identical to SEQ ID NO: 37106

SEQ ID NO: 161084 - DNA, 601 bp, Human; identical to SEQ ID NO: 37107

SEQ ID NO: 161085 - DNA, 601 bp, Human; identical to SEQ ID NO: 37108

SEQ ID NO: 161086 - DNA, 601 bp, Human; identical to SEQ ID NO: 37109

SEQ ID NO: 161087 - DNA, 601 bp, Human; identical to SEQ ID NO: 37110

SEQ ID NO: 161088 - DNA, 601 bp, Human; identical to SEQ ID NO: 37111

SEQ ID NO: 161089 - DNA, 601 bp, Human; identical to SEQ ID NO: 37112

SEQ ID NO: 161090 - DNA, 601 bp, Human; identical to SEQ ID NO: 37113

SEQ ID NO: 161091 - DNA, 601 bp, Human; identical to SEQ ID NO: 37114

SEQ ID NO: 161092 - DNA, 601 bp, Human; identical to SEQ ID NO: 37115

SEQ ID NO: 161093 - DNA, 601 bp, Human; identical to SEQ ID NO: 37116

SEQ ID NO: 161094 - DNA, 601 bp, Human; identical to SEQ ID NO: 37117

SEQ ID NO: 161095 - DNA, 601 bp, Human; identical to SEQ ID NO: 37118

SEQ ID NO: 161096 - DNA, 601 bp, Human; identical to SEQ ID NO: 37119

SEQ ID NO: 161097 - DNA, 601 bp, Human; identical to SEQ ID NO: 37120

SEQ ID NO: 161098 - DNA, 601 bp, Human; identical to SEQ ID NO: 37121

SEQ ID NO: 161099 - DNA, 601 bp, Human; identical to SEQ ID NO: 37122

SEQ ID NO: 161100 - DNA, 601 bp, Human; identical to SEQ ID NO: 37123

SEQ ID NO: 161101 - DNA, 601 bp, Human; identical to SEQ ID NO: 37124

SEQ ID NO: 161102 - DNA, 601 bp, Human; identical to SEQ ID NO: 37125

SEQ ID NO: 161103 - DNA, 601 bp, Human; identical to SEQ ID NO: 37126

SEQ ID NO: 161104 - DNA, 601 bp, Human; identical to SEQ ID NO: 37127

SEQ ID NO: 161105 - DNA, 601 bp, Human; identical to SEQ ID NO: 37128

SEQ ID NO: 161106 - DNA, 601 bp, Human; identical to SEQ ID NO: 37129

SEQ ID NO: 161107 - DNA, 601 bp, Human; identical to SEQ ID NO: 37130

SEQ ID NO: 161108 - DNA, 601 bp, Human; identical to SEQ ID NO: 37131

SEQ ID NO: 161109 - DNA, 601 bp, Human; identical to SEQ ID NO: 37132

SEQ ID NO: 161110 - DNA, 601 bp, Human; identical to SEQ ID NO: 37133

SEQ ID NO: 161111 - DNA, 601 bp, Human; identical to SEQ ID NO: 37134

SEQ ID NO: 161112 - DNA, 601 bp, Human; identical to SEQ ID NO: 37135

SEQ ID NO: 161113 - DNA, 601 bp, Human; identical to SEQ ID NO: 37136

SEQ ID NO: 161114 - DNA, 601 bp, Human; identical to SEQ ID NO: 37137

SEQ ID NO: 161115 - DNA, 601 bp, Human; identical to SEQ ID NO: 37138

SEQ ID NO: 161116 - DNA, 601 bp, Human; identical to SEQ ID NO: 37139

SEQ ID NO: 161117 - DNA, 601 bp, Human; identical to SEQ ID NO: 37140

SEQ ID NO: 161118 - DNA, 601 bp, Human
aactcctatatcatcaccatgcttggctaatttttaattttttttttgggtagagatggttctcactctgttgcccacactggtctcaaactcctgggcttgagccatcctcctgcctcaccctcccaaagtgctaggattacagggcatgaactgtgccatacccatcttcgaggttttatggtcatgtagaatttctgttcaaggaaagcagataacagacagggttaagggcatttgcttggaatatttaggagttttgcaggtcattcctttgaaatggaatttgttgcacatcccygatctgagattagaaacttttctgcatgttggtgtgaagacgaaagaagacagtgtttataaaatagtttatacttcaattgcctagcagtagaaacctgatttctaggaatttcggcttctgagtcaactctagctgcaagagccacttcattttcccctaaaagctccatgaaggcaggagccgtgtctctcttgatctatgtgtgagtaatcaatatttttcacatgactaaataatcaaacccgtagaactagagaacaacaaaaacaaaaacaaaaaattaagaaatccagatcg

SEQ ID NO: 161119 - DNA, 601 bp, Human
ggacagtgcagcggtctgcctatctgaggacctgtaccccgatatcaatgtcatcactggtcagcatggccccctctcccctgcctgctcacccccattcaatgcctcacttcaaggccttggggctcctctgggacctcagtcctcctatctgaccttgctttcacccacctcctcttcccccttagctgtgccctccttagccttagaagccagtggtgccctgaccagaggggaccctgtgttcacaggcatcctcaaggattatcttcgagagttgcccaccccactcatcacccarcccctgtataaggtggtactggaggccatggcccgggaccccccaaacagagttccccccaccactgagggcacccgagggctcctcagctgcctgccagatgtggaaagggtgagttgggcctggtgggagtgatgggacttgagagtgggctgataccaatagaatgtttcacccatgcctgggcctgagatgggcatgagctggcagcatcatcatatccccaagaaataggtgctattagcatcccacttcatagatttggaaactgaggcccaaagcaggtgacagttgcccaag

SEQ ID NO: 161120 - DNA, 601 bp, Human
gccaccttaagggaccaatcagtgtcttgggcttgaagctacgccccctcatggagtaaactggtacctggttgcctcagcaaccagttcagatccaaccaatctgtctgttttgtctttttttattttcatttttttgtaaagacagggtttctctatattgcccaagctggtctcaaacgcatgatctcaagccatccttccgcctcagcctcccaaagtactgggattataaaccaaatcaccttgccccacagagctgattcatctttttatttttattttttattttttttgagayggagtcttgctctctagcccaggctggggtgtggtggcatgatctcagctcactgcaacctctgcctcccaggttcaagggattctcccacctcagcctcccgagtagctgggattataggcacgcaccaccagtcctggctaatttttatattttaagtagagcagggtttcactgtgttggccaggctggtcttgaactcctgacctcaagtgatccacccatttcaggcctctcaaagtgctgggattacaggcatgcactaccaatcctagctaatttttgtatttttagtggaga

SEQ ID NO: 161121 - DNA, 601 bp, Human
acgcaccaccagtcctggctaatttttatattttaagtagagcagggtttcactgtgttggccaggctggtcttgaactcctgacctcaagtgatccacccatttcaggcctctcaaagtgctgggattacaggcatgcactaccaatcctagctaatttttgtatttttagtggagatggggcttcacggtgttggccaggctggtcttgaactcctgacctcaagtgatccgcctgcctcaggcctcccaaagtgctgggattacaggcatgatccaggcatgatccacagacctgccsctacccatctttgatgcagtcagaggccctgcctcttgacatgccaatcagaggcctagttgcctaagcaaccagtcctagctctgccagtgaaaacctgaaacggtcgaaggccgctttccacaggccaatcaggagcctagttccctaagcagccaatcagaggtcggctgtcgcctctttctatgacctaccctgtctcccttcagatccccgcctgccccgacaatctccagatgtcgcgccttacttgcgacccaaacgacagccacctctgcacctgccgctggcagaccccga

SEQ ID NO: 161122 - DNA, 601 bp, Human
tttggacactagttgccaagtctggggcctggggattttagggaccagcggttgtgaccatctttcctgagcaccaagggcttccccttttgttgccaaaaaggtagttctcgcgcttgctaggctggcctctcttgcctccccttggccggggcaacaccagttactgtgagcatcaccctggtgtggtgagtcacctctagtcggccctcttgctgctgccaaccaaatcagtattagctttgagcactgcactgtttctccctcccttggacgacacaaagactagcatgaggcactstttgtggggggcagcccctatcctgggttccagcatggacacaggggtagcctggggcttatagagaaacagctggtttcccctaccctttcccggggaagaccccacgattggcctctagtcagcaaatggagataacagagtctggcctttccaatccccatctccttgccccccccttgcccccccccccccgaaaaaaattgagcacttaaacccctcccttttggagggggccccctgaagcgtcaggctgggggcagtctggtacggaacatatttattgcctccatgcatgtg

SEQ ID NO: 161123 - DNA, 601 bp, Human
gattactttgagaaactttccctctactccgtgtgcccgtcgctggtcgtgcgacccaagcccctgcattcctgtacgggtaagacgctccgctaggggataagtggggttcggtagctttcacgtccgtgtaggtggcctgtgctttgcgatccgagggcgagaggaagggttaagttaagggattcttttcctgcgcctcagcaagcggtgggcattgcaaaggcatctgcgacgtggccgggaaggaccacgcaaggtgtggatggcacgagtggaaataaaggcggcagggccttakgagtgggctgctcgcgcaacgcctgattgtcctgctcggaggagaacgcttcctcgtttcctgctgaaagttcaaacacttgagcaggttcagcgtctaaatcgttgtttcaggaagtggtggtgtgtgtgaatttcaaacttgagcttggcggccttgcatctcaccttgagttaacttgtccagcctcctactgtctccactgtgaattttgcaagtaaatcagtatcctgaggttctcaacaaaatctcgaattcactgagctttgcttacaatgatcgccctctgagaaagtagtt

SEQ ID NO: 161124 - DNA, 601 bp, Human
aaggtcaccctcgtttgtcttaagtgaccaaaaccagcaatggtaacaatgaaaacattactcacacctggttttctctcttcacgggaggtaagagcaatagtaaagataaagagaacttaatacatatattgaaaacgtagtagagtttctatcgaaaataaatccaaggtacttttaaaattttgaatgcattaagagaagatccaagtttcaaagtatctcggcattgttaggatttaggttatggaacatgggtataataaaacgaaaaagaagtaggagcactttttatcagaaraaagttattgagtgtgctttccattaaaggtaagcataaagtatttccaaaccaaaagaacctttgagattgttagttgcatgagaggcatgagataaattaaattacacttaaaatgaaaaaatgaagggccaacagttttggaagatattttttggaacatttgagttgttaatgctcaatgcgtggaatcctgtattttctcttggttccattgatagtccctatatgacaatcagtaaacatatgataaatacatacagtgaagttcttttaaaaccaaattgttcctacatgtat

SEQ ID NO: 161125 - DNA, 601 bp, Human
gaaaaagagaggatctgtttcagtcattaacattgcgtatgggacattcccaggacaaaacagaacaacttctaagcacctaggtagagcctagtgccggcagaattttcagtgactttgtgctgtgttgacttgaaggcagcttttcctggcttataggagtcacagaattggatcatagaagaaaacgtggcagaagaggagtaataaatagctgcagagaatagtcattcagtcagaggtggctgagtaagtgtcgtgttttattgaaccttgtgtgggaaataaatcagaggaaaawaaaatgattcatatgtagttttgtgagtgttataagtgaaatgcacgtatttcacagacttaagtgttgctcagtcttgtgcttttcgaagttcactgatggttcgtggtagagggtggctgttggcaatggttttctggctccgttattccagtactttcttctttcggattgttagttgaaaatgtgtcgttattttgctctagttgagaattaaaatatagaaactgggatttgctggtggaattaaacccataaaaactggctacaatagttcatactttcagatcataagccttc

SEQ ID NO: 161126 - DNA, 601 bp, Human
ttcctggcttataggagtcacagaattggatcatagaagaaaacgtggcagaagaggagtaataaatagctgcagagaatagtcattcagtcagaggtggctgagtaagtgtcgtgttttattgaaccttgtgtgggaaataaatcagaggaaaaaaaaatgattcatatgtagttttgtgagtgttataagtgaaatgcacgtatttcacagacttaagtgttgctcagtcttgtgcttttcgaagttcactgatggttcgtggtagagggtggctgttggcaatggttttctggctccrttattccagtactttcttctttcggattgttagttgaaaatgtgtcgttattttgctctagttgagaattaaaatatagaaactgggatttgctggtggaattaaacccataaaaactggctacaatagttcatactttcagatcataagccttcagtgggtttacagttacagttaaagccttacatgtattagatcatgggaatcccattagtgtcttctcaggggttttgcaaataccatactttcaaagcatttttgtttttaacagttaaggtcaggacaaaaatctttgattag

SEQ ID NO: 161127 - DNA, 601 bp, Human
tcaaagcatttttgtttttaacagttaaggtcaggacaaaaatctttgattagatgaatgtaatcttttttcttattaattaaaaacaacaacaataagttgctggcatcccaaaggacactgtaattttcttcttttcttttctttttcttttttttttttttttttttgctagatggaactaaatgttgagcactggtggtggaagcaatgcataaaaagttcaagtgaaaggcatacattggaattaaagttactgaactttctcagcctttcatttgctgatttaagatttaaagaygtgtaacagaagtgaactgtgtcaggtaaaataatgaaaactaagagaaaaaaaaggcctcaaaattaaaaagttaccagcatgtacaataagtacataaaattgggatggaaagaaaactacagcattaaaaaaaaaaaaaacactgcataatgaaacagttcatgctctgtggatttagtaacctaaaggtcaatttatggtaccaaatatcaggcagaatagcatgtattcaagcaaactgagaaatggaaatagttttcatctcaggcagataatcacctgacaggaatttattgt

SEQ ID NO: 161128 - DNA, 601 bp, Human
ctttttcttttttttttttttttttttgctagatggaactaaatgttgagcactggtggtggaagcaatgcataaaaagttcaagtgaaaggcatacattggaattaaagttactgaactttctcagcctttcatttgctgatttaagatttaaagacgtgtaacagaagtgaactgtgtcaggtaaaataatgaaaactaagagaaaaaaaaggcctcaaaattaaaaagttaccagcatgtacaataagtacataaaattgggatggaaagaaaactacagcattaaaaaaaaaaaaaacactgcataatgaaacagttcatgctctgtggatttagtaacctaaaggtcaatttatggtaccaaatatcaggcagaatagcatgtattcaagcaaactgagaaatggaaatagttttcatctcaggcagataatcacctgacaggaatttattgttcgacattctagccttgatggaatcctcaccttccaaaaattgttgtttaacagacgctttcttattataaacacaataattttagtcttggaaagatgtctctaaatttctctcggtttcctagtacgtctcgtaaatcatc

SEQ ID NO: 161129 - DNA, 601 bp, Human
ttaggatgctttattttctttttccggttgtgattaatgtttcttggtggaaaagcccacttgaagaaagctggtttcttggggtagaatagtttgtggaagcatcggcgtggtcatttttgaagcctctgcctttctgtctgatctttagaatcaggcagtttctaaatttgaggcgtgttgagaaaaaatggataacttgcttcacaaaaataaggattgttacaattaccctaagggttttcacatgaagatactgataaatgaacctatggtactaattacttttattacaatttttctacttagaacctagaattaccttacatttacacatgcacttttgtggggaggtgagtgtagatacttggacattttacagcctgcgaataggatgagacttttaattattccactaacctataatctaattcttttccccttctctggcagaatgggtctgttgaatctcttacctgtctgatctttggtggttagacctacagagctggagaggctcataaaatcatagatcaatatcctcaagcagaaggtattttttgcaaagtgccagggtcacgtcagtgcttcgttatagttt

SEQ ID NO: 161130 - DNA, 601 bp, Human
tcttggtggaaaagcccacttgaagaaagctggtttcttggggtagaatagtttgtggaagcatcggcgtggtcatttttgaagcctctgcctttctgtctgatctttagaatcaggcagtttctaaatttgaggcgtgttgagaaaaaatggataacttgcttcacaaaaataaggattgttacaattaccctaagggttttcacatgaagatactgataaatgaacctatggtactaattacttttattacaatttttctacttagaacctagaattaccttacatttacacatgcacwtttgtggggaggtgagtgtagatacttggacattttacagcctgcgaataggatgagacttttaattattccactaacctataatctaattcttttccccttctctggcagaatgggtctgttgaatctcttacctgtctgatctttggtggttagacctacagagctggagaggctcataaaatcatagatcaatatcctcaagcagaaggtattttttgcaaagtgccagggtcacgtcagtgcttcgttatagtttcagtccactgtatgccactctcctccttgtcatagtactca

SEQ ID NO: 161131 - DNA, 601 bp, Human
aaggattgttacaattaccctaagggttttcacatgaagatactgataaatgaacctatggtactaattacttttattacaatttttctacttagaacctagaattaccttacatttacacatgcacttttgtggggaggtgagtgtagatacttggacattttacagcctgcgaataggatgagacttttaattattccactaacctataatctaattcttttccccttctctggcagaatgggtctgttgaatctcttacctgtctgatctttggtggttagacctacagagctggagmggctcataaaatcatagatcaatatcctcaagcagaaggtattttttgcaaagtgccagggtcacgtcagtgcttcgttatagtttcagtccactgtatgccactctcctccttgtcatagtactcagaaatcaggaagacttttccaacttggttacacacccgggactaacccgtgcagtcacacccaggggacagtcaaccagccagttagaagggacatttggggaagggtgtttatcttttaggaggtggcatcaagaacattttatcctgtggtggatccaagagaagcaagtc

SEQ ID NO: 161132 - DNA, 601 bp, Human
agagttggatactggaatgttaatggagaaacataaaccaaggtctgggaaaaatgatcgttatcaacaagcatttgtatttctgccagaggcacataggcttttagtagcaattactcataactgcttctcctgttcccattgtaagggtaaataaatagagggatgcacgggatctgggactcatccagggtcagtatatatttggaactgagctcttttgggatccttaactgttatctcactactcttttgctagagataccaagggattccttaggagtcagttttttttttttttcttccaatagcgggatcttggctcactgcaacctccaccttctgggttcaaatgattctcctgcctcagcctcctgagtagctgggattacaggcgcccatgaccacacccagctaatttttgtatttttagtagagacagggtttcaccatgttggccaggctggtctcgaactcctaatctcgtgatccacccgcctcggcctcccaaagtgctgggattataggcatgagccatcgcgcccgctgtgaagtcggttttaactcatgaatagttcattagcggtgtcttctctggctc

SEQ ID NO: 161133 - DNA, 601 bp, Human
agatatgtttgttttttgctggttgtatttctggatccaagactgaatttgtgatagaaacatggatagtataaagttgttagttttagcatatcctagaaatcagagtggaaagattaaatgtaacatatcccaaaaatctatatgaaaaggagttaggattgcaaaggattattttatttataaagagagattgaaaggaaaaaaaagaagggaagaaggaaagtaagagtgggtttctttgaaattcttgaggctgcacagattcagcctcatagcacagcattcctccgaagggctrtacaggcaaaacaaagctggcttgtgaaattctgtcgctccatgggtactaaatggctaaagttgattctacttagacgcgtgctggggcctcttcaaggttgagatccagagcttaagctctgcacagcatttagccttcgctctggaagactgagtaaatgttaaaccagaagcaattttaggtgttatttgcactttgttttgaggtcaggtaggaggagcagcagagatgcaaaggtaggtacgtcacatgggctgaggcctcttcatttgtttttgtttttgttttatttttttg

SEQ ID NO: 161134 - DNA, 601 bp, Human
gctggttgtatttctggatccaagactgaatttgtgatagaaacatggatagtataaagttgttagttttagcatatcctagaaatcagagtggaaagattaaatgtaacatatcccaaaaatctatatgaaaaggagttaggattgcaaaggattattttatttataaagagagattgaaaggaaaaaaaagaagggaagaaggaaagtaagagtgggtttctttgaaattcttgaggctgcacagattcagcctcatagcacagcattcctccgaagggctgtacaggcaaaacaaagstggcttgtgaaattctgtcgctccatgggtactaaatggctaaagttgattctacttagacgcgtgctggggcctcttcaaggttgagatccagagcttaagctctgcacagcatttagccttcgctctggaagactgagtaaatgttaaaccagaagcaattttaggtgttatttgcactttgttttgaggtcaggtaggaggagcagcagagatgcaaaggtaggtacgtcacatgggctgaggcctcttcatttgtttttgtttttgttttatttttttgaaacaggatcttggtct

SEQ ID NO: 161135 - DNA, 601 bp, Human
catatcccaaaaatctatatgaaaaggagttaggattgcaaaggattattttatttataaagagagattgaaaggaaaaaaaagaagggaagaaggaaagtaagagtgggtttctttgaaattcttgaggctgcacagattcagcctcatagcacagcattcctccgaagggctgtacaggcaaaacaaagctggcttgtgaaattctgtcgctccatgggtactaaatggctaaagttgattctacttagacgcgtgctggggcctcttcaaggttgagatccagagcttaagctctgcrcagcatttagccttcgctctggaagactgagtaaatgttaaaccagaagcaattttaggtgttatttgcactttgttttgaggtcaggtaggaggagcagcagagatgcaaaggtaggtacgtcacatgggctgaggcctcttcatttgtttttgtttttgttttatttttttgaaacaggatcttggtctgttgcccaggctggagtgcagtggggcgatcttggctcactgcaacctctgcttcccgggttcaagcgatcctcccacctcagcctccctagtagctgggactacagac

SEQ ID NO: 161136 - DNA, 601 bp, Human
ttcaccatgttggacaggctggtctcgaacttctgacctcaggtgatctgcccgctttggcctcctgaagtgctgggattacaggcgtgagccactgcacccagccgaggcctcttaatttgtactgagcttgtgaacgtgcatgctatggagcctgagggtcttccttgccacacgtcctgcccacgactgtagttagcagactagagttggtgggtctatggctaagcccattgacaagctctcagctggaatatggttagagggctgcaaggactcaggtgggatgcataaattaacrcctcattttgcatcttctgttggggatgcagttctgttttacactccagtcttgtggaatgggtgtttctagtgtggctctagggacgcactcacagctggattaaccaccttttccccgagaacttgctaaagcccacaggtgctcaaaggatgggcaaaagaccactgtgctgcaggtggcaccctctcttggaagcagcatgacgacgagaagaagagaagcattgagggcattcgtgcaaagactgcaagcgtggagaagcaccttgggcctgcctgtcggtgcctgcctccattt

SEQ ID NO: 161137 - DNA, 601 bp, Human
tctgacctcaggtgatctgcccgctttggcctcctgaagtgctgggattacaggcgtgagccactgcacccagccgaggcctcttaatttgtactgagcttgtgaacgtgcatgctatggagcctgagggtcttccttgccacacgtcctgcccacgactgtagttagcagactagagttggtgggtctatggctaagcccattgacaagctctcagctggaatatggttagagggctgcaaggactcaggtgggatgcataaattaacacctcattttgcatcttctgttggggatgcasttctgttttacactccagtcttgtggaatgggtgtttctagtgtggctctagggacgcactcacagctggattaaccaccttttccccgagaacttgctaaagcccacaggtgctcaaaggatgggcaaaagaccactgtgctgcaggtggcaccctctcttggaagcagcatgacgacgagaagaagagaagcattgagggcattcgtgcaaagactgcaagcgtggagaagcaccttgggcctgcctgtcggtgcctgcctccattttagctgcctgagaggatggaacggtagtttc

SEQ ID NO: 161138 - DNA, 601 bp, Human
tctttccagcttaccaacatgtccttaggaacatattcttctgggtattgaggaaagatgagtattttctgttttttgtttttttgtttgtttgtttttgagacagagtctcgctctgtcactgaggctggagtgtaatggtgcaatctcggctcactgcaggctctgcctcctgggttcaagtgattctcctgccgcaccctaccaagtagctgggattacaggcgtctgccaccatgcccggctaatttttgtatttttagtagagatggagtttcaccatgttggccaggctggtctyaaattcccaaccttgtgatccacctgcctcggcctcccaaagtgctggaagccaccgcacccggccagatgagtattttcacaatgtgcatagaataggattggctgctgcctaggtgatgtcagatcatttctgatctttttttttttttaaaaaaccaacatatgcatttggtaagtgatatgatgcttatcctttggtttttcttattcaaggattacttaccatgtggagaaatggagtggtcttgggcctgatgaaatttcatgaaatagtggctatatttctgtcctgggaagt

SEQ ID NO: 161139 - DNA, 601 bp, Human
agctgcagacgcacataccctagggctcagcagttccactcctgggtatgtgcctggagaaaccagtgtatgagtgtaaaaggatacctgtaaaaatgttcacctgtgtgttatgttagtaaaaaataaaaaacaatttagctgtcctttcagaaggaaaaaggttaaaataatatatgctatatccatgcaatgaaattctatgcagcaattaaaataaatgaaccagatacacttgtattaatatggatacattttaggaatacaatgttgagaaaaaaagttgtagattgatacttamtgtctgataccatttatttaaatggttgaaaaggcacaaactaatactacatattgtttagagaggcaggggcatgggagtggggagtgctaaccacaggtttttattttcctatgtaatttatttatttattaagacaaaaaggcctaatgtaaatatggctaagtattatgatgtgaagaaacttgggtcatggctacatagaagttaatgacattattctttgtacttttccatatatctgaaatttttcataacatgaagattgaaaagtgatagcacaagagaccgcacatgtcc

SEQ ID NO: 161140 - DNA, 601 bp, Human
atatatgctatatccatgcaatgaaattctatgcagcaattaaaataaatgaaccagatacacttgtattaatatggatacattttaggaatacaatgttgagaaaaaaagttgtagattgatacttactgtctgataccatttatttaaatggttgaaaaggcacaaactaatactacatattgtttagagaggcaggggcatgggagtggggagtgctaaccacaggtttttattttcctatgtaatttatttatttattaagacaaaaaggcctaatgtaaatatggctaagtattaygatgtgaagaaacttgggtcatggctacatagaagttaatgacattattctttgtacttttccatatatctgaaatttttcataacatgaagattgaaaagtgatagcacaagagaccgcacatgtccacagaactcttaatcttgtggaacttttgatctttttcttaatagcttttctatcctgaaacagtagcatttaaatacagagcttgttgtacatagtctcacagtgggaaactgagaacactttataactaaacatatgtacaactcacactgaaacaaccactgtggcttc

SEQ ID NO: 161141 - DNA, 601 bp, Human
cccacaggatctgtggccagggtggccagattttctttggtgctaagcacgaggactgtgcccaaactggacgtgatggaaaggatggtggctctatcagtttcattaccagggttcagactttcgcgggttacgggacaaagtccttctgcattttattatacgcagatagtcgcacactctggctgggatcagttaaacagactgacacttttgcttgtgccttactctttcgacctcctggaactctccagtgaaaccttattcctcgtaaaatgaactagccaggcttggggctgtsaatataggaaacattatcaaggaagatattccaaagagctgccgtgggactacataagtcagaaaaaatgcggaggacttcctcctgcaacccaggggagtctgttcacttgcaacaaatctgacagatccacttttgaatcctctgtctggaactacttaggaaaagacaagcaaggatttaggatatttagggtaaattttaaatgtgtttcactgaaagagagagagaggaaggtgttttaatatggttccaatctaagacctttcttttccatgactaaacattttactgaaataa

SEQ ID NO: 161142 - DNA, 601 bp, Human
caaagagctgccgtgggactacataagtcagaaaaaatgcggaggacttcctcctgcaacccaggggagtctgttcacttgcaacaaatctgacagatccacttttgaatcctctgtctggaactacttaggaaaagacaagcaaggatttaggatatttagggtaaattttaaatgtgtttcactgaaagagagagagaggaaggtgttttaatatggttccaatctaagacctttcttttccatgactaaacattttactgaaataattggtaagttaccccagaggagatatttcggraaggtgttgttaatattgttatccctggatatcatggtaactcattaatgaacctcagcacattagacagctgtggctattggaagcatgttttcaatcatcagttcagagcaaggcatgaaggaacatcctattggagtgcttgcttttttttctactgggagattgggcctttgctggttagaacaatcaggggctaaacagcatatttcatttcttagggaggtgctaaataggagtaacaacaataataaatggcaaccacgtgcccggcactgtgctaggtgcttgtatacataa

SEQ ID NO: 161143 - DNA, 601 bp, Human
tcaaaaatttcatcatcctgggtcacaaaagatcatgacgactgtattataatacaataatggtattcatgcagtggcgcacagaaaattgtgtgtacttgacgcacaggcggtgtggaagcaggatttaaagtagaactcctgtcaaaaacctttcctccagagcctccactgcctcattctgtgatgtttcaatacgtcagtttctgctgttggtaaaacacatcttacctccccagtatgttggggagcagtgattgatgaaggaggattaatttgctgcttttcgggagggactccktgcagtctccaggggattacatgtattatggtgtttccacagaaagctagaccagggattggctaaatctggcccactacgaattgttctactaccacaagctaaggatggttttcacattcgtaaaccgaggaaaagaaatcaaaagcggaacatttcgtgacctgtgaaaattatgtgaaattcagacatcagtgtccgtacataaaaatgttattggaacacagcacatgcaccagtctgcgtgttgtctgtggcagctttcatgctgtcacagtggagggagaggttgtgacagac

SEQ ID NO: 161144 - DNA, 601 bp, Human
ggggggtcaaaaatatttatagtaaagtggtagaattcaacaaagtatttttgggactttctctttgctgctgcagccccgaccggttttcccagggggaatctgaggatggcccctgaggagaggctgggcgtgtcagcatcactggcatttttcagtttgagatttggatgacagtttatatgcttcttaattgactttaacctgctgcccatccctagaagtaatagtaatggtaataaaagttacacaatcacatcgccacagctctgtcctgaagggcttgcatagctggatggarcacttaattgggatggtccactctgctggggaagtgcaggagactatgtgcctttggaattttcaactcttcagggtcaggaactgccagacctctcaggaaggatgaagcacgactctctctagttgctctcttatttacattgaggcccttgggtcagggtgaggctttgcgtctccaaggtagcctttgagctaatgaaacccactgtggggtgagagatgcgaaattaacctgatttgctgcaacttcctgtgcactgtcgggcttaccagccagtaggctgaagaacccttgaga

SEQ ID NO: 161145 - DNA, 601 bp, Human
tgttgagctttggtcatttttgaactttatatagatggaatcacactatactttttgtgacttgcttttttctcatagcattgcatttcccagattcctctctgctgttgtgtgtacctacggttcactcattttcattgatagagtgtccagtgtgtacataaaccatactgtttatctgttttgttgatgggctttgcggttgtttttgctgctttgaacatgcttgttaaattcctttttagaaaactaatgatcaggaggactcacttaagtgaaatagtttttctatgagaaaaayagttctacagtttaatgaaaattgtaatatctgcgccttgaacaaacagatgtagtttttattttaggacgcatgctaactacctatgaagtgggtttatttttagtggcttttttttggttaaatttttttccccagagttgaacaatgatttattttaatttctaaaccaaatcaaggcatttattgtaaaaccactagaaaataagtcttcccaatttaacagcatatgttttataaatattttaataaaatgaattttaaaatattaaataattttagttagaatgtgaagtactt

SEQ ID NO: 161146 - DNA, 601 bp, Human
taataaaatgaattttaaaatattaaataattttagttagaatgtgaagtacttctctaaattaaacattaataaagctttttcatccagagcaacaaaagaattgcattatataggtaaaatggcctctgccctactcacatttatttgcggactggaaaagtaatgtttatttctaacatatttttagcttcaaaagactttagaaaccttttgaaataatctgcagagctgtgcaaaggcaccgaggtttaggacaggcaggaagctatagtccactcagcattttttttttttttttgactggaaagaaaaccaaagcccagagtaattaaattgctcaaccaagatcactcggaggcttgcaatgcctttgaaatacaatgactctaaactagctatatgaatctgtactaccatttctaaattagaagccacaagttgctttttataataatatatattttgttgcttctgtgcatcttaatttattttatataatttaaaaaacaaagtcactaatcaaatccataatgacagtttgggatttgatttttaaaatgcttttctctaccctgttgactgtgccgagcctagagag

SEQ ID NO: 161147 - DNA, 601 bp, Human
tgttgcttctgtgcatcttaatttattttatataatttaaaaaacaaagtcactaatcaaatccataatgacagtttgggatttgatttttaaaatgcttttctctaccctgttgactgtgccgagcctagagagtctatttagttcccgtaggctggtttctgggattgacaatatttccattgtcatacaactctgctgtcgccagtgatgttcgaggaccagcactacccttgaaggatcctgctgttgtgtcaacaaataatggcacaggcctctctgacagcttgtccacaaactmtcctgagggtttctgtctgaaggaagcagcagctttgcaagagtgattttagtgaggtcgtttggattagattgagttagtgggccgtgagttccgtgcatttagggttgtgtgtgaggcttttcgtgttcttgaaatctcctccggccctcccggtcacacccctccagtgccacgttcagccctctctctctgcacccatcctgaaatagccatggttcagcatggaagaaatccactcctctcatctctcagtgctggtcagctccgcatttgcctgggggtgggttttgactgtct

SEQ ID NO: 161148 - DNA, 601 bp, Human
cctagagagtctatttagttcccgtaggctggtttctgggattgacaatatttccattgtcatacaactctgctgtcgccagtgatgttcgaggaccagcactacccttgaaggatcctgctgttgtgtcaacaaataatggcacaggcctctctgacagcttgtccacaaactctcctgagggtttctgtctgaaggaagcagcagctttgcaagagtgattttagtgaggtcgtttggattagattgagttagtgggccgtgagttccgtgcatttagggttgtgtgtgaggcttttcrtgttcttgaaatctcctccggccctcccggtcacacccctccagtgccacgttcagccctctctctctgcacccatcctgaaatagccatggttcagcatggaagaaatccactcctctcatctctcagtgctggtcagctccgcatttgcctgggggtgggttttgactgtcttctccttaaagagaatctctgcacgtgtaaaatctgtttcaggaaagtaataggaaggcagcaggacttggagcctgatggtgtggattcagcttccagttctgccgctcactgggtgacctgggc

SEQ ID NO: 161149 - DNA, 601 bp, Human
cttacaaggctgggcacggtggctcacatctgtaatcccaacactttgggaggctgaagcaggaggattgcttgagcctgggaattcaagaccaccctgggcaacatagtgagacatcatctctacaaaaaatcaaaagttagccgggcgtggtggtatgtgcctgtagtcccagctccttgggaggctaaatggggaggatctcttgaacctggaagttccagactgcagtgagctgtggtcatgccattgcactcagcttgggtggacagagaccctgtctccaaaaaaaaaaaaaaaattcagagatgaaaagtgctaagaaactgaagtaattaacagtgctgacccatttgaaataaaattattcatgagctcacttgcctctttttgtgcacaggagattgtataggtggctatgattatttttataaaaaattggattctaaacaagtttatcaaatacttagtatccaccttaaaagctttcacgaattaaatttaacccttaaatgatgcagtgatccgcactgaactttctgattaaaacaaaggaaagctaacaacacttatcgtttcaactagagttcgttaaaaaaat

SEQ ID NO: 161150 - DNA, 601 bp, Human
aaaaaaaaaaattcagagatgaaaagtgctaagaaactgaagtaattaacagtgctgacccatttgaaataaaattattcatgagctcacttgcctctttttgtgcacaggagattgtataggtggctatgattatttttataaaaaattggattctaaacaagtttatcaaatacttagtatccaccttaaaagctttcacgaattaaatttaacccttaaatgatgcagtgatccgcactgaactttctgattaaaacaaaggaaagctaacaacacttatcgtttcaactagagttcrttaaaaaaatattgtggaccatttacgcaccaggcgctatgtgaagactgcacagatgatggtgatgtgagcgtcagagcccctgccctcgttcttgtgggaggcacagatgagtaaatacgcagttaccagaatcatacgaccaattccatgatgggggaaggtgggtgtgctgagggacacctaactgagactgagacttggccgagcagttggtgagggcccagggagggcagcctctaagttgagacctacaagatgaaaaggaaggccgagaggaatgatctagcagaggcagaa

SEQ ID NO: 161151 - DNA, 601 bp, Human
gattatttttataaaaaattggattctaaacaagtttatcaaatacttagtatccaccttaaaagctttcacgaattaaatttaacccttaaatgatgcagtgatccgcactgaactttctgattaaaacaaaggaaagctaacaacacttatcgtttcaactagagttcgttaaaaaaatattgtggaccatttacgcaccaggcgctatgtgaagactgcacagatgatggtgatgtgagcgtcagagcccctgccctcgttcttgtgggaggcacagatgagtaaatacgcagttacmagaatcatacgaccaattccatgatgggggaaggtgggtgtgctgagggacacctaactgagactgagacttggccgagcagttggtgagggcccagggagggcagcctctaagttgagacctacaagatgaaaaggaaggccgagaggaatgatctagcagaggcagaacatttctgaaatgagttctttttctgaacactatgttgaatacagctgaacattttctgatggttgaggatctcatgaccttcagggtaattgtttttatcaccaatctttagctatctagtgctgtgga

SEQ ID NO: 161152 - DNA, 601 bp, Human
tgaaggatccaatgagataaagactgaaaagtggtcagagccgtgctccttaaaatgtgattcatgggccagcagtaccagtgatatctgggaacttgttaggagtgcaagatcctgctcttcactaagaaacatattctggatataaaaatggttgttgatgaccctgacattatcatcttcattggcatggttgagatagaatcaacattgcagtaaatttaggagttaatgggaaatgagacggtggaaataatatagtcttgcaagaaacttggctaaggtaggaaagagagaaatygttagagatggatataagttaagacatagttttagtatggcagagacttgaccacctgttttttagcttaaagcaaagtatagacagtttgaggtttatgaggaagttggataatgggtgatagtgagtcctggaggaaaccagaggggttggaaaataggtaaagtggctttatttctttaaattattttttaaaaattttagacttcaataatttaatcatgcaattttgtggttagaaagaggttgtagtgactataaattgacataggatatgtagacacaagatcagaaagagca

SEQ ID NO: 161153 - DNA, 601 bp, Human
aaaatgtgattcatgggccagcagtaccagtgatatctgggaacttgttaggagtgcaagatcctgctcttcactaagaaacatattctggatataaaaatggttgttgatgaccctgacattatcatcttcattggcatggttgagatagaatcaacattgcagtaaatttaggagttaatgggaaatgagacggtggaaataatatagtcttgcaagaaacttggctaaggtaggaaagagagaaattgttagagatggatataagttaagacatagttttagtatggcagagacttgaccacctgttttttagcttaaagcaaagtatagacagtttgaggtttatgaggaagttggataatgggtgatagtgagtcctggaggaaaccagaggggttggaaaataggtaaagtggctttatttctttaaattattttttaaaaattttagacttcaataatttaatcatgcaattttgtggttagaaagaggttgtagtgactataaattgacataggatatgtagacacaagatcagaaagagcaactaactccagcctgcagtttacacacagtggcttctgcaaggttgatcca

SEQ ID NO: 161154 - DNA, 601 bp, Human
aatgtgattcatgggccagcagtaccagtgatatctgggaacttgttaggagtgcaagatcctgctcttcactaagaaacatattctggatataaaaatggttgttgatgaccctgacattatcatcttcattggcatggttgagatagaatcaacattgcagtaaatttaggagttaatgggaaatgagacggtggaaataatatagtcttgcaagaaacttggctaaggtaggaaagagagaaattgttagagatggatataagttaagacatagttttagtatggcagagacttgaccacctgttttttagcttaaagcaaagtatagacagtttgaggtttatgaggaagttggataatgggtgatagtgagtcctggaggaaaccagaggggttggaaaataggtaaagtggctttatttctttaaattattttttaaaaattttagacttcaataatttaatcatgcaattttgtggttagaaagaggttgtagtgactataaattgacataggatatgtagacacaagatcagaaagagcaactaactccagcctgcagtttacacacagtggcttctgcaaggttgatccatt

SEQ ID NO: 161155 - DNA, 601 bp, Human
aaatggttgttgatgaccctgacattatcatcttcattggcatggttgagatagaatcaacattgcagtaaatttaggagttaatgggaaatgagacggtggaaataatatagtcttgcaagaaacttggctaaggtaggaaagagagaaattgttagagatggatataagttaagacatagttttagtatggcagagacttgaccacctgttttttagcttaaagcaaagtatagacagtttgaggtttatgaggaagttggataatgggtgatagtgagtcctggaggaaaccagaggrgttggaaaataggtaaagtggctttatttctttaaattattttttaaaaattttagacttcaataatttaatcatgcaattttgtggttagaaagaggttgtagtgactataaattgacataggatatgtagacacaagatcagaaagagcaactaactccagcctgcagtttacacacagtggcttctgcaaggttgatccatttggccaaagttgtccatagcaccttgtaggtagagacttgtgataagtggatcaagcattcaaagaagccgggcacggtggctcacacctgtaat

SEQ ID NO: 161156 - DNA, 601 bp, Human
caaaaattagccaggtgtggtggcagacacctataattccagctacttcagaggctgaggtgagagaatcgcttgaacccagaaggcagaggttgtagtgagccaagattgcaccattgcactacggcctgggcaacagagcaagactctgtctcaaaaaaaaaaaaaagcattcaaagaaatgaaggccaacttccagaacatgtggttgacagtggtttttttttttttcagataaaataaatatgcaaaagacataaatatccttacatagaagtgtatgaacaaatataaatcatcrtagtgtatgggatgaggtgaaatgactgccattttagaggtgtgaagcttggctttccatccaactatgtgtctcagggtttccttaagaggcatcgctgtataccagcagaagcctgcagctttgggggcacagacctggcttgaattctcagtcccttacttcttagcatgttagcttgggcacattgcttagacacactgagcatttgtttccccattccaaaaaaaaaaggcatactcactacacaggattgttatgatgactaaaagacaaagtgtgcatgtaaactgtcaggga

SEQ ID NO: 161157 - DNA, 601 bp, Human
ttcatgaaaatgctgttaatgaaatttaatgtttcagaaattaaagcaatcaatccactattttgtaaatactggggagacttcagtggtcagaggattaactggttggttaactctctttgtctcaggttcccagcagatcctctaaaggagaaatcagtgaattaatcactcagtcaacaactgctacttgaatgcctaagctatggaagatgccattgtagacacagagggagatccaaaccaaacaacaacaaaaaccctgggagtccttgtcctcaaggagcttaaagtctatcakaacataagacattccaggaaggaagtgattcaggccaagtgaggagccaaacagcacacagtgaagaaggtattcagatgaggagaatggtatttgcaaatcaactctatatgcaaatgcatatttggagaagtaggcatgtagtaagaccaggtggaatactaatggtgtccttgaaagaaggctcagctgtcctcgtgttgcaatggcctcacctgcggctctgctgctttacagagctcccagctcaagtgggtttttccagcccctttgggttccccagtcaggtggccactgtca

SEQ ID NO: 161158 - DNA, 601 bp, Human
tgaattaatcactcagtcaacaactgctacttgaatgcctaagctatggaagatgccattgtagacacagagggagatccaaaccaaacaacaacaaaaaccctgggagtccttgtcctcaaggagcttaaagtctatcataacataagacattccaggaaggaagtgattcaggccaagtgaggagccaaacagcacacagtgaagaaggtattcagatgaggagaatggtatttgcaaatcaactctatatgcaaatgcatatttggagaagtaggcatgtagtaagaccaggtggaakactaatggtgtccttgaaagaaggctcagctgtcctcgtgttgcaatggcctcacctgcggctctgctgctttacagagctcccagctcaagtgggtttttccagcccctttgggttccccagtcaggtggccactgtcagtcatttactttgaaattgtttcttctactgcactcctaattgcttataaaataggtggtggaagaaattgaagtggatatattagggcagtgttgcaaacttaatttttatcatggggatgagatggccttgcactggctcatatttaaaggcttgtgt

SEQ ID NO: 161159 - DNA, 601 bp, Human
gcctcctgagtagatagatgggactacagatgtgtgctgccatgcccagctaatttttaagatttatctcagagacagggtcttgctatgttgcccaggctaactagtacttttctgaaaggcacagaaaggtcagcaggtataaggacaccaccagaacaagggtttggagtcctgcactggaaatccactctaatgaatgattctatcaaagatttcatgaaaaataatccagtatctatgttgtcctgaaattttcaacaaggaccactgtggagacccatacctacacacattgctrcactcattgctacacccatacctacacacattgctacacagccattttggtcacggttctgaatgacgttgccacgtcctgaagaaaaccccagtcagcttggagagggcagcgagggaggctgcaggctgacggggtgaacagtgcaccatccacagattacaagggcatgcctgtctcatgcgccaaccaaaatgatggtgggactcagtatcactccatgtgacacttatcaccttgctttgggtgattagaaccaattaagagggtgacacatagcagagatggagaaagaaaaca

SEQ ID NO: 161160 - DNA, 601 bp, Human
gttacctgttctgcgagagtaatgttggctaataagcctggtgggaaattcttttctcttctgagggccttgctgttatttcatgtttcattcccaggaagacacaaagcctgtccatttggtgtgagcagtgaatggaggattccgacaggtgcccttgcaagcttcctggtggaggagccattccgagggcatcagtcttgttttgatcttttctcagatggaagacttgaatggagcactctctcagcctgtttagggggctctttgatcttgctgtgcctaataggcagaactctcytctctttttcctctgaggacaaaaataaacatagatgctgagtttgtgaacagctgcataaacaatgcaatttggaagtatgcaaaaatatgtgggttatatatacatccatacgtatagcctcttgatctgacttttgcatccttgtgaccaccgcttgatctgagagacatttccatctgatgcaatgatatccagtcccttttaatgctccaagggatttaaggcctcagagcatttggacagaagcatttctttcctctggatgtggctcaattctgggatatcccgactacagca

SEQ ID NO: 161161 - DNA, 601 bp, Human
gacctcagaagtcacttgtttaacctcctgcatgctgtagagccttcacccacagagcctcagagcctccatggtggtctcagtctctgcttgaatacggctggtggagaggacagcttcctataaccctactcagtcacatcagaccaaactcctacatcttcatgtaacacatttgagaaacctcagttgagcacctgttttgcgtatgatgctatttactagtgatacaagttgaagaagacacagctttccctcattaggggctcatttagttctattagcaattccttagatgacrttgtttccaaacccatccctgctctcaataccctcttttgcagagttacaggtcatttaaaacctgacttcaaaattggacataacactttatgcacagtctatgctttgcacttctgttgagacttgcgctaggatcagcccaaatcccatgttttactcatccccacttcacagacagctgtgaaatcagatgtttttcatattatacttattagtggataatacagttcagtaaactttgagtacctactaaatatgcagcactctactaaatgttgtctcgaaaatatgattctgg

SEQ ID NO: 161162 - DNA, 601 bp, Human
ccaccctcagcctcccccatacatgctccatcactgaagcctgtttattcctttcatggtacagtatttaccccaagtcatgattaaatatctgtttatatatttctttattggattatttgtttatttttctctctctagactgcaagctccttgagcagaccatgtttattttgtctaccacaggtgctcaataaatatttttgactatttattacatgagaaggtttccatgcaaacacccattgaatacgattgaacttgaaccctaagagatgggctgtgacctttgttgccctcraactaatcaaaggggagtgatattcaccatccagaatctagaataacttagaccttgtgggccaggagctagctacccatatgataatacaagagctctcagagaaatcatggaagttttgagcaatctctctctccctttgctaatttacttttcaaaactgaagtataatggaataacttccccacctctcaaatgtcagcatgctctgaaatttcatgttctctcaggcgagcgattcatgttttccatcccacccaccgttctctgccttgtgtttaaggatgtgagtgatagtct

SEQ ID NO: 161163 - DNA, 601 bp, Human
aagctgactaaaccataggcttgtttctcttttatgaaacaggaacatcttttagatgacgtggtgaaaagtgaatatatttgatgggataattgctgtccattcaccatttttaggattgataactttggaagagctggtaaaggttaagttctgccttagagaaacttttaccagtagctgttcttttattgtgcttttattgtgatatcaaaagtgcacgtggcctggtttgattttttcccctctttgcaaacttttaggacttgatttccatcctgtttcctgaaactttaaaatkatctgcattttggtgagtcttttttcattcattgttaagatggccaattcatcttattcacctgcagttaagaaatattctgttatagtcttttatttataatttcctccattattttttcttggaatttctaccaattggatattacaagtcctaggttgatccactaattttcttatctttctcttcccatttctctactttgtattctgactctgtgtcctatcttagaaccttgacttaacttatatgggccttaatagcctcatctataaaatggaattattgatggtacctttt

SEQ ID NO: 161164 - DNA, 601 bp, Human
tttccaaaagttatttcttgttctcgaattgtttcctttttgaaatcacatactatttcctggatacagtattttttctcatctctctgaggatgttaatgacagctttctttataagtttttcttctaccccctgaattccctctgattatgccagtttccttttttccacctgtttgtttgatttctgtctttcatgtttgaggctttcctcagatgtttagtgacttgggccgtctctttatctgcaggaatgaagctctgagacactgaatgggaggggtgtgtggggctgtgtgtrcatgaatgaatatgtgcacaccctgtgggccagcaggcctccctatagggtccaggcagggagcaagctgttagttgggagcctataaacaccagagccagtaggtcatttacggtggccatttggtttcactggagaagaatcccccagttttctgccagcaggtggggtgaagatacatgtctgcttctgggattgagagggttgagtcacagcagggttcaccccacagttctgcacacagccatccattaaactctctgccctctgctgtgcctgactctgcctggtccagaccct

SEQ ID NO: 161165 - DNA, 601 bp, Human
cagtattttttctcatctctctgaggatgttaatgacagctttctttataagtttttcttctaccccctgaattccctctgattatgccagtttccttttttccacctgtttgtttgatttctgtctttcatgtttgaggctttcctcagatgtttagtgacttgggccgtctctttatctgcaggaatgaagctctgagacactgaatgggaggggtgtgtggggctgtgtgtacatgaatgaatatgtgcacaccctgtgggccagcaggcctccctatagggtccaggcagggagcargctgttagttgggagcctataaacaccagagccagtaggtcatttacggtggccatttggtttcactggagaagaatcccccagttttctgccagcaggtggggtgaagatacatgtctgcttctgggattgagagggttgagtcacagcagggttcaccccacagttctgcacacagccatccattaaactctctgccctctgctgtgcctgactctgcctggtccagaccctcttcagatcctgaactattgagatcatgttctcctcacagtatacacggtgcagccacagtatagc

SEQ ID NO: 161166 - DNA, 601 bp, Human
ggaagagcatcagatagaaaataggactcctgtcctttcgaggaactcggttggagcttgaaatttaacatgcaaaatttaagcaacatataaagtgtttataagtgccaaagaagtagtttatggccgggcacggtggctcacacctgtaatcccagcactttgggaggccgaggcaggcagatcacaaggtcaggagattgacaccatcctggctaacatggtgaaaccccgtctctactaaaaacacaaaaagttagccgggcatggtggcgggcgcctgtagtcccagctactcggraggctgaggcaggagaacggcgtgaacctgggaggcggagcttgcagtgaaccgagatcgcgtcactgcactccagcctgggctacagggcgagaatccatctcaaaaaaaaaaaacaaacaaaaaaagaagtagtttataaaatataggtagatgattttgaatagggagttactttggtacttggaatgtttatgattcaggacaggcaagaccccaaattgggactaagcctgggagggttctcggctttgcctaggaaagaattcaagggcaaggcagtggtattaaacagcaacg

SEQ ID NO: 161167 - DNA, 601 bp, Human
tggagcttgaaatttaacatgcaaaatttaagcaacatataaagtgtttataagtgccaaagaagtagtttatggccgggcacggtggctcacacctgtaatcccagcactttgggaggccgaggcaggcagatcacaaggtcaggagattgacaccatcctggctaacatggtgaaaccccgtctctactaaaaacacaaaaagttagccgggcatggtggcgggcgcctgtagtcccagctactcgggaggctgaggcaggagaacggcgtgaacctgggaggcggagcttgcagtgarccgagatcgcgtcactgcactccagcctgggctacagggcgagaatccatctcaaaaaaaaaaaacaaacaaaaaaagaagtagtttataaaatataggtagatgattttgaatagggagttactttggtacttggaatgtttatgattcaggacaggcaagaccccaaattgggactaagcctgggagggttctcggctttgcctaggaaagaattcaagggcaaggcagtggtattaaacagcaacgattattgaaacagcagtgtacagcagcaacagaggtcctgctccttgcaga

SEQ ID NO: 161168 - DNA, 601 bp, Human
tagggagttactttggtacttggaatgtttatgattcaggacaggcaagaccccaaattgggactaagcctgggagggttctcggctttgcctaggaaagaattcaagggcaaggcagtggtattaaacagcaacgattattgaaacagcagtgtacagcagcaacagaggtcctgctccttgcagagcaggcagtgtgcccagagcagcagctcaaaggcagtctgcactcacattgatacccacttttaattatatgcaaattaaggggcaatttatgcagaaatttctaggaagaggscggtaacttctgggtcatctggtcattgctgtggaaaggggtggtaacgtctagctgttgccatggcaatggaaaacacgtggcacacactggtgggtgtgtcttatggaaagctgcttctgtctcggccctgttgcagctagtcctcactttggtcctgtatccaggtcccacctcttacctcagttagggactattaattgagtgccaatgatgtgtctggccctaaaataagttctgaagaggttcagagaataatacacagtatatgttctcaagaaacttctattttaggtagag

SEQ ID NO: 161169 - DNA, 601 bp, Human
cataaatcctttccctaggcttccataaccctatggttacacctaacccatgtcctcaaatcccatattagcattacatgcaaatgacagcactggggagaagcagggagtgaatcagagcctgttgatggctctgttttgattacagccatgggtttgcttaagaaagatattgtgccttcattgtgactggcatcaaaggtatgtgaagatactacctaagctaggtgtgagaagcccaaatacattattactaatgattttcataagggctaaagagtttaggccaaaaataattaaagagaacaatagtgctgtcaataaaactcctcaataatgagatagtaattaatggacgaatggcctcattgttctttttggctctaggcattaagcatctcattttaaaagttgtggtaagtagtgcaatattgctcatttatatttttatttagtactgttaatttatttcactttttatttaatcttaaatcttttattttaatataaaaattggaatgatcctctcctttccccccattataaactttacaagcaagagtggttttggtgctttggaactttctcagttcactcccta

SEQ ID NO: 161170 - DNA, 601 bp, Human
tcctcaataatgagatagtaattaatggacgaatggcctcattgttctttttggctctaggcattaagcatctcattttaaaagttgtggtaagtagtgcaatattgctcatttatatttttatttagtactgttaatttatttcactttttatttaatcttaaatcttttattttaatataaaaattggaatgatcctctcctttccccccattataaactttacaagcaagagtggttttggtgctttggaactttctcagttcactccctatgataggtcctgtaatcaggctcttaytacatgttttgatggtgttattgatgatcatgatgagtttcaggtgcgtttttgttgcctaataatacagattctctggtgttctctatgacttcattgtatggggtcagcctggccagttctcctcatggccctttctccctttaagccccagaagccatcgggaaaagcctttcaccttattttttcagcaaagcctgcaggatgccatggggggatactcttacaggactattctaggcagcaagttttcttcatacagtggttcagagattttggataagcaataagaatggttct

SEQ ID NO: 161171 - DNA, 601 bp, Human
tttttggctctaggcattaagcatctcattttaaaagttgtggtaagtagtgcaatattgctcatttatatttttatttagtactgttaatttatttcactttttatttaatcttaaatcttttattttaatataaaaattggaatgatcctctcctttccccccattataaactttacaagcaagagtggttttggtgctttggaactttctcagttcactccctatgataggtcctgtaatcaggctcttactacatgttttgatggtgttattgatgatcatgatgagtttcaggtgygtttttgttgcctaataatacagattctctggtgttctctatgacttcattgtatggggtcagcctggccagttctcctcatggccctttctccctttaagccccagaagccatcgggaaaagcctttcaccttattttttcagcaaagcctgcaggatgccatggggggatactcttacaggactattctaggcagcaagttttcttcatacagtggttcagagattttggataagcaataagaatggttctgctgggcccactggtcataacttgtctaattaatgcatgtcccatta

SEQ ID NO: 161172 - DNA, 601 bp, Human
atatttatcaagacttaatttaatgaacttttcctcccttgctccaactttactttgtaaccctcctcctgaagaaaaggtgccaacattccactttaagtctaagctgaaatcatagatgatcctaagtgttttagaagtaaattagtgactcaagtcccaccagttttcctctgtcttccaaatgacactttttcctgaggcttccgattggatccaacgtgactggggcttttagcccccttcttaggctcctcagagtccatgctgagaatgactcagccaatttcagagatatggrttccttttgaagacccctgtttcatctttgacttttataggaaaggttggattggatgggctggctgttctctgtgtgggcacttgaaaggtaaggccttcgaacttggccttcgggtgtgttcagggccagggacttgtacacagaggaagtctggatgtgctttttaaatcttagcactgtgacttgagttttgccatttcaccttgcagtgtttgggaatcgtgtcgtagattgttgacctagccttgacactcagtggttgttgaggagtgaggagggtgtggctagggggcggag

SEQ ID NO: 161173 - DNA, 601 bp, Human
taaatcttagcactgtgacttgagttttgccatttcaccttgcagtgtttgggaatcgtgtcgtagattgttgacctagccttgacactcagtggttgttgaggagtgaggagggtgtggctagggggcggaggtgggaatgttggttgagaaagactaccaaaatgttagtgtgttgagaagtaacaggaacagtgcttgggcatggaaaagtttggcatgacagcctcttcctacagaaactttcccagaaatttctcaggaggaaggagttggctcagggtttccaatggattatctytggctatgatgcccaaagaatcttgacactaaggatttatagcttttactagttctgaatattaagaaatagtagagtccattaaaaatgcttggagtttgttgatatgttgggggctggtcatttcctccttgaactctgacctgctagaagctctaatgagtcatgaatgggctaatgagttgtcacctttagtttatatttaaatactaccttagagatgtgaaaacttgaacctgactctcatagcttcattatggacccacaaatgtaaccgactggatggatggtttccactga

SEQ ID NO: 161174 - DNA, 601 bp, Human
atatgttgggggctggtcatttcctccttgaactctgacctgctagaagctctaatgagtcatgaatgggctaatgagttgtcacctttagtttatatttaaatactaccttagagatgtgaaaacttgaacctgactctcatagcttcattatggacccacaaatgtaaccgactggatggatggtttccactgagattttggcctggtgtaattcggctgctgcttgaggctatttttggaggcttttggagtatcgtaggagtacatctatccagtgtctttgtttttttttttttttaatttttatttatttatttatttatttttgagacagagcctcgctgtgtcacccaggctggagtacagtggcgcaatctcagctcactgcaagctccgcctcccgggttcacgccattctcctgcctcagcctccccagtagctgggactgcaggctcccgccaccacgcccggctaattttttatatttttagtagagatggggtttcactgtgttagccaggatggtctcgaactcctgacctcgtgatccacccaccttggcctcccaaagtgctgggactacaggtgtgagccacc

SEQ ID NO: 161175 - DNA, 601 bp, Human
tgtaaaaattttccctcaactgtttggggatgcactggctgccatttattcttaacagcttaaataaaagagaaagggagaggaactctcattctatccaacaaaatccttccatcaaacacagagcttccctttcctccttacttcaacaggtagattccttcaaagttggaatcctttttgtaacatagtttgatgacccctgtgtgcattggatgcataatcactaaggatacacatctattagaaatgaatagaataccaaaaagagaaaatcaatgggattccatagaagtcatayaactgactgcgtgagatggaaacatcctgatggaaatgcctgtatgatgccagtcatcacagtaatgggaaatcttccgatcactgactatattttgggggccttgccagacactggtttgtttgcaggtgctccggtttaatgacttgccttcatgttccagcaacgagctcttcctgcttgtccttactctgtggaaccaattccaacatcagaagttgaaatgaggcacaaatgccttttcctctattttctctactcctcaggtttttggttttacttttttttttggacagttat

SEQ ID NO: 161176 - DNA, 601 bp, Human
atgacccctgtgtgcattggatgcataatcactaaggatacacatctattagaaatgaatagaataccaaaaagagaaaatcaatgggattccatagaagtcatataactgactgcgtgagatggaaacatcctgatggaaatgcctgtatgatgccagtcatcacagtaatgggaaatcttccgatcactgactatattttgggggccttgccagacactggtttgtttgcaggtgctccggtttaatgacttgccttcatgttccagcaacgagctcttcctgcttgtccttactctgyggaaccaattccaacatcagaagttgaaatgaggcacaaatgccttttcctctattttctctactcctcaggtttttggttttacttttttttttggacagttataatttggcaaatttgtatacttttatactggcatatcttaaacttttacctgttgctttatatcattcagtttggatcacattggaatctcagctaacctcattcttagaatgtcagttaaatgccactctttcatgagaatcctgatggcctatacttggttagatcttcctgaatactctttttcctcccctt

SEQ ID NO: 161177 - DNA, 601 bp, Human
gcccagcccctcaacactctttatagcacctgaactactgctttttaaatcatctgccatcctggctagaccctacgctggacaaggacctggtctgtcttttatgcatttatttaattaaattttcttccttttcctttttttagagatagagtctcactcttgacacccaggctgcagtgcaatggtgcaatcgtagctcactgcctcctccaactcctcggttcaagtgatcctcctgcctcagccccccaagtagctaggactacaggcacacaccaccacacctggctaatttttwaaatttccattgagatggggtctcactatgtcgcctaggttgatctcgaatttctggcttcaaacgatcctcctgcctcagcctcccaaagtgctgggattacaggcgtgagccatcgtgtccagccaggacatggtcttctcgtgtattgttttatccccagttagtgtgtagatctcttgtgtgtacagtagggattccacaatttatttagttgaattggattttattctctttttttttttttttgagatggagtttcactcttttcgcccggactggagtgcaatggcaccatct

SEQ ID NO: 161178 - DNA, 601 bp, Human
gaccccttgatccacccaccttggcctcccaaagtgctgggattacgggcttgagccactgcacccggcccagattggatttttaaaattacatatttttttgcatgtaatcaggaacttgcctgtggacccagggggccacatgcagaaaggtaatctccagtggctttttctagtaactgggtccagtgccctgacattgtgcacatctccccagcatgcctggtggagattcctaaaccagggctatagtccacttccagggccatagtcagagaaggggagaaagtttcaaaacttrtgtgaaaaggctaatgagtaacctcattgaatgtttatcattcttgaaattctctttggccattttactagtcctgtactctctggcttgtgctgctgcctcttatgctatataatgcctgtctcttctattgatgatttcctcttccagccctgttgatgaagatgtactccaaggtccagtccttcatcctctgtttctttctctctctctccttttttttttttttgttgagatggagtctcactctattgcccaggctggagtgcagttggctcactgtaacctccacctcctagg

SEQ ID NO: 161179 - DNA, 601 bp, Human
tcccaaagtgctgggattacgggcttgagccactgcacccggcccagattggatttttaaaattacatatttttttgcatgtaatcaggaacttgcctgtggacccagggggccacatgcagaaaggtaatctccagtggctttttctagtaactgggtccagtgccctgacattgtgcacatctccccagcatgcctggtggagattcctaaaccagggctatagtccacttccagggccatagtcagagaaggggagaaagtttcaaaacttatgtgaaaaggctaatgagtaacctcrttgaatgtttatcattcttgaaattctctttggccattttactagtcctgtactctctggcttgtgctgctgcctcttatgctatataatgcctgtctcttctattgatgatttcctcttccagccctgttgatgaagatgtactccaaggtccagtccttcatcctctgtttctttctctctctctccttttttttttttttgttgagatggagtctcactctattgcccaggctggagtgcagttggctcactgtaacctccacctcctaggttcaagcgattctcctgcctcagcct

SEQ ID NO: 161180 - DNA, 601 bp, Human
tttccagatactactggattttcctcgacaatgcctctggaatccatcccttccttcccctcttggaactcagttcctgctcttttcacagctcaccctgtcaccaggcactgtactctctagaattcctacacttcctacaccactcagcctttgccacatgtttcttcatttccctctttacctttaaataattagtttttttgagggcagagatcaggaattgcttctcttcttgtctctaccagtcagcacagagctgagtagctgttcaacagagttccctaatgatgatgacagkgaaccagaggattcctcccaggaaattttgtgtgtggactttgcctctgtgaatgccaggatgtcagctagaaatgattgagcacaagctatgaggcagagggatggatgaggttagcacaacaaagcagtgttgtgacttcttagtgaatagagacatctttacaatatggaacattcactggatctgctaagttgggtgattgaaaaaaatcagtgccttttttggaatagttcttcattgtctttcatactcatttgcaatgttatcccccaacaagcttgtagagaagtattacta

SEQ ID NO: 161181 - DNA, 601 bp, Human
ttccctaatgatgatgacagtgaaccagaggattcctcccaggaaattttgtgtgtggactttgcctctgtgaatgccaggatgtcagctagaaatgattgagcacaagctatgaggcagagggatggatgaggttagcacaacaaagcagtgttgtgacttcttagtgaatagagacatctttacaatatggaacattcactggatctgctaagttgggtgattgaaaaaaatcagtgccttttttggaatagttcttcattgtctttcatactcatttgcaatgttatcccccaacaarcttgtagagaagtattactattgcctttttatagaagagaaaacagaagcttcgaaatatgaccaaggtcatagagctcaaaggtgtcagaaccacatctctagccctgaaatcctgattccaggtaaaatcaattcaacaaagcatggagttaagcaccaggaagatggagtttcaaatttttttcctaaagaagttttcaatctcgtgagaaacagatgggtaaacaacataactcctaattcaaggtttgaattaagtaagagtgaatcaggacacaaacagaatgtgtgggtgcat

SEQ ID NO: 161182 - DNA, 601 bp, Human
ggatctgctaagttgggtgattgaaaaaaatcagtgccttttttggaatagttcttcattgtctttcatactcatttgcaatgttatcccccaacaagcttgtagagaagtattactattgcctttttatagaagagaaaacagaagcttcgaaatatgaccaaggtcatagagctcaaaggtgtcagaaccacatctctagccctgaaatcctgattccaggtaaaatcaattcaacaaagcatggagttaagcaccaggaagatggagtttcaaatttttttcctaaagaagttttcartctcgtgagaaacagatgggtaaacaacataactcctaattcaaggtttgaattaagtaagagtgaatcaggacacaaacagaatgtgtgggtgcatgaaggtaggagtgagtgattctgtctttgtactaaacagcagctgttcctggcagctttccgtcagggagtgcttgtgaagcatggatgaaagcaggtgtgggtgtatatggaaaacagcatggccgggaggagaaagaccacaccatgtccatgtgctaactggccaatggaggtgaagggtggtggaggctgcgggctgga

SEQ ID NO: 161183 - DNA, 601 bp, Human
gcatggagttaagcaccaggaagatggagtttcaaatttttttcctaaagaagttttcaatctcgtgagaaacagatgggtaaacaacataactcctaattcaaggtttgaattaagtaagagtgaatcaggacacaaacagaatgtgtgggtgcatgaaggtaggagtgagtgattctgtctttgtactaaacagcagctgttcctggcagctttccgtcagggagtgcttgtgaagcatggatgaaagcaggtgtgggtgtatatggaaaacagcatggccgggaggagaaagaccacrccatgtccatgtgctaactggccaatggaggtgaagggtggtggaggctgcgggctggatgatgactgaattaggtgatgtgacattttaggcagcatgagaaagtctagaaacctacctgttgggctagcttaatcgatctcacttagctccagcattgctgagtggttttgtgggtgtctacatttctagtgatattgcagggataaggtgataagacttggcttgtctctgcaaagtgaagaatatgaaaagaaggtgtgaagcaatcaggcttccaaggtctctctgatgtccttt

SEQ ID NO: 161184 - DNA, 601 bp, Human
gttccacatctccccaagctcccaggatgtctccggcacccaccaaccactcatgtactcaggttttccagaatccaaaaacagattctcaaaaaggccgaacatttggcagggaagtatttctaggtaaatgatatgcacagttatgtgatctccatcccagagggaaacattggctaagaggattggttgaagaaaaacaactattagaaaatgtgttcaatggggtcatgtttatgctccttctgtcaactaaaactgtgtgtttaaacaatgtctttggtttattacagtcatcacrctgtcagtagcagataatgtgcttgaatttcacaagtgtatgtaaatgatctagggtagcagggcagctgtccccagtcaacgttttcacattgtgataattctcaggaaagagaaagacatacttaagagttgtacgttatctgtcttctcagtaaccaaagtgtctcctaatgtatgcattaatttataatttggcactgtttttaaaacctgggtttgatttttagtcaaaatacagatttatggtgggatttatttcacagtacttttttgcaagagtaggaaatgttggaatgca

SEQ ID NO: 161185 - DNA, 601 bp, Human
ttctgaactttagagacacatatcaaataccaagagctcaagacagtgcctcattgcgattctatttgttgacaatggtgatccttttaagatcctgaaatgtttctcagcatcacggcagctttgtgtgtgcgcctccaacttcacgggggcgctctcagccagtggggaagagtacactcttagagcggaatttgcatcagaacgttgggtcaagattgctgaaacaatggactttggtgattaggatgttgctttaagtcactattatttattagaagttgtgtttttttttttttttcatgaagatttttcattaggtttaagctttatggaaccaaattgcccaaatctctggaagtcatttttaaataaccagcaattgcttttcagcctactaaaggataggatcatcagtagaatcatttctataaattaatctataaggttagtgtaactctaatcaagtttttaatgggacttgctttctttagagtctaacaagttgatttctaaagttcaactggaggccgggcatggtggctcacacttgtaatcccagcactttgggaggctgaggtggaaggatcacttgaggtca

SEQ ID NO: 161186 - DNA, 601 bp, Human
ggatcatatattagttcagtagaacaggacaaaatctgggaatagacccatgtatacataatataacccaactatttctagggccccatatggcctagtggatgtaaatcagaaatctgactgtggaagccttgaatatgaagatctttattttacttgttcctaaaggagtatattcatggatttcacaaagtatactccctaaaatattttccagaaatcttgtctaaatagccttcactctcctgcaaggtgcaaactcacggcagcctctaaaaatgtgtccccatctctctggtcytcgtggttttctaactttctcttcccccaccattccctgccccccatacattgtgttcccaatttgtgaccacctccacagagggcagcccttgggaagggtagtttttttccccagttggctgcttttctggagagcgggatattcccggaattctgctgatggaaattccccaggagactcccagaattctgatgagcaaaaattcccaacttcatttctttgggaatttactatatcttaaccctgccattttaagtcactgaactagtcaatatatggtgttagggtttttggcta

SEQ ID NO: 161187 - DNA, 601 bp, Human
tggcctcaagagatctaccacctcggcctcccagtgtgcatcaatcgttttattgctttatatttctgagtagtatttcgttgtgtgtctgtaccagtttttgtttatccatccccaaatgagggacatttggattgtttctagtttttgataattactaataattctgctataaacatctgtatacagggttttgtgttctcttttcacttgggttaatatctggggggttttgctaggtcaaatggtaagcgtttgtttaactttataagaaactactaattctctttccaaagaggcygtaccagtttgcattctcgccagcaatgaaggagagttccagttgctccacatcctcaccagcacttgatattgtcagttcattaaaaacgtcaactgttctagcagctgtgtaacagtacctctctgtggtttttaatttgcatttccttcattagaatcttttcatgtgctaatttgccatatgtagaacctctttggtaaagtgtcttttcaaaactttggcacgttgttatagggttattttttaattgtcaaactttgagagttctttatatattccgggtaaaaatcatttgtc

SEQ ID NO: 161188 - DNA, 601 bp, Human
catcagtcagatcatgtcctccctcagctcacatcttgccaatggcttttttaaaaatcacattttgaataaaatccaagtgatttgccctgacctacagggccctgcgtaatcgggctccaacagatctcttcccagttttctctcctgtgacttctgcccttgcctactctgcctttctgctggtctttcaacccatgctcattcggcctttagggctttgcctgtgctggttctggggctggggtgcttgtcccgtaccttctccaggctctcctctgcgtgggggtgcttacctgcrgaagggtcatcttcccaccatggccttccctgactcctcatccccaatactgccctctgccccacctgccccatcttcacactttgctgtatttttcatcatagtttatcactacctggcactatttacatatttacttgtttatttgtttgctgtctgcctccccaaatggatgtaagctccatgaaggtaggactttatagtattcgttgctatctccccagcttccagagcggagtgtagcccatagtagatgctcagtaaatattcatggctggattgaatgcaggattagatgca

SEQ ID NO: 161189 - DNA, 601 bp, Human
ctgtgactgggggccaaacaaaggcatgggaaggaataagaagagaaatgccaacccagagaagagagctggagcacaggtagtacctggatgcttctgtgatgttagtcggtttcaactcagagctagtgtgaatgttggttggctcagatgctggctgtggccttgaagtcacttttcagggctggactgagtcccaaagggcagtccctgggtcttctccattttcatcagatatcaaatggggaggatgagaggtcctttcgtggcatcagtatattagagtttgaaggattctttrgaatcagctagttttcttactcaccttatagatgatgaaactgagagataaaatgattcacataggtaatgatccagacattttaagctctgtgttgaataatcaaagggaaaagctctttacttgaactttacagatttaacagattgttggacagaaaagaactcttgccttgaaattcctaacgcaggagtggcatataactggtatgtatgccaccataccctgccccggccacatgcccatagcagacattgttaatcgacccagcaccttttcctcagccaagctctggccagc

SEQ ID NO: 161190 - DNA, 601 bp, Human
gaagagagctggagcacaggtagtacctggatgcttctgtgatgttagtcggtttcaactcagagctagtgtgaatgttggttggctcagatgctggctgtggccttgaagtcacttttcagggctggactgagtcccaaagggcagtccctgggtcttctccattttcatcagatatcaaatggggaggatgagaggtcctttcgtggcatcagtatattagagtttgaaggattctttagaatcagctagttttcttactcaccttatagatgatgaaactgagagataaaatgattcrcataggtaatgatccagacattttaagctctgtgttgaataatcaaagggaaaagctctttacttgaactttacagatttaacagattgttggacagaaaagaactcttgccttgaaattcctaacgcaggagtggcatataactggtatgtatgccaccataccctgccccggccacatgcccatagcagacattgttaatcgacccagcaccttttcctcagccaagctctggccagcctgagaatcctccttaacatagtgctggaggcgccagtcataccgatctgagctttcatg

SEQ ID NO: 161191 - DNA, 601 bp, Human
ggtttcaactcagagctagtgtgaatgttggttggctcagatgctggctgtggccttgaagtcacttttcagggctggactgagtcccaaagggcagtccctgggtcttctccattttcatcagatatcaaatggggaggatgagaggtcctttcgtggcatcagtatattagagtttgaaggattctttagaatcagctagttttcttactcaccttatagatgatgaaactgagagataaaatgattcacataggtaatgatccagacattttaagctctgtgttgaataatcaaaggraaaagctctttacttgaactttacagatttaacagattgttggacagaaaagaactcttgccttgaaattcctaacgcaggagtggcatataactggtatgtatgccaccataccctgccccggccacatgcccatagcagacattgttaatcgacccagcaccttttcctcagccaagctctggccagcctgagaatcctccttaacatagtgctggaggcgccagtcataccgatctgagctttcatgtgatttaaaatctgtttgcctccctcttctgaatgatgtatccatgtgat

SEQ ID NO: 161192 - DNA, 601 bp, Human
ttttcttactcaccttatagatgatgaaactgagagataaaatgattcacataggtaatgatccagacattttaagctctgtgttgaataatcaaagggaaaagctctttacttgaactttacagatttaacagattgttggacagaaaagaactcttgccttgaaattcctaacgcaggagtggcatataactggtatgtatgccaccataccctgccccggccacatgcccatagcagacattgttaatcgacccagcaccttttcctcagccaagctctggccagcctgagaatcctycttaacatagtgctggaggcgccagtcataccgatctgagctttcatgtgatttaaaatctgtttgcctccctcttctgaatgatgtatccatgtgattcatgatgtgctgatagcatgggacttcaagtcagaagaacttggtttgactcctccatctgctgcttcctagttacgttatcttaggcaactcacttaaccttcctggggcaatttactccctctgagatgagaaagttgaattaaataatccgaaagcatcctgtcaagctctgaaaaatgctatgcttcaaggtacaca

SEQ ID NO: 161193 - DNA, 601 bp, Human
atagatgatgaaactgagagataaaatgattcacataggtaatgatccagacattttaagctctgtgttgaataatcaaagggaaaagctctttacttgaactttacagatttaacagattgttggacagaaaagaactcttgccttgaaattcctaacgcaggagtggcatataactggtatgtatgccaccataccctgccccggccacatgcccatagcagacattgttaatcgacccagcaccttttcctcagccaagctctggccagcctgagaatcctccttaacatagtgctgraggcgccagtcataccgatctgagctttcatgtgatttaaaatctgtttgcctccctcttctgaatgatgtatccatgtgattcatgatgtgctgatagcatgggacttcaagtcagaagaacttggtttgactcctccatctgctgcttcctagttacgttatcttaggcaactcacttaaccttcctggggcaatttactccctctgagatgagaaagttgaattaaataatccgaaagcatcctgtcaagctctgaaaaatgctatgcttcaaggtacacagacttctcaggaagaa

SEQ ID NO: 161194 - DNA, 601 bp, Human; identical to SEQ ID NO: 28397

SEQ ID NO: 161195 - DNA, 601 bp, Human; identical to SEQ ID NO: 28398

SEQ ID NO: 161196 - DNA, 601 bp, Human; identical to SEQ ID NO: 28399

SEQ ID NO: 161197 - DNA, 601 bp, Human; identical to SEQ ID NO: 28400

SEQ ID NO: 161198 - DNA, 601 bp, Human; identical to SEQ ID NO: 28401

SEQ ID NO: 161199 - DNA, 601 bp, Human; identical to SEQ ID NO: 28402

SEQ ID NO: 161200 - DNA, 601 bp, Human; identical to SEQ ID NO: 28403

SEQ ID NO: 161201 - DNA, 601 bp, Human; identical to SEQ ID NO: 28404

SEQ ID NO: 161202 - DNA, 601 bp, Human; identical to SEQ ID NO: 28405

SEQ ID NO: 161203 - DNA, 601 bp, Human; identical to SEQ ID NO: 28406

SEQ ID NO: 161204 - DNA, 601 bp, Human; identical to SEQ ID NO: 28407

SEQ ID NO: 161205 - DNA, 601 bp, Human; identical to SEQ ID NO: 28408

SEQ ID NO: 161206 - DNA, 601 bp, Human; identical to SEQ ID NO: 28409

SEQ ID NO: 161207 - DNA, 601 bp, Human; identical to SEQ ID NO: 28410

SEQ ID NO: 161208 - DNA, 601 bp, Human
tcctggctttccctcactcattcctttctcccctgcctgtcctaggccctgtttgacacacagaacgaactacgcgcacacatcccaaacttcaccttcaacctgggctactcagggaaattcttccacacaggtaagtgggcctgcccctgccctcactagcaacttccaggactcctcagcacccaaaccctcaaagcacccatccatgagggcagcgggtgggtttactggcccacattagaggcagaggtgacccctctgcccccgtggagccaacagcctacaagagcagtcacarcccaggcagaggccatctggggacaacagcagcggcagcaacagcagccgcttgtccctccctgtcctttcgggctgagctggcctgggtggggcatcttctccctcttgcctctccctcctatcttttacaattatgtgtattatttctgcttataaaagaagctggttgagttttaagaacattacagaaacatgtagcatagaaagtgaagatgccctgtaattgtacccaccttggatgaccagtgtcatgggtttattttagagtcctaagggttgagggtgagggctataggtt

SEQ ID NO: 161209 - DNA, 601 bp, Human
tcattggaatagaatcagagcaggtatgtcagaggtagaagaaacccttgagatcattgactccagaccctgaattgtgcagatggtcccaaggatctagagagcagatagtcttggccaaggtcccccactgagtcaagggcacactctagactagaattcagggctctgggctggggctctgtctgctcctgtgctgtagcccagataactcttccaggcagctcctgggtgggctctggccatgctctcccatccccaggcacaggcccaggttagagggcctcatggcccagtgggyggttctgagctgcctgtgttgctgcaggtaccaatgctgaggacgctggggatgatctgctgctgtcgtatgtgaaggagttctggtggttcccccacatgtggagccacatgcagccccaccttttccacaaccagtccgtgttggccgagcagatggccttgaacaagaagttcgctgtcgtgagtaagattccttgcagggcagagcggggcgggctaagggctgggctggaggtccagactgctggcctcttgctgcttttgcagtctgctctgacggatttttactaacacctct

SEQ ID NO: 161210 - DNA, 601 bp, Human
accagcacggaggagtacccccacctgaagccagcccgctaccgccgtggcttcatccacaatggcatcatggtgagtgggcccctggaagcccaggaggtgggagaatggagagcacagtctgtcatgtgtgtgcatacgctgtcctggtaagcacggctctggtttgctggcttaggggttgcagatcagcttctgctgcctcctctggcacccgaggctctctgccccagggaaggtgggctgccactccgacccctttcatgagctctttcttagcttttgtgacagaggatcaagsaataatcagcattcttgaaagaggtttctgatgaggatgtgggacagggctctgttacagtctttttgctgattaaaaatttttttcttggctgggcctgatggctcacacctgtaatcctagcactttgggaggccaaggcaggcagattgcttgagcctaggagtttcataccagcctgggcaatgtagtgaaaccccatctctactaaaaaagtactaaaaaaaaaatatgcctggtgattagccaggtgtggtggtgcatgcctgtagtcccagctacttgcagggctgaggcagg

SEQ ID NO: 161211 - DNA, 601 bp, Human
atatcgggggttggtttcccccaatacatgtgtaaaatatacagtggtcagatggtgatgagtgccacggacaaagttaagcagggaatggaaggaaggaatgctggcaagagaagctggtttaaataaggtggctaggtgggccttcctggaataagccacgctgccacatgaggaagagcactcaaggcagagaacacaagtgcaaaggccctgaagcgggctgtgctggctgtgtttgaaggccaaataggaggccgggatggctggaggggagtgagggatggtggtagatgaggtyggggtgggtgatggaccagatcgatagggccatgtaaggccagccattggatggccatgggcttttaggctgagatgggaaggttttgaatggagcatgatctgactcatctttgaaagggatttctatcattctggctgttgtgtggagcagagactgtaggggacaaaagtggcagcagggagaccagttaggaggcactgcagtcttccagaccagaggtggcagcagcttggaccagggcccaatgttgggatgtggccatactctgggcttagaatagttaggcctgtggttaga

SEQ ID NO: 161212 - DNA, 601 bp, Human
gcagaagctggaattggtgacagtctcatagttcagaccaggagtccacaaaccgtgactcatgggccaaaaccagcctgagacctgtttttgtaaagaacgttttattggcagacagccacgctcattcttgtatctactgtctatagctgctttcatgctatgacggcagagtcgagtagttgcaatggaaacttccatgccccaaacctaaaatatttactaaacacttaccaaaagattaattaaactttataggaagcgtttcttgaccccctggttcagacgcagcttgtccagwtaaattcaacaagtgcttatgagttcctgttacgtgctaaggggcattttgcgagctctttgggggacatgaaactgaccagaagtggagcctgcctgtcagtggctcagtgtctgggggtggggatgtgacaaggacacatgtagcatgtaggtatcatgcccattgggctgtaagggccacatatccatgtgcagtgggagtccactgactgggttctggggcgccccacacatcccttccactgttgttttaggacccctgcgaggacaaacgtcacaaagacatctggtccaagga

SEQ ID NO: 161213 - DNA, 601 bp, Human
tgaccagaagtggagcctgcctgtcagtggctcagtgtctgggggtggggatgtgacaaggacacatgtagcatgtaggtatcatgcccattgggctgtaagggccacatatccatgtgcagtgggagtccactgactgggttctggggcgccccacacatcccttccactgttgttttaggacccctgcgaggacaaacgtcacaaagacatctggtccaaggagaagacgtgtgaccgcttcccaaagctcctcatcatcggcccccagaaaacaggcaggtctctctgctcttgaccsagcttccccaactgcctgctgtctcagccacagaattctgaggactgccttgccctggccccactcccggataatttgctccctctttcccaggaagtaggaatgaagttggggtgaacacaaattgcctgtcagtatggaggggaaagaggtggaggaggggcctggagttctcctatttatcctgaaccatagcctcagggagctctccctgcattatcctgggagtctccaagtccagtcagagaagcccagatcagttgctctgctagtttgagtaatgccaagcaaaactggtac

SEQ ID NO: 161214 - DNA, 601 bp, Human
tgttcttgtgggcccttcagggacaggtcgctggtctttgggcgtcacttggggaagtcattaagattgccacttcccaccagagcctgcagaggttacctttgtagaggttcccagcagagggtcctagtagaggttcccttaagggtgtgggggccagagcagagatggttttactctccaccttttcagttggcatctttctctatttgccttttttctttctttttaaaaaatgtttcatgtcaggtaggtaatgtgctgagatcataacaaggttcgaggtgggtacacctcacaygtgtgtgaacacccaatcatcacgtgcatggactgcaaagtttgcctttttaaaccttgtccatgtattaccattatttattatttttatgtcagtgggttccctgggtggagaggttatgggccttctgtctttcttttttttttttttgagatggaatctcgctctgtcacccaggctgcagtgcagtggcgcgatctcggcttactgcaacctctgcttcccgggttcaagtgattctcctgcttcagcctcccaagtagctgggactacaggtgcccgccaccatgcctggctaat

SEQ ID NO: 161215 - DNA, 601 bp, Human
tgctttcctgtggctttttctttaggagaagaaaaccgagaaacacttgtcaagtgtttctgttttctgccgtgctgtgtgcccccgcctcctggcgctgtgcagggaatgggcagtctgctttcatgggggaacgtagggtagagagagagccgccacaggttgggtcagtccctgttctgcactgacactgctgtacatctgcaccttactggagagtcacagctggtttctagaaggcagaggaggggtttcacgtttgtgtccccttctcaaagattagaaaaccaagtttcagcamgtttcatgtggtggcatttgaatccaagtcttctaaatctaagaccctattcctttttctgtccatgatcaagaggggtaagggatagaaggagaagggagactcattctccccaggaggacctgggaagatgttggaggagaggaagggtgggggcctgtctcagaaggaggtcgggacgaggaggacgctgctgtgcaccatattgccccagccctgggctgtgtgtgatcctcaggggagggggttggcggctgggggatagtgcctgtcgcacaggtgcctgagctctggctttct

SEQ ID NO: 161216 - DNA, 601 bp, Human
aaccaagtttcagcaagtttcatgtggtggcatttgaatccaagtcttctaaatctaagaccctattcctttttctgtccatgatcaagaggggtaagggatagaaggagaagggagactcattctccccaggaggacctgggaagatgttggaggagaggaagggtgggggcctgtctcagaaggaggtcgggacgaggaggacgctgctgtgcaccatattgccccagccctgggctgtgtgtgatcctcaggggagggggttggcggctgggggatagtgcctgtcgcacaggtgccygagctctggctttctggacttagtgaattctgcagattcggacctcccatggcattattttaagtgattcagaccagccagtctcccttttatagttctttcccagtccttctgatttccataaaggagaaatgctcactttagtgcaagtggtcttacgtcctttctaacactgtcaacctctgctttcaacaaagagagcatgttcagggcctgttgcacacatttgtgtctggctggagtttgagaacattgtttttattgccatttgtgagtggttgccttctatatatgacaaca

SEQ ID NO: 161217 - DNA, 601 bp, Human
ctcccatggcattattttaagtgattcagaccagccagtctcccttttatagttctttcccagtccttctgatttccataaaggagaaatgctcactttagtgcaagtggtcttacgtcctttctaacactgtcaacctctgctttcaacaaagagagcatgttcagggcctgttgcacacatttgtgtctggctggagtttgagaacattgtttttattgccatttgtgagtggttgccttctatatatgacaacagtgcagcagcgtgatcttggctcactgcaacctccaccccccgrgtttaagcgattctcgtgcctcagccttccgagtagctgggaccacaggtgtgcaccaccatgccagctaatttttgtatttttagtagagacggggtttcgccacattggccagctggtctcgaactcctgacctcaagtgatccacccaccccagcctcccaaaattctgggattacaggcatgagccaccatgcctggcatcaggaaaccctgatttcgtccagttcccgtatttcaaagatggagaagttggggctctgggaccagtggcttcccttgacactggacacagtgaga

SEQ ID NO: 161218 - DNA, 601 bp, Human
ttgacgctgggaggggtaaagaaggcttcttgggtttaaaaaaaaaaaagagttactcagcattgagaatgctcagaaaagatttcccagaacactgaaggatgggaaactgttcatgttgtagattgctgaagcggctgtggctggtcgggctggaggagagaagactcagaatgtgcgagctgccctttgccggaagtaggacaggcacgtttagtgcagcctaggacacatttgatcccacagatggcacatagcttctgacagtccatgtgggttcaagagcagtagattccctggkctctgccattcctggggtccatgaacatggctttaaggtcggaagtgggtggctgagccagctcccatccaaagactttcccacctccacaggtttgatccaaagaaaggattttggtgccaactgcttgaaggaggaaaaaccaagtgtctgggcaaaagcaagggccggaaatatcccgagatggacttggatgtaagtggtggacacactacctgtagcacctgcataagggtaaggggtccctgtatggagttgagggggattctctttcctttaccatgcactcagcatgttcat

SEQ ID NO: 161219 - DNA, 601 bp, Human
gctcctgccaactgggagttcactattggaggctaccatttagaaggagattgtggataaataagaggtgtatggggggtggtgccagcagcatggtgggttttttgtttttttgttttcttttgagacggagtttcgcttttgtcacccaggctggagtgcaatcgcgtgatcttggctcactgcaacctccgctttccgggttcaaaagattctcttgcctcagactcccgagtagctgggattactggcgcccaccacctcaccccgctaatttttgtatttttagtagggttttccyatgttggccaggctggtcttgaactcctgacctcaggtgatccacatgcctcggcctcccaaagtgctgggattacaggcatgagccaccgtgcccggccgagcatggcgatttttagaggaggtcactcttaagtcagtacacaaggtctgagctttccttcccgttacagtcccgagccttcctgaaggactattaccgggaccacaacatcgagctctccaagctgctgtataagatgggccagacacttcccacttggctacgagaggacctccagaacaccaggtagccgtggcc

SEQ ID NO: 161220 - DNA, 601 bp, Human
aggcggcggtggcagcggtaaggacccttccctcgccctgcgcctctggacctgcaggtgctcgggcgcggcccaggccgccccctgtctgacctctgctccggccctgctcgggttcccgggagtgtggccctcctgtccactctcgccctggggggctgctctttggctccctctcctcagtctcaggctatcggagccttcagcagcacagcctaaccctctctctgtacagatagggaaaccgagaccccctgcgaagtgcggaaatgcgcctgcggccgcggagcaagacccgaamtagaacgcaggctcccagactcgtgtcccacactcatttagcaacaccgactccgtgctcttcatctgcttcttccactcctaacccagccctaggcaaaggcggcaggttcgccccagaagggacgattaactaactgtgtgaacagggcaggtgactttcctggccagggctgggtctccccatcacacagtcaagacattgctgggtcatatccttcaggctgaaaaagagccctctttggccagactggggcaaggggtctgtaccttaccttctcagggtcctccctgaactctt

SEQ ID NO: 161221 - DNA, 601 bp, Human
aagaaccctgtgttctatgagaggaggtggtggcagcaccagtgctcaggatcctgcagttcccagtctgtgaggctctggagaaggaagcctgtgtttcctgctcctgtgttccactttctgcttcctgctcatggggtgactttggagatgaatggggaggttccctatgggtagggacttggagagaggccatcactgtgtaagggaaaaggagtgtgtcagtgggggtcaggggactgggtatcctggaggagtttccaggagcttccatacaaatcacctcgtgtctctgggcacragagctgctgaacctggctcatcctctggtctcaaaagtcgcttgaaaactgttgtctgcaggcagatgagtctaccccaggcaaaaaagcatttccccctccttgctctccgagagtagagggaaaggcagaaggaggtctgggggttcccaaggctccaggaaagggacttccctggagccaggttagccctcttccgcagaggatgcaggaaccctgaccttcttgaagccagaaggtgctgcctgtcttcccagggcatctgactgtctattcagtgctcctgaagtgggggcaga

SEQ ID NO: 161222 - DNA, 601 bp, Human
tgtgtaagggaaaaggagtgtgtcagtgggggtcaggggactgggtatcctggaggagtttccaggagcttccatacaaatcacctcgtgtctctgggcacgagagctgctgaacctggctcatcctctggtctcaaaagtcgcttgaaaactgttgtctgcaggcagatgagtctaccccaggcaaaaaagcatttccccctccttgctctccgagagtagagggaaaggcagaaggaggtctgggggttcccaaggctccaggaaagggacttccctggagccaggttagccctcttcygcagaggatgcaggaaccctgaccttcttgaagccagaaggtgctgcctgtcttcccagggcatctgactgtctattcagtgctcctgaagtgggggcagaattgggttggcactgttgactctccctgagagagaggccaagcccctcctgtctttggcctcagtttctccttctgggcaatgaaggcatagggtttccaggggtgcttcctgtgcaatgctgctgtccaggacagctgaaggaggatcagtgcatgccactgccctcctaatccccactggcactggccaccaggtct

SEQ ID NO: 161223 - DNA, 601 bp, Human
tttccaggagcttccatacaaatcacctcgtgtctctgggcacgagagctgctgaacctggctcatcctctggtctcaaaagtcgcttgaaaactgttgtctgcaggcagatgagtctaccccaggcaaaaaagcatttccccctccttgctctccgagagtagagggaaaggcagaaggaggtctgggggttcccaaggctccaggaaagggacttccctggagccaggttagccctcttccgcagaggatgcaggaaccctgaccttcttgaagccagaaggtgctgcctgtcttcccrgggcatctgactgtctattcagtgctcctgaagtgggggcagaattgggttggcactgttgactctccctgagagagaggccaagcccctcctgtctttggcctcagtttctccttctgggcaatgaaggcatagggtttccaggggtgcttcctgtgcaatgctgctgtccaggacagctgaaggaggatcagtgcatgccactgccctcctaatccccactggcactggccaccaggtcttcagcctgccaccaatcctggctagcccccttttgccccacttctgagcctccagcat

SEQ ID NO: 161224 - DNA, 601 bp, Human
gctgctcagagcttggggaatcattgtgaaggtccaaaatggtttgttagcagcagggtctggtgtgtccataggaagttatcttaatgggccggcctctcaggtttttgtgttggagctcctgggatatggaaacaacattcacatctggagtcaaggccgtcaccatgttagcatgccagaccctccccatgccacgctcacccctcaggcttgtgggggcaccccacatggatcccccccatcaacagaaagagggagcaagctaggctccacaccctcccatggcttccttttgttyttgaaaccaaatccatatccctctcctacagaatctgctggcctctccagccccatcttgtgcctctctcattcattcattcattcaagcaggcaagcagtaatattctctgagtgagtgtcttctgtcctgaacttgctcctaggcattggagatgatggcctgaacaaggcagacgggtccacctgcatgcagagagctgccctctctgccctcactctgctcctccctgcctgggggcctttgtacctactgctcactctccctggaatgtctttccctgttcatgacatggaagcc

SEQ ID NO: 161225 - DNA, 601 bp, Human
gaggaggaactaattctaggccacacagatggcatggaactgggaccaggacccactgactttagctggtggtttagaatccacaggggcctcgttaaagatgacagagaaattaggatgtggtagatctggagtggggcctgggaatctgcattttcagcaagcccttgtgtgtacagacgtgcatgcctgtttgcatgtgtgtgttggggttaggatcttgaagcacagccagctggggctggaccacccagggaggagtcacaaaggttttcagagctggatttgtggtccaggcctkggggggccaaagctggtcatccaccagggccacacacccggcaggaagagggcaaaggaagtgctgacctaggggccatttgattgtgctggagcagaggccacactctgtccttgcctggcccaggctggatggggagcccccactgcaggccactgtggctcctgtccccatcctccccccgggcaggcccagtgtctagactctcagactgaaattggtcttagaattctttcagctacaataacaaacacaatcagagaatcaacaaacattgggaggttcacgtttccaagttgg

SEQ ID NO: 161226 - DNA, 601 bp, Human
gtatttgtttcaccccttgcagcctagttactttaaaaacagctcttcatgctctgtcattgtcatcgtcacccataataatgtctggctgttcctgtcaccacggcccctgtggccaatagccagtttctggcaaaatcaccactgtggtcaccatcactgagggtctcctaagggagaatgccccatggacctctcacccactttgaagcatgaaaggagaccttaggaacagctggcctccgctcccctctgggcatgcatctcctctccagggacagcaagattatgactttctgasacagatcacggcttaagtaccttcttcctgctcatgagccaaaattcacaaaattcacccagccctcaggctctccctaccttgcctggtggggtttgacccccccagccaagctgtcagcatgcggggagggggagtattggggaagttttctggcttgtgactgaaaagtaccagtcctaaccaaggagtcagatctccttggttcttagtaggccccatttgagccacggagcatcagtggattccctccctcaggggaacccccaggtccctccaagtcctctcctttctatgctg

SEQ ID NO: 161227 - DNA, 601 bp, Human
gtcagcatgcggggagggggagtattggggaagttttctggcttgtgactgaaaagtaccagtcctaaccaaggagtcagatctccttggttcttagtaggccccatttgagccacggagcatcagtggattccctccctcaggggaacccccaggtccctccaagtcctctcctttctatgctgagggctcccagcttctttctgttgtcctcctatcacctcttttcctgaacaccctccagcctggccacctgccctttggacatgctccatattgtctgcatctttcttaaaatatrgtgcccggaacggaggaacaaaactccagcactggtgggtgaaggagacctggctttcgcatcaggaagccttgggctccagacctagttcttccactcaccaacctggtagaaacctcgggtatgtcatgacacctctttgagcctcagttttcctcatgacgaaaatggagcttagatgaatactgagctcaaaaagttgttctgagaatgaaatcaggtaatgtgagtgagatgtctagtgcagtgggcacatagtaagtgctcaatatacagtaacttactaagatcatcatcatg

SEQ ID NO: 161228 - DNA, 601 bp, Human
ttactaagatcatcatcatgctcttcatcttcgtcatcctcatcctcatcaaaataggaccatccagccggccacggtggctcatgcctgtaatcccagcactttgggaggccgaggcgggtggatcacgaggtcaggagaccaagaccatcctggctaacacggtgaaaccctgtctctactaaaaatacaaaacattagccgggcgtggtggtgggcgcctgtagtcccagctactcgggaggctgagacgggagaattgcttgaacccgggaggtggaggttgcggtgtgctgaggtygtaccactgcactccaggctgggcaacagagggagactctttctcaattaaaaaaaaaaaaaaaaaggactatcccttgatttggcatctgtgttagccagactaaggtcagggtagctttgttagtgcctaagctaccctgctggcccagtaagttttggtcgcctaaaatcctgaggctctcctgcatatgacaaggttagtccagttgagagcacttgattatctggactgagaatgtcttttcatttagccctgttcaattccagagtcttgtcttgaggtcacatttctggcctg

SEQ ID NO: 161229 - DNA, 601 bp, Human
ctccccaccccctccttcctccacctcctcctgagctgtgctccatcaatcattccctctcttgagtctccaatctttcctcctctcttggttccttccattcaggctgcaaacacaaagtctctcccatcttaaacaaatttcctttcatccctgcttctccatcaagtgacggttccaagtctcattagcaaaagctggggctgagcgcctaccacctgtcaggccctgggcttggtgcttgctgtgcccatctcatttaaccctggtgatgaccctattgggtaggcaccatggataygatgaggtagctgaaacttgaagacaccagcgtccttgcccaaggtcacagggtggcagacccaacattccaacccaggactatctcctccctagccagtgtgctctcaccagtactcgtatctccttctgtctctagcaaactctgaaggaagcatatattgagaaagtgagagaaatccaaataaagctagatgaagcaaagaaaggataaatttacatgactaggatgtgtgggactggagctggcctctgaagctctaggaccttgatgacacccatggtgtctctcggcaagcac

SEQ ID NO: 161230 - DNA, 601 bp, Human
aggggagccggattctgaagggtgctggtttctgtactgaggagtctgcactttcttcagcaggaaattcacacattctctccctcattcattcattcactccctcagcaggcgtttctcagcgtctgcgctgagcccagcactgttctgggcactggggctccagaggtgagtaaatccctgctggccactctggccctcagcagtctggtatagaagaaaagaaacctacagtgttccatcaggtctgagggggcatctgcaggccaggggaggggcggggctagagctgggcttttgrgggagctgcccccaaggcccttgctgaccaccccgctcctggcaggcgccttcctcgtgccctacttcctcatgctggccatctgtggcatccccctcttcttcctggagctctccctgggccagttctccagcctagggcccctggctgtctggaaaatcagccctctcttcaaaggtgaggcctcagtggtccccagggagggaagggctcagggtctgggggaggcagggaggttgcccccagaacccctgccagctccaggcagaggtggaagtgaagcccagatagctgccagct

SEQ ID NO: 161231 - DNA, 601 bp, Human
accctgcactgctgagggtggccagagggcatcccccacagtctcagcatgtaccgccaagatgagctcaggtggtgatggcaggtggactctggcttctaatcccagctcttcacctgaccagctgtgtggcctcaaacaatttatttggcttctgttgctttatctgtagcatgagggcaataatactaggtatctcagaaaggttgttgtgaagattaaaggagagaaagcatatattaataaattgtgcagtccagtctggtggatagtaagtgctcaataaatactagctgagaaggatgatgatgatgataacagtaatagtaacattatggagtctcagtttcctcctctgtaacaggggttggtaacagtacctgcttcataaggtgttatccagttagtcatttacccactcattcattcttttaataaatatttattgagcaactgctatatcataggtaaagcacttagcataaggccaggacgtacatagtaaggaccatctcagactcctctaatagagataggactataatagagtaagggactgtcatcagaattaaacaacataatgcaggtgaaaccattatca

SEQ ID NO: 161232 - DNA, 601 bp, Human
tccagtctggtggatagtaagtgctcaataaatactagctgagaatgatgatgatgatgataacagtaatagtaacattatggagtctcagtttcctcctctgtaacaggggttggtaacagtacctgcttcataaggtgttatccagttagtcatttacccactcattcattcttttaataaatatttattgagcaactgctatatcataggtaaagcacttagcataaggccaggacgtacatagtaaggaccatctcagactcctctaatagagataggactataatagagtaagggcctgtcatcagaattaaacaacataatgcaggtgaaaccattatcacggtgctgggcacacagtgggtcctgggaatggtgggtgtcggaaggacgttgcactcatcagcctatcccaatgccccattttatggtcaataaaacaaagccttgtcactgcattctgcctttaaaagaagaaagagaaagaaagaaagaaagaaagaaagaaagaaagaaagaaagaaagaaagaaagaaagaaagaaagaaggaaagaaaaagaaagaaagaaagaaagcaaagcccagaggcttgctcag

SEQ ID NO: 161233 - DNA, 601 bp, Human
aaagaaagaaagaaagaaagaaagaaagaaagaaagaaagaaagaaagaaagaaagaaggaaagaaaaagaaagaaagaaagaaagcaaagcccagaggcttgctcagtattgctcagtaattagtgacagagatggtattgacactaaggactcctgagtcctgatcctgttctggaacattctaaaatagcctggtccctaggtgggactgttggctggccagagaacacagaccctataacccccatcccttacctataaaggactgctgttaggagatttctcccagataggctccrtgtcttgaaatgttttggtctttaacctgcctgtagtacatagttcattcatttgtccacttcaagtccatctgaagtgtccgcacctgctgaagagtttatctgaccagtgggaaagaatcagcctgagtttgcagcttaaagccaaaggatttgatacaatcactggcagctgccagggtggttctccatggccatgccacagcccactgcatcagtcaggatgcaggcaggaggccgatggattgtcagagggtttcactgaagggagtttagtgaagggacttttcagagggtcat

SEQ ID NO: 161234 - DNA, 601 bp, Human
actacagtctcccactgttgcctcccattagccaaacccacacggaagctgaagaggaaggaagaagaggaagggtggtctcgaactcctatcctcaagtgatcttccttcctcagcctcccaaagctgaggaaggggtaaggtctggtgaggccagcctcctgggtcagagttggtcggagaaggatggagagggatcaagagggcgtcaagtggagaacagcagtagagccttgtgggctggacatggcttgactccatgtctgtggagcctggtggggtgaccaggggacactgagamctttgtctcccacagccgctacgtcctccacatccaaggcagccagggcatcggcagccctggggagatccgctggaacctctgcctctgcctgctgctggcctgggtcatcgtgttcctctgtatcctcaagggtgtgaagtcttcgggcaaggtgaagcctgggaggccccggaggcctgaggggctggatggggtgaaggcttcctggagaaggcagggcatggactgagcatgagaagatgaagagacttcagctgggcagaggggaagggagagagccttgagactgggggatga

SEQ ID NO: 161235 - DNA, 601 bp, Human
ctcaaggatgaaggccggttcctggcttgggctacccaaaggctggggaggcaagtgacacagatgagtttacaaggaatggcactgagtcaaggtccccgatgccatcagctcctcacttatcatctctcaggtggtgtatttcacggccacgttcccctacctcatcctgctcatgctgctggtccgcggagtcaccctcccaggggcctggaagggcatccagttctatctcaccccccagttccaccacttgttgtcttccaaggtgagcccctcagggcggggtgcagagggaggrgccaggcctgagctggagagtggaaagagggctccctgggacaccgcagtaccaggcactctgctcagcccttcttgcgtcttttttatttattattattgttatttttttctatttttaaattgataggtaaaattttatgtatttatcatgtacaacatgatgttttgaagcatatgtacctgggggaactgttaaatctagctaattagcatatgtattatctcacataattatcatttttgtagtgagaacacttaacatccactctcttagcattctccaagaatacgatatatt

SEQ ID NO: 161236 - DNA, 601 bp, Human
tagctaattagcatatgtattatctcacataattatcatttttgtagtgagaacacttaacatccactctcttagcattctccaagaatacgatatattgtcactaactgcatattatacttcatttattattattaacaatcatggaaacactatcctcattttacagaggaataaactgaggctcaaaagggttcttatcaagcttaaggtcatacagctaggggatcgcagaacagggatcccagcccagatttgtgtgactgtaaaccccaaggagggcattagtgacaatggtgayaacaatggtactgacagctaatgttaatatttattgactggggactgtgcctgaccttgccctagtgttttacatgcatgtgtgtagtgatttaacccaccctcctcccatgaagtaggcactattcctatcccctcgttacagatagggatcctgcggtccagaggggtgacctggcttgttcaggctgcacagctagaaaatggtgaagctggggtccaaatccaggtgccaggattccagaaaggaagtaaaggggttatgcaggcttactgccaatacaaatctcctgcacacttt

SEQ ID NO: 161237 - DNA, 601 bp, Human
atgaagtaggcactattcctatcccctcgttacagatagggatcctgcggtccagaggggtgacctggcttgttcaggctgcacagctagaaaatggtgaagctggggtccaaatccaggtgccaggattccagaaaggaagtaaaggggttatgcaggcttactgccaatacaaatctcctgcacactttacattaggctctgtgtccttcagaactggaccaagcttagagaccatcttctagatcctgggtgggaaactgaagcccgcagaggggaagggacttgcccatgtcccacsgtgtaaatgttgggggaggctttgctcctggtccacgtcacttgtgagccaggctcatgaccacgccatccctcgtgaccacgccatccctggagctgtcacaccatcttcattcactgccttccttctctgtccttgaccatccgcacaccctccctttccatccttcccggcacaggtgtggattgaagctgctcttcagatcttctattccctgggtgtgggcttcggggggctcctcacctttgcctcctacaacacgtttcaccagaacatctataggtcagtgtcccacagcct

SEQ ID NO: 161238 - DNA, 601 bp, Human
ctcgtgaccacgccatccctggagctgtcacaccatcttcattcactgccttccttctctgtccttgaccatccgcacaccctccctttccatccttcccggcacaggtgtggattgaagctgctcttcagatcttctattccctgggtgtgggcttcggggggctcctcacctttgcctcctacaacacgtttcaccagaacatctataggtcagtgtcccacagcctcccagaccctggggtccaaagcagggaggagagtggccggccagggagggcctcagaggctgaaaggaaggyccactcaccctggcccgcacctggacttcttctggtagagacactttcatcgtcactctgggcaacgccatcaccagcatcctggctggctttgccatcttctccgtgctgggctacatgtctcaggagctgggcgtgcctgtggaccaagtagccaaagcaggtgggcaggctgccaggcctcagtggggtgagcatgtgtgttgggtagagatggggctgggccagtggaccagcaagattatggatgggggccaggcgcggtggctcatgcctgtgatcccagcactttgggaggcc

SEQ ID NO: 161239 - DNA, 601 bp, Human
gggagggcctcagaggctgaaaggaaggcccactcaccctggcccgcacctggacttcttctggtagagacactttcatcgtcactctgggcaacgccatcaccagcatcctggctggctttgccatcttctccgtgctgggctacatgtctcaggagctgggcgtgcctgtggaccaagtagccaaagcaggtgggcaggctgccaggcctcagtggggtgagcatgtgtgttgggtagagatggggctgggccagtggaccagcaagattatggatgggggccaggcgcggtggctcaygcctgtgatcccagcactttgggaggccaaggtgggcggatcgcttgaggtcaggagttcgagaccagcctggtcaacctggtgagtcccagtgtctactaaaaatacaaaaagtagccgggcgtggtggcacatgcctgtaatcccagtactcaggaggctgaggcaggagaatcgcttgaacccgggaggtggaggttgcaatgagccaagattgggtcactgccctctagcatgggcaacagagcaagactctgcctcaaaaaaaaaaaaaaaagattgtggatgggtatgtcatgt

SEQ ID NO: 161240 - DNA, 601 bp, Human
catcttctccgtgctgggctacatgtctcaggagctgggcgtgcctgtggaccaagtagccaaagcaggtgggcaggctgccaggcctcagtggggtgagcatgtgtgttgggtagagatggggctgggccagtggaccagcaagattatggatgggggccaggcgcggtggctcatgcctgtgatcccagcactttgggaggccaaggtgggcggatcgcttgaggtcaggagttcgagaccagcctggtcaacctggtgagtcccagtgtctactaaaaatacaaaaagtagccgggcktggtggcacatgcctgtaatcccagtactcaggaggctgaggcaggagaatcgcttgaacccgggaggtggaggttgcaatgagccaagattgggtcactgccctctagcatgggcaacagagcaagactctgcctcaaaaaaaaaaaaaaaagattgtggatgggtatgtcatgtgtgtgcatatgcacacatgtacgtgcaaaggaacatgtcctagctggtctctggtggtccatgtgcaaggggatgggtgagcaaacgagtgtgcattaacccatgtctggaggccaatgagttt

SEQ ID NO: 161241 - DNA, 601 bp, Human
gtggaccagcaagattatggatgggggccaggcgcggtggctcatgcctgtgatcccagcactttgggaggccaaggtgggcggatcgcttgaggtcaggagttcgagaccagcctggtcaacctggtgagtcccagtgtctactaaaaatacaaaaagtagccgggcgtggtggcacatgcctgtaatcccagtactcaggaggctgaggcaggagaatcgcttgaacccgggaggtggaggttgcaatgagccaagattgggtcactgccctctagcatgggcaacagagcaagactcygcctcaaaaaaaaaaaaaaaagattgtggatgggtatgtcatgtgtgtgcatatgcacacatgtacgtgcaaaggaacatgtcctagctggtctctggtggtccatgtgcaaggggatgggtgagcaaacgagtgtgcattaacccatgtctggaggccaatgagtttctgtgcaagattgtcacattttgtgctttggttgcacaaataagtcatattgtgtgtggaggtgtctatgtgcaagtgaaaagggtgagaatgatcttgtgaatcactgtgtcttttgccagtggatgcatg

SEQ ID NO: 161242 - DNA, 601 bp, Human
gtgaaaagggtgagaatgatcttgtgaatcactgtgtcttttgccagtggatgcatgtaaatgtgtgtgttagtggggttatttgtaccaataattgtatacataagtatatttcaatgaggttttatattggggtcttgtgtttgtttatcaacctatgtttatcgagcacctacaatgtgctggtgtaggtcctgggagttaaggaagtatcagagggtgcatttaagtgggcatctctgggttaggctaaacaaatggcccaaatgagtgtaagtggccgtgtgtgtctgagtgtgcrtatgggagcccaccgcatgacccaagctgctgaccccgtgtgcccctggcccaggccctggcctggcctttgtcgtctacccacaggccatgaccatgctgcctctgtcacccttctggtccttcctcttcttcttcatgcttctgactctcggcctagacagccaggtgagtctcgtctgtggcagcaggcaccccgtgtgtgtgtgtgtgtgtgtgtgtgtgtgtgtgtgtgtgtgtgtgtgtgtgtgtgtgtgttggggatagaattctgacccccagcccctcctctctcctcagt

SEQ ID NO: 161243 - DNA, 601 bp, Human
agtatcagagggtgcatttaagtgggcatctctgggttaggctaaacaaatggcccaaatgagtgtaagtggccgtgtgtgtctgagtgtgcgtatgggagcccaccgcatgacccaagctgctgaccccgtgtgcccctggcccaggccctggcctggcctttgtcgtctacccacaggccatgaccatgctgcctctgtcacccttctggtccttcctcttcttcttcatgcttctgactctcggcctagacagccaggtgagtctcgtctgtggcagcaggcaccccgtgtgtgtgtgtgtgtgtgtgtgtgtgtgtgtgtgtgtgtgtgtgtgtgtgtgtgtgtgttggggatagaattctgacccccagcccctcctctctcctcagtttgcttttctggagaccattgtgacagctgtgacagatgagttcccatactacctgcggcccaagaaggcggtgttctcagggctcatctgcgtggccatgtacctgatggggctgatcctcaccactgatgtgagtggcgctacagggaggatggcaggtgggcgggacaagggcagacgcctgcaacgagatctctggcccagctg

SEQ ID NO: 161244 - DNA, 601 bp, Human
gtatcagagggtgcatttaagtgggcatctctgggttaggctaaacaaatggcccaaatgagtgtaagtggccgtgtgtgtctgagtgtgcgtatgggagcccaccgcatgacccaagctgctgaccccgtgtgcccctggcccaggccctggcctggcctttgtcgtctacccacaggccatgaccatgctgcctctgtcacccttctggtccttcctcttcttcttcatgcttctgactctcggcctagacagccaggtgagtctcgtctgtggcagcaggcaccccgtgtgtgtgtgtgtgtgtgtgtgtgtgtgtgtgtgtgtgtgtgtgtgtgtgtgtgtgtgttggggatagaattctgacccccagcccctcctctctcctcagtttgcttttctggagaccattgtgacagctgtgacagatgagttcccatactacctgcggcccaagaaggcggtgttctcagggctcatctgcgtggccatgtacctgatggggctgatcctcaccactgatgtgagtggcgctacagggaggatggcaggtgggcgggacaagggcagacgcctgcaacgagatctctggcccagctga

SEQ ID NO: 161245 - DNA, 601 bp, Human
atcagagggtgcatttaagtgggcatctctgggttaggctaaacaaatggcccaaatgagtgtaagtggccgtgtgtgtctgagtgtgcgtatgggagcccaccgcatgacccaagctgctgaccccgtgtgcccctggcccaggccctggcctggcctttgtcgtctacccacaggccatgaccatgctgcctctgtcacccttctggtccttcctcttcttcttcatgcttctgactctcggcctagacagccaggtgagtctcgtctgtggcagcaggcaccccgtgtgtgtgtgtgtgtgtgtgtgtgtgtgtgtgtgtgtgtgtgtgtgtgtgtgtgtgtgttggggatagaattctgacccccagcccctcctctctcctcagtttgcttttctggagaccattgtgacagctgtgacagatgagttcccatactacctgcggcccaagaaggcggtgttctcagggctcatctgcgtggccatgtacctgatggggctgatcctcaccactgatgtgagtggcgctacagggaggatggcaggtgggcgggacaagggcagacgcctgcaacgagatctctggcccagctgagc

SEQ ID NO: 161246 - DNA, 601 bp, Human
ctggggccccagaattgaaagcgggagtcccctctgcacgttcagtctggtagggccaccctggcccgcagtggagggctgtggggtggccaccagaatcctagtccatcccctcccctgatgttcccagcttctgtagctgtgctgggcctggccctagttcagttggttaaatgcgtgggtctttcccaggccccagggcctcaggattggagcctttaggctgtgatttctgtcttggggttagagcagctaagggtctggggtgcctcagaactgggctgctgcaggccttggtgtkgggtcagcttcgagctgggctggctgaagccctgcaaaggctccagagatggaccacttcaggttccggtacagcttaggatcctgggtagctctgggctggactgtctcaggccttgggctggcactaggctgggctacctcgggccttaaggcagtttagacaaaagcccgcagtgatgctgggagtccccactctgcaggccctcctggtgtatagcatcgtcaagtaccagccctcggagtatggcagttaccgcttcccgccctgggctgagctgctgggcatcctgatgggcct

SEQ ID NO: 161247 - DNA, 601 bp, Human
ttggttaaatgcgtgggtctttcccaggccccagggcctcaggattggagcctttaggctgtgatttctgtcttggggttagagcagctaagggtctggggtgcctcagaactgggctgctgcaggccttggtgttgggtcagcttcgagctgggctggctgaagccctgcaaaggctccagagatggaccacttcaggttccggtacagcttaggatcctgggtagctctgggctggactgtctcaggccttgggctggcactaggctgggctacctcgggccttaaggcagtttagacraaagcccgcagtgatgctgggagtccccactctgcaggccctcctggtgtatagcatcgtcaagtaccagccctcggagtatggcagttaccgcttcccgccctgggctgagctgctgggcatcctgatgggcctgctgtcctgcctcatgatcccagctggcatgctggtggctgtgcttcgagaagagggctcactctgggaggtgagtctgcccaccctgtccactctcagccttcctgacctgtggcctgaccctaggtccccctgctagaacagaaaacatatgcacccacccct

SEQ ID NO: 161248 - DNA, 601 bp, Human
cctgatgggcctgctgtcctgcctcatgatcccagctggcatgctggtggctgtgcttcgagaagagggctcactctgggaggtgagtctgcccaccctgtccactctcagccttcctgacctgtggcctgaccctaggtccccctgctagaacagaaaacatatgcacccaccccttatccagcttcttttagcctgaggagacttgcctgggctgaggcagattcaggggctggagtcctgccctgtggcactttgtaccacatgaagccttaggggagtgggtggcacaatctaaagwccactgttaaccagggactggccccagatcccaccgtgggttgggggtgtgtcaggtcttgaactcaggtcaccagcccagagcttgcttctggaactcagggtcaaatggcgacagtgagggaccccagagggcaggctatcaccctactcccgtgcccaggagtcctgctgtgtcccactggtggcccgggatagaatgatggtgtgagccctgcccacgcctagggttttggggagggactcagacaaacatagagagtgcactctgccacagggtctgaggccttggaagagagga

SEQ ID NO: 161249 - DNA, 601 bp, Human
atcccagctggcatgctggtggctgtgcttcgagaagagggctcactctgggaggtgagtctgcccaccctgtccactctcagccttcctgacctgtggcctgaccctaggtccccctgctagaacagaaaacatatgcacccaccccttatccagcttcttttagcctgaggagacttgcctgggctgaggcagattcaggggctggagtcctgccctgtggcactttgtaccacatgaagccttaggggagtgggtggcacaatctaaagaccactgttaaccagggactggccccagrtcccaccgtgggttgggggtgtgtcaggtcttgaactcaggtcaccagcccagagcttgcttctggaactcagggtcaaatggcgacagtgagggaccccagagggcaggctatcaccctactcccgtgcccaggagtcctgctgtgtcccactggtggcccgggatagaatgatggtgtgagccctgcccacgcctagggttttggggagggactcagacaaacatagagagtgcactctgccacagggtctgaggccttggaagagaggagtagtgaccctttgtgggccagcagaag

SEQ ID NO: 161250 - DNA, 601 bp, Human
gttcaaccattggtagctaggaattggcaatggtggagatatttacaccacagaaaatggctacaaagcgggcctcccttgcaccccaccccacagtctgcttaccagcacactactgcctctcctccacttcccccgtgtagctcctgcccctcagctcccccaccacaaggctccacctgcaggggttgctcaggaggcagaagtggtttatgcctcccccatcctgctgccagaccacaggggcaccctggagtctagcctctgcactgcctccaattgctgtgtgacttggggcaawctccttcccttctctgaacctcaggagctccacctctgttccttgcttgagagccagggtacctgcaaagggagggaagagaggggagttgcttaggggggaggctccagctcccaggaagctcatggtccccaagccttgctaatgagccactaggagtgctgggctctccagcagtcaccaccgccccgctgccctgctgccctgctgccctgtcccacagccaggtggaaggggcatgttttggggggctcgagagctgtggtgagcactgcggaagaggcattccccagctcagga

SEQ ID NO: 161251 - DNA, 601 bp, Human
ctgcttaccagcacactactgcctctcctccacttcccccgtgtagctcctgcccctcagctcccccaccacaaggctccacctgcaggggttgctcaggaggcagaagtggtttatgcctcccccatcctgctgccagaccacaggggcaccctggagtctagcctctgcactgcctccaattgctgtgtgacttggggcaaactccttcccttctctgaacctcaggagctccacctctgttccttgcttgagagccagggtacctgcaaagggagggaagagaggggagttgcttagkggggaggctccagctcccaggaagctcatggtccccaagccttgctaatgagccactaggagtgctgggctctccagcagtcaccaccgccccgctgccctgctgccctgctgccctgtcccacagccaggtggaaggggcatgttttggggggctcgagagctgtggtgagcactgcggaagaggcattccccagctcaggaatgccagcttcagaggccagggcttccagcactgaccctaggatcagaatcctgcctctgccatttgccagcctcgcggccctaagcaagttactgc

SEQ ID NO: 161252 - DNA, 601 bp, Human
aagcaaaatattttaaaggttcaggatggagtcaggacgggttcaaatcccaacgccaccacttcccacctgtgtgaccttggccaacttaactgatctctctgagctttaatactcagataatatcagtgcgggcggatggtaaaagtactaatacccctctcattaggacactgtaaagattaaattagccaatgcttagcacagagctggagtgcactgggtgctcaattttaggccaggggttctcacagggggtgattttgcccttgggggacatttggcaatgtctggagacatygttggttgtcgtggaggggagagggatacaaggaggggtgctcctgtcatctagtgggcagagttcagagatgctgctaaacaaccttccatgcgcaggacagcccccataacacagaatcctctagaccgaaatgtcaggagcactcaggttaagaatgtctgagcacccccgttttcagctggaaacaaacctaagtccttgttctcagggagcttgtattttattgtgggggacaggcaataaagaaatatgtaaaggtaagttctgcacttaaaaaaaaaaggagtacaggaataa

SEQ ID NO: 161253 - DNA, 601 bp, Human
ctctcattaggacactgtaaagattaaattagccaatgcttagcacagagctggagtgcactgggtgctcaattttaggccaggggttctcacagggggtgattttgcccttgggggacatttggcaatgtctggagacattgttggttgtcgtggaggggagagggatacaaggaggggtgctcctgtcatctagtgggcagagttcagagatgctgctaaacaaccttccatgcgcaggacagcccccataacacagaatcctctagaccgaaatgtcaggagcactcaggttaagaacgtctgagcacccccgttttcagctggaaacaaacctaagtccttgttctcagggagcttgtattttattgtgggggacaggcaataaagaaatatgtaaaggtaagttctgcacttaaaaaaaaaaggagtacaggaataaatggagagtggtactttggccaggatggtcagagaagacctctctgaggaggtggcacctgactaaccggacagggtgatccatgtaggtatctagggtaagagcattccaggcagaaaggcaacacgtgcaaaggccctgaggctgggggctggcatg

SEQ ID NO: 161254 - DNA, 601 bp, Human
tctcattaggacactgtaaagattaaattagccaatgcttagcacagagctggagtgcactgggtgctcaattttaggccaggggttctcacagggggtgattttgcccttgggggacatttggcaatgtctggagacattgttggttgtcgtggaggggagagggatacaaggaggggtgctcctgtcatctagtgggcagagttcagagatgctgctaaacaaccttccatgcgcaggacagcccccataacacagaatcctctagaccgaaatgtcaggagcactcaggttaagaatgtctgagcacccccgttttcagctggaaacaaacctaagtccttgttctcagggagcttgtattttattgtgggggacaggcaataaagaaatatgtaaaggtaagttctgcacttaaaaaaaaaaggagtacaggaataaatggagagtggtactttggccaggatggtcagagaagacctctctgaggaggtggcacctgactaaccggacagggtgatccatgtaggtatctagggtaagagcattccaggcagaaaggcaacacgtgcaaaggccctgaggctgggggctggcatgt

SEQ ID NO: 161255 - DNA, 601 bp, Human
tgtcgtggaggggagagggatacaaggaggggtgctcctgtcatctagtgggcagagttcagagatgctgctaaacaaccttccatgcgcaggacagcccccataacacagaatcctctagaccgaaatgtcaggagcactcaggttaagaatgtctgagcacccccgttttcagctggaaacaaacctaagtccttgttctcagggagcttgtattttattgtgggggacaggcaataaagaaatatgtaaaggtaagttctgcacttaaaaaaaaaaggagtacaggaataaatggagrgtggtactttggccaggatggtcagagaagacctctctgaggaggtggcacctgactaaccggacagggtgatccatgtaggtatctagggtaagagcattccaggcagaaaggcaacacgtgcaaaggccctgaggctgggggctggcatgtttaagaacagcatggaggccagtgctgcggctggagcagagggggtggagagaactggtggagctgatatcagggaggtaggcaggggccaggagctggaggccctggtgcacactttggatttcatttccagtgagatgtgcagcc

SEQ ID NO: 161256 - DNA, 601 bp, Human
agccattggcaggcttctgagcagtggggtagcatgcgttcaacacatcttcctaagtatcactgtgctgtgagtaccgagctgtgggagaccccggctaaaggcatcacacatggtatctccctcggaacctgcccagtgggctgcccaaatgttaattgcctcctttctttaaggacacaggggctccctcttctccctggcatgacaggcagagggatttgggaatgtggttgaggaagaaggaactctggaatctccaggcttagtcattatcttagtcaccccgactccgtccatkgaaactggggctctacaagggaaaggtcagaggcagaaggaggcaggtcggggctggaagaaaccgggaaagccagctgcaagcccaccgcagttctcccggttcatggctcttttccaaaagcccccagctccttaagattcagcatttaggggaaggctcccggattggcattcagacactctgaggaggggcccgccgcgtaattatagcaacagccaccacttcccaggccttaccctgttcccagcaccctgctaagtgcgtcatctcagtgccttcacaacaaccctgtgacag

SEQ ID NO: 161257 - DNA, 601 bp, Human
ttgggaatgtggttgaggaagaaggaactctggaatctccaggcttagtcattatcttagtcaccccgactccgtccatggaaactggggctctacaagggaaaggtcagaggcagaaggaggcaggtcggggctggaagaaaccgggaaagccagctgcaagcccaccgcagttctcccggttcatggctcttttccaaaagcccccagctccttaagattcagcatttaggggaaggctcccggattggcattcagacactctgaggaggggcccgccgcgtaattatagcaacagccrccacttcccaggccttaccctgttcccagcaccctgctaagtgcgtcatctcagtgccttcacaacaaccctgtgacaggactgggattcccgaattacagaccaggaagcagagcacccagagccgagcggcattgccaagagccatccagcttgcaagtggtagaacaggattctcacccaggcaggtggatccctcccctggggaagtcatagtgccccccacttccccgccagggggctgtggccaggactcccccagtgatgtggtcaggtgtttgctgggtgtctggccacagt

SEQ ID NO: 161258 - DNA, 601 bp, Human
gacactctgaggaggggcccgccgcgtaattatagcaacagccaccacttcccaggccttaccctgttcccagcaccctgctaagtgcgtcatctcagtgccttcacaacaaccctgtgacaggactgggattcccgaattacagaccaggaagcagagcacccagagccgagcggcattgccaagagccatccagcttgcaagtggtagaacaggattctcacccaggcaggtggatccctcccctggggaagtcatagtgccccccacttccccgccagggggctgtggccaggactcmcccagtgatgtggtcaggtgtttgctgggtgtctggccacagtgaaccctccaccagcgctgcctgtttcctgttttcactgctctcgttgctttgctgcagcggctccaacaggccagccggccggccatggactggggaccatcgctggaggagaaccggacgggcatgtatgtggccacgctggctgggagccagtcaccaaagccactgatggtgcacatgcgcaagtacgggggcatcaccagcttcgagaacacggccatcgaggtggaccgtgagattgcagaggaggaggag

SEQ ID NO: 161259 - DNA, 601 bp, Human
tagaatccactaatctgtcattatcatcatgcccctggcttttggcatccaggagtcagtgccaggattaaaccttctctaatgcaggcatttcaaaccaacaagggaaggggaagagtagctcactttagttggtgctcagatgagtggggagggagagtgaagatggtgtgaagatgagctgtctactcatatataatggtaaataataagtctacttacttatttattatttattcatttatttataaagagacagggtctctctatgaccaaactcctgggctcaagtgatcctccyaatattgcctccccaaatgctgggattacaggcatgagccatcacgcccaaccaacttttgcctttttgttagtatgtcccaccaagaaggaagaaggcataacaattctgaaaacttattagacagaggaaaatataaagaagtaaaaatgcagaatttttattaatatgggagacagtgtggcataagtacatatatactgcatgagaatggtttcttagtatgaggttaaagataagtctacaataatttttaaagtgtgattctactttgatgtaaatctaattttttgttttacc

SEQ ID NO: 161260 - DNA, 601 bp, Human
tttatttataaagagacagggtctctctatgaccaaactcctgggctcaagtgatcctcccaatattgcctccccaaatgctgggattacaggcatgagccatcacgcccaaccaacttttgcctttttgttagtatgtcccaccaagaaggaagaaggcataacaattctgaaaacttattagacagaggaaaatataaagaagtaaaaatgcagaatttttattaatatgggagacagtgtggcataagtacatatatactgcatgagaatggtttcttagtatgaggttaaagataagtctacaataatttttaaagtgtgattctactttgatgtaaatctaattttttgttttaccaattaaaacttcacttgtacacttgctcttagccaagaggctgagaagccgtaagacttcacttttacagtagtgatttgtaatttaaggaaaatacttggtttcttaactagaataattttttccaatttgaagttttcttgtggatccttgagaatgtttttcttttaaaagaggtctgttctttgtgatgggaagaatgaaaaaaaaaagaggtatgaaccttattcaagtttaaga

SEQ ID NO: 161261 - DNA, 601 bp, Human
cagaatctgagtgatttcacacaagtcacaacttgctaaatggccgtcgaacccgcacccagagcccacttgcagtccactgctgctcctgcaaagggaactagggaaagaagataattcccaagaaaccaaggattcaatgaccatcacgctgtaaggacgaagaatgtgtctcctctcttgtaacccctgggaaatcacaatatttgtgggctaaatggacaagcacattttcttacctggacaaaacagcatttctttagagagaatcccctgaactgctagcccgtcccagccattrccttcctcagccttttgccagctggatgcctctccacccaggtactcacttgccagaaagatcagtgacatggacaaaagtgtcattgaaggatgcaaagatatggcagacaccaaatacattctctccttcagccacctgaggtccgaggctgatgacctgttcttccttcttttccttcccctttcgaggtgccatttctgagtggaaggaaaagaaactcaaggttaacagacaaaacatttccagaatccctttcccctggctattaaatgaaaccctagtcctgcttcatgtccc

SEQ ID NO: 161262 - DNA, 601 bp, Human
ggagttcagtccagtggggttgaatggcccaatatagctatactcagtattaacattttatatatctacttttgcatttaatccttaccattactccacaaggtagacattactgtcctaattttacatatgaggaaaccaaaactcagaatctgagtgatttcacacaagtcacaacttgctaaatggccgtcgaacccgcacccagagcccacttgcagtccactgctgctcctgcaaagggaactagggaaagaagataattcccaagaaaccaaggattcaatgaccatcacgctgtaaggacgaagaatgtgtctcctctcttgtaacccctgggaaatcacaatatttgtgggctaaatggacaagcacattttcttacctggacaaaacagcatttctttagagagaatcccctgaactgctagcccgtcccagccattgccttcctcagccttttgccagctggatgcctctccacccaggtactcacttgccagaaagatcagtgacatggacaaaagtgtcattgaaggatgcaaagatatggcagacaccaaatacattctctccttcagccacctgaggtccgaggctg

SEQ ID NO: 161263 - DNA, 601 bp, Human
cacaacaaaaaacccaaacctcaaatccaggtgctccagcacccaagcccagcaggttttctaccacccagccatcccctctgcgactcgtacctatttcctcctgtggcccggagtttgatgtgtagggcggtgatacccagctccttgcacctctgggccacatcctgggcagccaacatagcagcatatggtgaggattcatctcggtctgcctttaccttcatcccaccagtcacacggcagatggtttccctggggacaaaagcacagggtcatttcttcctcgtccaacaaggartgcttacgatatcctaatgagtgaagagcaacacagctcagtcatggtggaggatgatggtcatgggctctgccctcatggagttcagtccagtggggttgaatggcccaatatagctatactcagtattaacattttatatatctacttttgcatttaatccttaccattactccacaaggtagacattactgtcctaattttacatatgaggaaaccaaaactcagaatctgagtgatttcacacaagtcacaacttgctaaatggccgtcgaacccgcacccagagcccacttgcag

SEQ ID NO: 161264 - DNA, 601 bp, Human
aggttctgacatctagcccaccgtcttctctagaggaaaaaacccttctagacagggtaactgcaactgtctcgttttcattaagtaaaaagacactgaaaaaaagtctgaaaaaatcttttaaggctgggcgccggtggctcatgcctgtaatcctagcactttgggctttgggagactgaggctggtggaacgcctgaggccaggagtttgggaccaacctgggcaacatggtgaaactccccgctacaaaaaaaaaaaaaaagcccggtgtggcacacactgttgtcccagctactcrgtagatgcaggtgggaggatcctttggacagatccgcccacgaggcgaaatttacagtgagctgagattgtgccactgaattccagcccacgcaacagagccagaccctgtctcaagaaaacaaaatcatccttcaagtaggacacagtaggaactttggcctggggcgtcagtgtatgtcgctactaactgcacagaacaatgtgcagggaaagactactgttcccttcctaagagctgtaaggagccaggagatcacaggcctgagggtattaataacagaagctggtaccccccact

SEQ ID NO: 161265 - DNA, 601 bp, Human
tgaacatgaagcggccccatctgccagttcctcgaatttcctgacgtggtcttaactcactttccagaaagggaaacaggctgagctgtgcgcaagatgtcagaggcacaggacaaatccaggttctgacatctagcccaccgtcttctctagaggaaaaaacccttctagacagggtaactgcaactgtctcgttttcattaagtaaaaagacactgaaaaaaagtctgaaaaaatcttttaaggctgggcgccggtggctcatgcctgtaatcctagcactttgggctttgggagactraggctggtggaacgcctgaggccaggagtttgggaccaacctgggcaacatggtgaaactccccgctacaaaaaaaaaaaaaaagcccggtgtggcacacactgttgtcccagctactcagtagatgcaggtgggaggatcctttggacagatccgcccacgaggcgaaatttacagtgagctgagattgtgccactgaattccagcccacgcaacagagccagaccctgtctcaagaaaacaaaatcatccttcaagtaggacacagtaggaactttggcctggggcgtcagtgtatgt

SEQ ID NO: 161266 - DNA, 601 bp, Human
atcctgctgctccccaaatgactccccagtacctaacagatggatgtgaacatgaagcggccccatctgccagttcctcgaatttcctgacgtggtcttaactcactttccagaaagggaaacaggctgagctgtgcgcaagatgtcagaggcacaggacaaatccaggttctgacatctagcccaccgtcttctctagaggaaaaaacccttctagacagggtaactgcaactgtctcgttttcattaagtaaaaagacactgaaaaaaagtctgaaaaaatcttttaaggctgggcgccggtggctcatgcctgtaatcctagcactttgggctttgggagactgaggctggtggaacgcctgaggccaggagtttgggaccaacctgggcaacatggtgaaactccccgctacaaaaaaaaaaaaaaagcccggtgtggcacacactgttgtcccagctactcagtagatgcaggtgggaggatcctttggacagatccgcccacgaggcgaaatttacagtgagctgagattgtgccactgaattccagcccacgcaacagagccagaccctgtctcaagaaaacaaaatcatcctt

SEQ ID NO: 161267 - DNA, 601 bp, Human
ggaggaagagaaagcgtcattgcctggagctggatgggaagggcccccaggactccctagaccaatggcctaaccaatcagcaacagatcctgctgctccccaaatgactccccagtacctaacagatggatgtgaacatgaagcggccccatctgccagttcctcgaatttcctgacgtggtcttaactcactttccagaaagggaaacaggctgagctgtgcgcaagatgtcagaggcacaggacaaatccaggttctgacatctagcccaccgtcttctctagaggaaaaaacccttytagacagggtaactgcaactgtctcgttttcattaagtaaaaagacactgaaaaaaagtctgaaaaaatcttttaaggctgggcgccggtggctcatgcctgtaatcctagcactttgggctttgggagactgaggctggtggaacgcctgaggccaggagtttgggaccaacctgggcaacatggtgaaactccccgctacaaaaaaaaaaaaaaagcccggtgtggcacacactgttgtcccagctactcagtagatgcaggtgggaggatcctttggacagatccgcccacgaggcg

SEQ ID NO: 161268 - DNA, 601 bp, Human
cctgatgaaggagagaaggctggagttgaaacagtttacatgaaggcaatttattaacagaaaatattttgaggaatcttgttcacagacggcgaccacggcgaccccccttcctgcgagtgctgtcagaggggatgggggtgacatcctctgtggggaggaagagaaagcgtcattgcctggagctggatgggaagggcccccaggactccctagaccaatggcctaaccaatcagcaacagatcctgctgctccccaaatgactccccagtacctaacagatggatgtgaacatgaagyggccccatctgccagttcctcgaatttcctgacgtggtcttaactcactttccagaaagggaaacaggctgagctgtgcgcaagatgtcagaggcacaggacaaatccaggttctgacatctagcccaccgtcttctctagaggaaaaaacccttctagacagggtaactgcaactgtctcgttttcattaagtaaaaagacactgaaaaaaagtctgaaaaaatcttttaaggctgggcgccggtggctcatgcctgtaatcctagcactttgggctttgggagactgaggctggtgga

SEQ ID NO: 161269 - DNA, 601 bp, Human; identical to SEQ ID NO: 29823

SEQ ID NO: 161270 - DNA, 601 bp, Human; identical to SEQ ID NO: 29824

SEQ ID NO: 161271 - DNA, 601 bp, Human; identical to SEQ ID NO: 29825

SEQ ID NO: 161272 - DNA, 601 bp, Human; identical to SEQ ID NO: 29826

SEQ ID NO: 161273 - DNA, 601 bp, Human; identical to SEQ ID NO: 29827

SEQ ID NO: 161274 - DNA, 601 bp, Human; identical to SEQ ID NO: 29828

SEQ ID NO: 161275 - DNA, 601 bp, Human; identical to SEQ ID NO: 29829

SEQ ID NO: 161276 - DNA, 601 bp, Human; identical to SEQ ID NO: 29830

SEQ ID NO: 161277 - DNA, 601 bp, Human; identical to SEQ ID NO: 29831

SEQ ID NO: 161278 - DNA, 601 bp, Human; identical to SEQ ID NO: 18018

SEQ ID NO: 161279 - DNA, 601 bp, Human; identical to SEQ ID NO: 18019

SEQ ID NO: 161280 - DNA, 601 bp, Human; identical to SEQ ID NO: 18020

SEQ ID NO: 161281 - DNA, 601 bp, Human; identical to SEQ ID NO: 18021

SEQ ID NO: 161282 - DNA, 601 bp, Human; identical to SEQ ID NO: 18022

SEQ ID NO: 161283 - DNA, 601 bp, Human; identical to SEQ ID NO: 18023

SEQ ID NO: 161284 - DNA, 601 bp, Human; identical to SEQ ID NO: 18024

SEQ ID NO: 161285 - DNA, 601 bp, Human; identical to SEQ ID NO: 18025

SEQ ID NO: 161286 - DNA, 601 bp, Human; identical to SEQ ID NO: 18026

SEQ ID NO: 161287 - DNA, 601 bp, Human; identical to SEQ ID NO: 18027

SEQ ID NO: 161288 - DNA, 601 bp, Human; identical to SEQ ID NO: 18028

SEQ ID NO: 161289 - DNA, 601 bp, Human; identical to SEQ ID NO: 18029

SEQ ID NO: 161290 - DNA, 601 bp, Human; identical to SEQ ID NO: 18030

SEQ ID NO: 161291 - DNA, 601 bp, Human; identical to SEQ ID NO: 18031

SEQ ID NO: 161292 - DNA, 601 bp, Human; identical to SEQ ID NO: 18032

SEQ ID NO: 161293 - DNA, 601 bp, Human; identical to SEQ ID NO: 18033

SEQ ID NO: 161294 - DNA, 601 bp, Human
ggtactgagaatggggggtcctactataacaaatacctaaaaatgtggaagcagctttataaataggtaatgggtggagactagacgaatacttgaagtacatagtagaaaaagcctagattgccttaaacatttttaaaagagattctggtgaggaatcagaaagaaaagaggaggccgggtgtagtggttcacacctgtaatcccagcactttgggaggccaaggcgggtggatcacctgaggtcaggagtttgagaccagcctggtcaacatgatgaaaccctatctctactaaaaayacaaaaattagtcaggcatggtggcaggtgcctgtaatccccgctactcaggaggctaaggcaggagaatcacttgaacctgggaggcggaggttgcagtgagccaagatcacgccactgtacttcagcctgggcaacagagcaagactctgtcttgaaaaacaaaataaaacaaacaaacaaaaacaaagaaagaaaagaggggagctagagaaaaagcctcaatcttcttaaagaatacctaagtaaccatgaacagactattggtaaaatatgaggtaaagtccattctgatgaggt

SEQ ID NO: 161295 - DNA, 601 bp, Human
ctcaattttaaaaaaaaaaaaaaaaaaaaaggaagtcctgagtaaaaggagagcaatatcatatttctgtatagcaaagagaatgttgtaaagaagtcaaattttctgtccatcctccaaaaatatatgtatacatctacatttgtgtatgtgtgctggggaaaggggataatcagagaattccaatccaaattcctgtattgttggttttggggggtcttttggttttaatcacgataaaataatgctaacctattttggaaaggataaacaagaaagcatgagagaaaatgtgggaaarcagaataatgaagaaatacttggccaggcgcggtggctcaggcctgtaatcccagcactttgggaggccgaggcaggtggatcacgaggtcaggagttcaagaccagcatggtcaacatggggaaaccccatctctactaaaaatactaagatttgttgggcgtagtggcatacgcctgtaatcccagctacttgggaggctgaggtaggagaattgcttgaacccaggaggcagaggttgcagtgagccgagatcacaccattgcactccagtctgggcaacagagtgagactccatct

SEQ ID NO: 161296 - DNA, 601 bp, Human
aacggaagcatcctgtttggaaccatcccaaacactcctatacctctcctctcatttatattctgttgctataatgcaactataattgtaagtttagcactttctgaagttctgagagtcattccatccaatcatcaaacctgagggaatgcctgggggacccaaaactatagctacctggtcagaagtgagagtgatcctggggacccccaaactggaggctgatatctgaagggagagcagtcttgtagaggattgtgccctaaacctgtgaagtctggcccaactccaggtaacagtaaaaaaaaaaagcattgtattaaaaaaaaacacatacatacatttgttcttgatttgtaattcatctcaaatgcccatattttctaaactattaagaataaaaatatttccttaacatgctaaagaatatataagtaaaatcaatacatattatatgttagtgaagatattctgaatcaggaacaaaacaaggatgaccactcactgttatcatttaacgttactctgaaatgttgactgattgggtgaaagtaaatgaaatgtatgtgaaaggagaaaaccaaattgtcattatttgcca

SEQ ID NO: 161297 - DNA, 601 bp, Human
aattagccaaacatggtggcacgcgcctgtggtcccactccaagcctactcaggaggctgaggtgggaggatcacttgagcccagaagtcgaggctgtagtgagccaagatcacaccactgcactccagactgggcaacagagtgagacctggtctcaaaaaagaaaaaaaaattggttggtgaagcggaaatggacaaatggggtcacatcaagataaaccaagatcacaacactgcactccagcctgggtgacagagcaagactccgtctcagggatggcggggcggagggccgggccragggaagcttctacacagcaaaggaaacaatcaaccaagagaagagacaactcacagaatgagagaaagtctttgcaaattatccatctgacaagggattaacaaccagaatatataaggagctcaaacaactctataggaaataacctaataatctgattttaaaacgggcaaaagatctgaatagacatttcttaaaagaagacatacaaatggcaaacaggcatatgaaaaggtgctcatatcattgatcacagaaatgcaaatcaaaaccacaatgagatatcatctcactcccgt

SEQ ID NO: 161298 - DNA, 601 bp, Human
aaaatcccaatactcaaacacaataatgaaagtacccagacaataaactatagatcttgttgacttgagaatgtaaatataaatttgccactaaaaagtaagcaccatgaagacaaggggttttgtctgatttgttcaccgctatatctaaaactagtacctggagcacagaatagacactcaatatttgctggaaaccagtacctggagcacagaatagacactcaatatttgttggataaatgattgaaatactaccaaagtgaatttgacatttaaaagtagaaaatttatctcagcrtttagaagaatatttggcacagacacaataagcttaagtatttgttgactcaagtgaattaatgtaataatttcatacaatgtaattttgatcacatctatacaaatcatctcaattgacagttatgtaataaagaatttggttggcggctgggcatggtggctcacacctgtaatcccagcactttttgaggtctggtgggtagatcacttaagcccagaaattcaagaccagcctgggcaacacggcaaaaccccatctccacaatactccaaaaaaattagccaaacatggtggcac

SEQ ID NO: 161299 - DNA, 601 bp, Human
tatatgaaatgcaaatcaaagcatatatataaaatgtttaaagaagtaaatgaaatggaaaaatatcaaaaagtatctccatattttaacatatttcagattttcacataaatagtaattcttgtgctatacaaactattcctgtgcggagaaaaagaaagttacctattccatgccctaataaaatcccaatactcaaacacaataatgaaagtacccagacaataaactatagatcttgttgacttgagaatgtaaatataaatttgccactaaaaagtaagcaccatgaagacaaggrgttttgtctgatttgttcaccgctatatctaaaactagtacctggagcacagaatagacactcaatatttgctggaaaccagtacctggagcacagaatagacactcaatatttgttggataaatgattgaaatactaccaaagtgaatttgacatttaaaagtagaaaatttatctcagcgtttagaagaatatttggcacagacacaataagcttaagtatttgttgactcaagtgaattaatgtaataatttcatacaatgtaattttgatcacatctatacaaatcatctcaattg

SEQ ID NO: 161300 - DNA, 601 bp, Human
gaggcaggagaatcgcttgaactcaggaggtatcggttgcagtgagccgagattgcgccattgcactccagcctgggcaacaagagcgaaactctgtctcaaaaagaaaaaaaaaaagtttagaccacttagaaatcaattcttattacacatctttgaaaaaaggtaaaattttggtagcgctaaccaaatgtaccaagatccttgtttacagtgaattttcaccaaattttgattaagactgaatttcaaagagaatgttttctttgaagccaatatatgataaattttataaagaatmatatagtatagaaattttccttttaaacaactgtactgaatgacaaaaatcccaaactggaactaaaagtttgtaacaaggttttctcagcatcaaggagaaaagtgcaaagtaatgcattcattttctaagccaaaaaataatgaaaaacacaaaagagggagattttaaattaatcaaaggttttataaatctctacaataactctcccagaaaatatacaactacagtgtaatttctcatcttaccttcttcttcgatttccattgtttcctgatggtcttgttatctgagtagaca

SEQ ID NO: 161301 - DNA, 601 bp, Human
aactatgcaagaactttctgatttgagggcaaaaccagattccaaaccaaagtcctatgctaccattttgttcagtcattaaagaaatagaaccgctattcagaatctactaaaaaaaaaaatttctacttgtatgaccaagagtctgttcaggcacattcaacaccactagcagaaggagcaatttctttaaatatggatgttaggaatctacctcttatggcacattttataagggtaacatagaatagtagcaactgatcactttttattgatatcctagacaaaagatatatactayagatatcaataagacatagcatagcattttatttccttagaaaacattccattaatttaactgaatttacaagaaatcttttttaaaaagtttttaaaataacattcaaaaataagaatatgttgaaattcattgcacctaatggaaaattcttatttagtaattgcttacgcaggcaaaaatctacagatattctgagggaagataacataacttttggaaaataacactgcatatacctaagaacatttcaacagttccaaaactcacatataccatataatcgattaaaatataaca

SEQ ID NO: 161302 - DNA, 601 bp, Human
tatatggaattggccaggcatggtggctcacacctgtaatcccagcactttggaaggccaaggtgggcagatcacctgaggtcaggagtttgagaccagcctggccaacatggtgaaaccccatctctactaaaaatacaaaaaaaaaaaaaaattagccaggcgtggtggcaggcgcctgtaatcccagctactcgggaggctgaggcagaattgcttgaacctgggaggcagaggttgcagtgagccaagatcgcgccattgcactccagcctggatgacagaggaagactccatctctaataaataaataaataaataaataaataaataaataaataaataaaaataaaaattatatggaatcacaaaagacccaaaataaccaaagctatcgtaagtaaaaacaacaaaactgaaggaatcacattacctgacttcaaattgtactacagcactatagtaaccaaaggagcatggtagtggcataaaaacacatcggccaatggaacagaattgagaatccggaaatagatccatacatctacagtgaactcattttttttttttttttttgagacagggtcacactctgtcacct

SEQ ID NO: 161303 - DNA, 601 bp, Human
actggctatagaatacacatttttctcctcagtgcatgaatcattttcagggatataccatattatagccaaaaaacaagtcttaaaacattccagaaaattaaaatgatatcaagtatcaccgggagggtacagcctccctcctggctgctttcatgggctggtgttgagtgtctacggcttttccaggtgcacaatgcaagctattggtggatctaccattctggggtcttgaggacagtggccctcttctcacagctccactaggaagtgccccagtgagaactctatgtgcgggtgyccaccccacatttcccttccacactgccctagcaaaggttcaccatgagtgccctgccccggcagcaaacatctgcctggacatccaagcatttccatacaacctgtgaaatctaggcagaggttctcaaatctcaatacttgacttctgtgcacctctacaaaaaaatacaaaaaattagggagggagggatgtggtggcacatgcctgtggtcccagctacatgggggactcacacacaagaatcacttgaactgggaagcagagtttgcagtgagccaagatcatgccactgcactc

SEQ ID NO: 161304 - DNA, 601 bp, Human
gcaggctcgataccacgtagaagctgccaaggtttggagcgtccaccctctgaagccacagcctgagctgtacattggcccctttcagccatggctggagcaactgggacatgggacaccaagtcccaaggctgcacacagcatggggaccctgggtccggcccacgaaaccactttttcctcctaggcctccaggcctgtgaagggaggggctgccatgaaagtgtctgacatgtcctggaaacattttccccattgcttgggtattaatgttaggctccttgctacttatgcaaatttmtgcagccagtttgaatttctccccagaaaatgggtttttcttttcttctttttttttttcttttgagacagagtctcgttctgtcacccaggctggagtgcagtggcgtgatctcagctcactgcaaatgccacctcttgggttcaagcaattcccctgcctcagcctcccaggtagctgggattacaagtacccaccatcatgcctggttaatttttgtatttttttagtagagatggggtttcaccatgttggccagattggtcttaaactactgacctcaggtgatccacccacctc

SEQ ID NO: 161305 - DNA, 601 bp, Human
agtgccctgcccctgcagcaaaactattgcctgggcatccatcttctgaaatctaggcagaggttcccaaacctcaattcttgacttctgtgcacctgcaggctcgataccacgtagaagctgccaaggtttggagcgtccaccctctgaagccacagcctgagctgtacattggcccctttcagccatggctggagcaactgggacatgggacaccaagtcccaaggctgcacacagcatggggaccctgggtccggcccacgaaaccactttttcctcctaggcctccaggcctgtgargggaggggctgccatgaaagtgtctgacatgtcctggaaacattttccccattgcttgggtattaatgttaggctccttgctacttatgcaaatttctgcagccagtttgaatttctccccagaaaatgggtttttcttttcttctttttttttttcttttgagacagagtctcgttctgtcacccaggctggagtgcagtggcgtgatctcagctcactgcaaatgccacctcttgggttcaagcaattcccctgcctcagcctcccaggtagctgggattacaagtacccaccatcat

SEQ ID NO: 161306 - DNA, 601 bp, Human
ccactatgtccagccggtctgacatatttaaactgctaaatgaaaaacctttttgtcctacaatactatacccaacaaaaataaacttcaaacaagaagtaaaaataaagacatccccagaaaaaaacaaaagctgaaggatttcatcaacaacagacctgcctacaagaaatgcaaaagagagttcttcaaattgaaagaaatgacattaatgagcaataagcaatcatctgaaggtacaaaactcattagtaatagtaaatacacaaaaaagacagaatattataaccctgtaattgtyatgtgtaaacgactcatatcttcaataggaagactaaaagatgaaccaacttaaaagaatacaacatttcaagacatagacagtataataagatataaatacaaacaacaaaaagttaaaaagcaaggggacagagtgaaagtgtacagtttttattacttttctctttgctggtttatgagtttgtttgcttgtttatgcaatcagtgttaccagtttaaaaaaataggttataaaatattatttgcaagcctcaatgtaacccccaaattaaaaaaataataaaagatgcataaaaaa

SEQ ID NO: 161307 - DNA, 601 bp, Human
gtcttgaacttctggcctcaagcaatcctcccatcttgacctcccaaagtgctgggattataggcctgagccactatgtccagccggtctgacatatttaaactgctaaatgaaaaacctttttgtcctacaatactatacccaacaaaaataaacttcaaacaagaagtaaaaataaagacatccccagaaaaaaacaaaagctgaaggatttcatcaacaacagacctgcctacaagaaatgcaaaagagagttcttcaaattgaaagaaatgacattaatgagcaataagcaatcatgtgaaggtacaaaactcattagtaatagtaaatacacaaaaaagacagaatattataaccctgtaattgtcatgtgtaaacgactcatatcttcaataggaagactaaaagatgaaccaacttaaaagaatacaacatttcaagacatagacagtataataagatataaatacaaacaacaaaaagttaaaaagcaaggggacagagtgaaagtgtacagtttttattacttttctctttgctggtttatgagtttgtttgcttgtttatgcaatcagtgttaccagtttaaaaaaatagg

SEQ ID NO: 161308 - DNA, 601 bp, Human
ttagagacagaaaattcaaaatagctatttttagccaggcacagtggcttatgcctgtaatcccagcagtttgggaggccaagggacaggtggatcagttgagctaaggagttcaaaaccagcctgggcaacatggcaaaacctcgtctttacaaaaattagctgggtgcaatggcatgtgcctgtagtcccagctacttggaaggctgaggcaggaggatcacttgagcctaggaggtggagtttgcagtgagccgagattgtaccattgcacttcaacctgagcaatgacagtgaaacyctgtctcaaaaaaaaaaaaaaaaaaaaaaaaaaaaaagctattttgaggaaactcaaacaaattcaagaatacacagaaggaattcagaatcctatcagataaatttaacagagagagtgaaataactaaaaaaaaaaaatcaaacaaattctggagctgaaaaatgcaactgacatactgaagaaatgcatcagagtctcttaacagcagaattgatcaagcagaagaaagaattagtgagcttcaagacagtatatttaaaaagacacagaggagacaaaagaaaaagaataaaaaag

SEQ ID NO: 161309 - DNA, 601 bp, Human
tgctgtgctggcttcagacctgacccaggccagtcccagtattaatggccacaggggtgctgtgtcactcctcctggctccaagcagctcagcacagagagaaagagactccatttgtttgggagaaagttagggaagagaacaagagtctctccctggtaatccagagaattctcccagatctgacccaagaccaccaaggcagtaacctctacaagtctgcaggagccacaacattactgggcttagggtgccccctaatgcagatacagctgcagtgaccaaagacttagatcacaaygcccaattcccctcaaatacttggaaagccttcccaagaaggacaggtacaaagaagcccagactgtgaagactacaataaacatctaaccattcaatgcacagacactaatgaacatccacaagcatcaagaccatcgaagaaaacatgacctcaccaatatctaataagataccagtgaccaattccagagagacagaaatatacaaccttagagacagaaaattcaaaatagctatttttagccaggcacagtggcttatgcctgtaatcccagcagtttgggaggccaagggacag

SEQ ID NO: 161310 - DNA, 601 bp, Human
atcttaataggaaaatgttacatggggaaaaaaaccccttgttaaatccatctaaatcttaccctacggcacttttctccatctgaaaattttgctttctctcttgtttgccacattctaatctctggtcgacattgtctcctcttaatgataggatggacacaacttgggtcattgtcagtttcagtccctttgttagatattaattttactcttttaatcctattttttaaaaaaggaaaagaagattaattttttgaaagtaacacctttcatgaaaccactttcttttaaggaataygctatattattctggaaatcaagaaaatgcaggaatcatatttttcaggactttagcttgctaagtaagggtgtagaatgacaaaatactcactcacagactcagaatgtgagtctattcttcaaagactcatgtcaattaactgaaaggaagcatatacttttcagtgttgcacaaaagtaggttcacagtcctctccacatcttctcagacacaatgcaactcctaccttatatcgtgtgttattgccactccactagcccagtagacttaggtgcacatgacctattgagacaccag

SEQ ID NO: 161311 - DNA, 601 bp, Human
gttaaactctgatgtctctagcaagcagtactccctctaagaagctattgccatgttatggaactgatcaactaaggtgttctgggaggggagtgattcctgtaagcacaccaagatgacccactcaattggcttagctgagctttttgacacacacaaagtgaccccaactctaaatattgtgaacttgactacagacctactcgtgaacaggattcagctccaaaacgttaaaggataatcagtcaaagaaaagtaccaacataaatatgaaagttattccatgaccacaattgccttrttaatcaaaataaaagaaaaaaccacaccaccaccatctactctgctcacctctgagttacaattttccaaataatataatatgccctttagctctcatgatgagatttactactcccatctttcagaactcctttctcaaaaatctgtcttcatcagcatcaatccaatttatgatgtttaaaaataaacttcatatgccaagtgaatatttaataatctcattatttagggattaagtaacctcctgctgggcatcatctgtgatacttttaagcttagggtcaatgtaggaaaatat

SEQ ID NO: 161312 - DNA, 601 bp, Human
caaccattattcaaagtaataactttgctttatgtcaagtgagctccctaaaacatgtggctcattccactggtatgactagaaaatcctaaggatcagttctttattctgttttaggctccaaataacaatagcagcagcaactaccatttattgagtgcctattatgtgtcaaattttccggtaaaaggtttttgtttttgtttttaaatttgttgatttaaaagtaaagaaatttactcaagcccaaagtaagatggaatttactgaaaaacatacagataatgctcacagaaacctkgtgaaaaacaggaagtcaccaagcagctgccctctccatctcgcttcccccagggctacgtaggctcccatctccactcctcttagccagctccattgccttacaagacctttgttttctgcctccccactgagtttgactcatattagctttggcttgtcatggcaccctagcagcagacttctcaagataaaatgtggaaatcagaaagcaatagaatcctaaaagtgctgaaaggaaataactggcaacctggaattcaattcctggtaaaaaaaaaaaaaaaaaaaaaaaaaaaaa

SEQ ID NO: 161313 - DNA, 601 bp, Human
gtttttcatttaccttaaaatcatgtaattactcttttactctgtcaatttaagaacatttccaaaaatccaatattttaatactgaaagcagaagagctttaatactcattaactattacctatttatttaatcactatatatttctctaagttttctagattttctcctttagcaagggtctagaagtaacaaagaaggaaaataccacaaataaaataagacaaatgcatttgcagctactttaactatcagtgtgtccactcacaactatatggcaaccattattcaaagtaataamtttgctttatgtcaagtgagctccctaaaacatgtggctcattccactggtatgactagaaaatcctaaggatcagttctttattctgttttaggctccaaataacaatagcagcagcaactaccatttattgagtgcctattatgtgtcaaattttccggtaaaaggtttttgtttttgtttttaaatttgttgatttaaaagtaaagaaatttactcaagcccaaagtaagatggaatttactgaaaaacatacagataatgctcacagaaaccttgtgaaaaacaggaagtcaccaa

SEQ ID NO: 161314 - DNA, 601 bp, Human
tgccagtcaccttgcaagggtaggtagtgtgagtgtgaggcttgctaatcttgttcccccagtagtctcctcacacagggaggataaagagcttgaccatgattatagccccatggatggtgctggctacctccttggagcactaacacccagaccaacatagccgttgtagtcctcaatggtgacaaatgccttgaacctggtccttgatgcacagagaagaggcagatctcctccagggacttgatcttcatgtccttgaccagatggcccaacttggtgatggggagccactctttgyccttaatcttgcctccaggagctctgtgacctcagctctggtcctaaccaccactgtgacccctacccctgatgccactgtggaagagtccacttccaggacccctcccaacccaaggtatcatctgccatttaatgttttcttagagaaaagactgatttaactcaaatgatagtaaaagtgtatcatagcctatgacttactttcaacaacttggtggacagctttaatacattgtttactagagtaagctgttctttcttatttggctttttttccatcttaagatataaattaatc

SEQ ID NO: 161315 - DNA, 601 bp, Human; identical to SEQ ID NO: 122872

SEQ ID NO: 161316 - DNA, 601 bp, Human; identical to SEQ ID NO: 122871

SEQ ID NO: 161317 - DNA, 601 bp, Human
ttgatatattatgttaaatcaggctatgttatagtaaagaataaaccttaacaacttagtgagataacacataaatatttatttcttccttacacaatatcagctgatctccagggctacccttttccaaatggcgttttgggaatccaagtggcctttctcttacagctttgccttcttgaggatggaggatcgctgtagaggaggaaacaaagctggagggtcacataccagctcttcaatccttggcctagaattcacacctgctattcccactcccaggccattggccagaagaackagtcacagagccatgcctgtatttaagcaacagcgaaatgttaagcatgtggggagcagtatatgcctccgccaccctggctgagagtgtgtgtcaataaaccttcttggataaactaatgagtaaatctgacagagggtttaaattatactatgacagaaatactcaaatcctgaagcagctttccacttccagagcctcagatgaaatcacacatgtcatcaacaggaggaataatgaacatggagctgcctttattaacaatctagtctatacaaggcactgttctagaaatttcaa

SEQ ID NO: 161318 - DNA, 601 bp, Human
ccaggctggggaggaggagcaaaggcaggcttgagcacccagctgtttgttgttggcaaatatgtctaaatattgtgctggttccctgttctatactttattgccatgaagtaaatgctgaactagaatgttcatatgacctcatctaaacagctccctgtgtttatgggcaaagaaagcacagaatatgagtacttgaaggacctcagctcagcttttaatttcaggtggcttcaaatctatcatggattaagctgaaatacacaaaaatgtatattttctcaaatgaggaaactgagamttggagcgaagacatgtagcctgccactgttcaaataagtgttagtagctatctctcttgaagcagcctgcctctcaggctgccacacacaccactccactgactggatgaagcaaaagtttattccgtattccaacttcaagtggagctccttttactggcatggctaagcagggtcagaaggagtagaggtgaaggtggaatgataaaatctagtgtagatgagttgagtctctagaaatcttgggtctgtgctgagaagctaattctcatgtaaggagaagctaattctaagttata

SEQ ID NO: 161319 - DNA, 601 bp, Human
ctctagcttcagcctctcccctgacagtgctgttgttgacaatgccatggtgatggctataccctttgtatccactatccttgaggggaagactgattacagcattttcagccaactttgaacagtctaatctctcaaactaggcccgtaaaatgtagccttgatattatctgacattccattgggaaacttggcataagttcctaaagaactaggccagaggttctggaaggacaccatcctatagcaccaagcaagtgtaccttaaagtgagtcatcagaggctgacttttctcccccrttgtatctccacagcctaccctgcaattttcacgctgagatttcccacagactgtgtagggggtttccatacaaatataagctgtgataaccctgagttcctaaagcaacaccaacatgaatcatatgaatcatacaaaatcttcaaaggaagacaactttttatctgtctggtgttaaatcagattgcaatattaaagaaaaccacgtcttccttgaaaagcctgccagcttctctacttccttcctccttccctcagtcaggagagtttgaacttcagattgttagcaacaggtactc

SEQ ID NO: 161320 - DNA, 601 bp, Human
ttgcaatattaaagaaaaccacgtcttccttgaaaagcctgccagcttctctacttccttcctccttccctcagtcaggagagtttgaacttcagattgttagcaacaggtactcctgaatgtccttgccctcagatttcctcctctttgtcactggtctgctaattttacctcactgttttatcagacaaaaagcctaaagaggttcaaggagctaaaatgagctaaaatttctagaacaatagctggcaattggtcaatttgctattttattcttttctcctctgtctcttcttcttgrgcagtaggaataaaaaaggaaaaaagaaaaaacattgaaatggagacaaaataaaatgggaatacaagaagacaaaataaagtgggaatacaagaaaaccattagattacttgaatcttccctttaatttctggtggcttcaaggctggtagggatcaaattgaaagaaagtatatacaaatatattgtgctaagttcttcacttccaaatttaggaaaagctttgaacaaggaaggtatccttttctttaattataaaccttatattaaacctctaaccaaaataatagactactaaga

SEQ ID NO: 161321 - DNA, 601 bp, Human
ctgtcctagcagaggttctccattagggctctgcccctttaagcagatttctgcctggacatccaagtgtttctatacatcctctgaaatctaggcagaacttcccaaatctcagttcttatcttctgcacatccacatgcccaacaccatgtggaagctgccaagctttgaggcttgcaccctctgaagctacaatctgagctgtactttggccccttttagccatggctggaacacagggcaaccagtcctgagactgcacaaagcagcaaggccctggtgccctgcatcttaggcctmcagtcctatgatgggagggtctgcagagaagatgtctgatatgccctggaatcattttccccattgtcttggcaattaacatttggctcctcgttacatatgcaaatttctgcagccagcttgaatttctcctcagaaaattggtttttcttttctatcatcacatcatcaggctgcaaattttccagacttttattatgctctgctccccttttaaaaataagtttcaattttaaaccatatatttttgaatacataaaactgaatgctgttaacagcccccaagtcacctcttgaatg

SEQ ID NO: 161322 - DNA, 601 bp, Human
gctgggaatgccatgacgtgggcacattgaaagacaagaggcaggcatgatcagccttgaactttaggaagatcccaggaagctgatggaagacaagatgtggagtgaatgtgaaggcaagatacaaaaataagaattttttgtaataagcttttaagaagtggtggggcctcaactaggtctaaggtggtgtgtgtacagtggaggagaagatataagaaatactcagaaggccaaataatcaggatttgggaatgggaatgggaatgggagaatggaagggtggacgattactctctgmcttctggcttagggatcactggctttagcaataactctgttaagataagaatacagggagaccaatgttgaatccaaacaatttcatactgcagcttccccttcatttccttttctgcatctgaagtgttctcactgggtttggtttggttttgttttctccttggaaggtccagaaatgtccttggtgtgtttgacagactttcaggcccatgcgcgagagcagctgtctaagtcaactcgggattttattgaaggtggagcagatgacagcatcacgcgggatgacaacattgcagca

SEQ ID NO: 161323 - DNA, 601 bp, Human
gtgtacagtggaggagaagatataagaaatactcagaaggccaaataatcaggatttgggaatgggaatgggaatgggagaatggaagggtggacgattactctctgccttctggcttagggatcactggctttagcaataactctgttaagataagaatacagggagaccaatgttgaatccaaacaatttcatactgcagcttccccttcatttccttttctgcatctgaagtgttctcactgggtttggtttggttttgttttctccttggaaggtccagaaatgtccttggtgtgtytgacagactttcaggcccatgcgcgagagcagctgtctaagtcaactcgggattttattgaaggtggagcagatgacagcatcacgcgggatgacaacattgcagcatttaaaaggtgtggtcttctgtagcctgtctattgttaggttaaggtgcactggtggagagcaacttggacagtagtagtcctggtttctgcctccaaaaaacacagatcactcaagacctaataatgtggatgattttgttgttgttttggtttgttagggcaggggagggagggctgatgggaagatggaa

SEQ ID NO: 161324 - DNA, 601 bp, Human
agcataagtgagtcattctccttcatctcagcaactttgcaacctgacaagatagaacaagagtcccagaatgaccagttccctaggcagggaggatgggcctgctgggaggcctagatctcctgagttcctaaactctggcttggagaagaaaatggaagacaggagagaacactcaggtttggagaaaatatggagatccaaggagtctcaaagataataagagattgagtcaggggagaagagttggtctgaaaaagtaggagatggagcatcggtcaaccaacagcagtccacaggyagaggctgacccgccacttatttttgtatggtccatgagctaacgatggtttttcatttttgaatggctgagggtggggagtcaaaagaagaataatttgtaatacataaaaattatatgaagttcaaattttggtgtccataaataaagttttattttaacacaaccatgctcagccatttactattgtttatggctgcttttgcacttcaagagcagtgttgaataactgtgacaaagattacatggcccacaaagcctcaaatatttactctctggccctttatagaaaaagcttgc

SEQ ID NO: 161325 - DNA, 601 bp, Human
aaagtaggaaatgggaaatctgccagtcagcagcagccatatgaacgtcatcaccatcaacttcattagcactggtatctatgcagtacaccactttgcaatgtaaagaatgctgccatagctagtatcttattcagtctcccaacaatcctaaagacatgtattattattttccctattttacagataaagaaaatgagagactcaatgccacacagcaaagaaggggtagaactagcattcttctaatttcatatgctatgctttttccaccatgaagttcaggattctccactggaaytacattccctcatcctctgccctctctaattctcttctgcttcattaaggagttcataagaggcccagttgcctgtctgaaggctataacacaaccaacatgattctggagattgcatggcatctttagctggaaatattttgttatcgagtagagggtttgtaagacaggttatacagaggagaacccaaaaaggtttaggtctctcagcctgatcaaattgccttccatccctttcttacaaggaagcagaatgaaattaagctttatctgcattcatggggcaagatggccagaggc

SEQ ID NO: 161326 - DNA, 601 bp, Human
catgtcctttgctttacagctgcccaagcggctggtatctgctacatcaccagcacatttgccagctgtagccttgaagacattgtcattgcagctcccgaaggcctccgatggttccaactctatgtgcatccagacctgcagctgaacaaacagttgatccagagggtagaatccctaggtttcaaagctttggtaataactttggatacacctgtatgtggcaacaggcgacatgacattcgaaaccagttgaggaggaacttaacactaacagatcttcaatcacctaaaaaggtargaaagataccaaattcgatggacaggcattacaagaggcaaatttccttccctcttttctcctttcctccattctttctttccacaggcatttatcgaacacctgctctgtgccagacactgcggataaagcagtttcaaaaagcagatatggttcctgctccctagagtttccagacaagcacaatcaacataagaccaaatgttctcacccttggagctgcccaacttgtcaccagaagtgttctggccagagctggatgctgagaaataggaaagccacggaaaatatttttgcacg

SEQ ID NO: 161327 - DNA, 601 bp, Human
ctaaaaaggtaagaaagataccaaattcgatggacaggcattacaagaggcaaatttccttccctcttttctcctttcctccattctttctttccacaggcatttatcgaacacctgctctgtgccagacactgcggataaagcagtttcaaaaagcagatatggttcctgctccctagagtttccagacaagcacaatcaacataagaccaaatgttctcacccttggagctgcccaacttgtcaccagaagtgttctggccagagctggatgctgagaaataggaaagccacggaaaakatttttgcacgaactggagagtaaactaaaaaagttcatgtaacattttctactttatgacacactcagaaaatgctaattttggatggcatacatagacaaactgactctccaaaggggatgttcatgaccaaagtgactggccagacagtctagacaggccaggttctaccttactgccttgaaactgaggaatcaatatctctgcacacatagagctcatttgtggagcaccaggatgctatagcacatttgtttgtaatctctgaactaggtgactacaaaggggaccttccccat

SEQ ID NO: 161328 - DNA, 601 bp, Human
aaaggggatgttcatgaccaaagtgactggccagacagtctagacaggccaggttctaccttactgccttgaaactgaggaatcaatatctctgcacacatagagctcatttgtggagcaccaggatgctatagcacatttgtttgtaatctctgaactaggtgactacaaaggggaccttccccattaaaatcctacaattaaatggcaagaagtgcctcagagagagacagccatgataaagtgggaatccctggctatagtagagatactaaagccagccttttcaaccagtgggcarctgtgacaccaagccaagtaactcaacagttctcattaatcacagattggccttgaggtgctccaaaatccttattcaaattccagaagcacattgagatttataaatgtttgatgtacatggtgagccaagagtaaatattgggtaataactgatttagtattgcttagttcttatcctgggtatgcctcaaccgtaacatatcacattgaccaataaatgcttttgcttatccatcttatatactaaactctgaattttttaaagtagaaactttgtcttatttgtctttgtgtcccc

SEQ ID NO: 161329 - DNA, 601 bp, Human
aaacctcatagaggtgggaacttttctcaaaatccttaccttttatagcactggcaacaacctgcagggagtgggacactgacctcaggcacagactctaggggagtgccaaaaactcagatactatagtttgaaatcaggtgatttcaaagttcctcatagaagttcccacctctttcacaacattataaaaatactccaaataataccatgctgggactataaaaaatgcctcttattagaatgtgaattctctctagttattacatgtaagttcaaaacatattcaattccccgcccycacctataagttaaagtagaaaattatttcctcactattttcttatactgttcagtctcagccaaagtatcccattcaggtagaatgctaatggattcctttggcagcagaaggcctcatagggcccagttttgactcttcttctcaggccatccctcagagaagcacagacaaaaaccctgagggtgttccagaactccctccccaaggatcttccgccttgatccataaggggcctgtttgtcactcctctttacagacttgtaggtgcctagaagcatagatcggcctggggcacct

SEQ ID NO: 161330 - DNA, 601 bp, Human
tctttgtgtctctgtctgtctgcctcgggagcagggtgaacatggtgttaaggaagttttgaacattttaacaaatgagttccacacttccatggcccttacaggtaagttaacatgttttccctgatttggaacttaaagcaggatggctaaagaataggagcagcagtccttccctctagcagaccctttcctgatgtggtagctgtccaaaagataggacaggcaggcaactttcaagacaaagattaagcactattctctgcacagtggaaaccagagctgtcctcaagatcattgwcagctctggggagtgtcacctctggctctgaattcttgcttctgttgaattcgttcaatttacggactattgacatatcccatgcctgctgtttctgtccactccagtcaacccaggcatgaaactcaactcttttctatgcttccacttttaggaaaagaccctctcattagtatatttttgtgaataatacattttgccaaagttatggtgcacacatcataaatatggaaagaactcccagttaaacgttacgcagcctgttattgcattctttcagccttctcatcaccagggact

SEQ ID NO: 161331 - DNA, 601 bp, Human
ctaaagaagagtcttttcctttgacagaactttcctttagaaggcaattgtcatgtggaatactcaccccatctcttttgctatctgtgtgtcatattcctcccgaaaagatacttcctatatccctgagccttatcagaaccaagataaagatcaaagacatctattgcacacaagagttgatttagaaaatgctaaaatagggtttttacatgtttaccctgacattttgacatggccatgttcagagatgacctgggctcaggttcacagaataatacccaatgcaaacagaattacrttattcattctgtatgtaaaccattttataagagtgagcacaaagatcaagtcagacttgctccccttcatcaccccttacccatgatgaggtgagttgcttgtgtttgacaaaaatgagcttgtaaccacattgttcttttaggctgccggtcggtcgctgagatcaatcgaaacttggtccagttttccaggctgtaagaaaaaagggccaataaccagactgctgaggttgcccacaggaggatcacaaactcacagcacagtgtgtgatgctgtccttcctggaccccattctgtc

SEQ ID NO: 161332 - DNA, 601 bp, Human
aggttgcagtgagttgagatcgcgccagtgcactccagcccgggcgacagtgagagactccaactcaaaaaaaaaaagtttgcaaccactgacaagactgtagtcctcagcaaaagtgtggtggaggtgactttcaacttcagtaaatgtctgcttcttatacttctccatccctctccatccactgctccacccattttctctccaaggagatgcctgggctgtcaaatatttcccactaggatggcccactcacacttgtccctagataatgtcccggactctaggtatttccccaacsctttgcctccatcaaaactttttttgtgcttgatcccattcctttctggttttgttttgttgtattgtgttgttttgactaggagactactagcaatctgataaactaatctgtggaaatcaagtaggttaccttcccaggaaacatttgaaatgtattccagactttctaaatacatgccatgccatcacctaaaggaacttacctaccttatcatcagctattcatcagatttctaggttgtaaatctattcctgggtattcttatgtgtcatatctataatttcctcacaagtatat

SEQ ID NO: 161333 - DNA, 601 bp, Human
attccatatttactctctagaggccagcctccctccaccaaattataagacatttaagtttgcaaccactggccgggcacagtggctcatgcctgtaatcactttgggaggccgaggcaggaggatcacgaggtcaggactttgagaccagcctggccaacatagtggaaccccgtctccactaaaaaatacaaaatattagctgggcgttgtggcaggcacctgtaatcccagcactttgggaggccgaggcaggaggatcacgaggtcaggactttgagaccagcctggccaacatagyggaaccccgtctccactaaaaaatacaaaatattagctgggcgttgtggcaggcacctgtaatcccagctgcttgggaggctgaggcaggagaatcgtttgaaaccgggaggcggaggttgcagtgagttgagatcgcgccagtgcactccagcccgggcgacagtgagagactccaactcaaaaaaaaaaagtttgcaaccactgacaagactgtagtcctcagcaaaagtgtggtggaggtgactttcaacttcagtaaatgtctgcttcttatacttctccatccctctccatccac

SEQ ID NO: 161334 - DNA, 601 bp, Human
taattcctatatatcctaccatgaagcttataataccttgcacttacacagaagatttaaaatatttctgcttgttgaagcagataaaaagagatttctcaaattcctaatgaataataaggccccacacttggctcatgaggaaacgcaaggtactatatgttctttcactgagtctcacaggggctcatcacatgcccacactaggcacagaggcaaaatgttgtattctaagttatcagaatgcacgccgctgctcattatctaaccctcaggaaaacgcctgagacagaccgccaattcatgagattcaactgaaaaaggagtgaaaaacaagaagtccatcatgtgacattggaggccatggcattttcagtggaggaaggagttgaagggttgaagagaaaagctcaatttgcagcctcaccactcgtggaaccatcctacacaggtgttgagatagcgccaaacagtagcagctggatgcagattttccctgttataatagcttagagaatgcataggctgaaaataccaggctattccctctctttagggagacccagtaggaaggtgtggatgtatggataaatactgaatg

SEQ ID NO: 161335 - DNA, 601 bp, Human
gtggctgtcccaaagatatatgaaaaaaatactttgctaggatgccccaaaaccttttgtctctgccaacataaattctgaaactgaaattcaaaacacaatttgtttaccactattacagaatgtgcttataaggctgagatgtttattttaatacctttggcatttaacctttaacctcttatttactttgtaaatatttcagcatggtgagaaaaagaaaaaaaaagtttttaaaaactcaccattaagaaacattttaatcacagattggtaaaaacacaagttgctgcattttcamaaaaaaaaaaaaaaaaaaaagagatgactcaaacttggaaaaccatgactgtacataattcctatatatcctaccatgaagcttataataccttgcacttacacagaagatttaaaatatttctgcttgttgaagcagataaaaagagatttctcaaattcctaatgaataataaggccccacacttggctcatgaggaaacgcaaggtactatatgttctttcactgagtctcacaggggctcatcacatgcccacactaggcacagaggcaaaatgttgtattctaagttatcagaat

SEQ ID NO: 161336 - DNA, 601 bp, Human
tgtggctgtcccaaagatatatgaaaaaaatactttgctaggatgccccaaaaccttttgtctctgccaacataaattctgaaactgaaattcaaaacacaatttgtttaccactattacagaatgtgcttataaggctgagatgtttattttaatacctttggcatttaacctttaacctcttatttactttgtaaatatttcagcatggtgagaaaaagaaaaaaaaagtttttaaaaactcaccattaagaaacattttaatcacagattggtaaaaacacaagttgctgcattttcacaaaaaaaaaaaaaaaaaaaagagatgactcaaacttggaaaaccatgactgtacataattcctatatatcctaccatgaagcttataataccttgcacttacacagaagatttaaaatatttctgcttgttgaagcagataaaaagagatttctcaaattcctaatgaataataaggccccacacttggctcatgaggaaacgcaaggtactatatgttctttcactgagtctcacaggggctcatcacatgcccacactaggcacagaggcaaaatgttgtattctaagttatcagaa

SEQ ID NO: 161337 - DNA, 601 bp, Human
gtagctgcgattacaggcatgcaccaccacacctggctacttttgtatttttagtagagacggggtttcaccaggttggccaagctggtctcaaactcctgacctcaggtgatctgcccacctcggccccccaaagtgctgggattacaggcgtgaaccacagggcccagccctgtctctttcttttttttttctctctctttctctctctctctctcactctcacccaggctgcagtgccacagttacagctcactgcatacttgaactcctcagttcaagaaatcctcccacctcagcytcccaagtagctgggactatagtgcatgacaccacacgtggctaatttttaaaattttttttggtaaaggcctgaacgaccacacccggcaaaaaaataggttttattacatagctcataaatgaccattcaaaagtgctttgaacaatggcaatgacgtcattctcatggtggtaactcagaagggcgggccaacttcattcacatgtacagtttgagttctatgggttgtcaaagttcatgtcactatgttagggctggcttttacagttgtacttctcttaagtgtggctgtcccaa

SEQ ID NO: 161338 - DNA, 601 bp, Human
gtgtgtacctataatcccagctactcaggaggttgaggcaggagaatcgcttgaaactgggaggcagaaggaggttacagtgagccgagattatgccactgcactccagcctgggcgacagagtgagactccatctcaagaaaaacaaacaaacaaagaaacaatgcatttgaacagactgaaaggaaacccagagacaaaaataattactgtgttagggtgtgggggtactttgggtgaattattctaaatttctttttctttttttttttcttttttgagatgtgccccaggctgtagkgcaatggtgtgatctcggctcactgcaacctcggcctcccaggttcaagcagttctcctgcctcagcctcccaagtagctgagattacaggtgcctgccaccacactcggctaattttttatttttagtagagacagggtttcaccatgttggccaggctggtctcggacttctgacctcaggtgatccctccacctcagccttccaaagtgctgggattacgggcgttagccaccgcgcccggctgaattcttctaaatttcttataatgaagttagtacagtaaccttccacctacaa

SEQ ID NO: 161339 - DNA, 601 bp, Human
cacttttcagatgggtgaccttaaacacggtacctaactcattttcctcatctgtaaaccaaggaaaatactaatatgtactttaaagtagatacaaatgctggatgatatagaagtggtttcttagtaatcactagttccaatagcagattctcttctattcaacagtgtgttaaactgttaaattcacggaagcatacccagcccccctcaaaggctctaaggtctgcagaaggaattaccaagaaagcaaagcacagaactccctcagaaactggaggagccattgaaaactctttaycaccatgtaatcctgtacaatcacaagcacttccgaaaacagcattatcctgtatttgtctgagtgatttataacgttaagatcgaccacatgatttcctagctctaaatttcccaaactccggtttgcagggaaaggaagcatttcttttctaaggaagtcagcacacctagatctagccaacagcagttgatttttaagtttcttcaaccttcacatttccctttctcaaaagttggatcccacctgcattaaaaactactgtcctagcacattacaaagttattcaatctaaaatgt

SEQ ID NO: 161340 - DNA, 601 bp, Human
ctgttcccagtaggaactgagagtttttgaggaagagtgacagatgcaaagccgtgttactagaagatgattgcgctgatgctatttctgtgaattaccgggggataagagtgaagaccacttaagaaacgcttataatgttcccagtgtaagacaatgcacatccaaactagggtggccactgtgaaaaggaagggggagtcctgtgaagatatactcacaggacgttggaaatggcaggagcaaggcagggatgggaacaacagacaaagacactactgtctccagcatagatgcctgkgggaattctaaaaggaaaaccaggtaggagtaaaaggtaaggtgcagttctccagcgccaggactggagtgttctgaaggctgggctcttttcaatgcccttctctattttcatgctattgatcgtccccattctggatctctttcttcctctctggcctgacaaaatctgttctcaccctctttaggagaaggtttgatagactagttcagagggatcagtaatgggagaaagtatagcatggacagcagccgtggaagaggcaccccgggttgataggttttccaagcatgctgtcgg

SEQ ID NO: 161341 - DNA, 601 bp, Human
ctggaaaatagagttggataaatgcaaccagtaattggtttaatttagaccgtaatgcattttggtctttagactgttcccagtaggaactgagagtttttgaggaagagtgacagatgcaaagccgtgttactagaagatgattgcgctgatgctatttctgtgaattaccgggggataagagtgaagaccacttaagaaacgcttataatgttcccagtgtaagacaatgcacatccaaactagggtggccactgtgaaaaggaagggggagtcctgtgaagatatactcacaggacgttggaaatggcaggagcaaggcagggatgggaacaacagacaaagacactactgtctccagcatagatgcctgggggaattctaaaaggaaaaccaggtaggagtaaaaggtaaggtgcagttctccagcgccaggactggagtgttctgaaggctgggctcttttcaatgcccttctctattttcatgctattgatcgtccccattctggatctctttcttcctctctggcctgacaaaatctgttctcaccctctttaggagaaggtttgatagactagttcagagggatcagtaatgg

SEQ ID NO: 161342 - DNA, 601 bp, Human
agctggagggcaatggcacgatcacagttcactgcaacctccggctcccaggttcaagtgattctcctgcctcagcctctcgagcagctgggattacaggcatgcgccaccatgcccggccaattttgtatttttagtagagatggggtttcaccatgttggtcaggctggtttcaaactcctgacctcaggtgatccgcccacctaggcctcccaaagtgctgggattataggcgtgagccaccgcacgcagccgagttcaatatcttaatgagacacaaaagcttaaagggtctaacamaaggcagaacatgatgcatgaggtaagaacatttcaaactaggtgccatggacatatggaagaggaaggtgactatctgggaaggcttgggggtccaggggagggaattttgttgagcctagatctagaaactgatctaagacttggacatgatggaaggacacccaggcaaggggaaaaaaggggatcatttgaaaccttattaatagtaattattaattagtaattatttcattttcctcccataacttcccatataaacatcttaggtatatatgcatatgcctcctatattttttc

SEQ ID NO: 161343 - DNA, 601 bp, Human
ttacatggtgtgttgcagcatggcaaaaatacatcctgatcagtttgcatttggtgttgcatcaaattatggcatagcccacaatgcttaaacatccatcaacagtggctctcaacctaggctgcttttaggaaccatccaggaagctttgaaaagtaatacagttgtgtctgaatccttttggtctaggatggtgcccaagggttgtcatttttaaaaagcactacgggtgaattttagctggataaagaccattggctatatgtcagaaacaacttctgctccttggagttcaatatcattttttttttttttgagatggagtctcactctgttgcccaagctggagggcaatggcacgatcacagttcactgcaacctccggctcccaggttcaagtgattctcctgcctcagcctctcgagcagctgggattacaggcatgcgccaccatgcccggccaattttgtatttttagtagagatggggtttcaccatgttggtcaggctggtttcaaactcctgacctcaggtgatccgcccacctaggcctcccaaagtgctgggattataggcgtgagccaccgcacgcagccgagtt

SEQ ID NO: 161344 - DNA, 601 bp, Human
atgaatggaggcccctgaaagaagggctgatggggaaggacaccatgtctgtgggtataaggcatcagttacaaagacgttcaccttctcaaagtgctctagagcacgggttcccaaccccggggccatggacccgtgctggcagtggcctgtcaggaaccgggctgcacagcagcaggtgagtggctggtgagcaagcattaccgcctgagctccgcctcctgtaagatcaaagcagcactagattcccatagaagcacaaagcccattgtgaaccgaatatacgcaggatccaggctgygcgcttctaatgagaatctaataccgattatctgaggtggaacagttttctcccaaaaccatccccactccacaccccaggctgcagaaaagctgtcttccacgaaaccggtccctggtgccaaaaaggttggggactgctgctctagagggttcatgctactccaaccaaagttccaaagagattttcttatggaactttgacacattgattctaaattttatctggaagagtaaatgagtataaattgccaagaactcacttaaaaaggaatttaattagtaaagtcttgccaaaaat

SEQ ID NO: 161345 - DNA, 601 bp, Human
ttccgaatgcatgtgagtgaatatcactttatagtttgcaaaacactttttatataattggttcttagaattacttgattcctggaatcaacattttttccttctgagattgtaagcaaaggtctggctcccacttctgaatccctcattcagctaggcagaattaacacatctttccccttcttccacttgtgctttcttgacctcaggatgacgaggtgcatcactgaacatccagcccccgaccagggacctattcagaagcacgaactgcaggctgtgtcccaccatggatcacatycagcccagactcagctccttctgcaaccctgccaaagagcctacgaatgacggccccatagcccaggccactctattaatgaagaagagtgcactgggacacttgaggagaacctgttttgtctcatgtttttgaagcaagagtaaaaaatggaatgcctcaaaatgctacaatccctctatattcaggtgagggagattcttgtaattctgtgggttatgacatgatatccattaaattataagaactatggataaaattattaatattttcaaaagacaatgttttaggaaatatccc

SEQ ID NO: 161346 - DNA, 601 bp, Human
tacttgagttggttttctatgacgtcactcactgtgtttttaccatgtgtagtatcaaataacagtagcatcaaatgacatgtttacaattgcctttgcaaataactgccgtttctaagttcattactcctcttactattttttatttctaatttgcttggacatttaatgtccaaagtaaaactaactttataatatttggtttttattcaggaataaaatcaggaaggatttaagaaaaatcttcagccaggcatggtggctcatgcctgtaatcccagcactttgggaggctgaggcrggaggatcacgaggtcagcagttcaagaccagcctggccaacatggtgaaaccccatctctactaaaaatacaaaaatcagctgggcgtggtggcacacacctgtaatcccagctactcgggaggctgaggtagaaaagcttgaacaggggaggcagaggttgcagtgagctgagatcccgccacagcactccagcctgggacagagcgagactccatctcaaaaaaaaaaaaaaaaaagaaaaaaaagaaaaaaagaaaaatcttcaaagaacataaaattcattttaatttttaattt

SEQ ID NO: 161347 - DNA, 601 bp, Human
gtgaaactacctacaaaggtctatcaacatctaaaaatagacatttaaacaatgaagagtgcaccctataaataaaacatcaggctgggcgctgtggctcatgcctgtaatcccagcatttttggaggccgaggcaggtggatcacctgaggccaggagttcaaaaccagcctggccaacatggcgagacctcatctctattaaaaatacaaaaattagccaggcgtggtggcacatgcctgtaatccctgctactggggaggctgaggcatgagaattgcttgaacctgggatacagagkttgcagtgagccaagattgtgccactgcactccagcctgggtggcagagcaagactctgtctcaaaaaaagaaaatgtcaatgacacattttattcaacttgaagtagtaataatgggtactaaactcttccattttatcaaacctcaatagacagaaacctttcagagccttcctctccactggttctaatggatggtgtggaatgatacacagtgcttggatacagattttatgtgtaacaagagatgttttcctgttcctggttttctaaccaaatatttgactgaccttctggttt

SEQ ID NO: 161348 - DNA, 601 bp, Human
ggtttgctgagaatgacggtttccagcttcatccatgtccctgcaaaggacatgaactcatccttttttatggctgcatagtattccacagtatatatgtgccacgttttctttatcctgtctatcattgatggacatttgggttgacaactcctagttttaaaaaaaaatctatgcttatataatacctccttgcagttactgaattgtacagttattgaattgtttatcttttacaaagcacttctactttatttcatttgattcttatggaggtgttttattattatgaatatttccrttttacagatgtaaaaatggagggaactgattaagatgacaagagccaggattcaaaccagggctccacactctaaatttctattgaataatttttaagtttcctaagtttactacaggtatgaaaacaaaacataaggcaggcaattatgatgaaacctgctctgctcaggaatggagttgtgttatccatatctacaactgctgagcttgattgtgatttttctaaacatgaacattcatcagatataattcgtataatataaagcacatggttttattctgttctacaatttcgcat

SEQ ID NO: 161349 - DNA, 601 bp, Human
tactttaagttctgggatacatttgcagaacgtgcgggtttgttacataggtatacacgtgccatgatggtttgctgcatccatcaacccatcatctacatcagataattctcctacccctcccctagccccccaccccctgacaggccccagtgtgtgatgttcccctccctggtccacgtgttctcattgttcagctcccacttgtcagtgagaacatgcggtgtttggttttctgctcctaggctggtttgctgagaatgacggtttccagcttcatccatgtccctgcaaaggacakgaactcatccttttttatggctgcatagtattccacagtatatatgtgccacgttttctttatcctgtctatcattgatggacatttgggttgacaactcctagttttaaaaaaaaatctatgcttatataatacctccttgcagttactgaattgtacagttattgaattgtttatcttttacaaagcacttctactttatttcatttgattcttatggaggtgttttattattatgaatatttccgttttacagatgtaaaaatggagggaactgattaagatgacaagagccaggat

SEQ ID NO: 161350 - DNA, 601 bp, Human
ggagttttgccatgttggccaggctaatctcaaacttctgggctcaagcgatcctcctgtctcggcctcccaaactgctaggctataggtgagagcgaggtatctacttttgaatctagtccatctactcaccaacctcccacacccattgtgaaattactactactacccacaaccctaccacacaacactggacctatttcccattggtgagtgggtatccttcctctgagcaaatggacttcctacttctttctagatccattctcttcctgcctggctttcagcttctagtttttcwtgcttttttctccctttattcctatgtttatagttgaaagctaaaccacaagagtgagttcagtaaatattttttgagcttccactatgcatctaagtaaacacttcagaaccagcatatatcctcataggaaagagctacttcttcctctgaaaccccctggaaatatgcccaggtaatagggaagcacatgaaaggtaagcgacttcctgactgaatagaccaattgcactcagttttgtggcagtggatataaaagaaatatgaagaacctctcgtcagtggggcacaatgactcac

SEQ ID NO: 161351 - DNA, 601 bp, Human
caagtgatcctccaccacagcaacccccggagtagctgggattacaggcactccaccaccgcgcctgggtaatttttgtattttttgtagagatggagttttgccatgttggccaggctaatctcaaacttctgggctcaagcgatcctcctgtctcggcctcccaaactgctaggctataggtgagagcgaggtatctacttttgaatctagtccatctactcaccaacctcccacacccattgtgaaattactactactacccacaaccctaccacacaacactggacctatttcccaytggtgagtgggtatccttcctctgagcaaatggacttcctacttctttctagatccattctcttcctgcctggctttcagcttctagtttttcatgcttttttctccctttattcctatgtttatagttgaaagctaaaccacaagagtgagttcagtaaatattttttgagcttccactatgcatctaagtaaacacttcagaaccagcatatatcctcataggaaagagctacttcttcctctgaaaccccctggaaatatgcccaggtaatagggaagcacatgaaaggtaagcgac

SEQ ID NO: 161352 - DNA, 601 bp, Human
aaaaccttgaaagatgtgacagcagccttgctcagtccacaggtggactcactatattatggacacagtaagtgacagggcttttaaatcacaagcaccttccttttccaacccccatctacaactggggaaacatctttgaactaagggaagagcactgatatgagaaatcagaggtcagcaacatatcagaaaagaaacaactgagaaccaagaaactgccccatatttcagatgagatgggagaggtagaacaatatatacaaacggcaagaaaaagatcagatagactctcctctcstagagatcgcaatcaacttgattatcaacaccagccccaaattgttttttattacaaaggtatgtagacacagcactctaccactccaaaaatactaagatggaaagaaatgaatcccaaattttcaacaacttatatcccttccaccatctaaatttcattaggttaacaggtcagtagcacatctttaaaaagtataaataactctgttaaagtaatacctgtcagtcattttcaccttgatgaaaattattaatgtttcaatcaaattttcttttctgtttatatgtagctagttct

SEQ ID NO: 161353 - DNA, 601 bp, Human
gaactggaacctaggtggggcttttcgggtggggttgcagtagggaaagagaactgaagaggtaatgataccatctccctttatgggtaaggcgttttctcacttgactcttccacagagtgcacacctccatgcaggagtctcccatgtaatcctccaccttgtgtggacccaagactttgctttctattcccatggacccaccagtgcagccgtggctcaccgctgggcactgctagccttgatgcctgcttacatctccatatacctgctttttaaaaggcactttgtacatttttctttttttttttttatttcagagatggggtctcactctatcacccaggctggagtgcagtgccagcctcgacctcccaggctcaagcaatcctctcacttcagcctcctgagtagctgggaccacaagtgtgcatcaccacatctggctatttttattattattattatttatagacatggggtctccctatgtttcccaggcttgtctcaaactcctggccttaagcaattctccttcctctgcctccaaaagtattgggattgcaggtatgagccagcacgcccagccatttatttactt

SEQ ID NO: 161354 - DNA, 601 bp, Human
taattaaagatgatgtattcctacataaattcttccctttgtcaatatggtaaaaaggacattggaaacacaactcgaaagcgacctgttcagagtctacctcttatgggctgagtgaccaagacctgccccctgcccccgactctactgtatgtaaaaaggttttataaaacagcaagtcagggaaccactcagggaacagtggggagaatgtaggacaatcctgagcaccaggcttcaggcaatcaggcacctgcacccagaggaactggaacctaggtggggcttttcgggtggggtygcagtagggaaagagaactgaagaggtaatgataccatctccctttatgggtaaggcgttttctcacttgactcttccacagagtgcacacctccatgcaggagtctcccatgtaatcctccaccttgtgtggacccaagactttgctttctattcccatggacccaccagtgcagccgtggctcaccgctgggcactgctagccttgatgcctgcttacatctccatatacctgctttttaaaaggcactttgtacatttttctttttttttttttatttcagagatggggtctcactc

SEQ ID NO: 161355 - DNA, 601 bp, Human
gagcatgcctataatcccagctactcaggaggctgaggcacgggaattgcttgaacctgggaggtggaggctgcagtgagccgagactgcgccactgcactccagcctggcgacagagcaagactccatctcaaaaaaaggattatttgggtggtcagtctgaacccatttttcaatttaaaatcacaagatgtttttcaatgtcgtatcgacacgtgataactgttgattttttaattattattttgagcctaaatgtctcctaaccaagagatttacattttcatgattttaccattcyatttttgtctatgaaccttgcttttgtgttaaaatatgtactgctacttgcataatttatagctatgctttaattaaagatgatgtattcctacataaattcttccctttgtcaatatggtaaaaaggacattggaaacacaactcgaaagcgacctgttcagagtctacctcttatgggctgagtgaccaagacctgccccctgcccccgactctactgtatgtaaaaaggttttataaaacagcaagtcagggaaccactcagggaacagtggggagaatgtaggacaatcctgagca

SEQ ID NO: 161356 - DNA, 601 bp, Human
gaggcatcaagaatcttcccaaagcacaaaaagcaacagctacgacatttaaagtaatgggaataggaagagggaagtcaccacacattcttcatgatcctgaattctttaaacaccaaaactctcattaaactcaaaggttcagttcctcttccatttgagtacatttgtattatcagatgcttaaaggaaaaacaaaacagaaaaaaaaaaaacccagacagctatgtatttccctgaagacacaaataattcacacttctctggaaaagcgcacagtagaattgggtgggacgggcayggtggctcacgcccgtaattccagcactttgggaggccgaggcaggcagaagacgaggtcaggagatcgagaccatcctggccaacatggtgaaaccccatctgtactaaaatacaaaaaaaaaaattagccaggtgtggtggagcatgcctataatcccagctactcaggaggctgaggcacgggaattgcttgaacctgggaggtggaggctgcagtgagccgagactgcgccactgcactccagcctggcgacagagcaagactccatctcaaaaaaaggattatttgggtggtcag

SEQ ID NO: 161357 - DNA, 601 bp, Human
ggctgtccagtgaatcagaatgtggaggcatcaagaatcttcccaaagcacaaaaagcaacagctacgacatttaaagtaatgggaataggaagagggaagtcaccacacattcttcatgatcctgaattctttaaacaccaaaactctcattaaactcaaaggttcagttcctcttccatttgagtacatttgtattatcagatgcttaaaggaaaaacaaaacagaaaaaaaaaaaacccagacagctatgtatttccctgaagacacaaataattcacacttctctggaaaagcgcayagtagaattgggtgggacgggcatggtggctcacgcccgtaattccagcactttgggaggccgaggcaggcagaagacgaggtcaggagatcgagaccatcctggccaacatggtgaaaccccatctgtactaaaatacaaaaaaaaaaattagccaggtgtggtggagcatgcctataatcccagctactcaggaggctgaggcacgggaattgcttgaacctgggaggtggaggctgcagtgagccgagactgcgccactgcactccagcctggcgacagagcaagactccatctcaa

SEQ ID NO: 161358 - DNA, 601 bp, Human
ttccatgaaggaatactaagatttttaaaaattaatttagcatttcttcattatctttttaaaattaaattagttaagattaaaccattaattcctccatccactggcccaggctgggggaatactgctgtgcttggtgagcacaggagcaggtgtccatttccatggcatctgtagtgctcaatgtcagcccacgcaagtccttgagctctcaatatctgtttttcagtgtctgacctgtcaaatgcgggacatggattgactcccacagacccttccagctctaacccccatggcctayaatcagggctgtccagtgaatcagaatgtggaggcatcaagaatcttcccaaagcacaaaaagcaacagctacgacatttaaagtaatgggaataggaagagggaagtcaccacacattcttcatgatcctgaattctttaaacaccaaaactctcattaaactcaaaggttcagttcctcttccatttgagtacatttgtattatcagatgcttaaaggaaaaacaaaacagaaaaaaaaaaaacccagacagctatgtatttccctgaagacacaaataattcacacttctctggaaa

SEQ ID NO: 161359 - DNA, 601 bp, Human
tcctttttagttaggggataaaagatctccaaatgacataaccagggatttcgtggaagtgatcacagcttgactaaaggacttaaattcgtgcacaatgagtcccagtcagtaggctgtgacatcagctgaccagcacctaactgcaccacaggttgagattatttatttatttcaactccagattttatggagtttgatagtgcaatccaataacacatcttttaaacaataaacactaaaatgtatacatgtccaatcattttgttagcttttttccatgaaggaatactaagatttktaaaaattaatttagcatttcttcattatctttttaaaattaaattagttaagattaaaccattaattcctccatccactggcccaggctgggggaatactgctgtgcttggtgagcacaggagcaggtgtccatttccatggcatctgtagtgctcaatgtcagcccacgcaagtccttgagctctcaatatctgtttttcagtgtctgacctgtcaaatgcgggacatggattgactcccacagacccttccagctctaacccccatggcctataatcagggctgtccagtgaatcag

SEQ ID NO: 161360 - DNA, 601 bp, Human
cccgtcaccatgcccagctaattgttgtatttttagtagagagagggtttcaccatgttggccaggatggtctccatctcttgaactcgttgatccacctaccttggcctcccaaagtgctgtgattacaggtgtgagccacagtgcccggccaattgtcctttttagttaggggataaaagatctccaaatgacataaccagggatttcgtggaagtgatcacagcttgactaaaggacttaaattcgtgcacaatgagtcccagtcagtaggctgtgacatcagctgaccagcacctawctgcaccacaggttgagattatttatttatttcaactccagattttatggagtttgatagtgcaatccaataacacatcttttaaacaataaacactaaaatgtatacatgtccaatcattttgttagcttttttccatgaaggaatactaagatttttaaaaattaatttagcatttcttcattatctttttaaaattaaattagttaagattaaaccattaattcctccatccactggcccaggctgggggaatactgctgtgcttggtgagcacaggagcaggtgtccatttccatg

SEQ ID NO: 161361 - DNA, 601 bp, Human
ggggacctgaggagtaaaattgagccttatgtcctaaagacattaaaagactcctaaaggccttgcttctatcagggagtaattaagacacaaagaaaaatccagatagtctcaactacaagtacatttcccatttacaaaacttcaagtaatagctggatttgtttttacttttagcactctaaggctttttagaaaaaaaaaaaaaaaagccttttgactgaagaactatcttcccttcagtagggtttaacaatttaaatgaattcaatttccttttcttttttttttttatttctgrgacagaatctcgctctatcgccaggctggagtgcagtggcacaatctcagctcactgcaacctccacctcctgggttcaagcgattctcctgcctcagcccttccgaggagctgtgactacaggcgcccgtcaccatgcccagctaattgttgtatttttagtagagagagggtttcaccatgttggccaggatggtctccatctcttgaactcgttgatccacctaccttggcctcccaaagtgctgtgattacaggtgtgagccacagtgcccggccaattgtcctttttagttaggg

SEQ ID NO: 161362 - DNA, 601 bp, Human
ttgattctaaaaagcacattgggaaaaagaaaaaggtacatgggttttgagtttgtttgttttttttccatttaacatatcttaaaccagaatatgtcttacaacagaagacatgtcttaatttagttagcaatatttttcttttttaaaggtatataagaaatggtgctttctggccgggcacggtggcttacgcctacaattccagcactttgggaggacgaggtgggcggatcacgaggtcaggagatcaagaccatcctggctaacacggtgaaactccgtctctactaaaaatacaaaaaaaaaaaaaaatagcctggtatggtggtgggcacctgtagtcccagctactcaggaggctgaggcaggagaatggtgtgaacccaggaggcagagcttgcagtgagccgagatcgcaccactgcactccagcctgggcgacagagcaagaccccatcacaaaaaaaaaaaaaaaaaaaaaaggtgccttttgaaatatcaatggcaaccaaaaatggaaataagattgacagaaaagaaacatctgttcctaaaaccaaactaaaccaatggttttgatgaaatatggtaatttctg

SEQ ID NO: 161363 - DNA, 601 bp, Human
atacaatctcacaccagtcagaatggttattagaaagtcaaaaaacaacagatggtggtaaggctgaggagaaaagagaacaattacacactgtaggtgggagtgtaagttagttcagtcactgtggaaagcagctgggagatttctcaaagaacctaaaacagaactatcattcaactcagcaatcccattactgggtatacatcgaaaagaaaataaattgttctaccaaaacgacacatgtacttgtatgtttaccacagcactattcacaatagcaaagacatggaatcaacctagrtgcccatcaacagtgaattggataaaggaaatgtggtacatatataccatggagtactatgcagccataaagaagagcgaaatcatgtcctttgaagcaacatggatgaaactgggggctattatcataagcaaattaatgcaggaacagaaattcaaataccctatgttctcacttaaaagtgggagctaaacattgggtactcatggacataaagatggcaccaatagacatggggactactagaggcaggagagagggaggtgggtaagaactgaaaaactagttataccccatatc

SEQ ID NO: 161364 - DNA, 601 bp, Human
tatcagcatacagaaatcagtagcatttctatacaccaatgacattcaagttgtgagccaaatcaagaatgcaatcccattgacaatagcaaaaaaactaaaatacttaggaatacatctaaccaaggaggtgaaagacaactataagaactacaaaacactgttgaaagaaatcacagatgacacaaacgaatggaaaaaacattccatgctcatccattggaagaatcaatatcgttaaaatggccatactgcccaaagcaatctacagattctatgctatttctatcaaacaaccaaygtcatttttcacataactaaaaaaaactattccaaaattcctatgaaaccaaaaaagggcccaaatacaaaagcaatcctaagcaaaaaagaataaagccagagacatcacattaactgactttaaactatagtataagggtacaataaccaaaacagcatggtactagtacaaaaatagacacattgaccaatattctgttctctgttctgttcaacagagaacccagaaataaagctgtacacctataaccatctgatcttcaacaaagttgacaaaaataagcaatgtggaaagaac

SEQ ID NO: 161365 - DNA, 601 bp, Human
atcactctagaagaggcagacatggaggtcccatcttcctagtgctggaactaagtctcgaaatgcttcaatgtcttgcccatacactcctgtatgcaatagaattgagcccaacggagactaccatgaaagcccctgcttttcccaccacactgtcctggaaatgctagacacaacaaactaggtagtggtttttataattgtcaaagcaagtggtcatgagaactggaggactaaaggatggtagacttgataactgatcagacatgaaaatcatacaagagattaaaaccaaaaaacraaaaagatttcaaaattattagtctagaagacttgcattgccagtcatagacatttggaagttacaaaagaggaagatgtttttgttttactgcagtttgggggtagagagtagtagaagcctaccagaatgttgactaaaaatactaacatttattgagtacttactgtttgccaggcagtgtactaaggacttcacgtgcaccaattaatttaatcctcacaaaactctttgagacagatgttgttattatccccattttaaagatgaggaaaatgagaaagtcactcaagattacac

SEQ ID NO: 161366 - DNA, 601 bp, Human
atagcttcctccctaggcagagaaaaaagttcacctgatgtttgtatatgccaaaaggggcatgtacattccaatctttatccgtctatctatcatccatccatctactcgataaatattgaatgccaattaatggtccagatactttgctataagttggcagatagagatgaacaaggcacacacattacctgccctcatagagcttacagtccaataaggcaaacacagaagtaaacaagcaatgctaacagtctgataagagctgtgtatgctaagacatacccttttctccctcctccctaaagaaacctggaacaaggtgccaaaagctggtaactaagtagaatttaatctggcatgagtcatgataacatgtaggatgcttagggtaaactctaaactcacaatcactaagggcaacgcaacagagaaagtgatttgggaagacagcagcaacaagagacctccataaagaaggctcttgtggtagcatatgcaagatgaccactcaggccaaacctaggatgactatacaaactgttatcagaggggcagtgctgatagtttcagtttcaggactgccccatattagtgtgaa

SEQ ID NO: 161367 - DNA, 601 bp, Human
gcgggggagagtattaggaaaaatagctaatgcatgctgggcttaatacctaggtgatgggttgataggtgaagcaaaccactatggcacacgtttacctatgtaacaaacctgtacatcttgcacatgtaccctagaactaaaaattaaaaaaaaaaaaaaaaagtctagttctgatctgccaagaaataacactgggtaagttacttaacctctctgtgcctcagtttcctcatttgtaaaacagacatgatacttatatcacttcatcagactgtgaggaagattgaatgagctcttktatgtgcaatgattagttaaaatgatcacattaacctcttccttgaattctttgcctttggaaataatgccccaatgctgctgctgttgctgttaataaaaatattaaaataagcacacttagattaagattggtgtttatatttgtctgaggcttagcataaaaacttgcaaaggtggaattagagcactaacttgaactttctcagtgacaaataagctgcgatccatcagcttactcagacacgtttttgtaacattttgtagacactgaggaatacttttgcactgaggcacccgt

SEQ ID NO: 161368 - DNA, 601 bp, Human
aataaatacatctccaggcctcatggagcctgggggccaccagcttacagcttctgatggggagaggagacccaaagtctcctttacttgagctttttgaagctatctggcttctccccttccttggatgttgtgaggcaacagaccatgatttttttaagtaagttctctgtgttgcctaaacaatagcttccattacatgtgcccccaaaagccttaactagtacacaactcctacctgtttctctcccactcacttctttggctacatgttttgacctgattgccatccccatccacrtaaaacattttaatctcagaactggaaggggtcttacgaaaggtctactagttagggtgggcgggggagagtattaggaaaaatagctaatgcatgctgggcttaatacctaggtgatgggttgataggtgaagcaaaccactatggcacacgtttacctatgtaacaaacctgtacatcttgcacatgtaccctagaactaaaaattaaaaaaaaaaaaaaaaagtctagttctgatctgccaagaaataacactgggtaagttacttaacctctctgtgcctcagtttcctcatttgt

SEQ ID NO: 161369 - DNA, 601 bp, Human
atcctcctgtgcacaggacaaacctccacaacaaataactctctggcctaaaatgtcagtagtgtcaatgttgtaaaaccctggcttaggtgactgctggaggtagaggggctgaggaggaggcagcttccatctagctccagccaattgttaccacaggcggggtggcagggggaatgaggcctcaaggttgcctggtctgatttttctagagaagctggaaatctggatttccatgagtaaccttttgatttttaagcaccagctcaatttttaataaacgtatgggccaaataaatayatctccaggcctcatggagcctgggggccaccagcttacagcttctgatggggagaggagacccaaagtctcctttacttgagctttttgaagctatctggcttctccccttccttggatgttgtgaggcaacagaccatgatttttttaagtaagttctctgtgttgcctaaacaatagcttccattacatgtgcccccaaaagccttaactagtacacaactcctacctgtttctctcccactcacttctttggctacatgttttgacctgattgccatccccatccacataaaacat

SEQ ID NO: 161370 - DNA, 601 bp, Human
tgcaggaggtagcagccatgatggttaatgccaccctgccacctggtcacaggagaaggcctctgacccaagccagaccaagtgatctcactcccagaaatggtataatggaaagatttagggactgagtggtcagtggcttaggctcattatacaacccagtgattttcactccggggcagctctgctccccagaggacatttggcagaatatggattcattcttggtggtcagactgaggagggggtactactggtatctagtgagtggataccagggatgtagctaaacatcctcctrtgcacaggacaaacctccacaacaaataactctctggcctaaaatgtcagtagtgtcaatgttgtaaaaccctggcttaggtgactgctggaggtagaggggctgaggaggaggcagcttccatctagctccagccaattgttaccacaggcggggtggcagggggaatgaggcctcaaggttgcctggtctgatttttctagagaagctggaaatctggatttccatgagtaaccttttgatttttaagcaccagctcaatttttaataaacgtatgggccaaataaatacatctccag

SEQ ID NO: 161371 - DNA, 601 bp, Human
caagtgactgcatcattcatgctttcaggcctgggctgagtctgatgatggccggtgttgcttttcttcctcaatctccctggactagacagggcagagtatgttacagaggactgtcattttaggggtagccagaggggcagaggtgggctccagaatcctttctctacctcgctatgtgcacttaggcagccacttaaaccattctgtgcaccctagtttccccatcccctgaatatgaatgacaactctgtgccttaactatttcacacaatgctggagagaataaacttgagaaaayagattcaaagaacttctgggaagtgaagattgttatactattgatagttattcctggactctcttgttttcacacagtgtcttttgcatccctccttcccacatactgtgagggatacctattgagttgcctgccctgattccctctctgcaggaggtagcagccatgatggttaatgccaccctgccacctggtcacaggagaaggcctctgacccaagccagaccaagtgatctcactcccagaaatggtataatggaaagatttagggactgagtggtcagtggcttaggctcatta

SEQ ID NO: 161372 - DNA, 601 bp, Human
ataatgggagtacagatgcaactaccccacccccgccccacctccaacactccatcatctttcagtgatcattctgtggcatgttctcctatctcctatgctcacatcctagagatgagggtacatgctcttttatttcaagctcttgtttctgagaacctccagcaattcccaacttccaccattcctgccaaatgaaggctggatttattttgatttgtgttggctctgtagccccttgttaagtaaactaggactctgtgtctggccaatgcattcacgaagagaaaaatagaaggartcaaagtgaattatagggagagagggagggggaagttccctggaagtctaaaagtaggaaccaaggatggtatttttggcttgggactttctgtaccacatgaaattatgagaatgacttaattgctcctgtgcattcgaaacctgagagagaccataatggctgggttacgcccagactgactggaacaggagttagacagcgtggcctcctgccagctaaacctgctctgcaaacacaagtgactgcatcattcatgctttcaggcctgggctgagtctgatgatggccggtgttgct

SEQ ID NO: 161373 - DNA, 601 bp, Human
gcatcatagctccctgcagcttcaaactcctgggctcaagcgatcctcctgcctcagcctcccaaagtgctgggattaggcgagaacaccatccttgatcatgctagttcacaaaatggggcccccaaaccagcagcatcagcaacaccaggaaacttgttagaaatacaaagtcttggctgggcgcagtggctcatgccttgtaatcccagcactttgggaagccgaggcaggtagatcatgaggtctggagatcgagaccatctggctaacacaatgaaaccccgactctactaaaaaaaataataataataataataatacaaaaaattagccgggcatggtggcatgccacctgtagtcacagctaatcaggaagctgaggcaggagagtcgcttgaacccgggaggcggagatcacgccattgcactgcaacatcttgggccccaccctaaacctgctaaatgagatgctctgggcatgggggtggggcccagcaatctgtgctttaacaagtcctcccgtagattctggtgctggctaaggcttttgagaaccactgctttagtgagaagacttataaataagtttgtaattatc

SEQ ID NO: 161374 - DNA, 601 bp, Human
catcaatctgagcatactacaaggcaacaaaagaaattttagggtttcatttttacaactgaaagagttcagagaagagaaaagatcgtgtgcactagtcaggaaaggttccgtggaggaacaggaacttgggccgagcctggaggaagcagaggactcagccactgggacgagggggactttccagggacaacacaaatgaagaaacagaagcataaaggagcagctgtcactactgctgtgaaaaaccttgcgtttagagcaccattctttgttttttaagagacagaatcttgctccrtcaccctggctgttacaatggcatcatagctccctgcagcttcaaactcctgggctcaagcgatcctcctgcctcagcctcccaaagtgctgggattaggcgagaacaccatccttgatcatgctagttcacaaaatggggcccccaaaccagcagcatcagcaacaccaggaaacttgttagaaatacaaagtcttggctgggcgcagtggctcatgccttgtaatcccagcactttgggaagccgaggcaggtagatcatgaggtctggagatcgagaccatctggctaacacaatga

SEQ ID NO: 161375 - DNA, 601 bp, Human
tcagctatagcaaaccaaatggactacaacactcagcaatatattttctctcttaattcactttgaactttcatcacaaaataaataattgagtcctgtgcttggctctgtgctaagttcaagaacacacataagagcatctaagggatgatcgtgttcacaaatcaaatcagttcagtctagttgggaaaacaattatcatgcatcaatctgagcatactacaaggcaacaaaagaaattttagggtttcatttttacaactgaaagagttcagagaagagaaaagatcgtgtgcactartcaggaaaggttccgtggaggaacaggaacttgggccgagcctggaggaagcagaggactcagccactgggacgagggggactttccagggacaacacaaatgaagaaacagaagcataaaggagcagctgtcactactgctgtgaaaaaccttgcgtttagagcaccattctttgttttttaagagacagaatcttgctccgtcaccctggctgttacaatggcatcatagctccctgcagcttcaaactcctgggctcaagcgatcctcctgcctcagcctcccaaagtgctgggatt

SEQ ID NO: 161376 - DNA, 601 bp, Human
ctgcagctttgggcacagaaatcacatgagtttaccatataagaaccataaagcttaatttggtgggtatctctggcactatatatcaggcaagcccagttggtgttataggcaacgttatgatttaaacgtgtcttccaaagttcatgtgctgaaaactcaatccccaatgcgacagtgctgaaggtagaaaaagggggaacctttaagaagtgactaggtcatgaggactctgccctcataaataaatggatgctgttattgtgggagtgggtttgttttaaaagtgagtgtggccctstcttgctatctctcacacactttctcactctttctcgtgcacgcacttgccatatgttgctttctgccgtgttgaagcagcaagaaggccctcactagatgcagcccctcgatcatgaacttcccagcctccaggaccaggagaaataaaattccttttcattataaattacccagtctgtggtattcagctatagcaaaccaaatggactacaacactcagcaatatattttctctcttaattcactttgaactttcatcacaaaataaataattgagtcctgtgcttggctctgtgct

SEQ ID NO: 161377 - DNA, 601 bp, Human
ggcagagctcagacagtaatgctcactcatgcatgcttacttcctgctgtgcatcccagttcctaacaggccacggaccgtattgcccaggggttggggacccctgctctagaagaccagaagtttgggcagttctgaagcaggcagaaggacctgcagctttgggcacagaaatcacatgagtttaccatataagaaccataaagcttaatttggtgggtatctctggcactatatatcaggcaagcccagttggtgttataggcaacgttatgatttaaacgtgtcttccaaagttcakgtgctgaaaactcaatccccaatgcgacagtgctgaaggtagaaaaagggggaacctttaagaagtgactaggtcatgaggactctgccctcataaataaatggatgctgttattgtgggagtgggtttgttttaaaagtgagtgtggccctgtcttgctatctctcacacactttctcactctttctcgtgcacgcacttgccatatgttgctttctgccgtgttgaagcagcaagaaggccctcactagatgcagcccctcgatcatgaacttcccagcctccaggaccaggagaaat

SEQ ID NO: 161378 - DNA, 580 bp, Human
gttgaaaccgttccacctcacatcatcaggcattagattctaataaggaacacgtcacctaggtccctcacatgcgcagttcataacagggttcgggctcctatgagaatctaatgccgccactgatctgacaggaggcagagctcagacagtaatgctcactcatgcatgcttacttcctgctgtgcatcccagttcctaacaggccacggaccgtattgcccaggggttggggacccctgctctagaagaccagaagtttgggcagttctgaagcagrcagaaggacctgcagctttgggcacagaaatcacatgagtttaccatataagaaccataaagcttaatttggtgggtatctctggcactatatatcaggcaagcccagttggtgttataggcaacgttatgatttaaacgtgtcttccaaagttcatgtgctgaaaactcaatccccaatgcgacagtgctgaaggtagaaaaagggggaacctttaagaagtgactaggtcatgaggactctgccctcataaataaatggatgctgttattgtgggagtgggtttgttttaaaagtgag

SEQ ID NO: 161379 - DNA, 601 bp, Human
attggggcgacacagccacaagccaaggaatgccaaggctggccagcaacactagaagctgagcaaaagcatggaacagaatctccccaaccttcggaaggagcatggtcctgatgcccatgctgattttgaatcctagccttcggaattgtgagaacacatttctgttgttttaagccaccagttcatagcaatttgttaaggcagccctaggaaatgaattatagtatctaaagaaaggtgggaagggctgaccaccaagatgaaacaagccttcgtgcccaaattcctctgcttcacmaagttgcctttggtagtttcgtatatatactctgtaagaagctagtggtctcagaattatggttctaaagaacaaatgtgattttgttaaaaacctccactttctgtaggacaaattccaagcaagcccttagtgtgccatgtaagccctctcaagtctggccccaacctgcctgtcccacgtactcatgtactcatgatcatcttccccctccacttccctgcctgcatgctgacctccagccatcactctgccctggagtccagcaactgattctcatgcacagtagacaacaggcat

SEQ ID NO: 161380 - DNA, 601 bp, Human
caaaaaagacatgttgaagtcctaggccacagtatctgtgaatgtgacctaatttggaaatagtctttgcggatagaatcaagttaagacgaagtcagcaaagcgggccttaatccaagataactcacgtccttaaagaagagaagagacacagaaacagacacagggagaaggtcatgtgatgatggaggcagagattggggcgacacagccacaagccaaggaatgccaaggctggccagcaacactagaagctgagcaaaagcatggaacagaatctccccaaccttcggaaggagcrtggtcctgatgcccatgctgattttgaatcctagccttcggaattgtgagaacacatttctgttgttttaagccaccagttcatagcaatttgttaaggcagccctaggaaatgaattatagtatctaaagaaaggtgggaagggctgaccaccaagatgaaacaagccttcgtgcccaaattcctctgcttcaccaagttgcctttggtagtttcgtatatatactctgtaagaagctagtggtctcagaattatggttctaaagaacaaatgtgattttgttaaaaacctccactttc

SEQ ID NO: 161381 - DNA, 601 bp, Human
atataccccacccaccacatttgtaaataggctaagaatcacccttgatccttcctcccactacatcagatcttagtggttctccttcagacccacccctcgactactcccctttcctctctgttctcacagccactgccttacttaaggtccccttatttctcacctgcaatagcgccctaactcgtctttttggtcagttctccacagcctgctgcttaggtcctgtgcaccttcccttcataattacttaagtgagctgctagtattacttactctaggtccaggcagcttcctagcsctcaccaagaacacatgacactgccaagttgaccagcttgagtgtggcagcaaacccactgcccccttgagtcctaaaatgataaggtgcagcgaagtgtgtatctgttgtgggttgcactgtgttgcctccaaaaaagacatgttgaagtcctaggccacagtatctgtgaatgtgacctaatttggaaatagtctttgcggatagaatcaagttaagacgaagtcagcaaagcgggccttaatccaagataactcacgtccttaaagaagagaagagacacagaaacagacacaggga

SEQ ID NO: 161382 - DNA, 601 bp, Human
tctgcctttaaaatatctttattcacatgcatttctaaggttgcccttcggtttcttccatatcattttcacctttttacccttcttggcagcacataaagcataacttaagtgggtagagtcaaagagaagcttgtctggataggccttcgtatatactgatagggattatataccccacccaccacatttgtaaataggctaagaatcacccttgatccttcctcccactacatcagatcttagtggttctccttcagacccacccctcgactactcccctttcctctctgttctcacrgccactgccttacttaaggtccccttatttctcacctgcaatagcgccctaactcgtctttttggtcagttctccacagcctgctgcttaggtcctgtgcaccttcccttcataattacttaagtgagctgctagtattacttactctaggtccaggcagcttcctagcgctcaccaagaacacatgacactgccaagttgaccagcttgagtgtggcagcaaacccactgcccccttgagtcctaaaatgataaggtgcagcgaagtgtgtatctgttgtgggttgcactgtgttgcct

SEQ ID NO: 161383 - DNA, 601 bp, Human
attagctgggcttggtgacgcatgcctgtggtcccagctacttgggaggctgaggtgggaggatagcttgagcctgggagttcggaagctacagtaagccatgatcacaccactgcactccagcctgggtgacagagtgagaccttgtctctaaaaataaattaaaagaaaaaaacctggaagaaagaagagaaggaagattgatggggagggagaaaagggatgactgtgtactatgcactagctctgagcccggcaccttacatacattaactgatgtctatcctcagagtaatgctayaagaatggtgttgctgctccatttactgaaaacaaaatgaagcttccataagttaagtgtctcctcacaatactacaacccccaaaaaagcaactaaaacaacaacaacaacaaacaggacttgaattttctgacttgtcaaaggattttccattgttccaagattgctgtgtaaactaaacagatgcaaaaactgtttactaaatgctactgaagaataacaggacatcatgatggtgatgccatgacctgcaacacaggttcactaagaatttttgagtctccctggaggtcagccag

SEQ ID NO: 161384 - DNA, 601 bp, Human
attaggctgggcacaatggctcacgcctgtaatcccagcactttgggaggccaaggcgggtggatcacctgaggtcagcagttcgaaaccagcctggccaacatagcaaaaccccgtctctactaaaaatacaaaaattagccaggtgtgggggctcacacctgtaatcccagctacatgggaggctgaggcaggagaatcacttgaacccgggaggtggaggttgcagtgagccgacattgcaccactgctctccagcctgggtgacagagcaagacaccatctcaaaaaaaaaaaaaaattagctgggcatggtggcaggtgcccctaatcccagctactcgggaggctgaggcagaattgcttgaacccaggagacggaggtcacagtgagcggtaattgtgccattgcacttcaacctggtgacaagagcaaaactccatctcaaaaaaaaaaaaaatcctctagagggatttgtttattatttatttattatatatttatattttagccccagagaggcagaattgcagaaagagctctgggcctcagagagtcagaaaacctgttcgattagctgggcttggtgacgcatgcctg

SEQ ID NO: 161385 - DNA, 554 bp, Human
cactccagcttgggtgacagagtgagactctgtctcaaaaaaaaaaaaaaaaaaaaaaaaaataggctgggcatggtggctcacacctgtaatcccagcactttgggaggctgaggggggcagatcgcctgaggtcaggagttcgagaccagcatggccaacatggtgaaacctcatctctactaaaaatacaaacattaggctgggcacaatggctcacgcctgtaatcccagcactttgggaggccaaggcrggtggatcacctgaggtcagcagttcgaaaccagcctggccaacatagcaaaaccccgtctctactaaaaatacaaaaattagccaggtgtgggggctcacacctgtaatcccagctacatgggaggctgaggcaggagaatcacttgaacccgggaggtggaggttgcagtgagccgacattgcaccactgctctccagcctgggtgacagagcaagacaccatctcaaaaaaaaaaaaaaattagctgggcatggtggcaggtgcccctaatcccagctactcgggaggctgaggcag

SEQ ID NO: 161386 - DNA, 601 bp, Human
tgtattcaagttctaggacattcaaaattaggaggtcttgatcagagcttcactgggggcccataaggatgaggacagaccaaggccataccctaaggatggcagagcaggaaaaccagacaactgcagagctacacagcagccttgaactccctccatccagaatgttaagtgggagagaaataaacacatgccacagtaacaaccaataaaactccctcgtaattacagctgcatattctcaggtgggcatttttctatttaaatgcgataaaattaaattcaaccccagaagtttttytatggcaccaggtttacacaaatcatttgcaattaaatccctttgcaatatgttagtgctcacttctcagaatccaaaataagggaaaaaatctgttgtagattattacatgtacattattatagattacctgattgtatatttctgtgctcactaattgttttatgagtatatttatggtcttttccattacatagaatatttctagttttcacctttttgtcttactctttctttctcaatagcctagggcacattaatgaaagcataaaagatactgaacgaatatatgttttaatg

SEQ ID NO: 161387 - DNA, 601 bp, Human
atttatttatctatcgagatggggtttcactctgtcgcccaggttggagtgcagtggcatgatctcagctcactgcaacctctgcctcccgggatcaagcaatcctcccacctcggccttctgagtagttgggactacaagcacacaccaccatgcccggctaattttttgtatttttagtagagatggagttttgccatgttgcccaggctggtctcgaactcctgagctcaagtgatccgcccacctcagcctcccaaagtgctaggattacagccatgagccaccacgcccagcctaytccacagtaacttaaatgaaacttctacttagagaaacgaaaaatacagccagtattaaactgccccttgaactccccagcagatgagataaaccctgagtcacaactttcttgcctgacttgtctcttcctctattcagatttcctcccatctgaacaactggctcatggacagacagaggctgacctgtggcagcaattgtgagctgtgcttcctttccttgagttataaaatctcgggctttttattggacacacagttacccagaataaaaaattcattcccagcctaccatgtag

SEQ ID NO: 161388 - DNA, 601 bp, Human
catggtttcaccatgaccttgtccaaggtcagtgctctgtgagtcggcttatggccaacaggaagacaacatggccgagctgtgagcacctgaccagcgtcgagcaacactgtgaacgagtggtgtatagcgtccactgtcaccagttcctggaggtcagggcttgcttttttctttctcaaacaactgcctctaagcagccttcatatctagcagaatgtcaaagaagatcattccacaatttatttattatttatttatctatcgagatggggtttcactctgtcgcccaggttggagkgcagtggcatgatctcagctcactgcaacctctgcctcccgggatcaagcaatcctcccacctcggccttctgagtagttgggactacaagcacacaccaccatgcccggctaattttttgtatttttagtagagatggagttttgccatgttgcccaggctggtctcgaactcctgagctcaagtgatccgcccacctcagcctcccaaagtgctaggattacagccatgagccaccacgcccagcctactccacagtaacttaaatgaaacttctacttagagaaacgaaaaatacag

SEQ ID NO: 161389 - DNA, 601 bp, Human
gacacaaaataaatcatgtcatctttgccttctttttcctcatttcaaatggatgttgcatcatggattcagcataacttttttttcaagggggctctgctgaaactatgctctgttgcatccttagcccgtgatctggttagggcagaaatgcccgggaatcaggctcttggttcaaattaccctccctagtacagatcaagcgggacctaagactgcaaaagtatttactgttgtcaattaagctacaaaataagctattcattgaccttggctcaaatcaaatcctagaaaatggaamttgtctttaccctgtcataatcaaaattatgggtcctacaggaaacttttttgtgtctgtgctcagaaaaaaatatgaagtggctttgctttgtctctatttaccatggtttcaccatgaccttgtccaaggtcagtgctctgtgagtcggcttatggccaacaggaagacaacatggccgagctgtgagcacctgaccagcgtcgagcaacactgtgaacgagtggtgtatagcgtccactgtcaccagttcctggaggtcagggcttgcttttttctttctcaaacaactgcctctaa

SEQ ID NO: 161390 - DNA, 601 bp, Human
tctgcgagtagtggcactgaagtgtgatcatctcgcatttgcccctctccctggctcacaaatgtgacagggaaaggcggtggcacaaaacaccaggcacagtgactgcacacaaaaccattgctcaaaagctacttgttctactgagtcggcagtgtaggactctcttctgataaaattaacaacaacagcaggaatataatggcccgtttcctggatatatggcctttcacagttaagagtttccatacacattaaagtgatgcctggaggagtatcaggcaggcgtctctattttcawtttcttttctttcttttttttttttttttttagagggagtttcgctcttgtcacccaggctggagtgcaacggcgcaatcttggctcactgcaacctctgcctcctgggttcaagcgattctcctgcgttagtctctctagtagctgggattacaggcacacaccgccacgcctagctaatttttgtatttttagtagagatgaggtttcaccatgttggtcaagctggtctcaaactcctgacctcaggtgagtcatctgccttggcctcccacagtgctgcgattacaggcgtgagcc

SEQ ID NO: 161391 - DNA, 601 bp, Human
tcacactttttgaaacctggaagtgggccacatgttgtaaaaggaagctgaacgctggtgcactgatctagaaacctgtgatcgccttctagctataaatcttccggggttcccattaaaaaagaaattcccaaactgcccctcttttgttggagctatgattatgaaaaatcctgacaggctttcttgaaggtctcacaggctagctctaagaagctagccaaacgataaaatcacaatcataacaaactcttggaggagggagcttattgtatatctttctttttttccttttttttctttttttttttttttttttgagacagagtattgctctgttgcccaggctagagtgcactggcaccatgccagctcattgcaacctctgcctcccatgttcaagagattctcctgcctcagcctctggagtagctgggattacaggcacatgccaccatacctggctaatttttgtacttttagtagacatggtgcttcaccatgttggccaggctggtcttgaaatcctgacttcaggtgatacgtctgcctcgacctcctaaagtgctaggtgtgagccaccgcacctggcacatttgtt

SEQ ID NO: 161392 - DNA, 601 bp, Human
cctcggggtgcctgtgaacctcacccctgctccaatcctgttccccctctcttccttgactacagtggcattaaataagaacctatttaaagggtagaaatggaaggagttctttcagaccagatcgcttaaatccaggtgaggactgggggtaaaggacaacatgagtgaaaaggatggagtccaatcattcagttcaaagaggttgccaacatctgtccttgaatcacaaagaggaaagttcttctctatgcccaacctttgattcccgccattcttgtttccacaagggaatctgctkccacctgggataaccattaaacattttctttttgctaaaaattattgtgtggaaatattacctcagatgactttgttatacaagaaccaccacttccacaactacagtgactgggatagatcctcagaaaaaaagcctggtctctatggcaaattatcacagacatgaaggccagtgagcttattcagaggccaaagattcttgctctgccaatattacggccacatgttttacaagcctggagtccatttcttaaaggtatgtgtgtaggttcgtgattttaatattaatagctactgc

SEQ ID NO: 161393 - DNA, 601 bp, Human
acttccccactgcgtaatttttcctattacaaatgcaaagtgatttgtggtgagatactttgcgactatgtaaatatcctgttcctcatcaaaccttaagaactgactgaaaaaatttacatttacaaatctagttatttggtaccctgggggaatgtattaaactccgaaactgagtttttcagacagtcaagggccatggagtatgtgtttgggcttcttagatacatgacttcctcacagcccgctgagttccagagaggctgaggttgcccgatagctgtgccctgatcagtgatamtgcgttctacctccacaaggtgtgaaatcatgcattcctagaagctgaactgaaaaccagaactatgagtcaaggtgattcttaatggcccagacagcactgtgggaagaggcatagaaggaaatcaggtctgtccatatgcaaagctgctatgtgtgggatgttcacgtctggtttcctccctcggggtgcctgtgaacctcacccctgctccaatcctgttccccctctcttccttgactacagtggcattaaataagaacctatttaaagggtagaaatggaaggagttctttcaga

SEQ ID NO: 161394 - DNA, 601 bp, Human
ggtgtgcactaccatgcttggctaatttttttgaattttagtacagatgaggtctcactatgttgcccgggttggtcttgaactcctaagctcgagtgatcctcccaccgtgggctttgaaagtgctgggattacaggcatgagttttcctttgtcttttatgatggtgacattttaaacagttcaggcaagttattttatagaatttccctccatttgagtttgcctgatatttgtcatacttagattcatcttttacatttttgactagaattctaggcaaataattttgtgtccttcygagggcatgatgtccagaggtacatgatatttgtaggtgatattcactttcatcatttggttaagtattttccaacttccccactgcgtaatttttcctattacaaatgcaaagtgatttgtggtgagatactttgcgactatgtaaatatcctgttcctcatcaaaccttaagaactgactgaaaaaatttacatttacaaatctagttatttggtaccctgggggaatgtattaaactccgaaactgagtttttcagacagtcaagggccatggagtatgtgtttgggcttcttagat

SEQ ID NO: 161395 - DNA, 601 bp, Human
cctcccacctcagccctggagtagctgggactacaggtgtgcactaccatgcttggctaatttttttgaattttagtacagatgaggtctcactatgttgcccgggttggtcttgaactcctaagctcgagtgatcctcccaccgtgggctttgaaagtgctgggattacaggcatgagttttcctttgtcttttatgatggtgacattttaaacagttcaggcaagttattttatagaatttccctccatttgagtttgcctgatatttgtcatacttagattcatcttttacatttttractagaattctaggcaaataattttgtgtccttctgagggcatgatgtccagaggtacatgatatttgtaggtgatattcactttcatcatttggttaagtattttccaacttccccactgcgtaatttttcctattacaaatgcaaagtgatttgtggtgagatactttgcgactatgtaaatatcctgttcctcatcaaaccttaagaactgactgaaaaaatttacatttacaaatctagttatttggtaccctgggggaatgtattaaactccgaaactgagtttttcagacagtc

SEQ ID NO: 161396 - DNA, 601 bp, Human
ggaatgcagtggcacgatttcagctcactgcaacctccgtctcctggttcaaatgattctcctgcctcagcctcctgagtagctgggatttcaggtacgcaccaccacacccagctaatttttttttttttttttttttttttttttttttttttagtagggatggggtttttgccatgttggccaggccagtctcaaactcctgacctcaggtgatctgcctgcctcagcctcccaaagtgctgggataaaaagccaccatgtctggcttttaaaatttttataattttttgagacaggktcgtgctcttgtggcctgggctggagtacagtggtgcgatgagggctcactgccacctcgacctcctgggctcaagtgatcctcccacctcagccctggagtagctgggactacaggtgtgcactaccatgcttggctaatttttttgaattttagtacagatgaggtctcactatgttgcccgggttggtcttgaactcctaagctcgagtgatcctcccaccgtgggctttgaaagtgctgggattacaggcatgagttttcctttgtcttttatgatggtgacattttaaacagttc

SEQ ID NO: 161397 - DNA, 601 bp, Human
ttgagatggaatctcgctctgtcgcccaggctgaagtgcagtggcatgatgtcggctcactgcaagctccgcctcccgggttcacgccattcttctgcctcagcctcccgagtaggtgggactacaggcgcctgccaccatgcccagctaattttttttgtattttcagtagagatggggtttcaccatgttagcgaggatggtctcaatctcctgacctcatgatccactcgcctcggcctcccaaagtgttgggattacgggcgcgagccaccgcacccggccaggaaatttaacatcratagaatactttttatacaagtcaatattctaattttattatcccaatcatgtcctttattacttattttttcccctggtgcaggatcatgtaccacatttgtcagaatttttttttttttagagacagggtcttactctgtcacccaggctggaatgcagtggcacgatttcagctcactgcaacctccgtctcctggttcaaatgattctcctgcctcagcctcctgagtagctgggatttcaggtacgcaccaccacacccagctaatttttttttttttttttttttttttttttt

SEQ ID NO: 161398 - DNA, 601 bp, Human
ctgggcttaattgcccttgaaacacagtcgggacgtgctggtaggtgtctctctgcaggcactgtccacatcaactggagtgacttgattttggaggaagggtgaggggcagaggggatggagacctcttccagtccttttagtgattgctgatccatcccagagtaaagcagacaactgggttttctgtttgttttgtgtttgagtgcaggacaatgaaggtagggctgtttaaaccatctatttttaaattcaacacaacagttacacaaatatacaaagaattcacatacttttttctttttttttttttttttgagatggaatctcgctctgtcgcccaggctgaagtgcagtggcatgatgtcggctcactgcaagctccgcctcccgggttcacgccattcttctgcctcagcctcccgagtaggtgggactacaggcgcctgccaccatgcccagctaattttttttgtattttcagtagagatggggtttcaccatgttagcgaggatggtctcaatctcctgacctcatgatccactcgcctcggcctcccaaagtgttgggattacgggcgcgagccaccgcacccggcca

SEQ ID NO: 161399 - DNA, 601 bp, Human
agcatgaaggcctagggagaacagctcatttgcccagcagttccctgggcttaattgcccttgaaacacagtcgggacgtgctggtaggtgtctctctgcaggcactgtccacatcaactggagtgacttgattttggaggaagggtgaggggcagaggggatggagacctcttccagtccttttagtgattgctgatccatcccagagtaaagcagacaactgggttttctgtttgttttgtgtttgagtgcaggacaatgaaggtagggctgtttaaaccatctatttttaaattcaayacaacagttacacaaatatacaaagaattcacatacttttttctttttttttttttttttgagatggaatctcgctctgtcgcccaggctgaagtgcagtggcatgatgtcggctcactgcaagctccgcctcccgggttcacgccattcttctgcctcagcctcccgagtaggtgggactacaggcgcctgccaccatgcccagctaattttttttgtattttcagtagagatggggtttcaccatgttagcgaggatggtctcaatctcctgacctcatgatccactcgcctcggcct

SEQ ID NO: 161400 - DNA, 601 bp, Human
agagggggcaggaggagggaaccagaaccagcagtggagctagactgcttttaacctagagacagagaaaaaacaaacagctctttaaaaacacaatttctaagcatactaaaaggtagcaattccagcctaaaagcctgtcagcttagcaatgcaccaccctaaagaaagggcaaaattatcaaggcatagaaaagcaagagacatcacgctgtggataaaggaccctgctctatgccaacttctaagtaagacgaggaattacagtaatccagcccacagcaatttcccattttaactkatgcttcctgttttctatgctgggcatcataaggatattcagaaccaaacacagggttcacaggctgtcccttcactggggtacattcttttctgttcactcaccaaattgtgtgcaacattacaaaccaaaacagatctgttttcctactgacctcaatttgcggccaccattactgttgctgagaaaattcttggctctgcatggcagagcgggggctcctaccaacacaggccagcatgaaggcctagggagaacagctcatttgcccagcagttccctgggcttaattgcccttga

SEQ ID NO: 161401 - DNA, 601 bp, Human
tttttgtgaaattaaaaaatatgtataaagctaatgaaattcagctgaatctaaaatattaagcccctaacatatgtacagtgttgttttaggcatcacagtgaattcagaaaaggtaaatgaagccctcaaaagttttttcatctgatgtagcaaaaacaaaacaaaacaaaaaaccctgatatatgggccagctgtggtggctcacgcctgtaatcccagcactttgagaggttgaagtgggtggatcacttgagcctaggagtttgagactagcctgggaaacatggtgaaaccctgkctctactaaaaatgcaaaagttagccaggcatggtggcgcatgcctgtggtccctgctacttgggaagctgaggtggagaaatgcttgagcctgagaagtcaaagctgcagtgagccatgattgtaccactgcattccagcctgggcaacagagcaagaccctgtctcaaacaaaacaaaataacaacagaaaccctgacatatatacagaactgatactcagttcccactggaaagagcgtctggctggcttccaccctgattgttcggtattcatgttgctaactatttaaacatttt

SEQ ID NO: 161402 - DNA, 601 bp, Human
aatgggaggcctaaaacaatgtgcagttcctttctattctggtttgccccattgtgttctgaatagactgaatcactgcccagcttcagggccagcctctgaaaggccccattgtaagggctatgctttccagagcagagttaaggttgctgtagtaaccttcactatgaatttcctgaccagtgtgatgaaaatctcaactgaactgcgacagtactacagctacaaacaagaccgcgaaatgagcgtgggtctacccatttagggggtctttcttatctgaacatagcccactatctaytacttcaggcatccacattgccaaagaagggactaaatttctacaagccagagcttgagaggtgaccttgttgtataaagtctcagggggatctatcccataggatttgaggtggcaggcaaatgggagtttgtagacaaaggggaggcctcggctcataaactgtttaagctgtcctgtgtgctgggctggggaagccacttttctggagttgcacagggaggcatgggggtaccattggtccaaacaccacaggtaaggaataagtctgcactgagtgggagaaaacagtttagaatt

SEQ ID NO: 161403 - DNA, 601 bp, Human
tttgcagaggtaatagactgtgactttcttttgtgacaacggtgcctcagcacaatcagacaacttgaatatgtttaaaataaccttgcagaaatcctcagaaaaagtaggcaagatagacatcaattgccaaaacagtcccagctagggatccactggaggaatttttaacatagtttccaaagtcaaacagcatgccactctcaaccctgcaaagtcagagctggtagtaaatgctgggttcccttgctgtactgacaggaatgagagtcaaaggtgctgagataaacacacaaattayctcaaagcagtaatagtaaaaatcattttatgcaaggaatggagaccaactgatacccactctccgcattaggtagaaaagagtgtgctcacacaattaaagtacaagacggcatgctcgatttggggcaggacagtgaatagaaaacagaagtcaacatcaccacctcaaacagagcgttgtgctcacaaactgccagcaagaccacaagcatatctgcaaaaacatttgcatggtttctggttgcaaaaatgctgaaaggatttgtacgatactctgttcccaagtgcacaaaagtct

SEQ ID NO: 161404 - DNA, 601 bp, Human
tgcctcgtagccagcttcaaagtcagactccccatgcctggtgttcagtaacagcgggcttctcattcaaaaattttgcagaggtaatagactgtgactttcttttgtgacaacggtgcctcagcacaatcagacaacttgaatatgtttaaaataaccttgcagaaatcctcagaaaaagtaggcaagatagacatcaattgccaaaacagtcccagctagggatccactggaggaatttttaacatagtttccaaagtcaaacagcatgccactctcaaccctgcaaagtcagagctgrtagtaaatgctgggttcccttgctgtactgacaggaatgagagtcaaaggtgctgagataaacacacaaattatctcaaagcagtaatagtaaaaatcattttatgcaaggaatggagaccaactgatacccactctccgcattaggtagaaaagagtgtgctcacacaattaaagtacaagacggcatgctcgatttggggcaggacagtgaatagaaaacagaagtcaacatcaccacctcaaacagagcgttgtgctcacaaactgccagcaagaccacaagcatatctgcaaaaac

SEQ ID NO: 161405 - DNA, 601 bp, Human
tggtgacagagtgtgtgtgtccatggaatccagatttgtactggtttggtggctttagaaacctggcagcttctattaaggctacggtagaagacagaagaaatggattccccactcggtgaaaatatctcacgggagatgtcctctgagagccaggtttcatatgcaacccttgaagctgcctttagatcccacagtggtaaactggatgaagtgttaccttggctacggaacagagctaccctttctaaacagagggacattttgggtaccttgaatgactgactcttagaaagatcaygggcacaggagatgcctcagcaaagctgagatcagagctttggagccaccctgcgacatctttgggcctctgccttgtctccttgaaagcatgcctcgtagccagcttcaaagtcagactccccatgcctggtgttcagtaacagcgggcttctcattcaaaaattttgcagaggtaatagactgtgactttcttttgtgacaacggtgcctcagcacaatcagacaacttgaatatgtttaaaataaccttgcagaaatcctcagaaaaagtaggcaagatagacatcaattgccaaaa

SEQ ID NO: 161406 - DNA, 601 bp, Human
tatggcatcaaaagggcaacccacatcaagaagtgtgccccacaatgtttggggatcggggaacgggcatcacttttcttgagcaccaaccatgttcccaatgctacgttaggtgctttgcgtacattgtttcatttggtttcaaaagaattctagaaacagggaggtactgtgatccccatttaacagatgaaaaacttggtgacagagtgtgtgtgtccatggaatccagatttgtactggtttggtggctttagaaacctggcagcttctattaaggctacggtagaagacagaagamatggattccccactcggtgaaaatatctcacgggagatgtcctctgagagccaggtttcatatgcaacccttgaagctgcctttagatcccacagtggtaaactggatgaagtgttaccttggctacggaacagagctaccctttctaaacagagggacattttgggtaccttgaatgactgactcttagaaagatcatgggcacaggagatgcctcagcaaagctgagatcagagctttggagccaccctgcgacatctttgggcctctgccttgtctccttgaaagcatgcctcgtag

SEQ ID NO: 161407 - DNA, 601 bp, Human
gggaagaaagtaagagttaaggcattggcttgaaatctagaaacaagacagacagaaaggaaaaaggcaatctccagaagatgaggggcaatgccagcagaaattagaaagctgtcatctagttagagatctctggctgtagcatttcaaggtgttccttctgccagtaactctctcctgccagaatcactaaaactgaaagcaaaacacaaactgaccatgtctgatgtgattatggacatggttgggtcacaccagtttaaaactcacaactccctagaaaatccaaggaaatttttgsatttccttctccaagaatacttacttctcattgtatctgtgaaatataatatggcatcaaaagggcaacccacatcaagaagtgtgccccacaatgtttggggatcggggaacgggcatcacttttcttgagcaccaaccatgttcccaatgctacgttaggtgctttgcgtacattgtttcatttggtttcaaaagaattctagaaacagggaggtactgtgatccccatttaacagatgaaaaacttggtgacagagtgtgtgtgtccatggaatccagatttgtactggtttggtgg

SEQ ID NO: 161408 - DNA, 601 bp, Human
ccatttgagcaacagactgatgccttgtaggcaaaaaattaaggtgtttaaacaaacaacaaagtggcagggataaggaaggggcagaatacttacatatttacattcagaaccctaaaatattgtagctggaaggggcctggcctatcgattaagcagtgcaaaacttttactttacagatgagggacctgagggccagagaggtgaaaggatgtgtccacggggccatcctggactggaaccaggactagaactcgggtcctctgactcccagcccagcactgtgcagctctctgcttycagtccctcctgagcaaatctgtaccaaaagttttttgtttctgggaagaaaaataaggcactattttggatgcttaccataaaataatcagctgaatccaggcatttatataatttgaatttctcaaataataagtaataccatttgtgagccctgaccctctggcaatcaaactgcatgaggagactggggtccatccaaatattatatatgggagcagctcaatttcatcttagtttttaatgtaaagataaatacaaattaggttttaatattttctttccagtgagtttccttgc

SEQ ID NO: 161409 - DNA, 601 bp, Human
caggtgtgagctgtcatacccagccccgttcagtgcttttgagtacattaaaagagataacgcacagagatttcatattacccaagctcacagtaccagatgagtaaagttttgcattggttattaataagtgaactgggatactactagccactaatatagctctgattggatgtatgatatttcaagaaagagactgggtactgtcatctcatctggctaataagataataggagggacaggattcaaataaaaaatatagaacttttaaagtttcatgatgctcaagtgatgtataaytggacactataaatgtgagtcaatttgaatatgggattctgagaatagggatccgccacagaaaagaagacgacagacagtagctgcagagaagatacatagggagttcagcaggctaaccaaaatggaagccagtgacaaagaccatttgagcaacagactgatgccttgtaggcaaaaaattaaggtgtttaaacaaacaacaaagtggcagggataaggaaggggcagaatacttacatatttacattcagaaccctaaaatattgtagctggaaggggcctggcctatcgattaag

SEQ ID NO: 161410 - DNA, 601 bp, Human
ggtgttgacatggtctcagtctgagtgaatgtgggggattgtgtgagcaccctaagataggatggcctcctgtccaggcctggttcctgccatgctccctgagctgccgggatagactctggccacctgcaaccctcaactagaaggagtggatcagaaaatgcgtgaatgaatgattataagttattgtcaaatgaaaacttttaaagtagatgatagtcatacaaatacatgacaatcaacaatgtgcagcgaaggcgctcagcgagcctgccatgttcctgatgggttttgaactgcrtggtgcacagaggcactccttacagttctcactttgcaaacaattattccttaactcaaaccccactactactaccactgtcactcaccgactcaccaaatattgggcaaataattctattactttttttaaattaatctttcttttcttttcttttttgagacagggtctcactctgtcacccaggctagagtgcagtggtgtgatcacagctcactgcagcctgggcctcctgggctcaagtgattcttctgcctcggcctaccgagtagctgggactacaggtgtgtgccaccatgt

SEQ ID NO: 161411 - DNA, 601 bp, Human
tcctgcaggctcagggccgctcaatgtgtgatcacaaacaagttcatcctctcactcccttccaccacctgacagaggatgcagggctatcttgctgtttcttctgatccataccttggactttaggagtgggcttggggaacttagaaggggtggggaaaattaagaacaagcttgataattcaactaaaagccctaggatagacatgaagggaggcactgtcttctaatgggcctgctaggggcttgtctctcggaacccacacccaaatcgcaagcccagtttgcagaaggcaagcamtgcagcatgcagagacgggagccttatcttctattgatgtgtccttcccgacagactttctgagggctacctgcagttgctgccacctccccagccccaagttcaatcagcaagctctagaatgaatttgcaataaaaaccaatttggaagatcagcacggcttcactgatcttaccaggaccctcactgttgtatgcttctagggtggccacaaataggtagattctgccttcctttgatcagcttagatctttattaaaggttcaacagcaagccaatagagcaggtcctcggatgac

SEQ ID NO: 161412 - DNA, 601 bp, Human
ttttctgaaaaatgtttggggcatatctgaataagaactcaatttttaaaagttttataaggttgatgaaattattttctcatctctgtcttttaaaagccaacgtggaaactccacaagagtataaagagttggattttaaggagcggtgacacaggtaaggtgttggtgtgtcatctctcacttaggggtactgtgtctggacgtgctaagcgggggaagggtctggatgtgatcaggggtgtcttgatgtgggcacagcctttgttgtgggtttgctatagggatacggagtccaggraaacaagccaagctcaggggcaaggagcattccctgaacaaccactagccaacgctgaaccaaatgcagaagtgaggaatgcctgtttctggcatggttacttctggacccttggcttgcctgatctgctctgatctatggcacagtggcaccatgtccctcttggggcaaaatgtaaccataagggcattggtctaggggcctttagggtatcaatgacacatgtttacaaacagagatctcagaccacagctggttgatgggtggcagagatgagagtcccgtgggcacatctcaggg

SEQ ID NO: 161413 - DNA, 601 bp, Human
ctctttttttttttttttttttttttttgagacggagtctggctctgtcgcccaggctggagtgcagtggcacaatcttggctcactataacctctgccccccggcttcacgccattctcctgcctcagccccccgagtggctgggcttacagaaggtgcccaccgccacgcccagctaattcttttttgtgtgtgtttttagtagagaactcctgatcttgaactcctgacgtcaagtgatccacccaccttggcctcctcaagtgctgggattacaggcgtgagccaccacgcccgacyagacactgtctttaaaaaaaataataaaatcaattaattaattagctgaaatgaattttaaaaataaaagtgaaaaaaatttttaagaaaaagaaaagaaaaaattaagtcagcctattaaatgcataccaaattagtgtgtgcatgtccattaagatttttattaatcatacaggtcggcacaaaagtaattgcggtttttgccattaatggcaccggcctaatagattcataagtcaaaaatcctaccagactctgtgtcctaatttgtggtttgaaaatgatagtctctgaagtagt

SEQ ID NO: 161414 - DNA, 601 bp, Human
atcttgcaaggtgtggcggttcatgtccttcatctcagtggaggctgagacagaaagatcacgtaaggccaggagtttgagaacagcctgggcaacacagcaagacactgtctctttttttttttttttttttttttttgagacggagtctggctctgtcgcccaggctggagtgcagtggcacaatcttggctcactataacctctgccccccggcttcacgccattctcctgcctcagccccccgagtggctgggcttacagaaggtgcccaccgccacgcccagctaattcttttttktgtgtgtttttagtagagaactcctgatcttgaactcctgacgtcaagtgatccacccaccttggcctcctcaagtgctgggattacaggcgtgagccaccacgcccgaccagacactgtctttaaaaaaaataataaaatcaattaattaattagctgaaatgaattttaaaaataaaagtgaaaaaaatttttaagaaaaagaaaagaaaaaattaagtcagcctattaaatgcataccaaattagtgtgtgcatgtccattaagatttttattaatcatacaggtcggcacaaaagt

SEQ ID NO: 161415 - DNA, 601 bp, Human
caagctctacctctcacatgcctctgtgccttgggcaaggccagtttcacagaattttattatttacagttttaaagcaatcttgcaaggtgtggcggttcatgtccttcatctcagtggaggctgagacagaaagatcacgtaaggccaggagtttgagaacagcctgggcaacacagcaagacactgtctctttttttttttttttttttttttttgagacggagtctggctctgtcgcccaggctggagtgcagtggcacaatcttggctcactataacctctgccccccggcttcaygccattctcctgcctcagccccccgagtggctgggcttacagaaggtgcccaccgccacgcccagctaattcttttttgtgtgtgtttttagtagagaactcctgatcttgaactcctgacgtcaagtgatccacccaccttggcctcctcaagtgctgggattacaggcgtgagccaccacgcccgaccagacactgtctttaaaaaaaataataaaatcaattaattaattagctgaaatgaattttaaaaataaaagtgaaaaaaatttttaagaaaaagaaaagaaaaaattaagt

SEQ ID NO: 161416 - DNA, 601 bp, Human
acacagttctccttctcttaaccatgtaagtagtccagttaagagtaacagatatttgaggttggatgattactattttatttttatttttatttttttgagacagggtctcactttgtcacccaggctggagtgctgtggcgcaaacatagctcactgaggcctcaacctccagggctcaattaatcctccctcctcagcttccctagtagccagggctacaggtgtgcaccaccatacctggctgtgtttctctaccaaaaaaaaaaaaatttttttttttttttgtagagacggggtyccactgtgttgcccaggctagtctcaaactcttgggcttgagcaatcctcctgcctcagcctcccaaagtgctgggattataggtgtaagccaccgtgcccagcctggatgattaactttttaaacagaataacaggcaattaatcttcaccacatcattagtgaggtaaggacatttcaagctacagaataatatgaatcaaatgcttgagattccttaatatgacaaatgctcatttcacttctgctctgattatattttaatcaaacaagtgacaagagagtcacactgatgttagt

SEQ ID NO: 161417 - DNA, 601 bp, Human
cctaaacacagttctccttctcttaaccatgtaagtagtccagttaagagtaacagatatttgaggttggatgattactattttatttttatttttatttttttgagacagggtctcactttgtcacccaggctggagtgctgtggcgcaaacatagctcactgaggcctcaacctccagggctcaattaatcctccctcctcagcttccctagtagccagggctacaggtgtgcaccaccatacctggctgtgtttctctaccaaaaaaaaaaaaatttttttttttttttgtagagacrgggttccactgtgttgcccaggctagtctcaaactcttgggcttgagcaatcctcctgcctcagcctcccaaagtgctgggattataggtgtaagccaccgtgcccagcctggatgattaactttttaaacagaataacaggcaattaatcttcaccacatcattagtgaggtaaggacatttcaagctacagaataatatgaatcaaatgcttgagattccttaatatgacaaatgctcatttcacttctgctctgattatattttaatcaaacaagtgacaagagagtcacactgatg

SEQ ID NO: 161418 - DNA, 601 bp, Human
gatcaaagggaagagatattgcccctaaacacagttctccttctcttaaccatgtaagtagtccagttaagagtaacagatatttgaggttggatgattactattttatttttatttttatttttttgagacagggtctcactttgtcacccaggctggagtgctgtggcgcaaacatagctcactgaggcctcaacctccagggctcaattaatcctccctcctcagcttccctagtagccagggctacaggtgtgcaccaccatacctggctgtgtttctctaccaaaaaaaaaaaaawttttttttttttttgtagagacggggttccactgtgttgcccaggctagtctcaaactcttgggcttgagcaatcctcctgcctcagcctcccaaagtgctgggattataggtgtaagccaccgtgcccagcctggatgattaactttttaaacagaataacaggcaattaatcttcaccacatcattagtgaggtaaggacatttcaagctacagaataatatgaatcaaatgcttgagattccttaatatgacaaatgctcatttcacttctgctctgattatattttaatcaaacaa

SEQ ID NO: 161419 - DNA, 601 bp, Human
ggttgcatctgtgaccaacttgatctcaaaaaagccaaggacaactctcaaagactagccctcccagccaagaccctgtgccacttagccatagggtgtcacacaaatcagtcaacctcttggagcctgtcccctcctcagcaaaaaggggttcataacactacactcccccctgggccactgggaagatcaaataagactgaccatcaaaccacccccaatccttttaggggtagagctggttttacatgatgacatgatccagtgcatggaaggtgcacaccaagctagcaacattggytgagtgggttagaagggggagggaaaaaaaggtttgttgaaaataacaagggatggtaaggagccccaattttgttttgattgaacatatgatagtatttatatgcactatctctgtacaaaaatacagttgttaaaatgttgtggttgtttatctcagtgtactttctgcactgttttatttttctgagtatgtatatataaaatatacacacacagagctgttttcattgtgaaaaaagttagatcaaataagataatggatgtgaaagtcttgctaagcagaatgaaatatataaat

SEQ ID NO: 161420 - DNA, 601 bp, Human
ctcaggctgctaggttgcatctgtgaccaacttgatctcaaaaaagccaaggacaactctcaaagactagccctcccagccaagaccctgtgccacttagccatagggtgtcacacaaatcagtcaacctcttggagcctgtcccctcctcagcaaaaaggggttcataacactacactcccccctgggccactgggaagatcaaataagactgaccatcaaaccacccccaatccttttaggggtagagctggttttacatgatgacatgatccagtgcatggaaggtgcacaccaagcyagcaacattggctgagtgggttagaagggggagggaaaaaaaggtttgttgaaaataacaagggatggtaaggagccccaattttgttttgattgaacatatgatagtatttatatgcactatctctgtacaaaaatacagttgttaaaatgttgtggttgtttatctcagtgtactttctgcactgttttatttttctgagtatgtatatataaaatatacacacacagagctgttttcattgtgaaaaaagttagatcaaataagataatggatgtgaaagtcttgctaagcagaatg

SEQ ID NO: 161421 - DNA, 601 bp, Human
gtacaatatgaggaaaaagtgttcctgaaacagtgcatgggggacagggtagtcagtagccaacaacccactctcaaccccttacactcctagataattggaacatttactgaaaccagaaatacgtgccaatgctttttacataattatctcatttaattctcacaacacttgcaagacacaagtattataatttctgcactattttacaaatggagaaactgaagcttggggtcataatgtaccatgttgcctctgcttggagtgggtggaaaagtgcactgagggggtggcacgtgargctcggggaagggaatactcaatgaatatggagtatgtgcttattcataaagtttcatccatttaaatatatgtgaccataccacagattcattatttgtgtagcattttcacatacacgtggtctcctttcatccctgagacctgacacagggatttctgacttccttttctctgctctttctgcgataccaaagctcacttccaatatcatcgttaagtccaagtgtagacacaggctccaggtctactgtgggtccagtgatctcttagtcagtggtgcctggaatcaaccttccta

SEQ ID NO: 161422 - DNA, 601 bp, Human
gaatgcccccagtgttataagtagatcaccctgagaagcagataaaccatattcttacggtgaacaatggacaatgggtaacactctggcctgcagtcaaactgagcttgttttgtaatgggatttttctgtctccgtgagtaataacaggaaagggactacctattttaattttaagacattctggaattccaccttttacatttctgccattttactggactgaaacatttacttccactgcaaatgatgaaaaatcaaccaaaaatatttgtctgtctgctacatacaaggcactggrcttgcaaactggtctacaaaccagcattgggcttgcactttatttcaactttatgaaatttaaacccctaatattttggtgatgggaagatgtgtctctgaagcaagtatgtgtgtgctggacttcagtgcacagagtacaatatgaggaaaaagtgttcctgaaacagtgcatgggggacagggtagtcagtagccaacaacccactctcaaccccttacactcctagataattggaacatttactgaaaccagaaatacgtgccaatgctttttacataattatctcatttaattctc

SEQ ID NO: 161423 - DNA, 601 bp, Human
tggattctatgctaagtccaggtttgaaaggtgattggaagacgctgtgtggacagtaagatagtatcatgtctgagccatttagttggcccatgagcacaacaggacagcagatttgatttcagaaaacctgggactagaatgcccccagtgttataagtagatcaccctgagaagcagataaaccatattcttacggtgaacaatggacaatgggtaacactctggcctgcagtcaaactgagcttgttttgtaatgggatttttctgtctccgtgagtaataacaggaaagggactayctattttaattttaagacattctggaattccaccttttacatttctgccattttactggactgaaacatttacttccactgcaaatgatgaaaaatcaaccaaaaatatttgtctgtctgctacatacaaggcactggacttgcaaactggtctacaaaccagcattgggcttgcactttatttcaactttatgaaatttaaacccctaatattttggtgatgggaagatgtgtctctgaagcaagtatgtgtgtgctggacttcagtgcacagagtacaatatgaggaaaaagtgttcc

SEQ ID NO: 161424 - DNA, 601 bp, Human
gtggctcatacctgtaattccagaactttgggaggccaaggtgggcggatcacaagctcaagagatcaagaccatcccagccaacatagtgaaaccctgtttctactaaaaatacaaaatttagctgggcatggtggcatgagcttgtagtcccggctactcgggaggctgaggcaggagaattgcttgaacccaggaggcggaggttgcagtgagctgagatcgggccactgcactccagcctggcaacagagcaagactccatccccccacaaaaaaaaaaaaaaaacaaaaaaaaaacaaaaaaaaacatcaaagcctcatcctctttgagccagcaactgtattttttaggaaactacctcaagatacacctgcaaaagatacatgtgcaaggttgttcactgtagcaaagtttgtaatagggaaacagaagcatcattaagggactgattagaatacagaatgctctgcaaaggagtactttgcagtcattaaaggaacttgcatgtcctgatatggaaagagcttgaagatactgtttcattgaaagagtagtcaatatgtggaatacatatggaattattgaatttgtgtaatt

SEQ ID NO: 161425 - DNA, 601 bp, Human
cggtggctcatacctgtaattccagaactttgggaggccaaggtgggcggatcacaagctcaagagatcaagaccatcccagccaacatagtgaaaccctgtttctactaaaaatacaaaatttagctgggcatggtggcatgagcttgtagtcccggctactcgggaggctgaggcaggagaattgcttgaacccaggaggcggaggttgcagtgagctgagatcgggccactgcactccagcctggcaacagagcaagactccatccccccacaaaaaaaaaaaaaaaacaaaaaaaamacaaaaaaaaacatcaaagcctcatcctctttgagccagcaactgtattttttaggaaactacctcaagatacacctgcaaaagatacatgtgcaaggttgttcactgtagcaaagtttgtaatagggaaacagaagcatcattaagggactgattagaatacagaatgctctgcaaaggagtactttgcagtcattaaaggaacttgcatgtcctgatatggaaagagcttgaagatactgtttcattgaaagagtagtcaatatgtggaatacatatggaattattgaatttgtgtaa

SEQ ID NO: 161426 - DNA, 601 bp, Human
gcgcggtggctcatacctgtaattccagaactttgggaggccaaggtgggcggatcacaagctcaagagatcaagaccatcccagccaacatagtgaaaccctgtttctactaaaaatacaaaatttagctgggcatggtggcatgagcttgtagtcccggctactcgggaggctgaggcaggagaattgcttgaacccaggaggcggaggttgcagtgagctgagatcgggccactgcactccagcctggcaacagagcaagactccatccccccacaaaaaaaaaaaaaaaacaaaaamaaaacaaaaaaaaacatcaaagcctcatcctctttgagccagcaactgtattttttaggaaactacctcaagatacacctgcaaaagatacatgtgcaaggttgttcactgtagcaaagtttgtaatagggaaacagaagcatcattaagggactgattagaatacagaatgctctgcaaaggagtactttgcagtcattaaaggaacttgcatgtcctgatatggaaagagcttgaagatactgtttcattgaaagagtagtcaatatgtggaatacatatggaattattgaatttgtg

SEQ ID NO: 161427 - DNA, 601 bp, Human
caggcgcggtggctcatacctgtaattccagaactttgggaggccaaggtgggcggatcacaagctcaagagatcaagaccatcccagccaacatagtgaaaccctgtttctactaaaaatacaaaatttagctgggcatggtggcatgagcttgtagtcccggctactcgggaggctgaggcaggagaattgcttgaacccaggaggcggaggttgcagtgagctgagatcgggccactgcactccagcctggcaacagagcaagactccatccccccacaaaaaaaaaaaaaaaacaamaaaaaaacaaaaaaaaacatcaaagcctcatcctctttgagccagcaactgtattttttaggaaactacctcaagatacacctgcaaaagatacatgtgcaaggttgttcactgtagcaaagtttgtaatagggaaacagaagcatcattaagggactgattagaatacagaatgctctgcaaaggagtactttgcagtcattaaaggaacttgcatgtcctgatatggaaagagcttgaagatactgtttcattgaaagagtagtcaatatgtggaatacatatggaattattgaattt

SEQ ID NO: 161428 - DNA, 601 bp, Human
tgggccaggcgcggtggctcatacctgtaattccagaactttgggaggccaaggtgggcggatcacaagctcaagagatcaagaccatcccagccaacatagtgaaaccctgtttctactaaaaatacaaaatttagctgggcatggtggcatgagcttgtagtcccggctactcgggaggctgaggcaggagaattgcttgaacccaggaggcggaggttgcagtgagctgagatcgggccactgcactccagcctggcaacagagcaagactccatccccccacaaaaaaaaaaaaaacacaaaaaaaaaacaaaaaaaaacatcaaagcctcatcctctttgagccagcaactgtattttttaggaaactacctcaagatacacctgcaaaagatacatgtgcaaggttgttcactgtagcaaagtttgtaatagggaaacagaagcatcattaagggactgattagaatacagaatgctctgcaaaggagtactttgcagtcattaaaggaacttgcatgtcctgatatggaaagagcttgaagatactgtttcattgaaagagtagtcaatatgtggaatacatatggaattattg

SEQ ID NO: 161429 - DNA, 601 bp, Human
gtctgggccaggcgcggtggctcatacctgtaattccagaactttgggaggccaaggtgggcggatcacaagctcaagagatcaagaccatcccagccaacatagtgaaaccctgtttctactaaaaatacaaaatttagctgggcatggtggcatgagcttgtagtcccggctactcgggaggctgaggcaggagaattgcttgaacccaggaggcggaggttgcagtgagctgagatcgggccactgcactccagcctggcaacagagcaagactccatccccccacaaaaaaaaaaamaaaacaaaaaaaaaacaaaaaaaaacatcaaagcctcatcctctttgagccagcaactgtattttttaggaaactacctcaagatacacctgcaaaagatacatgtgcaaggttgttcactgtagcaaagtttgtaatagggaaacagaagcatcattaagggactgattagaatacagaatgctctgcaaaggagtactttgcagtcattaaaggaacttgcatgtcctgatatggaaagagcttgaagatactgtttcattgaaagagtagtcaatatgtggaatacatatggaatta

SEQ ID NO: 161430 - DNA, 601 bp, Human
aaagtctgggccaggcgcggtggctcatacctgtaattccagaactttgggaggccaaggtgggcggatcacaagctcaagagatcaagaccatcccagccaacatagtgaaaccctgtttctactaaaaatacaaaatttagctgggcatggtggcatgagcttgtagtcccggctactcgggaggctgaggcaggagaattgcttgaacccaggaggcggaggttgcagtgagctgagatcgggccactgcactccagcctggcaacagagcaagactccatccccccacaaaaaaaamaaaaaaacaaaaaaaaaacaaaaaaaaacatcaaagcctcatcctctttgagccagcaactgtattttttaggaaactacctcaagatacacctgcaaaagatacatgtgcaaggttgttcactgtagcaaagtttgtaatagggaaacagaagcatcattaagggactgattagaatacagaatgctctgcaaaggagtactttgcagtcattaaaggaacttgcatgtcctgatatggaaagagcttgaagatactgtttcattgaaagagtagtcaatatgtggaatacatatggaa

SEQ ID NO: 161431 - DNA, 601 bp, Human
gtttaccagggtggggaccaggaagagcaaaggtgagtcagcatacacaggaaggattattctctcctgaaagtccaccttcattgcccaggagacagccccagggtaggcctggccccacgcggcagcggttctgcaaacacttcattagtgtcccagggagcactgttctttgatgcatctgggagaaaggaggagttacccatatacttggtaaccactatcttcaaatgccttcaaatgcccagaaaagggagacaattaagtgtgttgtgtaaatacaacaaggtcccccaccccrtacagggcagtggggaggaggtgaccatcaatactcttacaaacttctacaaagagtaaactgcacagtatttttaggtagcaatttagaaatcggtattgaaattttagacacacagaccaatatataaacatagttaactaaataaaaatcaaagtctgggccaggcgcggtggctcatacctgtaattccagaactttgggaggccaaggtgggcggatcacaagctcaagagatcaagaccatcccagccaacatagtgaaaccctgtttctactaaaaatacaaaatttagctgg

SEQ ID NO: 161432 - DNA, 601 bp, Human
aagttactcttatccctgacacttcctacaaattatgacggagaaatttccattagatagagattgagtgcagacactctcagatccacattccgtttctaaggatgacgtagtttattaaaaagcagttgattcatgtgcaagttctggaaagtagggtacgcccctatccacataatagcctggtttgttgctaacatttaagaggtggaacccaaacaccagagtccctcacacacaggaagaactcggccttgaggctgggaacctcagatgggtgattccctgactgattttttcraaggtggaacctcactgactggtgtctgtttaccagggtggggaccaggaagagcaaaggtgagtcagcatacacaggaaggattattctctcctgaaagtccaccttcattgcccaggagacagccccagggtaggcctggccccacgcggcagcggttctgcaaacacttcattagtgtcccagggagcactgttctttgatgcatctgggagaaaggaggagttacccatatacttggtaaccactatcttcaaatgccttcaaatgcccagaaaagggagacaattaagtgtgttg

SEQ ID NO: 161433 - DNA, 601 bp, Human
ccatgtgtgctgggagaggggcagcagagatggttcctcatcagtgtgagggcagccattctcttcagagggcaaaggcattgtttattgggctactacttcatgactctcaggcgagcttcatttttgagtaattcccttttgcttcccccactaaaaatggtaccattttaaacaggtggatactcagcaaggtattgcattttacagcagctcctggtgagcgcagcacactgtacaaagggaggagggcagtggcgggcgtgccagctacgacatgaacgtaataataacaataatraaaagttactcttatccctgacacttcctacaaattatgacggagaaatttccattagatagagattgagtgcagacactctcagatccacattccgtttctaaggatgacgtagtttattaaaaagcagttgattcatgtgcaagttctggaaagtagggtacgcccctatccacataatagcctggtttgttgctaacatttaagaggtggaacccaaacaccagagtccctcacacacaggaagaactcggccttgaggctgggaacctcagatgggtgattccctgactgattttt

SEQ ID NO: 161434 - DNA, 601 bp, Human
caggtttggctgccatgtgtgctgggagaggggcagcagagatggttcctcatcagtgtgagggcagccattctcttcagagggcaaaggcattgtttattgggctactacttcatgactctcaggcgagcttcatttttgagtaattcccttttgcttcccccactaaaaatggtaccattttaaacaggtggatactcagcaaggtattgcattttacagcagctcctggtgagcgcagcacactgtacaaagggaggagggcagtggcgggcgtgccagctacgacatgaacgtaatrataacaataatgaaaagttactcttatccctgacacttcctacaaattatgacggagaaatttccattagatagagattgagtgcagacactctcagatccacattccgtttctaaggatgacgtagtttattaaaaagcagttgattcatgtgcaagttctggaaagtagggtacgcccctatccacataatagcctggtttgttgctaacatttaagaggtggaacccaaacaccagagtccctcacacacaggaagaactcggccttgaggctgggaacctcagatgggtgattccc

SEQ ID NO: 161435 - DNA, 601 bp, Human
ggtgggagcaactcagagcctttgggagaacctgacctgcccagatcgtcaaggacaaggtggatcaatgaaagctgggaagctttagcagagggtgatatggttatcagcaaagctggaaaccaaacatggatgtgcagaccctcagcccagccagggaagctgaaaagttccccacagtgaaacaaaaaccattttctgttgctgggtaggggacaacagaatttgctactagtgtgacttgtccagaggcacacagcctctgcacacagccgctgaatgccaggagttacatgggcgrtgtggtggggcattgttaccacgcactatcctacgctctagggagcagaggctgaaagttgttctaagacacaaactaccgccctagaattgtgagaatatgcaatagggctctggggcaactaacccttcgcacccgttttgcccctcatttcttcctctacccctgctgagaggcaggggcaggtttggctgccatgtgtgctgggagaggggcagcagagatggttcctcatcagtgtgagggcagccattctcttcagagggcaaaggcattgtttattgggctactacttcatga

SEQ ID NO: 161436 - DNA, 601 bp, Human
ctcctttttctcatggtagttatttcctagcagaaaagcactcacggtagagttcattgattctcatagttccaagtatcactcgatactgaagattcctagccccagtctctaatgctcaaagaggactcattttccagtctgctgtctatataacaaggtgacagtggttacaatatgcaaaggaattagttatttgatttgtggagggtgttctacttactactgcaagcaatcctaggagagaggggttaacattcccatgccatataggaggaaactgagatctcccgactagtargtagcaaaagccaagatgtgaaccgaagattcgatgactatggacgcatccaaacgtggtttcttcacagtctcatacatgaatgactgacttattggatatttctacccgttaagtttaacatgacaatggaatgacagactgtctccaaaacccaatgtatcattaaaaagacatacaatttttattcatgaccacctcctcttagcattagagactaaaacaccaaagttatttttgatttgatacgttttttatatccaataggtcacatatcagtttctgtatctctctctccct

SEQ ID NO: 161437 - DNA, 601 bp, Human
accctacaacagccttatgtgggagattttattattactcccattttacaggtacggaaagcaaggcacagaggtcacaaaacgtttcggtcaccaaatctatgcagagcaaggtttgaagccagacagtccagatccacatcctgccacccagctccttctaatcaattaactgccagttttcatgtgctgtgggtgctgcacgtaaaagtgattaacattttttgacggtgttaagtccggataaagtaagcatatttcagtattttgaccaaataaaataaaaacctgcaactgaacrtaactgtttttgtacaattcaattaaatgaagctgctgggcgcagtggctcacgcctgtaatcccagcactttgggaggctgaggtggacagatcatgaggtgaagagattgagaccatcccggccaacatggtgaatgaaaccccacctctactaaaaatacaaaaattagctgggcgtggtggtgcacgcctgtagtcccagctactcgggaggctgaggaaggagtgaatctgggaggcgaaggttgcagtgagccaagatttcgccaactgcacttcagcctggcgagagagcaag

SEQ ID NO: 161438 - DNA, 601 bp, Human
atttccaataaacaagtttacagtggaatttttggaaaataactcggaaatatgggaagcacttacacacctgcatggtaataatgactcatacttactgtttacttgctgcattctttatttggtttcaccctacaacagccttatgtgggagattttattattactcccattttacaggtacggaaagcaaggcacagaggtcacaaaacgtttcggtcaccaaatctatgcagagcaaggtttgaagccagacagtccagatccacatcctgccacccagctccttctaatcaattawctgccagttttcatgtgctgtgggtgctgcacgtaaaagtgattaacattttttgacggtgttaagtccggataaagtaagcatatttcagtattttgaccaaataaaataaaaacctgcaactgaacataactgtttttgtacaattcaattaaatgaagctgctgggcgcagtggctcacgcctgtaatcccagcactttgggaggctgaggtggacagatcatgaggtgaagagattgagaccatcccggccaacatggtgaatgaaaccccacctctactaaaaatacaaaaatta

SEQ ID NO: 161439 - DNA, 601 bp, Human
attagatatagaagggataaagtgagcaattttataactcaatgtgaaatcaagtctcttctcgtcttaacaattaaacataggagaggaaaaaacccaactcttacttacagtaatgccattctattataatattcccttaacattgaagtgttaaaggatgcttttaccacttagcagaggaagacttgcagcagagcccctgtattatttcacaaacatccatcaagctccctcaaagctgaaagctactctgtgctaatgatagaaagcacatttatgctgggcttcccatatattsagtgggtagagatttctaaaacataaagtcattagtggtcaagtaactcatttccttggtagaacacacgattagtcagtcatcgattcaaaggcattaattcaaaggcgcataaacagccctctctgtgtgagtcatttaaaaattctgttgtctgaatttaaaaagcaagtcttaacagtcaacaaattgtcaatgaatacttaatacaatgcaccatgccaaaaattatgcagaaaaccaagaaatacatgaggcaggatgatgccatttttgttaaaattaacaagaaagcacaca

SEQ ID NO: 161440 - DNA, 601 bp, Human
tttgtttttaatagtcttattaggcaatgctaagagttgaacttttaaaatcttttttttttttttttttttttttgaggtggagtcttgctctgtcaccaggccggagtgcagtggtgcaatctcggctcactgcaacctccgcctcccgggttcaagcaattctcctgcctcagcctcccgagtagccgggactacaggcatgcgccactacgcccggctaatttttgtatttatagtagagacggggtttcaccatgttggccaagatggtctcaatctcctgacctcatgatccacytgcctcagcctcccaaagtgctgggattacaggcatgagccactgtgcccagccggttaaaatctatttgaatagtcagtgaatttcccaaaaccacctacgctggtcgagtggacttccttgggttcatccctgaggtggcacagggaggtgagttgacttccccagagtcacgtggagagtgggtggcctggaactcgaagctttggctccagcccggcatctgtcttgctatatagcatgctgcccctccagtgaactggatgccaagggccagacctcactcggaacaactacgct

SEQ ID NO: 161441 - DNA, 601 bp, Human
aggaaaaaaatgccaattatttaaaagactctgggagacagaagaaacccaagatatctttaactgatgggttcccaaatgcctgcccgtggatctatcagttttcattgacctgcagcaagaatgacaaaaaaacaaacaatgcactgaatttttcataaagcttaatttattcaaaataaagaaactgtcctttattcttagattatgtccttcctacgtttttggtgtaaaaatattttcttttatgaaatgtgatggcagtacaactttcaaattttgttttttgttttgctgttctttttttttttttttttgagacggagtctcagtctgtcacccggatggagtgcagtggtgtgatcttggctcattgcaagctccgcctcccaggttcacaccattctcctgcctcagcctgcggagtagctgggactacaggcacccgccaccacgcccggctaattttttacatttttagtagagacggagtttcaccttgttagccaggatgatctcgatctcctgaccttgtgatccgcccgccttggcctcccaaagtgctaggattacaggcgtgagccaccgtgcccagcctcaa

SEQ ID NO: 161442 - DNA, 601 bp, Human
cttaggtgacagagcaaataaaataaaataaaaaatttaaaaaaaagtctcaaaaaataaaatggctgtttctacagaaaaactaaggagaatttaattgatttaaagaaaataaacatatcgtagttatttccggtgagagtttggaataattgtttatctaaacaattctcaccttttccaccttgctatgtctgcagagaccttagctattttccggacacctgtgctctcctgctgctttgggaactccaggtaattccaacaatgctcactcccactcctgttgcataattcaggkgtgcctctgggaaaagccgttcggatcattgtctttacccacataatccttggtggtgaaggtgtggcctaaggttaattttcaaactgcataaagatatgaagctatgataccaaaaaacagaaggaaaaaaatgccaattatttaaaagactctgggagacagaagaaacccaagatatctttaactgatgggttcccaaatgcctgcccgtggatctatcagttttcattgacctgcagcaagaatgacaaaaaaacaaacaatgcactgaatttttcataaagcttaatttattca

SEQ ID NO: 161443 - DNA, 601 bp, Human
tagattacataaattctgattagggcctggttaaggagatattcaggaaaaaaaacaaaaacaaaaatttattttggactattctaggccaatcgtgaatcaatgactcaggtcagaatgaaatgaagagggaaatttgtacctgctccctaaatttatcagtagggttcttggggataatactatttgggaagacacctaaaaaataaagtttggtttaaaatggctgtttctggttgggtgctataatcacaacactgtgggaggacaagtgggatgattgcttgagtccaggagttcragaccagcctgggcaatatactgagaccccatctccttaaaaaaaaaaaaaaaaaaaaaaaaaattgccaggcatggtggtcttcacatgtagtcccagctacttgggaggctgaggtgggaggatcacttaggcctgggaaggcaaggctgcagcgaactgtgatcacaccattgctctccagcttaggtgacagagcaaataaaataaaataaaaaatttaaaaaaaagtctcaaaaaataaaatggctgtttctacagaaaaactaaggagaatttaattgatttaaagaaaataaa

SEQ ID NO: 161444 - DNA, 601 bp, Human
aaaaagaaaacaaacaaacaattaatgaatgaagtaataatgattcttatggtaaacccaattttaaagaaacacagcactgctagaaccatcttcacttcagaagaggaagatgtttatttcatgtctacatctatccccagggaaaaacaaacaggcaaataagctccttccatggaggagggtacttgttcccttagttgtaaagggaatgtggttactgccgccttgtcctagacaaattgatcactgcacacaaagaataaagggctgccctcaggacaacagacaaaggtaccamctccccaccaatcccttggttactcaataaatatgaattcagttgcatatgagctcctaaagtgaccaacattttaaaaactgttaatttgctatataaagagatatctcattaagtcttgatttttcaccaagtagattacataaattctgattagggcctggttaaggagatattcaggaaaaaaaacaaaaacaaaaatttattttggactattctaggccaatcgtgaatcaatgactcaggtcagaatgaaatgaagagggaaatttgtacctgctccctaaatttatcagtagg

SEQ ID NO: 161445 - DNA, 601 bp, Human
accagcagtcctgaattttatctggcaaccctaaattggcagcctcttctaacttagattctctgatgctttgcatactcgaaaacctaattcccttaggtggatttttaaagtatcttttctaattggtaaggacctaatcaaaattgaatgaacgagcaggttgtggtggctcaagcctgtagtcctagcacttcgggagaataaggtgggtggaccccttgagctcaggagttcgaaaccagcctgggcaatctagtgagacctcatctctacaaaaaatttttttaaaattagccargcatgttggttggtacgtgcctgtagttcctgctgaggtgggaggattgcttaagccacgcaggtcgaggttgcagtgagccatgatcatgccactgcactccagcctgggcaacagagccagaccctggctcccaaaaaagaaaacaaacaaacaattaatgaatgaagtaataatgattcttatggtaaacccaattttaaagaaacacagcactgctagaaccatcttcacttcagaagaggaagatgtttatttcatgtctacatctatccccagggaaaaacaaacaggcaaata

SEQ ID NO: 161446 - DNA, 601 bp, Human
tatagtaaaaagtaacttgttgtttatctgaaattcaaacttaaccagcagtcctgaattttatctggcaaccctaaattggcagcctcttctaacttagattctctgatgctttgcatactcgaaaacctaattcccttaggtggatttttaaagtatcttttctaattggtaaggacctaatcaaaattgaatgaacgagcaggttgtggtggctcaagcctgtagtcctagcacttcgggagaataaggtgggtggaccccttgagctcaggagttcgaaaccagcctgggcaatctrgtgagacctcatctctacaaaaaatttttttaaaattagccaagcatgttggttggtacgtgcctgtagttcctgctgaggtgggaggattgcttaagccacgcaggtcgaggttgcagtgagccatgatcatgccactgcactccagcctgggcaacagagccagaccctggctcccaaaaaagaaaacaaacaaacaattaatgaatgaagtaataatgattcttatggtaaacccaattttaaagaaacacagcactgctagaaccatcttcacttcagaagaggaagatgtttatt

SEQ ID NO: 161447 - DNA, 601 bp, Human
gcaccaaataacaacctatttgacttcaggttgactgtcccttatccaaaatgctttttgcagattgtgctttttttcatattttggaacgtttgcattacactcaccaccagttcagcatccctaacccaaaaatccaaaatcgaaatgctctgaagagcatcgtgtcgattatcaaaacatttcaaactttgcagcatttcaaatttggaattttcagattaaggatactcagcctgtacagggaaactgaggcacggagaaatttttaaaagttgcttaaggtcacacactataagtkgcagagctaggattcaaactcaggcagtctggatcccacgcccatactcttaatcaaaagctagaatgtctaagataagcaggtactgttgcgttaatattattactggtagccagatttagcaaataaaaacacagaaaactagttaaattggaaagtcattcaaacaagaatttttttaagtatgttccaaataagtatgttccccagtaatatttggtacatacttatagtaaaaagtaacttgttgtttatctgaaattcaaacttaaccagcagtcctgaattttatctggcaac

SEQ ID NO: 161448 - DNA, 601 bp, Human
attagacacagtgttattactacttaatacaaatcaatgtgagatggatcatataatcatataatttttttaaagataatattttagattattgtgcatatacaaaggtaagcatgcagaatgacatgattatgcttttacttctctttgtcactgaccagaaagatcttcatacttgaaggggtggaacatgaattgctattagggaagatgaagtggttttaagaccacttcagcagtgcccagttctggtctaagggcaggccatagtgctaagagaaaatgctgatgagacagtgaktgagccataactgaaaattactgaagagttatggaagaagggccatggaaaatgtattcccaattgccaaagtcagatgaggccaatgatagattagtgaaaatttaggacacatacatgtactgttaaaattatcaagcaggtaagacgtccatgatgccgtagccaagactcaataaggcgtcataaaattaattaaacacatatacatttacatcttagcaccaaataacaacctatttgacttcaggttgactgtcccttatccaaaatgctttttgcagattgtgctttttttca

SEQ ID NO: 161449 - DNA, 601 bp, Human
agctgtaggtcctacatcctatttaactaattttctatgcaaataaggctcaaatattagacagtcctaagcttttttgagctctgctctaaaaagcagatcattggccaggcgtggtggctcaccagcactttgggaggctgaggcaggtggatcacctgaggtcaggcgttcaagactagcctgaccaacatggtgaaataccgtctctactaaaaatacaaaattagccaggtgtggtggtgcatgcctgtaatctcagctacttgggaggctgaggcaggagaattgtttgaacccrgaaggcggaggttgcagtgagcggagatcatgcccagcctgggcaacaagagcaaaattctgtctcaaaaaaaataataataataaaataaaaataaaataataaaaattaaaaaataaaaataaaaagcagatcattaaaaatcaaacaatgtcactcaagtttctccaataaaaaattcataatagaaaagtgcaaaagtactgctaacttcaagaaaaaccatgtctgcatcataaaagccctaaataaggcagtaatttatgtgacacgtaacttaccgctccttggtacatttca

SEQ ID NO: 161450 - DNA, 601 bp, Human
attttgagacactgaccaaaactttaggcactgatgtcactctgtcaccattgtaaaaatgtacttacttgttctcaaatatcattgagaaataacagaacagtagggtttgtaagattggaacaaagactctaggttactttttgtaagggttagagtagagcggacctcctcctgctggcatctcctggtctgtttctttaaagtttcgattatgtcacatgtaacatgagtgattccatgttggtttggtttggtctggtctgttaggggctactgcatgagatcagtccaaaacaayggactctcataattttgtttaaaaattcccctctttaggtcaggttctcacttaggtgagagtgtcaccaaaacttagcccttagcacccctctcagttaccctcattttgggtttctggtctcaagtgcacaaacaacattaatgactctttgaaaatgagaaagtagaggactgtaagaaagacacgaagatggaaaatggaaggaaatggagtgaaaagcaagctatgggcagtgggggaaagtcattgcccagtaaggcttcaacgctgctgaactgtcatacttgacctttgcat

SEQ ID NO: 161451 - DNA, 601 bp, Human
cactgcgcttcagcatgggtgacagagtgagactttgtttcaaaagaaaaaaaaaaaagaagaaaacatttagatccaacttaaaatatgtaaggaggcagctttaggctaaacttaatttaacaattcccctctcttgtttttttttgtttttgtttttaaatagagacagggtctcaccatgttgcccaggctggtcttgaactcctgggctccagtgatcctcccaccttggcttcccaatgtgctgggattataggcatgagccaccatgcccagtccaatttccctcttttggtcrtcctctcaattttgagacactgaccaaaactttaggcactgatgtcactctgtcaccattgtaaaaatgtacttacttgttctcaaatatcattgagaaataacagaacagtagggtttgtaagattggaacaaagactctaggttactttttgtaagggttagagtagagcggacctcctcctgctggcatctcctggtctgtttctttaaagtttcgattatgtcacatgtaacatgagtgattccatgttggtttggtttggtctggtctgttaggggctactgcatgagatcagtc

SEQ ID NO: 161452 - DNA, 601 bp, Human
agtgagacctcctctctacaaaaaagaaacaaaattagctggacatggtggtgtgtgcctgtagtcccagctatttgcttgggaagctgcggtcgggggatcgcttgagtcctggaggtggaggttcctgtgagccaagatcacagcactgcgcttcagcatgggtgacagagtgagactttgtttcaaaagaaaaaaaaaaaagaagaaaacatttagatccaacttaaaatatgtaaggaggcagctttaggctaaacttaatttaacaattcccctctcttgtttttttttgtttttktttttaaatagagacagggtctcaccatgttgcccaggctggtcttgaactcctgggctccagtgatcctcccaccttggcttcccaatgtgctgggattataggcatgagccaccatgcccagtccaatttccctcttttggtcgtcctctcaattttgagacactgaccaaaactttaggcactgatgtcactctgtcaccattgtaaaaatgtacttacttgttctcaaatatcattgagaaataacagaacagtagggtttgtaagattggaacaaagactctaggttactttttg

SEQ ID NO: 161453 - DNA, 601 bp, Human
caacatagtgagacctcctctctacaaaaaagaaacaaaattagctggacatggtggtgtgtgcctgtagtcccagctatttgcttgggaagctgcggtcgggggatcgcttgagtcctggaggtggaggttcctgtgagccaagatcacagcactgcgcttcagcatgggtgacagagtgagactttgtttcaaaagaaaaaaaaaaaagaagaaaacatttagatccaacttaaaatatgtaaggaggcagctttaggctaaacttaatttaacaattcccctctcttgtttttttttktttttgtttttaaatagagacagggtctcaccatgttgcccaggctggtcttgaactcctgggctccagtgatcctcccaccttggcttcccaatgtgctgggattataggcatgagccaccatgcccagtccaatttccctcttttggtcgtcctctcaattttgagacactgaccaaaactttaggcactgatgtcactctgtcaccattgtaaaaatgtacttacttgttctcaaatatcattgagaaataacagaacagtagggtttgtaagattggaacaaagactctaggttac

SEQ ID NO: 161454 - DNA, 601 bp, Human
gctactcaggaggctgaggcaggagaattgcttgaatccaggaggtggaggttgcagtgagctgagattgcagtattgcactccagtctggtgaagagcgagactccgtctcaaaacaaaacaaacaaacaaaaaaatatatatctagaaaatggaagtgaggtacagaaacagccagattagttacagattagtttagaatttgccttatttgaacacagtttgaatagttggccacctttgattggccaaaactcagtgactggcagaaaagtaggttatagtttgtttatacatctgsttaggctacagttcactgtgcacagagaaacatttagcgctgggtgtgatggctaatgcctgtaatcccagcactttctgaggcaaggccagaggatcacttgaacccagcagttccagatcaacctgggcaacatagtgagacctcctctctacaaaaaagaaacaaaattagctggacatggtggtgtgtgcctgtagtcccagctatttgcttgggaagctgcggtcgggggatcgcttgagtcctggaggtggaggttcctgtgagccaagatcacagcactgcgcttcagcatgg

SEQ ID NO: 161455 - DNA, 601 bp, Human
ctggctcaggcctgtaatctcagcactttgggaggctgaggtgggaggatcacttgaggtcaggagtccgagaccagtctggccaacgtggcaaaacccagtatctactaaaaacacaaaaattagccaggcgtgttggcagatgcctgtaatcccagctactcaggaggctgaggcaggagaattgcttgaatccaggaggtggaggttgcagtgagctgagattgcagtattgcactccagtctggtgaagagcgagactccgtctcaaaacaaaacaaacaaacaaaaaaatatatawctagaaaatggaagtgaggtacagaaacagccagattagttacagattagtttagaatttgccttatttgaacacagtttgaatagttggccacctttgattggccaaaactcagtgactggcagaaaagtaggttatagtttgtttatacatctgcttaggctacagttcactgtgcacagagaaacatttagcgctgggtgtgatggctaatgcctgtaatcccagcactttctgaggcaaggccagaggatcacttgaacccagcagttccagatcaacctgggcaacatagtgaga

SEQ ID NO: 161456 - DNA, 601 bp, Human
aggtgtggttctttaaagggataagctagtttggccagtttgtttcatctctattggaaaaaaaaatcctaccacgctaagatattctcctgggtttgtgatttcatcttatgggatatcttagctatgcacaaatatcaaactaaatacattttccatgcttaataaattatcaggctgacttcagccctgctttatacaatttcttgacacctacctttaccacaacctcaaaaattactaaaaagagaaatactttgttgagtatatatggagaaagaacactcctagcctgtaatcmctccaagctacttggtaggctgaggcagaagagttgtttaaccctaggacttggagtctagtctccacacacacacacaaatttaattagctgggtgtggtagcacatgcctgcagtcctagctacttgggaggctgaggtgggaggacagcttgagtccaggagttggaggacgcagtgagctacaattgtgggaataatagcgtccaagctgcaagtctcacagtgtaaatgacggatgggaaagcaatttgaaaagacagagtgatatacaaaggtgaagcttaacttacttaatcc

SEQ ID NO: 161457 - DNA, 601 bp, Human
gccttccggatgtgccccgtgtctttagacactccaacaccccacccttccacccatacacgcctctgcaggtgacagtccatttctaaatgtttctgtagacacttgggcaacaggtctttggagaggcctgccaaacacctagatctgacttctaccagaattctaaactcttacgtaattttttctaagaggccacgttgtagattctggggcctcagagggaattaggtgagattatctatggatcagaaaaaatacttaaatctttccataagaagagggcaagaaggtgtggttmtttaaagggataagctagtttggccagtttgtttcatctctattggaaaaaaaaatcctaccacgctaagatattctcctgggtttgtgatttcatcttatgggatatcttagctatgcacaaatatcaaactaaatacattttccatgcttaataaattatcaggctgacttcagccctgctttatacaatttcttgacacctacctttaccacaacctcaaaaattactaaaaagagaaatactttgttgagtatatatggagaaagaacactcctagcctgtaatcactccaagcta

SEQ ID NO: 161458 - DNA, 601 bp, Human
aatgttttaagaaagtttacgaatttgctttgggccacactgaaagctgtcctaggccgcatgtggcccatggcctgcagcccacaggttggacaagcttgacttaaacccagccaggattcagagccatgtcagactagagggattatgaaatgtggctacagacacctaatgctggcaattaccagtaatcttcccccaaattcaatgcaaatgacaaagttcaccaaaaatgttcaaacatgaactactaaattatgaagggaatgaaaaaatagggacctacagaaaaggaattcayctgactaaacagtgaaaacatgtttattatacttactgcaatcccatggaagctcaaaagttttatgatatggagctctattatatagagttataaataaagcaagataaagcagctaacctgcttgctactcagacacattaaccaggctgtgacatcagtagctgttgcaaaaccactgcttatcgaccgaaatccataaccacagcatagtctcatatcttccacgcccactgataaggatctttttcatacctgataatgacgcactggttctctctgtcaatgatcatgtttctg

SEQ ID NO: 161459 - DNA, 601 bp, Human
cgatctcagctcactgcaacctcctcatcccaggctcaagcgattctcccacctcagtctccctagtatctgggattagaggcgtgcgccaccatgcccagctaatttttgtaaataagcagaattttaaaagcacttaaggcaggagtatccaatcttttggcttccctgggccacactggaagaagaagaattgtcttgggccacacataaaatacactaacacaaacgatagctgaagagcttaaaaaaaattgcaaaaaaatctcataatgttttaagaaagtttacgaatttgctwtgggccacactgaaagctgtcctaggccgcatgtggcccatggcctgcagcccacaggttggacaagcttgacttaaacccagccaggattcagagccatgtcagactagagggattatgaaatgtggctacagacacctaatgctggcaattaccagtaatcttcccccaaattcaatgcaaatgacaaagttcaccaaaaatgttcaaacatgaactactaaattatgaagggaatgaaaaaatagggacctacagaaaaggaattcacctgactaaacagtgaaaacatgtttatta

SEQ ID NO: 161460 - DNA, 601 bp, Human
acagggtttgctatgttgtccgggctgatctccaattcctggcctcaagtgatcctcctgccccctggcttcccaaagtgctagtattacatatactcttttcttgaccttggaaatgaatctactgccatgccctgccagatttgctttaagtaatcaagtgggacagaatgggaggaccaaataaaacagaattggccatatactgacaacagtgcaaaatggataatagatatacagggacacattctactattctttctcattttgtgtatatttgtaattatccacaataaaaggttttttttttcccaaaaatgtctcagaaaaattaactaaaaaagatgaacacaaatacgtatgataagattgtgaactgtcaaattctaggtgatgagaatatggatgcttatactttctagtgtttgaaaatattcacaatagtaagcagagcttttttttttcttgatatggagtctcagtctgtcgcccaggctggactgcagtggcgtgatcttggctcactgcagcttccgcctcctgggttcaagtgattctcctgcctcagcctcctgagtatctgggactacaggcatgtacc

SEQ ID NO: 161461 - DNA, 587 bp, Human
aaatgatttataacagccgggttcactgacaatctggacacacgaagagagagcaacaggcatgaagtgcacagcatcactgatgaagtttcctttgccaaaaacggaatctgagtctgatcgagttttttttttttttttttttgagacagagtctcactctgtcgccaggcttgagtgcagtggcgcaatctcagctcactgaaaactctgcttcctgggttcaagcgatttccctgcctcagcctcccaagtagctgggactacaggcatgcgccaccatgccyggctaattttttgtattttagtagagatggggtttcaccatgttggccaggatggtcttgatctcctgacctcgtaatctgcccacccaagagtgctgggatcacaggtgtgaaccaccactcccggcgtctaatgaagtttttagatataactattaatttacagaaaatgtaggggacaatggaatacttaagcaacatcataggatacaattaggcaatgccagactgtatagtaagatctacaggacaaacaacctttttttttttttttttaacaaagccaagaaaacaaaaagg

SEQ ID NO: 161462 - DNA, 579 bp, Human
aaatgatttataacagccgggttcactgacaatctggacacacgaagagagagcaacaggcatgaagtgcacagcatcactgatgaagtttcctttgccaaaaacggaatctgagtctgatcgagttttttttttttttttttttgagacagagtctcactctgtcgccaggcttgagtgcagtggcgcaatctcagctcactgaaaactctgcttcctgggttcaagcgatttccctgcctcagcctcccaagtagctgggactacaggcatgcgccrccatgcctggctaattttttgtattttagtagagatggggtttcaccatgttggccaggatggtcttgatctcctgacctcgtaatctgcccacccaagagtgctgggatcacaggtgtgaaccaccactcccggcgtctaatgaagtttttagatataactattaatttacagaaaatgtaggggacaatggaatacttaagcaacatcataggatacaattaggcaatgccagactgtatagtaagatctacaggacaaacaacctttttttttttttttttaacaaagccaagaaaa

SEQ ID NO: 161463 - DNA, 601 bp, Human
ctccaaatacttcagatatgtatttaccttgaaatgcttcagtgctcatgttttgcagtactgacttgggaaccatgtaaatgttttgcataattataaaaacaaaattacatttaaaaatgcaaaacaactgaaattgtaaatgaaataaatgaacccaactgtaggtcaggttgacatagaaaaggattattttaagtgacttttatgaaacccagtattttgactgcaaatattggatatttggacaaaaaccagaaaagaaattttaaaatgaattcagtattgctactaataataytggtattgttactttaacagcattaacaaacttattctatctgtctaaaacgcatacaatgcaatgcaaataattgctaatgtaatcaggaactaagattgttcagcataagataaatgggatacaaaaattaaaatcaaagaaataaaaactctgaaatcttaaaaattaattgaaaacaattaatttttcaacttcatttttctcttaaaaagctcatattccctagctttgtacttttaaagaactataggcactgaaaacacagggcagtgagcactcttggtgtctagtttagtg

SEQ ID NO: 161464 - DNA, 601 bp, Human
cccaaggctgctcaactccagctgttttgacaaatcaagtttgtagatggacctaggcgtccatggagccctgtgcttgagaaagcagcacgtctccttccttgatttatttctttcaaaatccactttgtggccaggcgcggtggctcacgcctgtaatcccagcactttgggaggctgaggcgggtggatcacgagatcaagagatcaagaccaccctggccaacatggtgaaacccagtctctactaaaaatacaaaaaaaattagctgggtgtggtggcaggtgcctgtagtcccarctactcagaaggctgaggcaagaaaatcacttggacctgggaggcagaggttgcagtgagctgagatcacgccattgcactccagcctggtgacagagcaagactctgtctcaaaaaaaaaaaaaaaaatccgatttgttacactcatttctagtcttgaaatggtcaggtgcctgtccatcctgtcaccgtatccactgcgttggaaaatatgagtaagactgacaggaaactagaaacgccgcctttatgggctgcattatgccatctaaagtgtcatttagacaaagtcacaccagg

SEQ ID NO: 161465 - DNA, 601 bp, Human
tcacccctctatccagcgttctcgtggtaatctagctcccttcgtggactgtgttccagggcacataatcggctgtccacaggcagaattctgcctatgcaataatgaattggggtctgattcacacttccttgtgagtttgcttggcaagtcagtctacccaaggctgctcaactccagctgttttgacaaatcaagtttgtagatggacctaggcgtccatggagccctgtgcttgagaaagcagcacgtctccttccttgatttatttctttcaaaatccactttgtggccaggcgcrgtggctcacgcctgtaatcccagcactttgggaggctgaggcgggtggatcacgagatcaagagatcaagaccaccctggccaacatggtgaaacccagtctctactaaaaatacaaaaaaaattagctgggtgtggtggcaggtgcctgtagtcccagctactcagaaggctgaggcaagaaaatcacttggacctgggaggcagaggttgcagtgagctgagatcacgccattgcactccagcctggtgacagagcaagactctgtctcaaaaaaaaaaaaaaaaatccgatttgtta

SEQ ID NO: 161466 - DNA, 601 bp, Human
cttagttcatgtgttcacatcttcagatagaggtgactgctgtgagctgatttagcaaatacgatcatcccttcgctcagaattcacccctctatccagcgttctcgtggtaatctagctcccttcgtggactgtgttccagggcacataatcggctgtccacaggcagaattctgcctatgcaataatgaattggggtctgattcacacttccttgtgagtttgcttggcaagtcagtctacccaaggctgctcaactccagctgttttgacaaatcaagtttgtagatggacctaggcktccatggagccctgtgcttgagaaagcagcacgtctccttccttgatttatttctttcaaaatccactttgtggccaggcgcggtggctcacgcctgtaatcccagcactttgggaggctgaggcgggtggatcacgagatcaagagatcaagaccaccctggccaacatggtgaaacccagtctctactaaaaatacaaaaaaaattagctgggtgtggtggcaggtgcctgtagtcccagctactcagaaggctgaggcaagaaaatcacttggacctgggaggcagaggttgcagtg

SEQ ID NO: 161467 - DNA, 601 bp, Human
cctgggtgacagaatgagactccgtctcaaaaaaaaaaaaaaaaaaaaaaaaaaggataaattagtgaacacaaggcatggtagataaaattagcatctataggccgggtgcggtggctcataactgtaatcctagcattttgggcggccaaggcaggtggatcacttgaggtctggagctcataaccagcctggccaacatggtgaaaccctgtctctactaaaaatacaaaaaaattagccaggcaaggtggtgggcgcctgtagtcccagctacttgggatgctgaggcaggagaatygcttgaacccggggggatggaggttgcagtgagccgagatcacaccactgaactccagcctgaacgacagggtgagactccatctccaaaaaaaaaaaaaaaaaaaaaaaagttagcatccatagaagccactcttcctgatttgtctgccagtgggctgaggaggaaggcataggaaatatccaaggtcaaccccaggtgtttattccttactagaagttggcctaatagacatcagggcttggcaggagagagtgtaggttaatgaaagggggttgacttacagcagagtcaggacag

SEQ ID NO: 161468 - DNA, 601 bp, Human
cctgacctctgtcctatggtatatggtaactattacatctccattaaaatatgggaaatttgagacctagagagacatcactgctaataggtataaagaaagtgcataaggtttgaagtcagacagggctaaattcaaatagaggctctgccatctactagttttggatcttggaattctcttaagcctcattttttagatgcagcttcaaaaaacaatgccaacagagtggtaaggattaagagacaacctatacgaaagcaaccagcagagggcaggcactcaggaagtctatcttgcrgggtctgatggtgctaacagcaagaggtgacctgaaatcaggatttcaagagccttagccctggcttttaagcagagtgagctgggggagcttgaaaaaaggtattaatgctccaaggccaccacaaatcagttgaaacagaatctctggaggtggagcctacatatctgtagagccactgaactagtaaggcaattcaggaatcagaaatacttatccctagaaagttaaattggtgaacctaggccaggcatggcagctcacgcctataatcagagcactttgggaggctgaggcagg

SEQ ID NO: 161469 - DNA, 601 bp, Human
gtgttgaaattgtgccactgcactccagcctaggtgacagagcgagactctttttcaaaaactaaaataaaaaagcacctgtatttgtggggacagagtgagagactttaatcctaggagctcaagtccaggggtaactaacctggcgaacctgtcctgacctctgtcctatggtatatggtaactattacatctccattaaaatatgggaaatttgagacctagagagacatcactgctaataggtataaagaaagtgcataaggtttgaagtcagacagggctaaattcaaatagaggytctgccatctactagttttggatcttggaattctcttaagcctcattttttagatgcagcttcaaaaaacaatgccaacagagtggtaaggattaagagacaacctatacgaaagcaaccagcagagggcaggcactcaggaagtctatcttgcggggtctgatggtgctaacagcaagaggtgacctgaaatcaggatttcaagagccttagccctggcttttaagcagagtgagctgggggagcttgaaaaaaggtattaatgctccaaggccaccacaaatcagttgaaacagaatc

SEQ ID NO: 161470 - DNA, 601 bp, Human
ctgtcgctacaaaaaatttaaaaattagccaggcatgatggtgcgcatctgtggtcccagctactcgcgaggctgaggtgggaggatcgcttgagcctgagaggcggaggttgcagtgtgttgaaattgtgccactgcactccagcctaggtgacagagcgagactctttttcaaaaactaaaataaaaaagcacctgtatttgtggggacagagtgagagactttaatcctaggagctcaagtccaggggtaactaacctggcgaacctgtcctgacctctgtcctatggtatatggtarctattacatctccattaaaatatgggaaatttgagacctagagagacatcactgctaataggtataaagaaagtgcataaggtttgaagtcagacagggctaaattcaaatagaggctctgccatctactagttttggatcttggaattctcttaagcctcattttttagatgcagcttcaaaaaacaatgccaacagagtggtaaggattaagagacaacctatacgaaagcaaccagcagagggcaggcactcaggaagtctatcttgcggggtctgatggtgctaacagcaagaggt

SEQ ID NO: 161471 - DNA, 601 bp, Human
tggccaggctggtctcgaactcctgacctcaggtgatctgcccacctgctgggattacaggcgtgagccaccatgcccagcttcactatcattcttaatgatgctaatgtagctattgctgttgcatttttctgttggcactgcccagagtctaccttcacacttgcccattcctttatttctttacaggcttactgaaagtcatacgtcggcttcctcctcgcctttctaactcaggtcaggccctcactgctgcaatagatttccatattccctcaacatcccatctcttttctaccartaaccttatctttttgaaccaggtgtcagtgctatcatgtctctgctcagaggcctgctataatatagaaataggccatagagaaccatgaaaagaaggggaagactgagctctggcccccagacaaatccactggataacaagtcaggtaaaatacagaaactgcccaggtatggccatttggtgtataaatgcatcttcacctcttggtaagaaatcaaagctaatgtgtcaataaggtcatgttcttctgttaactaagtctgtgcgtcatttatcctccgttgatgacaagcccaa

SEQ ID NO: 161472 - DNA, 601 bp, Human
tggagtgcagtggtgccatcttggctcactgcaacctctgcctcctgggttcaactgattctcctgcctcagctttccaagtagctgggattacaggtgcctgccaccacacccagctaatttttatatttttagtagagatggggtttcaccatgttggccaggctggtctcgaactcctgacctcaggtgatctgcccacctgctgggattacaggcgtgagccaccatgcccagcttcactatcattcttaatgatgctaatgtagctattgctgttgcatttttctgttggcactgmccagagtctaccttcacacttgcccattcctttatttctttacaggcttactgaaagtcatacgtcggcttcctcctcgcctttctaactcaggtcaggccctcactgctgcaatagatttccatattccctcaacatcccatctcttttctaccagtaaccttatctttttgaaccaggtgtcagtgctatcatgtctctgctcagaggcctgctataatatagaaataggccatagagaaccatgaaaagaaggggaagactgagctctggcccccagacaaatccactggataacaa

SEQ ID NO: 161473 - DNA, 601 bp, Human
ttaaacagatttgcagagatgtctcttgacatccaaaggtatcacatatgtggttttaatgcacaaatccaaattctggattttggagaacagattaatgagctaagcagatatgggtggctcatttactgggctcacaggtacctaccaagccttcaggtgctcattatcattctttttttaaattttttaaatttttaatctttttttattttttgagatagagtcttgctctgtcatccaggctggagtgcagtggtgccatcttggctcactgcaacctctgcctcctgggttcaastgattctcctgcctcagctttccaagtagctgggattacaggtgcctgccaccacacccagctaatttttatatttttagtagagatggggtttcaccatgttggccaggctggtctcgaactcctgacctcaggtgatctgcccacctgctgggattacaggcgtgagccaccatgcccagcttcactatcattcttaatgatgctaatgtagctattgctgttgcatttttctgttggcactgcccagagtctaccttcacacttgcccattcctttatttctttacaggcttactga

SEQ ID NO: 161474 - DNA, 601 bp, Human
ttttgttaaacagatttgcagagatgtctcttgacatccaaaggtatcacatatgtggttttaatgcacaaatccaaattctggattttggagaacagattaatgagctaagcagatatgggtggctcatttactgggctcacaggtacctaccaagccttcaggtgctcattatcattctttttttaaattttttaaatttttaatctttttttattttttgagatagagtcttgctctgtcatccaggctggagtgcagtggtgccatcttggctcactgcaacctctgcctcctgggytcaactgattctcctgcctcagctttccaagtagctgggattacaggtgcctgccaccacacccagctaatttttatatttttagtagagatggggtttcaccatgttggccaggctggtctcgaactcctgacctcaggtgatctgcccacctgctgggattacaggcgtgagccaccatgcccagcttcactatcattcttaatgatgctaatgtagctattgctgttgcatttttctgttggcactgcccagagtctaccttcacacttgcccattcctttatttctttacaggctt

SEQ ID NO: 161475 - DNA, 601 bp, Human
tttaacagtttcattacctctttgagactcagtttcttgatctgcaaaagtaggggacagcaatacctagtttgctaggctgacgtaaagatgaaaaatgatacaattaaaaggatgcaaagcaagtactcgaaaaagagttgctgttatgtttatgggtaatatattaattaggcagccctcctgaatagcactccttggctgatgataaaggaattttagcaaccagactagaatgtaagatttgcagaaagcttggggaacagggtcaatctaggcccttgctcttcagatttacagscagcggcagccccatgcaaccccgtcatagtcagaggtatgggctgacagggcctcccaaagccaggccagggggatggcgaggtcaaaggccggtgctgctgggataaacaagaaattgggtggacccacagcaactcaggagagccctgaaaagcgtccccatgctaataataaaaggttcctgaaatacatcaaaggcaggaagatagcttgagaatccggagacacctgatggtgccacagcaaagagcacgagagacccacgagccaaatatgagcggcactgggaatttttccc

SEQ ID NO: 161476 - DNA, 601 bp, Human
ggaagagctagaaaaggaggtgagagagtctgtgtcaggggcaagagctctactgctcagaggacggtaaacctttaagaccctcatatgggttgactagtcaataaaaatcaacaaggtttcacaaaggaaccccatgaacagcacagttcatagtatcagcaaacttttagctactcctgagtctttactgatacacacccatttaagcaagccttctgccaacaacatttattacctcacgcagagttggaactaacaaataataaatagcctacatcactgtgatcataagacaaaaaattctgcgagaatgagaaaccacatcaaagaaggtcctggacagtcttctccaatggctcaattcacagactccgcttcctggcagccctactagatctggaacagaaacaagtcggaggtgaagcacatctgggaggttccagggtcatggagagaggggtcctccatcggactttagaattacactaaaaaactaattctcaaatacatgccatggctaatggtataaaagacaaaaacaaacagccatgctgaaaccactggttaaataagacaaattcattccttaacagattga

SEQ ID NO: 161477 - DNA, 601 bp, Human
tgtgtcaatcacttggtccacataagagtcctgtgtggtaggtgcttttataatctccattatttgaagtgagaaaaggtaagaaacttgctgaaggccacttagctagtgagtggaagagctagaaaaggaggtgagagagtctgtgtcaggggcaagagctctactgctcagaggacggtaaacctttaagaccctcatatgggttgactagtcaataaaaatcaacaaggtttcacaaaggaaccccatgaacagcacagttcatagtatcagcaaacttttagctactcctgagtcyttactgatacacacccatttaagcaagccttctgccaacaacatttattacctcacgcagagttggaactaacaaataataaatagcctacatcactgtgatcataagacaaataattctgcgagaatgagaaaccacatcaaagaaggtcctggacagtcttctccaatggctcaattcacagactccgcttcctggcagccctactagatctggaacagaaacaagtcggaggtgaagcacatctgggaggttccagggtcatggagagaggggtcctccatcggactttagaattac

SEQ ID NO: 161478 - DNA, 601 bp, Human
aattgacacactttttgttggtctctgaatactattcttcaataaaaagaacaagggctgctttgggaaatgaccaatgccagggctggagtggggaaaattcaaactgggcgtggaacatataactgtgccaaaaggtaaggaaatgtacagtgactggtgtggacgtgtcaagcatataagagccagctggaaggggttcccactggccaaatcaaaataagtaatgataataatggattacgatcctttgaataaaataggaagccataattccatagtgccatacgaaagtaaacgrgtcaatcagtaaataggagagaaaggaaagctcttcctcacagtggaataccaactaataaatgtggaaggaatgatggaaacagatatatcaccatttggcagccatcatacaggtgaccaggagtcattaatggatgctaaggctggtaggtggaggtttggatgtggagaaggatgttgtcatgatctgagaatatatccccacaaaatacacatcctaaaagaaaataaaattaatttaatgagaagaaacctagcagatgcctacagaaccaggtgatcaagagccctgcattgt

SEQ ID NO: 161479 - DNA, 601 bp, Human
ctgtggtcctagttactttggaggctgaggtgggaggattgtttgagtccaggaggttgaggctgcagtgagctattgttgagctactgcactccagcctgggtaacaaagtgagatcctgtctctaaaaaataaaataaaataaaataaaataaacaagtaaataaataataggccttgactgtgatgtgggaagctgggaggggtagggagtggaactggaaggcagtgcagagatccaagacagtgaccttgggttcaggtttggggatgcaccaagggttctggcctgtgccatttygtgctacattttatatagactctagacttccattttctcaaggcagcataccgacgaacttgcctttacctatacagaacaactgatatattatttacttagttttcaaaattgacacactttttgttggtctctgaatactattcttcaataaaaagaacaagggctgctttgggaaatgaccaatgccagggctggagtggggaaaattcaaactgggcgtggaacatataactgtgccaaaaggtaaggaaatgtacagtgactggtgtggacgtgtcaagcatataagagccagct

SEQ ID NO: 161480 - DNA, 601 bp, Human
ggtacacatgaagggaaccatgggtagttaaacaggacttgaggagacagtggctcacacctgtaatctcagcaatgtgggaggccaagggagttggagaaccagccttagcaaacagcaagatctcgtttcttaaaaagaacaaaaacaaaaccccaaaacacaaaagaaacaacaacaataataataaaacaaataaaaataaaaacaattggctgggtgcagtggctcacgcctataatcccagcactttgggaggccaaggcgggtggatcaccttaagtcaggagttcaagagcarcaagagcagcctggccgacatggtaaaaccccgtctctactaaaaacacaaaaaaattagccaggtgtggtggcatgcgcctgtagtcccagctgctcaagagatccgaggcaggagaatcacttgaacctaggggacagaggttgcagtgagctgagactgcacgactgcactccagcctcggtgacagagcaagactccatctcaaaaataaatagataaataaataaaaataaaaataaaaatttttaaataaaaacaattaaaaataattagctgggtgtggtagtgtgctcctgt

SEQ ID NO: 161481 - DNA, 601 bp, Human
attgtagagtgtgtgtctgtgtgtggggggggtctgtgtactaactatagaaatggaaacatacggtaaaatatcaacgaaatggaaagaatgttctggggaaaaaaagccatttacaatggtataatccaaggaccataattatttttctgagaaaggttattcctcacttaaaagtcaatagtattttctattcacttcaacttattcagcaaatgtaaaaatatttcagttcttttttattttgattttttgagatattccctaaaataagtaggatccgctgttaccactgttggaygactcaccaatgcacccccatcccccatttctgatctaaaaatctctctcctggctctgtaccacaggaactggtgttcccttgtaactggctgaatcaacgtaattgaaatatcacttttccaactttttgtttgtggtttaaaaaggacaaacacttaaaacaaaaatgatgtctacttttgttcatgcaacacacactgtctaacaaccccctctgccccagtgtgttaagccgaaggccagaatgagatgtggctcctgtcagagaagagctcactcactgtcttacagggaagtc

SEQ ID NO: 161482 - DNA, 601 bp, Human
tgtttcttctccggcactaaaacccaagttaaaagaaagtgaaggtcttagacaaaataatatatcccaaattatttactttgcatctcacagcagttattgtacagcaatttgctttgtttacgcttccaggcagcccgtcctaatttaattgacttataaaatggacacacacacacaaatactctagaaattaggaaaatatcccagtggttcccaaatctggcagtctatcagaatcgtcagagtactttttaattgcccatgtctgggcccgtcttctgacctgctggatcccagyctccagggacagagtctaggaataggaatttctaacaaactccctagttcttgtatagccagctgggaacaagccaagcaattttaaatcaaagtcataacagactttataggaaatattaattcaaataggaagtattgtagagtgtgtgtctgtgtgtggggggggtctgtgtactaactatagaaatggaaacatacggtaaaatatcaacgaaatggaaagaatgttctggggaaaaaaagccatttacaatggtataatccaaggaccataattatttttctgagaaaggttatt

SEQ ID NO: 161483 - DNA, 601 bp, Human
tggcctgtttgggatgagaaaatattgtttcttctccggcactaaaacccaagttaaaagaaagtgaaggtcttagacaaaataatatatcccaaattatttactttgcatctcacagcagttattgtacagcaatttgctttgtttacgcttccaggcagcccgtcctaatttaattgacttataaaatggacacacacacacaaatactctagaaattaggaaaatatcccagtggttcccaaatctggcagtctatcagaatcgtcagagtactttttaattgcccatgtctgggccygtcttctgacctgctggatcccagtctccagggacagagtctaggaataggaatttctaacaaactccctagttcttgtatagccagctgggaacaagccaagcaattttaaatcaaagtcataacagactttataggaaatattaattcaaataggaagtattgtagagtgtgtgtctgtgtgtggggggggtctgtgtactaactatagaaatggaaacatacggtaaaatatcaacgaaatggaaagaatgttctggggaaaaaaagccatttacaatggtataatccaaggaccat

SEQ ID NO: 161484 - DNA, 601 bp, Human
agcaatattaatcacatccggagtaacaaaggccaccttccgctgggtagccttcctgcatggggagagccttttgttaataatatatagtctgctcttcaaaatccccattcttcctacaaaatccccctgaattgataatgacctcaattcaaaacatgcttaagtcagtcagatttttcatctttctattggtaccctttgtgttaccaggatagaattaaagaaccccatatcatataaaatgatggtgggagttagtatgaaaaatgcagactgctacaagttcataggacaatatttttgttcgcgcttcgcgataaaaaattttagggcgcagagcaaatgttcttctatgaatatccagcccaaattaattgttatcgattgctgagttactcaaggaaagagaaaacatttgcttggggaacaaccaagcaaggtgacactcctattcccaaaaggaaactgaaatttgaaataattttacatttcaaaacaaaacaaaagaaacaaatgaacagagaattgagctggccatatagcgaaactcagaactttgctgaatttccttgaactaataatacggttttaaagaaat

SEQ ID NO: 161485 - DNA, 601 bp, Human
ttatatacaaaacatgattacaatttttttttcttaaaaaaaagactggaactaccacaaaatattaacaaaggctttggtcaagccagagactagagaaacttgttttaattcattagttttcaaacattttataatgcatatgctatttttgtaatttaaaaaaagaaaagaaaaagtgggcactctgaggtttcaaaccatgtgccttgaattgatgcaagcttccttattttagaagttctaaaattaaaccttgaagcaatattaatcacatccggagtaacaaaggccaccttcygctgggtagccttcctgcatggggagagccttttgttaataatatatagtctgctcttcaaaatccccattcttcctacaaaatccccctgaattgataatgacctcaattcaaaacatgcttaagtcagtcagatttttcatctttctattggtaccctttgtgttaccaggatagaattaaagaaccccatatcatataaaatgatggtgggagttagtatgaaaaatgcagactgctacaagttcataggacaatatttttgttcgcgcttcgcgataaaaaattttagggcgcaga

SEQ ID NO: 161486 - DNA, 601 bp, Human
tttttaagtacaataccagtagagaaaggcaagttacagcaggattaggtcgcccatgtgacccgtgtgagccggattaacatggtgtggataattaccactgtgcacaccactgaccattaagcattttacatgcccaataatgggggatatgattaggaaaattatggagtatcacaagggtggaattctacataaattacaactgacatgaagactgtaaacacaggaaacaagcaaatgaaatcatgttaagtgaaataagtcattcaagttatatacaaaacatgattacaatttktttttcttaaaaaaaagactggaactaccacaaaatattaacaaaggctttggtcaagccagagactagagaaacttgttttaattcattagttttcaaacattttataatgcatatgctatttttgtaatttaaaaaaagaaaagaaaaagtgggcactctgaggtttcaaaccatgtgccttgaattgatgcaagcttccttattttagaagttctaaaattaaaccttgaagcaatattaatcacatccggagtaacaaaggccaccttccgctgggtagccttcctgcatggggag

SEQ ID NO: 161487 - DNA, 601 bp, Human
tgtggaagaaaaattcttttctaacagcaaatggagcctcttacatttcccataacataaggtatcataatgggccactgcccactcacctggactttggtccctcctccagacactctggagatgtagctcatgatatatttggcagccactgtttttccagcaccactttcaccactaaagaaagacagacaaagaatccacctgagaagtggattgcgaccagctcccttccttgtctcccccatcacacaaaacaaacaaacaaacaaaaaaacaaaaaaaacaggcagaaaagaatttttttttttaagtacaataccagtagagaaaggcaagttacagcaggattaggtcgcccatgtgacccgtgtgagccggattaacatggtgtggataattaccactgtgcacaccactgaccattaagcattttacatgcccaataatgggggatatgattaggaaaattatggagtatcacaagggtggaattctacataaattacaactgacatgaagactgtaaacacaggaaacaagcaaatgaaatcatgttaagtgaaataagtcattcaagttatatacaaaacatgattac

SEQ ID NO: 161488 - DNA, 601 bp, Human
aatgtatgagaacaactgtgtccctacttcctaccaatcaagcgtttaaaacatggtaagattttggccaatctgataggcaaaaaatagttttctaatgcagttttaatttgcatttttcttcttatcatgatggtgaacatactttcatgttttgtgagtaatttatatttccttttctatgagttgtctttcatgtcctttgtttattttccttttgggctgctgatctttttattgatttgtaggagttcattatatattaggcacatctaccttaaaatatgctattccttaatcmcagcactttgggaggccgaggagggcagatcacctgaggtcaggagttcgagaccagactggccaacatagtgaaacccccgtctctactaaaaatacaaaaattagctgggcatggtggggcacacctgtaatcccagctactcaggaggctgaggcaggagaatctcttgaacccgggaggcagaggttgtggtgagccgagatcgcgccactgcactactccagcctgggcaacagagcaagactctgtctcaaaaaagaaaaaaaaaaaaaaaatatacacacacacacacacaca

SEQ ID NO: 161489 - DNA, 601 bp, Human
ccagcctggcgacagagcgagactccgtctaaaaaaaaaaaaaaaaaaaaaaaaggcagcaaaacagcatcctggattcttgtctccatgtcaaccctctcaggatccagtacaatcacaggaatagagaaaagcaagtggactgaaccacatgaacctaggttctatagctgcccttactgtccaatagggaagccataagctaccccaactgaggtgtaactgtagaatacacactgtatttcaaagacttagtaccaaaaaaaaaaaaatctcattaattttgttatattaattatayaataaaatctttttttacatattgggttaaataatactgttttaaaaagtaatttcctttttctctttttacttcttttaacatggctactagaaaatttagaattacacatatggcttgcttcatctttctactgcacagagctgctctccatcttcctttcattcagagaaagaggccactttaaggacccttcactctgcaaccttagtttgctctttctcttttccctgatatgctcaccacatgccacaaaattctgttggacatcactgatcactgatggatggatggatggat

SEQ ID NO: 161490 - DNA, 601 bp, Human
aagacagaggttgcagtgagctgagatcgcaccactgcactccagcctggcgacagagcgagactccgtctaaaaaaaaaaaaaaaaaaaaaaaaggcagcaaaacagcatcctggattcttgtctccatgtcaaccctctcaggatccagtacaatcacaggaatagagaaaagcaagtggactgaaccacatgaacctaggttctatagctgcccttactgtccaatagggaagccataagctaccccaactgaggtgtaactgtagaatacacactgtatttcaaagacttagtaccaaaaaaaaaaaaatctcattaattttgttatattaattatataataaaatctttttttacatattgggttaaataatactgttttaaaaagtaatttcctttttctctttttacttcttttaacatggctactagaaaatttagaattacacatatggcttgcttcatctttctactgcacagagctgctctccatcttcctttcattcagagaaagaggccactttaaggacccttcactctgcaaccttagtttgctctttctcttttccctgatatgctcaccacatgccacaaaatt

SEQ ID NO: 161491 - DNA, 601 bp, Human
ctttgggaagccaaggcgggcggatcatgaggtcaacagatcaagaccatcctggccagcatggtgaaaccccatctctactaaaaatacaaaaattagctgggcatagtggtgcacgcctgtagtcccagctactcgggaggctgaggcaggagaatcgcttgaacccagaagacagaggttgcagtgagctgagatcgcaccactgcactccagcctggcgacagagcgagactccgtctaaaaaaaaaaaaaaaaaaaaaaaaggcagcaaaacagcatcctggattcttgtctccakgtcaaccctctcaggatccagtacaatcacaggaatagagaaaagcaagtggactgaaccacatgaacctaggttctatagctgcccttactgtccaatagggaagccataagctaccccaactgaggtgtaactgtagaatacacactgtatttcaaagacttagtaccaaaaaaaaaaaaatctcattaattttgttatattaattatataataaaatctttttttacatattgggttaaataatactgttttaaaaagtaatttcctttttctctttttacttcttttaacatggct

SEQ ID NO: 161492 - DNA, 601 bp, Human
ttcttctatcttttccctttttaaattacagtgtttaaaatgagaatctttatgtatccattcatccatccatccgtccgtccatatgtattcatcaacaatcggtgatgttcaacagaattttgtggcatgtggcgggcatattagggaaaagagaaagagcaaactgaggtaaaagagtagcccatcggccgggcgcggtggctcacgcctgtaatcccagcactttgggaagccaaggcgggcggatcatgaggtcaacagatcaagaccatcctggccagcatggtgaaaccccatstctactaaaaatacaaaaattagctgggcatagtggtgcacgcctgtagtcccagctactcgggaggctgaggcaggagaatcgcttgaacccagaagacagaggttgcagtgagctgagatcgcaccactgcactccagcctggcgacagagcgagactccgtctaaaaaaaaaaaaaaaaaaaaaaaaggcagcaaaacagcatcctggattcttgtctccatgtcaaccctctcaggatccagtacaatcacaggaatagagaaaagcaagtggactgaaccacatgaacctaggtt

SEQ ID NO: 161493 - DNA, 601 bp, Human
gttaagaggcaacctgtgaggccaggtccagtcactttgggatgtcgttaggttacatgagtagggcataagacagatgcacaaagccagagggctgcggtgggcaggcagctcgctctgagggatggagaggaggaagtttctctccaaggtgccagatcagtctaactctgtgcacccttcagagtctatggaccaagttctaagaagcaaaaccactgccagtgggaaatgatacctgggatacccctctactctagttatttcttggtctgggaaagaaggtcttttctctagggcwtaaagacaactcctccaaggccaaagctgccactttcatcatttattttccttagtaaggcaactgatgtggaaaatgattttcaaaattatcttgtttgtatccccggggcgcaaaaaaaggcaaactgcagcttggcggcatgctgctatagaaaatgaaggaaagatcgaagaggtggcctcctgatgatatgtgaaaggctcccatttcctgtgggatactagacttcagtcagaagcatcaacatcatcaatcaagcgacactctctgaaacagggaagggacttacaaatcggc

SEQ ID NO: 161494 - DNA, 601 bp, Human
taaaacgttccagaatcagcctcacagatggctccgtgaatgctttagtgccagacatgatctatggttgaaataagatgcaaaatctatataaatcaaggttactggataaacatttgtttctttgtaaatgtggcttttgtcaaggggaacatattcatattcagccttgccagctttcctatttaccccctctggagacacccagacagaaacatgactaaatgagcattcataacaatgcacttggttgacattttcattaccagttaggtaagccagttaagaggcaacctgtgargccaggtccagtcactttgggatgtcgttaggttacatgagtagggcataagacagatgcacaaagccagagggctgcggtgggcaggcagctcgctctgagggatggagaggaggaagtttctctccaaggtgccagatcagtctaactctgtgcacccttcagagtctatggaccaagttctaagaagcaaaaccactgccagtgggaaatgatacctgggatacccctctactctagttatttcttggtctgggaaagaaggtcttttctctagggcataaagacaactcctccaag

SEQ ID NO: 161495 - DNA, 601 bp, Human
ttaatgtttgcccatttgagagacagaaaattatatgtggttttcatttacatttctctcatccatgatggtgaatagtgagagagagagagacagtgtgtgtgtgtgtgtgtgtgtgtgtgtgtgtgtgtgcaggtgaatgtgtgtctgaattgtctcttccaatctttctatcagggttgtataaaattttgcaattagaaaaataataaatgttgagtgtttttgttatttacagaaactgatatatcctccaaatataatgaataatttatattgcaaaaatcaatgaaaatatcartttaattgttttttttttctggtctccaaggaatccaagacaggggaaaaggtaaataaagagttaaatttggtcaagtccatttttataagatttagattgaaaattaattcaagtggaaaatttgtttaattcttctttcctattttattatctggaaaacttcttcaggataacacaactcaggcattgggcccaaatatgagagacaaacaaatgagtagtttgaataatattggaaagcaaagaaagtaagggcaagtctaacagatagaacccaccagggaacttgacagttat

SEQ ID NO: 161496 - DNA, 601 bp, Human
agttcccagcctctattctggtggtttctgacttaagggcagagaactcctgggggagggttggggcttgcatttatttaaagaagtcctgacatccattatacacttccatctagcactgggtattatttatgtgaaatatataattatttttcacttatctatatatgttgctttaatacaattttaaaaatgactgaattcacagaagttttaatcatttatatactttttcaaccaacaggtacaaactaaaagaattatttggcattgcctaagatgtgtgtgtaattgaaaagaytgaatgtgagctacttccacagtttaatgtccttctaatccagtgatccacaaactaaacacgaaacgaaacaaaacaaaacaaaaaacagtgaccaggtctttcttcgaagaaagtctaatgtggatcttcaatataaaatactaataagtaaatagaacataaaaaatttggttattaacatcattatattttttaagtacttaaaaaccttttacaaaagtacctgaatcagggccaggtgcaatggctcacgcctgtaatcctagcactttgggaggctgaggtgggtgggtcact

SEQ ID NO: 161497 - DNA, 601 bp, Human
tgagcccgagaggctcaggtagtaataatagtccatgctggtgatgccaaggctgtgtttctgctctgcagaggcgccctcgatgagctggagcaagagaacacaggttgagccatgatgtggaccacaaggcacccgaagtcactcctgcatcctgcagccaccatccctaaggactttctatctctgctttctaaaattacaggcagtcctggcccccaaatatgtacttgtagtagccccaggtcatctctgcaaattttgattcctaactctggaaagacctgcaagagctgaggaytttccattgtccactgaaaggaactggactgccaccctcggaagagtggaaagcaaaacagattttaattacttagttcctgcccaacttgctatggctttttaagctggcttttccatgtttctcactgcagggtgcatgttaaaaaactgccatgcagcttcctgctctctggtactctttgccttctttagaagcttttccttgactgtgaactcctccaagctgcaggatctacttccttgccatgacataaccacctgcattctagcttctcccctcaccactctggcggaaccc

SEQ ID NO: 161498 - DNA, 601 bp, Human
gaatagagtaggccatcagcaaacaggtatgctcaacgtatgaatcatttttgcctatttatcagagctcctgcagggtgataatgatgaattcatttctttttacccatctcaaatcattaagtggtcctcaggcaactggcacatggctgtttaaggatactgaaacatgtatgagcatacagagtgctcacagagaaagaggcggacatttcatgcagctctttgctttattaaccttcactgcccttttggccacaggaaatggccagttgggagagcagatcctgcctggccctgygccagcacttaccagagtttcctgaaactcccgcctgtcgtcaatgtcatcaaccttgtatgagcccgagaggctcaggtagtaataatagtccatgctggtgatgccaaggctgtgtttctgctctgcagaggcgccctcgatgagctggagcaagagaacacaggttgagccatgatgtggaccacaaggcacccgaagtcactcctgcatcctgcagccaccatccctaaggactttctatctctgctttctaaaattacaggcagtcctggcccccaaatatgtacttgtagtagc

SEQ ID NO: 161499 - DNA, 601 bp, Human
gtactgaacccacgctgctcattcagagtctactgctcagttctggatctgggttgaggaatagtccccagcttgaaacagactcaaagggcagtgggtggcaatgaaggcctttgaggccaagtgggtgttcagcctacctccagaaagttctacattattgcccccaggatggaacccctccataatctacctagtttcacagcttggaccataacatacatgcaatgtgaagggcatggcacagaaaaagggtcctctgccctaaacaatacagaggggaagagagtcttcaaaaccrgaaaagaaataagagaaaagactaaagacgttccaaaatgtctaaacctattcagtccatagacgtgcggtttgcttagcttttctaaggaaatagctcacgaatagagtaggccatcagcaaacaggtatgctcaacgtatgaatcatttttgcctatttatcagagctcctgcagggtgataatgatgaattcatttctttttacccatctcaaatcattaagtggtcctcaggcaactggcacatggctgtttaaggatactgaaacatgtatgagcatacagagtgctcacagaga

SEQ ID NO: 161500 - DNA, 601 bp, Human
catgtgacctgttgataccattttgtttcctggcacccaggacacagtctgtttgaactttctgtccctttcaaccacaaatgtactgaacccacgctgctcattcagagtctactgctcagttctggatctgggttgaggaatagtccccagcttgaaacagactcaaagggcagtgggtggcaatgaaggcctttgaggccaagtgggtgttcagcctacctccagaaagttctacattattgcccccaggatggaacccctccataatctacctagtttcacagcttggaccataacrtacatgcaatgtgaagggcatggcacagaaaaagggtcctctgccctaaacaatacagaggggaagagagtcttcaaaaccagaaaagaaataagagaaaagactaaagacgttccaaaatgtctaaacctattcagtccatagacgtgcggtttgcttagcttttctaaggaaatagctcacgaatagagtaggccatcagcaaacaggtatgctcaacgtatgaatcatttttgcctatttatcagagctcctgcagggtgataatgatgaattcatttctttttacccatctcaaat

SEQ ID NO: 161501 - DNA, 601 bp, Human
gcacacattcttctcacgtctcaaagtcatgctggaagggcacttctgtctctaagcatagcatgccatcctccaggaataagagaatactccaggaggaaagagactcggaagagtggtagttgtacacaaagtctccaagtcctgtcttcatcctttgatgtgttcttgttgccagcttcccctcgaaggtcgctgctgacctttccacctactcaaagtggactcgagatctttcccttcatcaggagggataagaatatattgtacttgcaaaaggatcttaatgaaaaatctccargaaatccaataaaagcatcatttaaaagtccagtttctgaggtcccttaaatgcaataaataccgctaaaatgtctaaatcttaagagaaacatctcctaagaaaactacactctaggaccagtgtgcagactccttattggcacttttccccgcagctgctttgaggccatgtgacctgttgataccattttgtttcctggcacccaggacacagtctgtttgaactttctgtccctttcaaccacaaatgtactgaacccacgctgctcattcagagtctactgctcagttctggatc

SEQ ID NO: 161502 - DNA, 601 bp, Human
agcagctgctctaaataaggatgtgacaagtacagacgagttacaaagaaaaaaaaaaaaaaaagccaaaacataagattgggttgtgcagtcacatgtggcttagcttgtgatgacagcaggacgttcttgtacaacatggtcactgcccaatgcacacattcttctcacgtctcaaagtcatgctggaagggcacttctgtctctaagcatagcatgccatcctccaggaataagagaatactccaggaggaaagagactcggaagagtggtagttgtacacaaagtctccaagtcctrtcttcatcctttgatgtgttcttgttgccagcttcccctcgaaggtcgctgctgacctttccacctactcaaagtggactcgagatctttcccttcatcaggagggataagaatatattgtacttgcaaaaggatcttaatgaaaaatctccaggaaatccaataaaagcatcatttaaaagtccagtttctgaggtcccttaaatgcaataaataccgctaaaatgtctaaatcttaagagaaacatctcctaagaaaactacactctaggaccagtgtgcagactccttattggcact

SEQ ID NO: 161503 - DNA, 601 bp, Human
ctagccacccctcattcaatggccacatgccagggctacgcacactcttcactctccacagccgcgtagttgccaacttctttgaagctgatgtttcccaggtggagaatacccgccactatctgcaacaccagcgtttgctcttctgcaaagatcccaatcacattcatggcgtgctggaagagaaaagagaaactatccagagaagctggtcaccagctttaaaagcaccttaggaagaagccaaggcacagcagctgctctaaataaggatgtgacaagtacagacgagttacaaagaaaaaaaaaaaaaaaagccaaaacataagattgggttgtgcagtcacatgtggcttagcttgtgatgacagcaggacgttcttgtacaacatggtcactgcccaatgcacacattcttctcacgtctcaaagtcatgctggaagggcacttctgtctctaagcatagcatgccatcctccaggaataagagaatactccaggaggaaagagactcggaagagtggtagttgtacacaaagtctccaagtcctgtcttcatcctttgatgtgttcttgttgccagcttcccctcgaaggtcg

SEQ ID NO: 161504 - DNA, 601 bp, Human
atcacttcttcccaatattcccatttgagatctaagcaaaggaaagtgctaggttacttctaatcagagctagccacccctcattcaatggccacatgccagggctacgcacactcttcactctccacagccgcgtagttgccaacttctttgaagctgatgtttcccaggtggagaatacccgccactatctgcaacaccagcgtttgctcttctgcaaagatcccaatcacattcatggcgtgctggaagagaaaagagaaactatccagagaagctggtcaccagctttaaaagcacsttaggaagaagccaaggcacagcagctgctctaaataaggatgtgacaagtacagacgagttacaaagaaaaaaaaaaaaaaaagccaaaacataagattgggttgtgcagtcacatgtggcttagcttgtgatgacagcaggacgttcttgtacaacatggtcactgcccaatgcacacattcttctcacgtctcaaagtcatgctggaagggcacttctgtctctaagcatagcatgccatcctccaggaataagagaatactccaggaggaaagagactcggaagagtggtagttgt

SEQ ID NO: 161505 - DNA, 601 bp, Human
acatgtagatttatcacttcttcccaatattcccatttgagatctaagcaaaggaaagtgctaggttacttctaatcagagctagccacccctcattcaatggccacatgccagggctacgcacactcttcactctccacagccgcgtagttgccaacttctttgaagctgatgtttcccaggtggagaatacccgccactatctgcaacaccagcgtttgctcttctgcaaagatcccaatcacattcatggcgtgctggaagagaaaagagaaactatccagagaagctggtcaccagytttaaaagcaccttaggaagaagccaaggcacagcagctgctctaaataaggatgtgacaagtacagacgagttacaaagaaaaaaaaaaaaaaaagccaaaacataagattgggttgtgcagtcacatgtggcttagcttgtgatgacagcaggacgttcttgtacaacatggtcactgcccaatgcacacattcttctcacgtctcaaagtcatgctggaagggcacttctgtctctaagcatagcatgccatcctccaggaataagagaatactccaggaggaaagagactcggaag

SEQ ID NO: 161506 - DNA, 601 bp, Human
ctgtgagcttcccatatttacatatattatattgcttgctctttaaaacctgtaagtgaatttagatcctaaagaccagttactgaaaaggttttgataaagacaataaatcttttgcattaagccattactctaatccccattaaagagatcactttatctttaaaccaaggtgtgaaatcctcccagctttccccaggttaatgataaattgaaacgattccattaataatcgatggtgtgggacttggaaaggctgggggtaaggacagggacaggtgcatagaagaggtctggtctstcgtgaagccattctgtttgccacagaggacatgtagatttatcacttcttcccaatattcccatttgagatctaagcaaaggaaagtgctaggttacttctaatcagagctagccacccctcattcaatggccacatgccagggctacgcacactcttcactctccacagccgcgtagttgccaacttctttgaagctgatgtttcccaggtggagaatacccgccactatctgcaacaccagcgtttgctcttctgcaaagatcccaatcacattcatggcgtgctggaagagaaaag

SEQ ID NO: 161507 - DNA, 601 bp, Human
aacgggctgacatttctcagtatacaccttccaatgagattaagtcagtgaatacattttgaaaaagtataatgccagaacaagacatttatcctctatatgagtgtttcacaaaaatgctttgagcaatagaagggcttccttttagaaaggacatgtaaacaaaatcaaatgcactgatctgaaaatggccattatccttagtttagttttactgttaacacatgtctaggaatctggatatgtcttccagtgaactaaacgtgcattcatctcacagagttgaacatttcttttgatkgagcagttctgaaacactctttttgtagaatctgcaagtggatatttggagcactttgaggcctgttgtggaaaaggaaatatcttcacagaagaactaaacagaagcattctgagaaacttctttgcgatgtgtgcattcatctcacagagttgcactcctgtgcacagagtaaggacagatgacattcataaatcagactggacccatgtcgggttgttgtgagaatcaagagacattcaccaacatatccaactaagaagggatttcttagtttgtttagcttcacagcaacgtaaa

SEQ ID NO: 161508 - DNA, 601 bp, Human
agaggggcattataagaagattcctctgagggtagcatatggagtgaaatgaaggggatggtattgttcatatcctgccctaatgtcacatggtatggcagtctgtggtctttggatagaaaaacggagacttccatagctcaacatcttgtttcagaccatgaaacttaccaaggagggctagtgatataaatggggttttcttgatttctgggcagaacgttctcatataaataaatgacaccattctttgacatgaaagaatgctcagatttttccaatatgaatgaaagatttttayagatgcaatgaaaattttgaacttggctgagttttctttttctgcataatgctttaccaaaattatctgataaaagaattttgttaaaggccttatgataatgctaaaaaatcacaagcctcccaataaaggataatctgtttgaatttcacagatggtgttagaatataacgggctgacatttctcagtatacaccttccaatgagattaagtcagtgaatacattttgaaaaagtataatgccagaacaagacatttatcctctatatgagtgtttcacaaaaatgctttgagcaata

SEQ ID NO: 161509 - DNA, 601 bp, Human
caatcacgggccccaagagcttacgttctagtgaaggctgcttatcagtaatcccatacacatccatctcctttgtttttcccaattgttttatgacatgagtcaattcctatgatgactgagacttccaataatacaaatcagggattcaagaaggatggcaaacctatccctcctactgagatcacagtcaaatgcctaaaatggacatctctccaagcttccagcacgacagccaggaaggaactcaatcaagaaacatttctttggctccaaatattgttttcttcctttttagtamaatgttttcatagcatcatttttgaagcacctgatattactgaactaataattacaaccaatcccatgtttattgagtatttagcatgtgtagggttactaaagagagaggaaaagatagaaaatatgtaagaaatcttgaatgcaatctagatgaggcaaaaatagtttgccaaataaagaacccttggaaaagctgaatatgtaacacagacagacaagatctggagaaattagaacaggaagatattactacttgctggggtagtcaagagatttgagctgggtgtaaaggatgaat

SEQ ID NO: 161510 - DNA, 601 bp, Human
ctaatttttgtgtttttttgtagagacagggtctcaccatgttgcagaggctggtctcaaactcctgggctgcagtgatcctcccaccttggcctctcaaagtactgggattacaggtgtgagccaccgcacccagcctactagttttactctttatagctaagatatgaagcatcaccagcatcaacttctgttacttacatctaccaagaaatcaaagacccgggcgtgcagggccttggcgagcgcatcccgggtgtaacaggcctgctctacgttgagggtcacgtggatggattcrgatttgcctccccacttgctatccatctgccggcttgttagcttttctttcaaccggtcctggtttatccctagcagatatgcaggaaaagctaaaactgtagaacataaaacaaaacatgacaatctttcagaattgtgacacttccaagtcatctcacaaacatatggaggcacttatgtgcacatgcacgtgtgtgtgcatagaaggcacaatcacgggccccaagagcttacgttctagtgaaggctgcttatcagtaatcccatacacatccatctcctttgtttttcccaattg

SEQ ID NO: 161511 - DNA, 601 bp, Human
atatctcaccctcagaaactgagaaaataagtgcttatggtttcaagccgctaggttttgggttaatttgtaacatagaaatatgtgaaaaacatattcctaaatctttaggtccaaaagtcaagaaaggcccatgaacgtggctctcctctttttctggtctctagtcctagctttactaaatattttgtccagaagaaacttgttaccacattagatttagctaaggtatcttggtgggcagttctagaaggaaaagcaggattcagtaatcacagagtgagagaaagtgaagtaaggyaatgggtgaaaggaaggagccagaacaggaacacaaaaccctcagtcgttttaccttttttttttttttttttttttttttgggagataggatctcactctaacccccaggctggagtgcagtggcgtaatctcggctcactgcagccttgacctcccaggctcaagtgatcttaaccacctcagcctcctgagtagctgggaccacaggcacatgccaccacacctggctaatttttgtgtttttttgtagagacagggtctcaccatgttgcagaggctggtctcaaactcctgggct

SEQ ID NO: 161512 - DNA, 601 bp, Human
tgtgtgtgtgtgtgtgtatgtgtatatatatatatatatatacacatacacacacacacacacacacacacacacacacataattatgccataaccaaaaatatctaatagtttcaaaatacatgcaaaaagtttttgatattccttcctctaaaaggtggagcctcattcccctccccttaagtgtgatctttgcttagtgacttgcttctaataaacagaatgtggcaaagtgacaatacctgagtccaagattaggacataaaaaactggcttcttgctcattctctctttcagatcwctcgctctggggaaaaccaaccattatgttatgaggatattcaaggagaggtccatgcagcaaggggctgagacctcctgccaacagccacatgggcaatccatctttcagccagatcctccaaccctaggcaagccttcagacaaccacagttccaatcagcttcctgactgcaacctcgtctttgagtcagaaccaccaagctcagccgatcccaaatatctcaccctcagaaactgagaaaataagtgcttatggtttcaagccgctaggttttgggttaatttgtaacatagaaat

SEQ ID NO: 161513 - DNA, 601 bp, Human
accctgaccttcccaagcaatgttatcctttaaatagccactaaagtacctagaatagttctcctaccctgtcctgcctgaccctactctaaccacactaaccataccttaagccgtataaatgttagtgcctggaatcaaatacagatcttttggattgaatggcccccactgttgtcccttgactagggtccttctagcttgaatatataaacgtcaaagaaacaaactagctaggaatctagggcctcctagatcactcacataataacagagtgaccttgggcaaattccttaatcratctatgcctcccttagtttatctgtaaagcagagataataatacctaagtcacagggttgttgtaagaattaagtgagggttttttctctttaaaatactcagaacagtatctgggcactaacatagttagttctatataagtgcctgctattattattttaccatttagaggctacagtgattaacagagattgttactggcagctctacactgctgaaagactaattgtcagaatatatatgtgatatacatatataaatatatattcatatataagagtttatgtgtgtgtgtgtg

SEQ ID NO: 161514 - DNA, 601 bp, Human
atgcctaaatctgtgttcttaatcaccgtgagaagaggccaagcaattcatgggaacagatgtaatgacagcaagggaggtttggatagagcggttggtgggggatgcagtgggggaggaatgtaagcgaacaattctttgaggtgatgaatacctggacgaattctgaagtaccagaggtgttttccaggcaaacaaaatgaaatatcatcttttgtgagcgaatgagtaatcatacacaacacacagtcagtgcccagtaaatcccacctcaaattaggatcacttatatgagtattcrtgtactggtactattcacaaaaaaaactgacaggtgacaggtagaaaggtaggtaggaagcccagcgctggaaggtgctctgaacaaagagaaaagagatatggattctagtcccaggctgcaccacccccttgctgaccagccttgggcaaaaccaccattgctcaggcctgaagttcccttctcagtaaaatgaggggtctggacaacctaactgcatgacttctgtttagtatgaccctgaccttcccaagcaatgttatcctttaaatagccactaaagtacctagaatagttctc

SEQ ID NO: 161515 - DNA, 601 bp, Human
tgatcgaagtaaaacctatttcacacaaagaacccacactaaaggatctgtaattgtcatttccagtgtcttccattcaccagtcatttaatgatgacccaacacaatatgccagggatgctaaggacaagacaacccttgttcctaggcgcttatagagagggtgagctatctgcagatagtaacaatagtcattatttttgaattgataatagaagcagcttacgtctattaaacattcacctttgccagggtttgctaagtgctctcaatgtgttgtttcacttaattcccatttcakttctcaaaatggcagtgataccattattttcccaattttccacatggatacaccaaggcttgcttaaggttgttctatgtaagaagcagggtctgggactaaatttaagcagtatgatgcctaaatctgtgttcttaatcaccgtgagaagaggccaagcaattcatgggaacagatgtaatgacagcaagggaggtttggatagagcggttggtgggggatgcagtgggggaggaatgtaagcgaacaattctttgaggtgatgaatacctggacgaattctgaagtaccagaggtgtt

SEQ ID NO: 161516 - DNA, 601 bp, Human
caagtactttggaaaaccaccaggattcagaaaagcgagtacagtagaaacaaaaaatgtttgtttaatgatgataaccattaatttctgtccaagtaagctttttcaggaagtcttaacaattagaaaaaaatgtcatcttggatgatcgaagtaaaacctatttcacacaaagaacccacactaaaggatctgtaattgtcatttccagtgtcttccattcaccagtcatttaatgatgacccaacacaatatgccagggatgctaaggacaagacaacccttgttcctaggcgcttawagagagggtgagctatctgcagatagtaacaatagtcattatttttgaattgataatagaagcagcttacgtctattaaacattcacctttgccagggtttgctaagtgctctcaatgtgttgtttcacttaattcccatttcatttctcaaaatggcagtgataccattattttcccaattttccacatggatacaccaaggcttgcttaaggttgttctatgtaagaagcagggtctgggactaaatttaagcagtatgatgcctaaatctgtgttcttaatcaccgtgagaagaggc

SEQ ID NO: 161517 - DNA, 601 bp, Human
ctaatttttgtatttttagtagagacggggtttcatcatgttggccaggctggtctcgaattcctgacctcaagtgatctgcccgtctcggcctcccaaagtgcagggattacaggcatgagccactgcgcctggctattatttatttttgagatagagtcttgctctgttgcctaggatggagtgcagtggtgtgatgatataagcctcgacctcctgggctcaagcaatcctttcacctcagcctccagagtagctgggactataggcttatgccaccacgtccagctaattattttattttttttgtatggatggggtctcattttgtcccgcaggctggtcttgaactcccgggctcaagcaattctcccgactcggcctcccaaagtgctaggattacaggcacgagccacagcacccagcctgcagtgaactttagaagaaactataccaaggcatgttacctcaggtaagtattcaaataccagctttgttaaaaatgcacgtattgttagggaagattgaaaatggcgtagatctgaggaaaccaagtcttttatttggaacacaatatttgccacagacagtcggggctgga

SEQ ID NO: 161518 - DNA, 601 bp, Human
taacacagagacaaggaactcacattatttcccagatagcaagagctctgcacggacagaccctgaatggacaaaaattcccataaaagagaaaaacctgaatgtcctgcaacaaagaccagggactttaatttttattttctaagaggtaacaggaaaggaacattttatgacttggtgatttttatgtttagtttgaaccctatgaaattattgccacacaactgtttctggccaaagaaaactacaatttagtagcaccgaactgataaatccagttacaaaaaaatcacaaaactcytaaaatttaacataggactgggcgcggtggctcacatctgtaatcccagcactttgggaggccgaggtgggcggatcacaaggtcaggagttcgagaccatcgtgaccaacatggtgaaaccctgtctctactaaaaatacaaaaagaagctgagtgtggtggggcgcgcctgtaatcccggctacttgggaggctgaggcaggagaattgcttgaacccagaaggtggaggttgaagtgagctgagattgtgccactgcacttcagcctggatgacagagcgaaactccaactcaaaaa

SEQ ID NO: 161519 - DNA, 601 bp, Human
ctaatttttgtatttagctaatacaatttttgtattagctaaattttgtgtttagaaatagggtttcaccatgttgctggggctggtcttgaacccctgtgctcaagcgatccacctgcctcagcctcccaaagtactgggattacaggcacgagccaccatgaccagcctgaatcagtcattaaggctaaagtcctagaagttggactagaacacagggccaattttatggctctttccatgctaagtcatcatgtgatcctgtcttctcttagaattcaataacaacttccatttgtamattgacattttactcatatccacatgttcatatttactgccagaataaagccgtactgttctcttttcacacatacagaaaactagtacaattgctcaaattctctgcaaatcagagttgtcactttgcctgttctaaaacaatgacacagagaataaaaactcacttaatgtaaacctgtgagcagtgaaaagacatactaaatgaacacttaccactttgttctctatgaggtcacatacgattttattattaaagtactcaatgggtgtccatcttattccctcttgaacatattct

SEQ ID NO: 161520 - DNA, 565 bp, Human
aactatgtagaaccagctgacacacgccgtgccatcgcgctgcaggttcgactactagcaggatccccagtttttgggcttttatatatataaaaaaatcctacagagatatctgttctgtatcactttattttgaatcaccttttttttttttttttttttttttttttttttgagacatggtcttgccttgctctgtcacccaggctagagtgcagtggcacaatctcagctcaccacatcctcaacctcccaggctcaagcratcctcccacctcagcctccagagtagctgggactacaggtgcgtgccaccatgcctggctaatttttgtatttagctaatacaatttttgtattagctaaattttgtgtttagaaatagggtttcaccatgttgctggggctggtcttgaacccctgtgctcaagcgatccacctgcctcagcctcccaaagtactgggattacaggcacgagccaccatgaccagcctgaatcagtcattaaggctaaagtcctagaagttggactagaacacagggccaattttatggctctttcca

SEQ ID NO: 161521 - DNA, 567 bp, Human
agaatccaaaagtaaaaacattttcctttgacctaatctatttcttaatgttctctttcagcgtgttacccatataggcatcatttcggtagttatttagtgtacacattctataatgcatttcctttttcacatagcactattttataagcattcctcatgttttacacattcttcacacttactattttaatggctatacttctctgttctgatatgctatagtttgtttaataactaagttgtctggccgggcatggtggctcatgcctgtaatcccagcaatttaggaggccgaggcgggtggatcacgaggtcaggagttcgagaccagcctggccaacatggtgaaaccccctctctactaaaaatacaaaaattagccaggtgtggtggtgggcgcctgtaatcccagctactcaggaggctgagacaggagaatcgcttgaacccgggaggtggaggttacagtgagccaagatggcgccactgcactctagcctgggcaaccgagcgagacgtctctcaaaataaataaataaacatgtaaataaataaataaataag

SEQ ID NO: 161522 - DNA, 601 bp, Human
ccccagacttaagataccatcttgaaagtcagtattccccttcaggcaagaatgcaattaatagtcccaaatagggagtcaccacttagatctaaagagggaggaaactccactttccaaaaagctgtttaactccctgaagttttatccaagagtcatgcacagatcattatctgctcactcatagtcatgccaaattgacttgcttaagaatccaaaagtaaaaacattttcctttgacctaatctatttcttaatgttctctttcagcgtgttacccatataggcatcatttcggtasttatttagtgtacacattctataatgcatttcctttttcacatagcactattttataagcattcctcatgttttacacattcttcacacttactattttaatggctatacttctctgttctgatatgctatagtttgtttaataactaagttgtctggccgggcatggtggctcatgcctgtaatcccagcaatttaggaggccgaggggggtggatcacgaggtcaggagttcgagaccagcctggccaacatggtgaaaccccctctctactaaaaatacaaaaattagccaggtgtg

SEQ ID NO: 161523 - DNA, 601 bp, Human
agcttggtatccattctgaaagctgccatggatggatcctcggagagcatggagactcaagtgttcctgtgtggagtggagtgaacatagctggtgtccctttgaaggatctgaactctgatataggaactgataaagatcctgagcaatggaaaaatgtccacaaagaagtgactgcaactgcctatgagattattaaaatgaaaggttatacttcttgggccattggcctatctgtggccgatttaacagaaagtattttgaagaatcttaggagaatacatccagtttccaccataaytaagggcctctatggaatagatgaagaagtattcctcagtattccttgtatcctgggagagaacggtattaccaaccttataaagataaagctgacccctgaagaagaggcccatctgaaaaaaagtgcaaaaacactctgggaaattcagaataagcttaagctttaaagttgcctaaaactaccattccgaaattattgaagagatcatagatacaggattatataacgaaattttgaataaacttgaattcctaaaagatggaaacaggaaagtaggtagagtgattttcctattta

SEQ ID NO: 161524 - DNA, 601 bp, Human
cggagactctggcaaggcccgcgcagccgcagtagagggccagggggcggggcacgcgcacctgccgtagagtgctgaaggtcctgccaacggctctcttggcgtctcaacgttcggatcagcagcttttttccattctctctctccacttcttcagtgagcagccatgagttggactgtgcctgttgtgcgggccagccagagaatgagctcggtgggagcgaatttcctatgcctggggatggccctgtgtctgcgtcaagcaacgcgcatcccgctcaacggcacctggctcttcacmcccgtgagcaagatggcgactgtgaagagtgagcttattgagcgtttcacttccgagaagcccgttcatcacagtaaggtctccatcataggaactggatcggtgggcatggcctgcgctatcagcatcttattaaaaggcttgagtgatgaacttgcccttgtggatcttgatgaagacaaactgaagggtgagacgatggatcttcaacatggcagccctttcacgaaaatgccaaatattgtttgtagcaaagattactttgtcacagcaaactccaacctagtgattatcacagca

SEQ ID NO: 161525 - DNA, 601 bp, Human
ttagtctgagcacccacggaaagcacgtgtcggagactctggcaaggcccgcgcagccgcagtagagggccagggggcggggcacgcgcacctgccgtagagtgctgaaggtcctgccaacggctctcttggcgtctcaacgttcggatcagcagcttttttccattctctctctccacttcttcagtgagcagccatgagttggactgtgcctgttgtgcgggccagccagagaatgagctcggtgggagcgaatttcctatgcctggggatggccctgtgtctgcgtcaagcaacgcgmatcccgctcaacggcacctggctcttcacacccgtgagcaagatggcgactgtgaagagtgagcttattgagcgtttcacttccgagaagcccgttcatcacagtaaggtctccatcataggaactggatcggtgggcatggcctgcgctatcagcatcttattaaaaggcttgagtgatgaacttgcccttgtggatcttgatgaagacaaactgaagggtgagacgatggatcttcaacatggcagccctttcacgaaaatgccaaatattgtttgtagcaaagattactttgtcaca

SEQ ID NO: 161526 - DNA, 601 bp, Human
ttgataatactcttagcaaaactaactccagaaatcacttgctagagaagcagcccttcactgccttagtctgagcacccacggaaagcacgtgtcggagactctggcaaggcccgcgcagccgcagtagagggccagggggcggggcacgcgcacctgccgtagagtgctgaaggtcctgccaacggctctcttggcgtctcaacgttcggatcagcagcttttttccattctctctctccacttcttcagtgagcagccatgagttggactgtgcctgttgtgcgggccagccagagartgagctcggtgggagcgaatttcctatgcctggggatggccctgtgtctgcgtcaagcaacgcgcatcccgctcaacggcacctggctcttcacacccgtgagcaagatggcgactgtgaagagtgagcttattgagcgtttcacttccgagaagcccgttcatcacagtaaggtctccatcataggaactggatcggtgggcatggcctgcgctatcagcatcttattaaaaggcttgagtgatgaacttgcccttgtggatcttgatgaagacaaactgaagggtgagacgatggatc

SEQ ID NO: 161527 - DNA, 601 bp, Human
atgccagtctgtgattccagcaagaggcaagacgaaaatccatttattcagcagctaatacatgtagcagggtgattcattttccaaaaatatgcagtagtatgctgagatttagtgctggagtgactcccagccggcccctaccctgctgaagccccagccgactgtcccagggtgggtcctggccaggactggcaccaaggcagtggaatcctttcaaaataggcctccagcgccatagaccagaaagcaggcgcccaattctgggacactgggagatggtgcaggcagccaccagtaygcaaagcatagagccctatccttcctggcagggtcacggttcagaaaacgtaaccttattttcatctgtagttaacagaagcatgtttcctcagcattcatattaaaaataaaaaactagtaattccagggatctcggttagcctcttaagcatgtcaactattgataatactcttagcaaaactaactccagaaatcacttgctagagaagcagcccttcactgccttagtctgagcacccacggaaagcacgtgtcggagactctggcaaggcccgcgcagccgcagtagagggccag

SEQ ID NO: 161528 - DNA, 601 bp, Human
caacttaacttttttatcatcagcagccccacacagcctggcatccagtaggcacccaatactgatgggctttataagaacaccaaaagtgcactctgggccttgatttatactaccagtaggcatggggagacaaggaatgccagtctgtgattccagcaagaggcaagacgaaaatccatttattcagcagctaatacatgtagcagggtgattcattttccaaaaatatgcagtagtatgctgagatttagtgctggagtgactcccagccggcccctaccctgctgaagccccagcygactgtcccagggtgggtcctggccaggactggcaccaaggcagtggaatcctttcaaaataggcctccagcgccatagaccagaaagcaggcgcccaattctgggacactgggagatggtgcaggcagccaccagtacgcaaagcatagagccctatccttcctggcagggtcacggttcagaaaacgtaaccttattttcatctgtagttaacagaagcatgtttcctcagcattcatattaaaaataaaaaactagtaattccagggatctcggttagcctcttaagcatgtcaact

SEQ ID NO: 161529 - DNA, 601 bp, Human
gaccacgacctcaacttaacttttttatcatcagcagccccacacagcctggcatccagtaggcacccaatactgatgggctttataagaacaccaaaagtgcactctgggccttgatttatactaccagtaggcatggggagacaaggaatgccagtctgtgattccagcaagaggcaagacgaaaatccatttattcagcagctaatacatgtagcagggtgattcattttccaaaaatatgcagtagtatgctgagatttagtgctggagtgactcccagccggcccctaccctgctsaagccccagccgactgtcccagggtgggtcctggccaggactggcaccaaggcagtggaatcctttcaaaataggcctccagcgccatagaccagaaagcaggcgcccaattctgggacactgggagatggtgcaggcagccaccagtacgcaaagcatagagccctatccttcctggcagggtcacggttcagaaaacgtaaccttattttcatctgtagttaacagaagcatgtttcctcagcattcatattaaaaataaaaaactagtaattccagggatctcggttagcctcttaa

SEQ ID NO: 161530 - DNA, 601 bp, Human
ataggggtgtctaagtgacatactcaatacttttcctaaattttagctaagccagagcaaaagtgaagcccctcatgctcagtaattcactgcaatgagccatgtcatctgaggctttgcagtttctcccagaagtggtatcaaagttgcaccaatctggccagaaactcatgctcagatactctgtttaacaagagatcagctgggatgatggatgagaccaggggatttccatagcactaggaagtccccaagaccacgacctcaacttaacttttttatcatcagcagccccacacarcctggcatccagtaggcacccaatactgatgggctttataagaacaccaaaagtgcactctgggccttgatttatactaccagtaggcatggggagacaaggaatgccagtctgtgattccagcaagaggcaagacgaaaatccatttattcagcagctaatacatgtagcagggtgattcattttccaaaaatatgcagtagtatgctgagatttagtgctggagtgactcccagccggcccctaccctgctgaagccccagccgactgtcccagggtgggtcctggccaggactggca

SEQ ID NO: 161531 - DNA, 601 bp, Human
agtattgaaaggtagaaagcctgaggccctgaaggacctgtagatggcacttggaatttgggggcatgaagtgttagggacataaaagggagagactgatatagagaaaagaaagctattttgagaaaccaaatagattaaatgataatccagacccaatagcatgaaggaacaaaatgctaaccactaaacatcacaggtgttttgttttgtttttgtttttttctttattagagacacagtgttcctatgttgcctggctggagggcagtggctattgacaggagtgatcacagctcastgcagcctcaaactcctaggatcaagtgatcctcctgccttagcctcctgagtagctgggactataggaacacaccaccacacccagctcataagtttgttttcatattgaaaatttcatcaaacctatatcccctgtcagctatggcaaaacatacttacagctcgctgctctgcataagctcgatgagatccataaaaagcacatcccggttcctttcacaaaagccatccatgtcataggatacctggccaagaatggaaagaaatcgaatttcattgaacaaaatgtaattaattg

SEQ ID NO: 161532 - DNA, 601 bp, Human
ttaaatagtcagaaatggccatcccaatccaaagccagtgggcttatttctccctgataatagtattgaaaggtagaaagcctgaggccctgaaggacctgtagatggcacttggaatttgggggcatgaagtgttagggacataaaagggagagactgatatagagaaaagaaagctattttgagaaaccaaatagattaaatgataatccagacccaatagcatgaaggaacaaaatgctaaccactaaacatcacaggtgttttgttttgtttttgtttttttctttattagagacayagtgttcctatgttgcctggctggagggcagtggctattgacaggagtgatcacagctcagtgcagcctcaaactcctaggatcaagtgatcctcctgccttagcctcctgagtagctgggactataggaacacaccaccacacccagctcataagtttgttttcatattgaaaatttcatcaaacctatatcccctgtcagctatggcaaaacatacttacagctcgctgctctgcataagctcgatgagatccataaaaagcacatcccggttcctttcacaaaagccatccatgtca

SEQ ID NO: 161533 - DNA, 601 bp, Human
ttcattgcagtcagccctttaataggaaattatcaggctcgctgctgttgatcagagaagctggccttgctattgtgacagcttaactaacagagagcaaaagggcagctcttacttgaaagaagctctagaaattgtaagatctggcatgcatgggccttgcctcgcaagcatgatggacttgctcatgtaaattacatcttatgtgttatccaggatcttgagaaccttttcagggaaaaggggaggaaggcagaggtggtcttgagagttctagcagcgtgcaagggggataccctcmctcttctacccctacagctgaaacagggtcttgggagttaaaatggatctcttagtcactccttctttagttgtccctcccagagttctcaagccatttcttcagtacttcagggactctggttaatgtgggtcttgctaagccattaaccatctttaaaaattcaacgaccatgaagaagagctcaggggcaaagtatcatagaaccagactgttccactcttaaatagtcagaaatggccatcccaatccaaagccagtgggcttatttctccctgataatagtattgaaaggtagaa

SEQ ID NO: 161534 - DNA, 601 bp, Human
ttgtggcttacctaaacatctcagagaagaacaaattgattatgtatgttttgaataaaaagaaatgcaaaatctcagaaatggtggtgtggctgcaaggaagcgcagggatggagagcagagggtgaggaggggtagggagctacagggagagaagtaaacggagcagaacagctgaccagggcctgaaaaggaaactcttgctttgctttcattgcagtcagccctttaataggaaattatcaggctcgctgctgttgatcagagaagctggccttgctattgtgacagcttaactaayagagagcaaaagggcagctcttacttgaaagaagctctagaaattgtaagatctggcatgcatgggccttgcctcgcaagcatgatggacttgctcatgtaaattacatcttatgtgttatccaggatcttgagaaccttttcagggaaaaggggaggaaggcagaggtggtcttgagagttctagcagcgtgcaagggggataccctccctcttctacccctacagctgaaacagggtcttgggagttaaaatggatctcttagtcactccttctttagttgtccctcccagagttctc

SEQ ID NO: 161535 - DNA, 601 bp, Human
caatgactttttgggcatcttgaattttccaggaagtctccccagcagtctacttttaacttgaccagatacaactacagattttgacatcaagtgtgtttacaaaataataggccatgtccgtatgacagcagtttatgtggaagcaataatagctcttaaacttggcaggaattttaataattttttaaaaacaatctctggaagcaagtctgcacctgactgccataaaacccacaagccaggacttgtggcttacctaaacatctcagagaagaacaaattgattatgtatgttttkaataaaaagaaatgcaaaatctcagaaatggtggtgtggctgcaaggaagcgcagggatggagagcagagggtgaggaggggtagggagctacagggagagaagtaaacggagcagaacagctgaccagggcctgaaaaggaaactcttgctttgctttcattgcagtcagccctttaataggaaattatcaggctcgctgctgttgatcagagaagctggccttgctattgtgacagcttaactaacagagagcaaaagggcagctcttacttgaaagaagctctagaaattgtaagat

SEQ ID NO: 161536 - DNA, 601 bp, Human
cacttcctcctcaatgactttttgggcatcttgaattttccaggaagtctccccagcagtctacttttaacttgaccagatacaactacagattttgacatcaagtgtgtttacaaaataataggccatgtccgtatgacagcagtttatgtggaagcaataatagctcttaaacttggcaggaattttaataattttttaaaaacaatctctggaagcaagtctgcacctgactgccataaaacccacaagccaggacttgtggcttacctaaacatctcagagaagaacaaattgattwtgtatgttttgaataaaaagaaatgcaaaatctcagaaatggtggtgtggctgcaaggaagcgcagggatggagagcagagggtgaggaggggtagggagctacagggagagaagtaaacggagcagaacagctgaccagggcctgaaaaggaaactcttgctttgctttcattgcagtcagccctttaataggaaattatcaggctcgctgctgttgatcagagaagctggccttgctattgtgacagcttaactaacagagagcaaaagggcagctcttacttgaaagaagctctaga

SEQ ID NO: 161537 - DNA, 601 bp, Human
cctcccaggttcaagtgattctcctgcctcagcctcctgagtagctgggactacaagtgcgtgccaccacagctaatttttgtatcgttagtagagacggggtttcaacatgttggccacagtggtctcgatctcttgacctcgtgatccacccaccttggcctcccaaagtgctgtgattacaggcatgagccactgcacccagcctgaagatactttcattagtggtgctatttgagctgcatgtgtttatacgtctgcctcactagcaacagggcagggacaatgccttactcatctyagtgtccctggtgtctgaagcatagcatggtgcacagttggtccataatatgtatttgctgactgggtgaatgacgggatccatgtaaattagcaatctgacattcaaactcaaactcacttcctcctcaatgactttttgggcatcttgaattttccaggaagtctccccagcagtctacttttaacttgaccagatacaactacagattttgacatcaagtgtgtttacaaaataataggccatgtccgtatgacagcagtttatgtggaagcaataatagctcttaaacttggcagg

SEQ ID NO: 161538 - DNA, 601 bp, Human
aacattgcctttccaacgtccctagtcacaggaattgaggtatatcttgacagaacataacagagggaggtcagtaggggattttaggtttttgttttgtttttgagacagggtctcgctctactgcccaggttggagcgcaggggttcaatcatggctcactgcagcctcgacctcccagactcaagccatcttcccacctccgcctcctgagtagctggcactatatataggcagacgccaccacgtccagctaattcttgtattttctttagagatggggtttcgccatgtttcccargctggtctcaaacaactggactcaagaggtgctcctgcctcagcctcctgaagtgttgggactacaggcatgaggcactgcgcctggccagcatgtgtttgttaagacaagcaagatagaccagagctcagggaattatatgaaatgtctggattcagtgcagatgctgctttgctctagagcagagtttctgagtctgggcaccattggtatctgcggctgaataattctttgttgggggccgaggagggcgcctcttctacatattgtgggatatttagcagcatccatggtctctgc

SEQ ID NO: 161539 - DNA, 601 bp, Human
cttgtaacaagcagcgatgttacttctgggcatcttctgtaaccacctcctcacgtctcactgacctcatcctggcccaggggtgcagttccttactcctagaaagcgctagcccttataagaatctataaacttcctaaaatagaactaacctttattttgcttccggcagtagttgggcgccctttcttgtcagcctgcagattttccggaaataaagactttatgaaaggcctggaaaaggagaaagagaatgaattaacaatctgtaagtacctctggggctgaaagcctgcctttytagaggatggggtgaagggccgtccccaggcacataaccttggctacagaaaagccatctgactcacagcgcgggccatcaagatgtgacttggggaaatgaacaacggacaaaagtcatgaagggaaagaattctaagatataagcaatttggaatcaaagactgcaaaataaattttaaaacattgcctttccaacgtccctagtcacaggaattgaggtatatcttgacagaacataacagagggaggtcagtaggggattttaggtttttgttttgtttttgagacagggtctcgc

SEQ ID NO: 161540 - DNA, 601 bp, Human
atcttaagatagactcttaagatagactccattttacagggaagcggtgagggcactgagagcgtaagtaacaccttggcaagcacacagcgaggaaaagccagagctgagattcgaacacaggcgagcaaactcaaagccctgctgtcactcaaccattcctttgattgtaaaactgaggaagtattcagctggtataattttaaaaaaaattattcttaaccagtatgattttaaaaaatagctcagtgagtatttcttacagttacatgattgtgtgtgacacaatgacaaaaactatttttttttttttttggagacagggtctcgttctgtcccccaggctggagcaatcatggctcactgcagctttgacttccttgactaaagcgatcctccttccttagcctcccaagtagctgagagcataagatgtgagccactacacctcatttttatttttagtagagatggggttctcattatatcgcacaggttggtctcgaactcctggggtcaagtaatcctccctcctcggcctccataagtgttgggattacaggccagagccactacatctggctgacacagattttttttt

SEQ ID NO: 161541 - DNA, 601 bp, Human
ctgaatcatcacagtaatctcttaagatagacactaatatcttaagatagactcttaagatagactccattttacagggaagcggtgagggcactgagagcgtaagtaacaccttggcaagcacacagcgaggaaaagccagagctgagattcgaacacaggcgagcaaactcaaagccctgctgtcactcaaccattcctttgattgtaaaactgaggaagtattcagctggtataattttaaaaaaaattattcttaaccagtatgattttaaaaaatagctcagtgagtatttcttasagttacatgattgtgtgtgacacaatgacaaaaactatttttttttttttttggagacagggtctcgttctgtcccccaggctggagcaatcatggctcactgcagctttgacttccttgactaaagcgatcctccttccttagcctcccaagtagctgagagcataagatgtgagccactacacctcatttttatttttagtagagatggggttctcattatatcgcacaggttggtctcgaactcctggggtcaagtaatcctccctcctcggcctccataagtgttgggattacagg

SEQ ID NO: 161542 - DNA, 601 bp, Human
agggactgtcctgaggctactaaatgtctctagttctttcaacatgatgttcttgacgctcagagggctctaccctacagctgaaagcccaggctggactcggtggcttgtgcctgtaatcctagcattttgggagtctgaggtggatcgcttgagcccaggagttcaagaccagcctaggtgacattgtgacaccccaactttacaaaaaagaaaaaaacaacaattaagcagagaccaacaacggcgatacaggaaaggggctaatgggaaagaatgtagtcagagcatacatatacaycttgtgttcagtatgcctcaggcactgcgttacatgcttccaatgaattatgaagctgaatcatcacagtaatctcttaagatagacactaatatcttaagatagactcttaagatagactccattttacagggaagcggtgagggcactgagagcgtaagtaacaccttggcaagcacacagcgaggaaaagccagagctgagattcgaacacaggcgagcaaactcaaagccctgctgtcactcaaccattcctttgattgtaaaactgaggaagtattcagctggtataattttaaa

SEQ ID NO: 161543 - DNA, 601 bp, Human
ttccagccaagaagggttcctgagttaggacagaaaagtaccaacagcacttgctcaacagaagcaggtgttaaaatacgcagacagcacagtgagaaacggctcagggtgaaagctcctcattctaccttcaacagagatgacagcaggcctgactgtgggtcctggcacttttatttgcaagttacatgactaatcactagatttctctggtcctcagttctctatctgtaaactaagtaggttgaactagaagacctctaatttaatctagagattgaaatacatattaaaaaacaawcaatcaggctgggtgcaacggctcactcctgtaatctcagcacttcgggaggctgaggcaggcggatcaattgaagtcaggagttcgagaccagcctggccaacatggtgaaacttcgtctctactaaaaaaaataccaaaaaattagctgagcatggtggtgccacctgtagtccagccacgtgggaggatgaggcaggaggatcgcttgaatctgggaggcagaggttgcagtgagccaagatcgcatcactgcccttcagcctgggtgacacagcaaggctccatctcaagaaaaaa

SEQ ID NO: 161544 - DNA, 601 bp, Human
tttttttttttttttttttttttttgagatggagtctcactctgaggcccaggctggagtgcagtggcgtgatctctgctcattgcaacctctgcctcccgagttcaagcgattcgcctgcctccgcctcccgagtagctgggactacaggcgtatgccaccaggcccaactaatttttgtaattttagtagagatggggtttcaccatgttggtcaggctggtctcgagctcctgacctcaggtgatccacccgcctcagcctctcaaagtgctgggattacaggcgtgagccactgtgyccagcctacaacttttaatttccaagaataactttgcaaactcttttgtcctaagtatttaacagcattccttctttttcacctcagcataagaaaacatagagaggcaagtgtaacttaagtttataagtcacttgccatagtcctctccagctaaaatagtgacagataacatttactgagtttgcagtgcagattagatacatgtattatctcatttacgcctcacaacaacctgaagaggtggctactatttaatattattcctgttttttagatgagaaagctgggccttaaaga

SEQ ID NO: 161545 - DNA, 601 bp, Human
atgatgcagactgcacttgagaacaaatttgatgatttttgcaacacatcaggtggagccggagagggactgcagggttgaatatagcacagcttttttttgttcttaaaatccccaaattcttaattttttaaacttcatttttagattttagttttgtatttaattacgactttttttttttttttttttttttttttgagatggagtctcactctgaggcccaggctggagtgcagtggcgtgatctctgctcattgcaacctctgcctcccgagttcaagcgattcgcctgcctccrcctcccgagtagctgggactacaggcgtatgccaccaggcccaactaatttttgtaattttagtagagatggggtttcaccatgttggtcaggctggtctcgagctcctgacctcaggtgatccacccgcctcagcctctcaaagtgctgggattacaggcgtgagccactgtgcccagcctacaacttttaatttccaagaataactttgcaaactcttttgtcctaagtatttaacagcattccttctttttcacctcagcataagaaaacatagagaggcaagtgtaacttaagttt

SEQ ID NO: 161546 - DNA, 601 bp, Human
ctctgaacaatgtgtgtctgggtctcccagcgggccacaaaattcataccctctagccaccaccttaacaggctcctcctcaatgccgccatttcttcctgcccaggccacttccctaaatcctagctgtgggaggaacagtgatgcaggcttcactggaagtcagggcagaaagggtttgctgaattcttgtgctctgcatttccctttgacatctttcctcccagagtcgttcttctcatcaatacggtgcttagggggaatgccagagcctccagcttgtccccagtgtcttcacgasgcacagcaaatgctggattgtatttccatcagctcttacgccctccactttccaccccaagctaagcattctaggccacatcctgtgggtcccgatcaggggctgggtggactaagaatgtctacacagaacctcaaactgattttaaaaccatcatgactctgcggtatgaggttatgttttgttttttttccatctgcccccagactagccaagatcaacattataaactgctaatgctgaaatgaatggcactgctaacattttagcaaatgacacggaggggaaacagtatacagc

SEQ ID NO: 161547 - DNA, 601 bp, Human
tagaaaagatgccttaagcggtcaggggtggtggctcacacctgtaatcccagcactttgggaggccgaggcagttggatcacgaagtcaggagttcaaaaccagcctggtcaagatggtgaaaccccatctctactaaaaatatagaagtagccaggcatgatggtgggcacctgtaatctcaactactcaggaggctgaggcaggagaatcactggaaaccgggaggcagaggttgcagtgaaccaagatcatgccgctgcactccagcctgggtgacagagcgagactcttgtctccaaaaaaaaaaaaaaatccttaagaatatgcatctatggatgagattattcagaacatagtggcctgaaaagatggcagctcttacatccaagcagcctggcttcttcagaggagagaacagacttagactgcatgccgaagtattcaatattaaatagaacgaactttcagacagtaaatgtttgacctacgtgtttttcttactatggatctgtttcctcctgtaaaggatcaggcatcatctatctgccatggtttaggatcttgctggcaggaaggaaaatggacacacctgtccctc

SEQ ID NO: 161548 - DNA, 601 bp, Human
cgggcctgaatatcattaacggacaatattgtagaaggaatctgactacattaaattgaaaaatttcagagattcaatagaaaagatgccttaagcggtcaggggtggtggctcacacctgtaatcccagcactttgggaggccgaggcagttggatcacgaagtcaggagttcaaaaccagcctggtcaagatggtgaaaccccatctctactaaaaatatagaagtagccaggcatgatggtgggcacctgtaatctcaactactcaggaggctgaggcaggagaatcactggaaaccrggaggcagaggttgcagtgaaccaagatcatgccgctgcactccagcctgggtgacagagcgagactcttgtctccaaaaaaaaaaaaaaatccttaagaatatgcatctatggatgagattattcagaacatagtggcctgaaaagatggcagctcttacatccaagcagcctggcttcttcagaggagagaacagacttagactgcatgccgaagtattcaatattaaatagaacgaactttcagacagtaaatgtttgacctacgtgtttttcttactatggatctgtttcctcctg

SEQ ID NO: 161549 - DNA, 601 bp, Human
agaagagaagattcaagagaaacacgacggtcacctcgaactaacagaaaaggtgtccagtggcaaagtaatgagaatgattcttatcgcagattgaaaacctgggattaggataaaagtgacctagagaaggactgtacagcctcctaaagtaagaattgaccaaagaagagctggtcaccttagcaagtatgagctcctcatccgggcctgaatatcattaacggacaatattgtagaaggaatctgactacattaaattgaaaaatttcagagattcaatagaaaagatgccttaagsggtcaggggtggtggctcacacctgtaatcccagcactttgggaggccgaggcagttggatcacgaagtcaggagttcaaaaccagcctggtcaagatggtgaaaccccatctctactaaaaatatagaagtagccaggcatgatggtgggcacctgtaatctcaactactcaggaggctgaggcaggagaatcactggaaaccgggaggcagaggttgcagtgaaccaagatcatgccgctgcactccagcctgggtgacagagcgagactcttgtctccaaaaaaaaaaaaaaatcct

SEQ ID NO: 161550 - DNA, 601 bp, Human
ggcagcaattcagaatgcagggcaagcaaccttgccagaagccaaacaaaaacgcatttgcaacaggaaaagaaaaaccctacacctcataaacttgtggaatgagtaaccctctttaccaggagcttcaactgggtgtgtaatcccagccagtgaagcacactgccctttcacggaccctaacactcctgactcatggatggagtgaaaccatttgttacacaataaacccaaaccaggattaagggtggaatcccagaaagcggtcttactggaattataaatcaacgctcgaccaactaataccttgaacttcttaaaaccagtttatttgaatgcatgtcataaaattctttgctgcaattcaaaggggaatcatttaaaaaaaaaaaaaagaaaagagaaaataccatcctcatcctatgaggatttactgaataaaatgtaccactcatttaatttctccattttctgatattccaatgaattatgttggatttttacaaggaagtagcatcagggttggtgaacttccaagcagctattgcaaaatttctattttagaggggctttcagtagaactatctacgtggggtagagg

SEQ ID NO: 161551 - DNA, 601 bp, Human
atgaatcacataggaaggaatattcctcatgttaaaacattgtttcattcattataacttccaccatcaggaaattttctggtagaaatgagtctagcaagtcctgtaatgtttaaaatttgggggtcatcaaagcgacacaagttgatttttgcatattcctggagcactgtcacctcctcagtagtcgttgatcagacaatgcccagttgttccctaggctatgccaactccatcttgcagagggagtctttttccaagactgtccctggccgtttactcaaattgatcagggctagasaactctgcaaggcagcaattcagaatgcagggcaagcaaccttgccagaagccaaacaaaaacgcatttgcaacaggaaaagaaaaaccctacacctcataaacttgtggaatgagtaaccctctttaccaggagcttcaactgggtgtgtaatcccagccagtgaagcacactgccctttcacggaccctaacactcctgactcatggatggagtgaaaccatttgttacacaataaacccaaaccaggattaagggtggaatcccagaaagcggtcttactggaattataaatcaacg

SEQ ID NO: 161552 - DNA, 601 bp, Human
gggcatagtggctcacgcttgtaatcccagcactttgggaggccgaggcgggcaaatcatgaggtcaggagttcgagaccagcctggccaacacagtgaaaccccgtctgtactaaatatccacctttgcccatataagtcagacagacagagacagagagagagagagagagagagagagagagagagagagaaagaaatgtcatgtcaattaaaaaggtaattaaattgaaaaataattaattttcctttctctcaccctccaaatctaaaactcgccactggccttttctctagtgaraaaaatgcatgaaaaatgcatttaaaggttctgctcattttaaagtacttttcataaacactggcttcacgccaagctttcgaggcagggaatgcatcacccattaattcaagcagaaacgttcctctcccatgaatcacataggaaggaatattcctcatgttaaaacattgtttcattcattataacttccaccatcaggaaattttctggtagaaatgagtctagcaagtcctgtaatgtttaaaatttgggggtcatcaaagcgacacaagttgatttttgcatattcctggagca

SEQ ID NO: 161553 - DNA, 601 bp, Human
ttaagagtctccagtttgatgggtcttacagagccaagagccagaaatgttgattcctctaagattattaactttcagaaagcctctgtgtgcaaagagttaagccgggcatagtggctcacgcttgtaatcccagcactttgggaggccgaggcgggcaaatcatgaggtcaggagttcgagaccagcctggccaacacagtgaaaccccgtctgtactaaatatccacctttgcccatataagtcagacagacagagacagagagagagagagagagagagagagagagagagagagaragaaatgtcatgtcaattaaaaaggtaattaaattgaaaaataattaattttcctttctctcaccctccaaatctaaaactcgccactggccttttctctagtgagaaaaatgcatgaaaaatgcatttaaaggttctgctcattttaaagtacttttcataaacactggcttcacgccaagctttcgaggcagggaatgcatcacccattaattcaagcagaaacgttcctctcccatgaatcacataggaaggaatattcctcatgttaaaacattgtttcattcattataacttcca

SEQ ID NO: 161554 - DNA, 601 bp, Human
caccaccacacctggctaatttttgtattttttggagagacagggtttcgccactttgcccaggctggtctcaaactcctgaactcaattatctgcctgctttagcctcccaaagttctgggattataggcatgagccactgtactcggcgtgtttcttcctttcctttcccttcactttcccttcccttttctttctttctttccctttccctttcctttctttctttcgagacagagtctcgctttgtcatccaggctggagtggagtggcaaactttctttcctttctttttcttttttttctttctttcttgagtcagagtctcactttgtcatccaggctggagtgcagtggcaaactttctttcttttctttctttcttgagacagagtcttgctttgtcatctaggctggagtgcagtggcaaaatctcggctctctgcaaactccgccttgtgggttcaagagattctcctgcctcagcatctcgaatagctggaattacaggcatgtgccaccatgcctgggtaattttttgtcttttttcgtagagacggggtttcgccatgttggccaggctggtctcgaactcctggcc

SEQ ID NO: 161555 - DNA, 601 bp, Human
acagacatttctccaaagaggaaatacaaatggctaacaggcacatgaaaaaatcctcaatataatttgccatctgggaaatgcaaatcaaaaccatcatgaaataccactccacactcactaggatggttagaaaataacttatgttggcaaggatttagataaattggaagcctcaaatactgctggtggtacaaaatgtgaagtggtgcagccacttcagaaaacaatcaggcagttcctctcaaaggttaaatgcagagttaccatatgaccaagcaattgcactttgaagcatatrcccgaaagaaatgaaatatgaccacataaaaacttgtacacagattttcatagcagcattattcataatagccaagaagtggaaacaactgacgtttatcaactgatgaatgcataagtaaactgtggtatatccacacaatggaatattattctgcaattaacaggaaggaagcatggaaatgcaacaacatggatgaatcttatgttcagtgaaagaagtcagtcacagaggacacatatatgattccattgctatgaaaagcataggcaaatctatagacagaaggtagataagtga

SEQ ID NO: 161556 - DNA, 601 bp, Human
tactgatttattctacaataaataacagtaaaagaattattattacaatgcaatgataaaaagacaaaacacccaattaaaaaatggcaaagggcctcacagacatttctccaaagaggaaatacaaatggctaacaggcacatgaaaaaatcctcaatataatttgccatctgggaaatgcaaatcaaaaccatcatgaaataccactccacactcactaggatggttagaaaataacttatgttggcaaggatttagataaattggaagcctcaaatactgctggtggtacaaaatgtraagtggtgcagccacttcagaaaacaatcaggcagttcctctcaaaggttaaatgcagagttaccatatgaccaagcaattgcactttgaagcatatacccgaaagaaatgaaatatgaccacataaaaacttgtacacagattttcatagcagcattattcataatagccaagaagtggaaacaactgacgtttatcaactgatgaatgcataagtaaactgtggtatatccacacaatggaatattattctgcaattaacaggaaggaagcatggaaatgcaacaacatggatgaatc

SEQ ID NO: 161557 - DNA, 601 bp, Human
ctacatttggcttacttcttttttgtttccctattccttcaaggaaattaaatagatgtagaaatacagtggaacgccacagaatcattagagaagttagagtgatgtaacattttaagggtaccacattttatccttttacaaacaacacaaaataagaacaatttaagtataggtcctgccaaatacatgttaagggatatataaaaataagtttaaatttatacatggattgtacaaaatttttgaggttaaatattttaagcttattgtcttaagtgggttaaacattttcctgaawttgtcttcatactgttaatttattcagtcaagttaaacctccgctcttcctgtggcacaattatcaagaattcttgcacttatgtgttacactaaacagacagcctaatgaatacttatggctactgatttattctacaataaataacagtaaaagaattattattacaatgcaatgataaaaagacaaaacacccaattaaaaaatggcaaagggcctcacagacatttctccaaagaggaaatacaaatggctaacaggcacatgaaaaaatcctcaatataatttgccatctgggaa

SEQ ID NO: 161558 - DNA, 601 bp, Human
aaacattatatccagcccctgcataatatatcaggaagatgtaattgtttctgattaaaatgctcagtttgacgcggtgtggtcgctcgtgctgataatcccaacactttgggaggttgaggtgggaggatcacttgagagtagctggggcaacatagcgagaccctgtctctacgaaaagtaaaaagtcatctgggcatggtgatgcatgcctgtagtactagctacttgcagactgaggtgggagagaatggcttgagcccaggagttcaaagatgcagtgagttatgattgcaccackgcactcctgagtaatagagcaagactttgtctctaaataaataaataaaacactacatttggcttacttcttttttgtttccctattccttcaaggaaattaaatagatgtagaaatacagtggaacgccacagaatcattagagaagttagagtgatgtaacattttaagggtaccacattttatccttttacaaacaacacaaaataagaacaatttaagtataggtcctgccaaatacatgttaagggatatataaaaataagtttaaatttatacatggattgtacaaaatttttg

SEQ ID NO: 161559 - DNA, 601 bp, Human
agtcctgcttacactataggcgtactgacgtctttaattcagagaacaaagagggtaaaccttgttcctagtctaactcacctccacggttattaggaaactcaaatgtgggggactgagtttctgacgctttattatacaaaatcattagctcttttttaaaacctctaaatggtgagtcggctgtcctaatctcatagcagaagaaacaacagccctaaataagaactgtcttattagaaatactagattccaaagacagtaattaacttcttcttcagttatatacaatctgaatttaaaaaaaaaaacattatatccagcccctgcataatatatcaggaagatgtaattgtttctgattaaaatgctcagtttgacgcggtgtggtcgctcgtgctgataatcccaacactttgggaggttgaggtgggaggatcacttgagagtagctggggcaacatagcgagaccctgtctctacgaaaagtaaaaagtcatctgggcatggtgatgcatgcctgtagtactagctacttgcagactgaggtgggagagaatggcttgagcccaggagttcaaagatgcagtgagttatgatt

SEQ ID NO: 161560 - DNA, 601 bp, Human
tctgtttaaggaagtctcataactaacatctcagttgtgtgtcagcaaatgggtggtgctatgtgatgcaaaagctctacaaataccttttctcaacttcctaaatatttctttcacatagtcctgcttacactataggcgtactgacgtctttaattcagagaacaaagagggtaaaccttgttcctagtctaactcacctccacggttattaggaaactcaaatgtgggggactgagtttctgacgctttattatacaaaatcattagctcttttttaaaacctctaaatggtgagtcrgctgtcctaatctcatagcagaagaaacaacagccctaaataagaactgtcttattagaaatactagattccaaagacagtaattaacttcttcttcagttatatacaatctgaatttaaaaaaaaaaacattatatccagcccctgcataatatatcaggaagatgtaattgtttctgattaaaatgctcagtttgacgcggtgtggtcgctcgtgctgataatcccaacactttgggaggttgaggtgggaggatcacttgagagtagctggggcaacatagcgagaccctgtctcta

SEQ ID NO: 161561 - DNA, 601 bp, Human
gcccacctcggcctcccaaagtgctgggattataggtgtgagccaccgtgcccggcccctcttaattaaaaaagggtattttggggtcgggcatggtagctgatgcctgtaatcccagcagtttgggaggctaaggcaggaggactgcttaagcccaagagttcaagaccagcctgggcaaccaagggagaccttatctctaaaataaataaataaataaaatttaaaaatgattatctaagccaaagttcctcaactgactgtgccctgtagggggaacattagtcaatgcctggatacrcttttggatgtcacaactcagaggaaggtacactactggcatctagtgggtggaggccaagaaggctgctaaacatcccacaatacacaggacagacttcgcagcaaagaatcttccagcctaaaatgtcagtggtctgaggttgagaaaaccttttctgagctagtgttactgatctgtttaaggaagtctcataactaacatctcagttgtgtgtcagcaaatgggtggtgctatgtgatgcaaaagctctacaaataccttttctcaacttcctaaatatttctttcacatagtcct

SEQ ID NO: 161562 - DNA, 601 bp, Human
cagcattgtttatggaagtcagtttggttggttggttggtttttaaaacaaggtagaaggaaggaggtctttcagaactggtttctcaaaaaacaaacaaaaaaacccagaatagattaaaaaaggtttgatcaggtttttttttttttcttgttttcttgagacacagtcttgctctgtcacccaggctaactcactgtggccttgacctcctgggctcgagtaatcctcctgcctcagcctcccagtgttctgggattacaggcatgagccactgcacctggactgataagtttttttkggggggtggatacatagtaggtatacatatttatgggttgcatgagattttttttcttttttactttttgcatgagatgttttgatacaggcatgcaatgtggaataaccacatcatggaaaatggggtgtccatctcctcaaacatttattctttgtgttatatgaaatccaactatactcttttagttgttttaaaatgtacagttaaattatatttgactatagtcacccagttgtgctaggaaacactaggtcttactcattctttctatttttttgtatgcattaaccatctgca

SEQ ID NO: 161563 - DNA, 601 bp, Human
cctcaccccatcctttggtatcgcactggagaccagggcataaaccaacaacacatgttctcctaccaagtgtacccaggccactctctttctctaggatatactcatgggaacaggttgcacagggcaatggtgcccctgcctaactggtgcctgtgataattttggacagatggcaataatagcttacattcctttcatcacatattttcagtttaagactcaaatatgctaatatttcctctcaaggcctttgtgccagctcctctttctgcctggaaatctgttccctgctcttgtkatctcttggatcactgatcccatgtttccttctcagaggaaatgcagctgggaccccagggactcccagctgctggcacttgagattaaggatgtttctgacctcggaggacacaaacatcctggcagccaggaggacgctctccaccactccgtgctttcctgggcttcctattcctccttctctcttgcccgtgaagtggaacgcctttgctgatgaggcatccctttatcatccccacattctgagaggctaaggtcagaggaagcatgcttgtgaggaagtgtaaatcatgctaca

SEQ ID NO: 161564 - DNA, 601 bp, Human
gcccaaggctacttagccattaagcgtcagagatgggatttgaatccctctctgtctctttcatgatggcactgtaaaaaagccatggactggttcacatttaaatatttcttttaaagattatccagtctactatacatgcctatgttagaaacattactattatgtcagaggctgatataatcaaggagagacaaacacattacagtttgtcaaatatggatagaatcatcatgggtatgtgtgggtgtgaagttggagggcgtggcccacgtgagagcacatccagggcccaggcaayaggcccccaggccttgagcgaagccagggccctcctttgttcccagaaactactgtcacgattagactgatttatgacagccaagggagaagggaaccttgagtggccctgccagctggttgcgactcaggtgattttaggagccttctctgctcctctcaaatgtctgcatcttgcctgataatatcataaacttcctagagaggtaaatcctcctattccctaattagagataaaaagcttaaaaatgaaaatgcctagtggaagtcacacattagcatgaataacattcatatatgt

SEQ ID NO: 161565 - DNA, 601 bp, Human
cacagccttctaggtacaatcctgggaattcccacccggcactctgctgcaccttccaggaggaatcctgagactatgcgtaactgacttggtgtcaactaaccatgggtgggacactgaagtccctctttagcttagacactcttagagattaagtaactattgagcattttctgtgtgaggctttgggtatataaacacatatggaacaaagagtccctgccctccaggagtgtagcagctagagaggagcgagacagtcagtgaggaaggagccactctctgatgcccctttttctayctgcttagtgctctgcaggaaatgaaccgggcagtgatgggctatggagagcaggtgtttagggaaggacccacttagaccaggaagggagggaaggcttctttgaggagacaacattgatggcatgaagcgaagaatgagaaaaagaagccagctgaggggtggagcagggctggcgggggccccgcgggagggaagagagtggagagccagccaagcactcacagactcgggggctttgatgaacactttactcctccccagctggaactggtcgctgtccatgttgaccgactgcag

SEQ ID NO: 161566 - DNA, 601 bp, Human
aaagaagtgtctctaaatgaagctgtagcagactgtttgtgaattgtaaatgtgtattatgaatgccttactggtaagtactgtgttctataaaccagagatttctcctcccacctattttccccctcacagtcctttctaggctcccccacagccttctaggtacaatcctgggaattcccacccggcactctgctgcaccttccaggaggaatcctgagactatgcgtaactgacttggtgtcaactaaccatgggtgggacactgaagtccctctttagcttagacactcttagagaytaagtaactattgagcattttctgtgtgaggctttgggtatataaacacatatggaacaaagagtccctgccctccaggagtgtagcagctagagaggagcgagacagtcagtgaggaaggagccactctctgatgcccctttttctatctgcttagtgctctgcaggaaatgaaccgggcagtgatgggctatggagagcaggtgtttagggaaggacccacttagaccaggaagggagggaaggcttctttgaggagacaacattgatggcatgaagcgaagaatgagaaaaagaagc

SEQ ID NO: 161567 - DNA, 601 bp, Human
acaggcgtgagccactgcgcgcggttatgatgtgggttcttaaagcaaataggtaattttgtatattcagaacatttactattaaggtgaaaccacatggtaggttttctttttcctttttttttttttttcttttttttagagaaagggtctttcttgatctgttgcccaggctggactgcagtggtacaatcatagctcactgtaaccttgaactcctgggctcaagtgatcctccaacctcagcctcctgagtagctaggacagcaggcgtgtaccaccacacccagctaattttaamtttttttgtagagaagaggtctaactgacttgcccagtcttgaactcctggcctcaagtcatcttcccaactcagcctcccaaagtattgagattagaggcatgagccactgtgcccagccagattttaagagtcaacttttgtgaaagtatttgcatgtcagggctagatggggatgtatgcgtttggggcaggggagagagcggaggtgatggtgtgcgtgtgtgagtgcatgtgtcaaagatgggggaaaggagagtcaaataatggtaataacacaattgaatgtaaggcaaggaa

SEQ ID NO: 161568 - DNA, 601 bp, Human
cgccaccatgcccggctaattttttttgtatttttagtagagatggggtttcgccgtgttagccaggatggtcttgatctcctgacctcgtgatctgccggcctcagccccccaaagtgctgggattacaggcgtgagccactgcgcgcggttatgatgtgggttcttaaagcaaataggtaattttgtatattcagaacatttactattaaggtgaaaccacatggtaggttttctttttcctttttttttttttttcttttttttagagaaagggtctttcttgatctgttgcccaggstggactgcagtggtacaatcatagctcactgtaaccttgaactcctgggctcaagtgatcctccaacctcagcctcctgagtagctaggacagcaggcgtgtaccaccacacccagctaattttaaatttttttgtagagaagaggtctaactgacttgcccagtcttgaactcctggcctcaagtcatcttcccaactcagcctcccaaagtattgagattagaggcatgagccactgtgcccagccagattttaagagtcaacttttgtgaaagtatttgcatgtcagggctagatgg

SEQ ID NO: 161569 - DNA, 601 bp, Human
tggagctggacgtgaggtgtgttaatgaggacttgcatttgcccagaaaggctggggctgtttagggaccacatcagcctctagcaggtcttgagagtccggccattttaccaatgaatgctgacagctgcgcctcaaccaggccttggaatgataaaggtgacagcaaacagctgtagtgagccgagtgcccactatggggcagaagtcaccctagatgatttccacacagtttcattcaacgcctccacagctacatgagccgcatactctgtcatctctattttacagatgagaacaytggaactaagactgggtggggctagaaagtgaacctaggtctttcaggctctgccaggctcctcctcatttagacacgcaaagctttctctgtaaatctgcacttgatccacttgtaaaatagtaggaaaccttctcatttaccttgagagtggcttacatgactctctaggaaaaaaataaaatcaaccaataaaaatccaaagtaaagatgatgaacagtcattgcaaaaatgttccagaagtaaacaagccaatgtggtttgaaggcagctgggcttgatttgttgtctctgtttat

SEQ ID NO: 161570 - DNA, 601 bp, Human
gcatgcagcctctaaacagaattttccagtttctgcaggagctgggcttgtgctgctgtggaaggagggctgccctactttcagttccaagaaaatatagacttcctgtctcaggattcaccaatctcaggattcaccaaggagcagcggagcagaggataataaccacagtgactggagctggacgtgaggtgtgttaatgaggacttgcatttgcccagaaaggctggggctgtttagggaccacatcagcctctagcaggtcttgagagtccggccattttaccaatgaatgctgacrgctgcgcctcaaccaggccttggaatgataaaggtgacagcaaacagctgtagtgagccgagtgcccactatggggcagaagtcaccctagatgatttccacacagtttcattcaacgcctccacagctacatgagccgcatactctgtcatctctattttacagatgagaacattggaactaagactgggtggggctagaaagtgaacctaggtctttcaggctctgccaggctcctcctcatttagacacgcaaagctttctctgtaaatctgcacttgatccacttgtaaaatagta

SEQ ID NO: 161571 - DNA, 601 bp, Human
ttattccccaccttgatccaaagagtatattattaggaagtcagatcaagtgagtgggtggaggctgttgctgttgtttggcgcggcacttctgcatgcagcctctaaacagaattttccagtttctgcaggagctgggcttgtgctgctgtggaaggagggctgccctactttcagttccaagaaaatatagacttcctgtctcaggattcaccaatctcaggattcaccaaggagcagcggagcagaggataataaccacagtgactggagctggacgtgaggtgtgttaatgaggacytgcatttgcccagaaaggctggggctgtttagggaccacatcagcctctagcaggtcttgagagtccggccattttaccaatgaatgctgacagctgcgcctcaaccaggccttggaatgataaaggtgacagcaaacagctgtagtgagccgagtgcccactatggggcagaagtcaccctagatgatttccacacagtttcattcaacgcctccacagctacatgagccgcatactctgtcatctctattttacagatgagaacattggaactaagactgggtggggctagaaagtga

SEQ ID NO: 161572 - DNA, 601 bp, Human
agaccttgtcctgccttgctacagtctctgtgagaatcgaatgagcgattcaatgcttctccacttattccccaccttgatccaaagagtatattattaggaagtcagatcaagtgagtgggtggaggctgttgctgttgtttggcgcggcacttctgcatgcagcctctaaacagaattttccagtttctgcaggagctgggcttgtgctgctgtggaaggagggctgccctactttcagttccaagaaaatatagacttcctgtctcaggattcaccaatctcaggattcaccaaggascagcggagcagaggataataaccacagtgactggagctggacgtgaggtgtgttaatgaggacttgcatttgcccagaaaggctggggctgtttagggaccacatcagcctctagcaggtcttgagagtccggccattttaccaatgaatgctgacagctgcgcctcaaccaggccttggaatgataaaggtgacagcaaacagctgtagtgagccgagtgcccactatggggcagaagtcaccctagatgatttccacacagtttcattcaacgcctccacagctacatgagccgcata

SEQ ID NO: 161573 - DNA, 601 bp, Human
atctcagaggcaggcagttagcacgtaccttgaacctcctgtcatacttggtgactgtgtctgcgaaatcaatcttctccctcttgcccacgaactgctggagttctgggtgctcttccatcccaatataatcccctataaagttcctgttaatactgtttctccttctctccttcttgttcaataagaggtctgaggctacaattcccaagagggtcaagatggaagaaggataagtcagtcagaaaagggaggaaaatactgtggaaatatacaaagaaactctaaatgatgcaatatktttagcgtgacattatatgcaaaataaaatggaacttaaaacttcacttaagctccaatttactcttcagatttattaaaatcaatgaaacaaaattgctaaaataccttcttctctcatttgaacgtatttcttccgggccacgaatttcctccatgatttctgtatcactcgagcatacccatcatactttctctctctcatctcttctaaaagaaatagctgtgaatggagagaagacaaatgtgagccaagccccaagccccaatccctgaacaacacttttcttgttattccagg

SEQ ID NO: 161574 - DNA, 601 bp, Human
cacaggttgcaaggaatggtttggttttagcaaaacatgcttccgttgtttatttcgttaaatttttttcttgacctccccgcccctggcaaaaagccaaaagctcttaacgggtccatgagcttctgaagcttcagatttttctattaggaccaagactttatcaaaaggtatctaaaggaggaggtgaaaaatcaactgttcctcctgtggctggaaaagccttacttatcagccactctgggaaaatggatgaggatactctgcaatattacttgatactctgaatcctttgattcarcgatttcactcctatcaatttcttctaaaaatattaggagacagatagatacacaaagatgtgtgaaaagatgctcactgaagttacgatagtaaaaaagaaaaactcactaaaaattgattcatgagaaactggttaaaaataataaagcatctgtcaaatggaatactatgcagccatgtaaaataacttatattgctaactgtattactatcgaaaattctcgcattatttaaaagacaaacaaacaaaaaaccacttcaggacataaaacagcatgtaatgtatatctcatttttt

SEQ ID NO: 161575 - DNA, 601 bp, Human
ttcacacagtggactgctgttaccaggacagggggaagctgccttggacagtcaatcttcactactgttgagaggccattccattcatcacatgaccgggccccatgacagtgaaagagggcattgttcatgattattaggatgacatgtaaaaaatgatgacatttgactctttttgacttaaaaactggcaaactcatatggagtcacttcacatatcaggacagcaggtgtaaagggaaagtcaccaacacctgtggtgaacttagcaaggatgcactacagcatgtttctaaacagrgggcagtgtctgcatatattttcttgggagttcataaaattttcattctaaaatactgatatattgtcatttgaatgataattctcaataatctaatagaaatctacttgggaatttgtgggtaaccactttataatgagtaccgctgcgagagctaagcacccctgtgtgcatccagggctgccgtcacagcagctggtgccatgcacaggttgcaaggaatggtttggttttagcaaaacatgcttccgttgtttatttcgttaaatttttttcttgacctccccgcccctggcaaaa

SEQ ID NO: 161576 - DNA, 601 bp, Human
cttcctcctggctgtttggaacagcggaccgtgatgctgaggcgagaaggggcagtcctgcctctgcacctccactactcacctgagggacacagacaagatccgttctatctcgattttccgcttcaggacttctttcaccaggcccttgtctgggccctgtttgactttttctcgtccgattaagtacaagcactttggggtaaggagcaggtctcgctttacaccctgtaaggagaggagctttaagaagctggacaggccaggcatggtggctcacacctgtaatcccagtactttcggaggccgaggcgggtgaatcacctgaggtcaggagttcgagaccagcctgaccaacatggtgaaaccccgtctctactgaaaatacaaaaattagctgggtgtggtggtgggcgcctgcaatcccagctacttgggaggctgaggcaggagaatcgctttaacctgggaggtggaggttgcagtgagccgagattgcgccattgcactccagcctgggtgacagagcaagactccgtctcaaaaaaaggtggacagacatggtcaatgtgatgacaacaattcacacagtggactgctg

SEQ ID NO: 161577 - DNA, 601 bp, Human
ctccctaaggaagtcccaaagaaacttccctttcaggaccctctgctcagggaaatgggtgaggcctccaacctgggtgaggtggactgggggacagggctctgaatccttggctctactgcaacaagagaaattattctctgaggtgttccatataccgggttcatttctaacatgtttcggttacaagagatctgggtcccccttgattagaggagctgtccggaggcaaccttttcttggtaccttcttcctgacatatcaagacttgctgagactagggagtcttccctttgggacraagggaaattccattctcttgatcatgattttgacagctgggaagcccagcccggccttcctcctggctgtttggaacagcggaccgtgatgctgaggcgagaaggggcagtcctgcctctgcacctccactactcacctgagggacacagacaagatccgttctatctcgattttccgcttcaggacttctttcaccaggcccttgtctgggccctgtttgactttttctcgtccgattaagtacaagcactttggggtaaggagcaggtctcgctttacaccctgtaaggagaggagc

SEQ ID NO: 161578 - DNA, 601 bp, Human
tgcaaaatggacactgcggactcatctgcttagcaactttaccacatcctgagttggcacgttttaaatacttcactgcactgcactgcctggccctttatccagggaaattaggaacagatagaatcagaaaccacagagacacaggcaagaatggatgcaactagaaatctgttttggattatcagactggaactaggatttccagcttggtacatcagacgcctgagcacataaaacccctgctttttcctgagcgcaccagttttgccttctgtgtggagtaagagtttgacaggcrtcccaattccatgttcatgtgagagcagaacatctttaatgcaaaggcccaaagcttttcctgattaaagtagtgttagcctcagaggcccagggacacgattcttggaggaagctatggggctcaaggaggcctttcttccattcttagtcttcatggattgcgaggatttcctgtgtcagcggaacttagtctaggagttcttaccatgggaggacttcgggaggacttagcatgggaggactcctagtctgggagttcttggcatgggaggacttcttagcatgggaagacctccta

SEQ ID NO: 161579 - DNA, 601 bp, Human
gtcactctcggcacagcgactacacacaccctagagctgtggttccctgactttcacctgctgtgcctgccaagcacgctgtggccaacctggcttagtccaggcatggcagggccccatgcaatgacaaacaaagcaggagcttcctgttgggtttccacggcagcctcagggcccagctagccaggaagagtgtggccagcaggcactgccccgctcaggttgggacccagccagtgagctgaatgtttaggaaggccttcagaaaatcagtcagcgcctagagctttaaaaaaaaaamaaaaaaaacaatagccttgaaacctacctgaggtggggctgcaaaatggacactgcggactcatctgcttagcaactttaccacatcctgagttggcacgttttaaatacttcactgcactgcactgcctggccctttatccagggaaattaggaacagatagaatcagaaaccacagagacacaggcaagaatggatgcaactagaaatctgttttggattatcagactggaactaggatttccagcttggtacatcagacgcctgagcacataaaacccctgctttttcctgagcgca

SEQ ID NO: 161580 - DNA, 601 bp, Human
gcctctaatcccagcactttgggaggctgagatgagtggatcacttgaagtcgggagttcaagacgagcctggccaacgtggtgaaaccttgtctctcactaaaaatacaaacattagccaggggtggtggctcaggcctgtaatcccagctactcgggagcctgaggcaggagaaccacttggaccagggaggcagaagttgcagtgagctgagatcacgccactgcactccagcctgggtgacagagcgagactctgtctaaaacaaaacaaaacaaaacaaaacaaaacaaccacacmaatgtagctcaattaggataatttatggtcccagtcatgagcactccaccaggggtctgagggactgaagacatacctgggcaataacagaaagaacaagtcactctcggcacagcgactacacacaccctagagctgtggttccctgactttcacctgctgtgcctgccaagcacgctgtggccaacctggcttagtccaggcatggcagggccccatgcaatgacaaacaaagcaggagcttcctgttgggtttccacggcagcctcagggcccagctagccaggaagagtgtggcca

SEQ ID NO: 161581 - DNA, 601 bp, Human
gatacaagtgtagctcaaggccaggcacggtggctcacgcctctaatcccagcactttgggaggctgagatgagtggatcacttgaagtcgggagttcaagacgagcctggccaacgtggtgaaaccttgtctctcactaaaaatacaaacattagccaggggtggtggctcaggcctgtaatcccagctactcgggagcctgaggcaggagaaccacttggaccagggaggcagaagttgcagtgagctgagatcacgccactgcactccagcctgggtgacagagcgagactctgtctcaaacaaaacaaaacaaaacaaaacaaaacaaccacacaaatgtagctcaattaggataatttatggtcccagtcatgagcactccaccaggggtctgagggactgaagacatacctgggcaataacagaaagaacaagtcactctcggcacagcgactacacacaccctagagctgtggttccctgactttcacctgctgtgcctgccaagcacgctgtggccaacctggcttagtccaggcatggcagggccccatgcaatgacaaacaaagcaggagcttcctgttgggtttccacgg

SEQ ID NO: 161582 - DNA, 601 bp, Human
ctttatattaaaattaaccacaaaacattatcatacctacagaaataaacaataaattcttcataccaaatatttagtcatgctcacatgttgtcttgtaactgttactgaatggttggttggtttgaatagggagctgtaggcccactgtgcactgacattaattgtaagagctagagatgggctaagatcaagcttatgggatactttgataaatcgtaactaggaggccatatgttgatatcattccagccaatagtcaactggtcaatctcagaaattcttaaaaacacatacagaygttgcagcttttttcctgaagtacaagccaactgttaaaatctttctctatgccagtactgaagtattttgagaacacacacgcatgttcagtagtctggtaccagaattaatttccactctgggttcgattctgcacacacatcaccctctggttgctttcctaacttggttctgattactggcctaactcaagtataaagaaatgaggggacactattattcatcttggcaagtgtgaggttcagtgactgcaatacacagacatcacaagttcaaatgactcacactttcttttttt

SEQ ID NO: 161583 - DNA, 601 bp, Human
gagtagctgggaccacgggcacgtaccaccactcctggctaattttcacattttttgtagagatgggttcttactatgttgcccaggtgggtcccaaacctcctggggtcaagcgagcctcctgccttggtctcccaaagtgctgggattacaggcgtgggtcactgcgctcagcctttatttcatgctcaaatgtttcagtacatatcattaaaagataaagtctctttatattaaaattaaccacaaaacattatcatacctacagaaataaacaataaattcttcataccaaatattyagtcatgctcacatgttgtcttgtaactgttactgaatggttggttggtttgaatagggagctgtaggcccactgtgcactgacattaattgtaagagctagagatgggctaagatcaagcttatgggatactttgataaatcgtaactaggaggccatatgttgatatcattccagccaatagtcaactggtcaatctcagaaattcttaaaaacacatacagatgttgcagcttttttcctgaagtacaagccaactgttaaaatctttctctatgccagtactgaagtattttgaga

SEQ ID NO: 161584 - DNA, 601 bp, Human
actcttcccgagtctccaatgaagccagaaatgcaagcgtcagtgtttcactttaatttttatttatttatttattttgagacggagtctcgctctgttgcccaggctggagtgcagtggtgtgatcttggctcactgcaccctccgcctcctgggctcaagcgattctcctgccgcagcctcctaagtagctgggattacaggcacacaccaccatgctcaactaatttttttgtatttttagtagagagggggtttcatcatgttggccaggctggtcttgaacgcctgacctcaagcratcggctcgcctcggcctcccaaagtgctgggattacaggtgtgagccaccacacccagcctaatttttatttaaataaggatttttcctgatcaaattatcctggagtccctttgacaaactattgtcttaatatctctctgagctattggccctatttctacctgttgggatcctattttttcttgtaaatgaaaacttcaaaaaaatttttaaccgtaactcaactagacatatatctgtatgtttagaaaagataaagacttctaaaaatttaacatctactggaggattagaaaa

SEQ ID NO: 161585 - DNA, 601 bp, Human
caaaagagctcttccaagtcattttgaattaataaagtctaagcctcctggcaccctagcccaggtgtaagaacccggctgcattaggtagagtgcatgcaaaagaccagagtaaaacaagaagctccactttttggcctttggggtgaggaatgaaacgccttcctgttttggttgtttgctcaaagctttctttggcatgtctggtcatgcctggtggcctggctgaactgtggcaggatggtgattattcaacagggctaaatgagcccaacacaagtcaccttgagtggtttaatgkgcttagatttattaggagtttcattactattataacgaaaaaagcaagcgggccaaaacttcaaggtcaattatcagcatgaatctagaaatgagaagagatgtgtttggacactttgactttaaccaacaactccaaaatcccctcccttcaatgatccaggcattggagctaggcagaccaccttcacccaggccagggtctcagctcattctgctctccttagcccatgctcctgaacctgaaaacaaagctttcgtgtttatttattctaaaaagtcagacttatctttggacttc

SEQ ID NO: 161586 - DNA, 601 bp, Human
tcccggtctctagaactgtaaaaattaaattcttactgtttacatattacccactttcagtcctcctacaggaaaggggcttggtaatccacaggagaaaaagaggtcgaaggaaccacagcacaattggataggaaggcgtagaatggcagtacgcgcaaaccatgggggtggggcggggcggtgaatggagttcactggaagcaagaggccagtgtcaggggaaaggagcttggtcctttcatggccagcttactgaagagcagccaaagagtttcccttggacgtaaagtcagaaccytttacagtgttttttggacaaataatagccatttgggtggaacacttggtcattatcattacctcagatgtttgttttcagacatccacacatcatagccatgcttcttgcccactcctgtgatagttgggatcaaggataaaccctgacaagcagtggtttaaacaatagacggttttcatctccgtcactcaacagctcatgcaaaggcaattcagggccaacgtgccagttccatagtgcctgggaacaaacacctcctacttacctttaaaggtacagccagcaatctaaaacccc

SEQ ID NO: 161587 - DNA, 601 bp, Human
gacacggttctttgtatatccagagccctgcagcatcactcaggagctctgctctgctctcagagcacctggtgtcactgcaccagtgggattactgtggctgtgacaaagccagatgatgaggcaaggggatcacaagaggactgagctgtggagaatctttgagaccctggatccttcttccatgtaaaatctgatccatttagaaggaaactcctgtggtatccctgttcagccccattcacaggtcaaggtaggggttgggcccttcttggaatgacagggctcccttgggcagagratcttgggggactatctcaggcttgtcaggaaccttctctccagactgagacagggagctagtgacccagagctgatggagccagtagctgtagccacagcctctaccttggtctgatgttgaaactcattcaccaatgtgctagtattaagaagtgtggccttaaggaggtgattaagttacaaggaagaggtcctcatgaattggattagtgaccttacagaagaggtatgacagagtggtttgccctttctgtcattctcccatgtgaggacacaacaagaggcgccatctataaag

SEQ ID NO: 161588 - DNA, 601 bp, Human
cagagagacgctgaggcagacccagctccgaggaaacgcttgctggtcaggggaggttgatgagacaaagttccatcttcaagcctggctaggcttggtagaaagcaacaacatgtatgtaattgagaatttgcattccctgttagatttatcactcaggtgaatggggccaccaccccaaagactataatatataagtttacgagtatctccaagtaccactgccaaatatcaaagacaaccctttgaagaatgagatttcgttagggattgtaagcattttcccaggcattagaaacarattaggcaaacctgcttcagtgaattgaccatggtaacattttattctctccaagtgccacagacacggttctttgtatatccagagccctgcagcatcactcaggagctctgctctgctctcagagcacctggtgtcactgcaccagtgggattactgtggctgtgacaaagccagatgatgaggcaaggggatcacaagaggactgagctgtggagaatctttgagaccctggatccttcttccatgtaaaatctgatccatttagaaggaaactcctgtggtatccctgttcagccc

SEQ ID NO: 161589 - DNA, 601 bp, Human
ggacagggtgggattgtggagaaatttatgcctggaggggagcaggtgttacaagctatagggtgatggcagagagacgctgaggcagacccagctccgaggaaacgcttgctggtcaggggaggttgatgagacaaagttccatcttcaagcctggctaggcttggtagaaagcaacaacatgtatgtaattgagaatttgcattccctgttagatttatcactcaggtgaatggggccaccaccccaaagactataatatataagtttacgagtatctccaagtaccactgccaaataycaaagacaaccctttgaagaatgagatttcgttagggattgtaagcattttcccaggcattagaaacaaattaggcaaacctgcttcagtgaattgaccatggtaacattttattctctccaagtgccacagacacggttctttgtatatccagagccctgcagcatcactcaggagctctgctctgctctcagagcacctggtgtcactgcaccagtgggattactgtggctgtgacaaagccagatgatgaggcaaggggatcacaagaggactgagctgtggagaatctttgagacc

SEQ ID NO: 161590 - DNA, 601 bp, Human
aaaccaatatcctggacttcaaggtacttattaggaaccttctggcaaacagtgctctgtggacactgtaggccaggagctactagaacgtacagacacatccaagttcagagatgcgaaggccagaatggacaaacagcaaacaagcaaaaatcatcaccttcaagctaatgaattttgtcagacaaggaaagaacacacctttgcgggaactgcatgtttggacagggtgggattgtggagaaatttatgcctggaggggagcaggtgttacaagctatagggtgatggcagagagacrctgaggcagacccagctccgaggaaacgcttgctggtcaggggaggttgatgagacaaagttccatcttcaagcctggctaggcttggtagaaagcaacaacatgtatgtaattgagaatttgcattccctgttagatttatcactcaggtgaatggggccaccaccccaaagactataatatataagtttacgagtatctccaagtaccactgccaaatatcaaagacaaccctttgaagaatgagatttcgttagggattgtaagcattttcccaggcattagaaacaaattaggcaa

SEQ ID NO: 161591 - DNA, 601 bp, Human
aggagcagggccctgaggatgcgcaccgcatccatggggtggcactgtcgctgcatgacaatgagccagaaaaaggagcatctggggcccggtaccgtgagacaccaggtggtgagggaggtacacctggctaatgtgccagtgccactctgtcaggtggtctcagaggcgcctgctgaggggacagaggaaagagacaatttccaggtcataccgctgtgctgtcattgtgcttccagctgttgtccctgattctgtgcttgtggaggactgagagatgccagacacaggccagcttgargactctagcatagaacctggctttgtttagtcctgtactattcttgcaccatcacagcccacccagggatggaaaaagacacacactagcaaccaaaatccaaatagaaggcaggatttacctgcaattcccaaactccccatccagttttaatgcttctatattgcatatatgcctgtattatgcaatccttattctgtttttaagttatattttctgatatcataagaaggaaaaatcataattttaagtagctgcctattataagtttccctcatcatgatataaaggctttgtctt

SEQ ID NO: 161592 - DNA, 601 bp, Human
tcttgggcagtccaggtccgatgctgacctgcagcactttgttactgggcttgaggacagccaggtccccaaacccttggtggaactgcacttgccgggagccccctgcactccaggggccccagttttcctttttcaacttcagttcaagcctgcaaaaagcacagtggggttaacaggtcgaaggacgcagtgagaaaacggtgctcagagatcccgccacggagttctgctgctggaaaagcataaacatgaggcgagaacggacaatctacaccaggagcagggccctgaggatgcrcaccgcatccatggggtggcactgtcgctgcatgacaatgagccagaaaaaggagcatctggggcccggtaccgtgagacaccaggtggtgagggaggtacacctggctaatgtgccagtgccactctgtcaggtggtctcagaggcgcctgctgaggggacagaggaaagagacaatttccaggtcataccgctgtgctgtcattgtgcttccagctgttgtccctgattctgtgcttgtggaggactgagagatgccagacacaggccagcttgaggactctagcatagaacctggct

SEQ ID NO: 161593 - DNA, 601 bp, Human
ttaacctgctcattttccttgctgttgctttagtttgaaatgttccattctgaagaaagcgtgagccccagcaagcagaaggtgtactgattctcagcccccacatctgtgcacatgtttgcagcatttgctcgggagactcgggggagcggcggcagttctgcctgcagggcccgtggagcacttacgggagttcttgggcagtccaggtccgatgctgacctgcagcactttgttactgggcttgaggacagccaggtccccaaacccttggtggaactgcacttgccgggagcccccygcactccaggggccccagttttcctttttcaacttcagttcaagcctgcaaaaagcacagtggggttaacaggtcgaaggacgcagtgagaaaacggtgctcagagatcccgccacggagttctgctgctggaaaagcataaacatgaggcgagaacggacaatctacaccaggagcagggccctgaggatgcgcaccgcatccatggggtggcactgtcgctgcatgacaatgagccagaaaaaggagcatctggggcccggtaccgtgagacaccaggtggtgagggaggtacacctg

SEQ ID NO: 161594 - DNA, 601 bp, Human
gtggcatagaggatgatgttggtattgtggacaagatctgactggaaagggaggggaaatttgaagctaacaaactttgatttgttttaaccacaatattgtaatgccaggtgtactgatacataagtactaagtccctcagaaacttttaacctgctcattttccttgctgttgctttagtttgaaatgttccattctgaagaaagcgtgagccccagcaagcagaaggtgtactgattctcagcccccacatctgtgcacatgtttgcagcatttgctcgggagactcgggggagcggyggcagttctgcctgcagggcccgtggagcacttacgggagttcttgggcagtccaggtccgatgctgacctgcagcactttgttactgggcttgaggacagccaggtccccaaacccttggtggaactgcacttgccgggagccccctgcactccaggggccccagttttcctttttcaacttcagttcaagcctgcaaaaagcacagtggggttaacaggtcgaaggacgcagtgagaaaacggtgctcagagatcccgccacggagttctgctgctggaaaagcataaacatgaggcg

SEQ ID NO: 161595 - DNA, 601 bp, Human
aagaaaaacaatagggtcttgaatggaacaggaaggaaggtaggattaaaccagctggaagaggggtgcagagggaatttcttataaagagaagagctgaagaatagagaagggtaggaggtgacaaggtgcacagtgcaaacacagcaaaggagctgcagctctagggcctgggagaaccgaccacgtgggatcggggcaaacccagtgtggcctgctggacgcttccctcccagtacctaggccactctcgccaccccaaataagatagaatccaacacctattgggcaatttcccctygggggcccgccgcacaaacatagcctgctggttatttgcagcctttctttgcccggctctgtgccctggggtctgagtcctgtggacagccaggcctctgccttccagtggggtgaggcctataggccaggccaacaggaggcactggaaggagactggagtgtcaggagggaggtgggggacttcatgtgcctccttcctgactgtagccttcagttcacctcgttcctccctctgctgcttcaggtttgcggataataatgatttcctgccactccctttccctgggtccctactttg

SEQ ID NO: 161596 - DNA, 601 bp, Human
cagggctggacagcagggccagaggagccagaggagatctctgcagagacatctatgtggggaagaaaaacaatagggtcttgaatggaacaggaaggaaggtaggattaaaccagctggaagaggggtgcagagggaatttcttataaagagaagagctgaagaatagagaagggtaggaggtgacaaggtgcacagtgcaaacacagcaaaggagctgcagctctagggcctgggagaaccgaccacgtgggatcggggcaaacccagtgtggcctgctggacgcttccctcccagtacctaggccactctcgccaccccaaataagatagaatccaacacctattgggcaatttcccctcgggggcccgccgcacaaacatagcctgctggttatttgcagcctttctttgcccggctctgtgccctggggtctgagtcctgtggacagccaggcctctgccttccagtggggtgaggcctataggccaggccaacaggaggcactggaaggagactggagtgtcaggagggaggtgggggacttcatgtgcctccttcctgactgtagccttcagttcacctcgttcctccctctgc

SEQ ID NO: 161597 - DNA, 601 bp, Human
aagccattaagcgcttcctttaagtgaaagcgcttcctttaagtaaattcagtaacaatatatcttctatctgtaacactgtgaagacagaaaaaaatttctgctggttttgtggaaaactcaaactggaaaagtatagataggttttggtaatatctgcattttcaagcccccactgggcgtcttggaatgcatcccccgaggataagggggtgctgctgtagtggtatttggccggagctgggtagtggtggtggggttagacctgtaaactcctatttccataaagcagcatcctgtrtcttaaaagctgacaacagtctggttgttacggacaaggaactcctttctctctgtcagaagcctttcctaagggagtaatatttcgaggtaatgaaatccagattgcaaactcagccgcagttcagtctcactgactcctatttttctgaattttgaggtctcaagtagggctgctgtgttgtacatgtggcactgaaatggtccatgcctggttaatatgtgtgcattgatttgctaatgggtttcttcccaaacatattttataagttatgggtccagatttagtggtcccagacta

SEQ ID NO: 161598 - DNA, 601 bp, Human
gtgtgctaccccatcatcagtcactaagcagccatcttgttattcataatggccccaggaagctggcaatttgggtatgccaaagagaagccattaagcgcttcctttaagtgaaagcgcttcctttaagtaaattcagtaacaatatatcttctatctgtaacactgtgaagacagaaaaaaatttctgctggttttgtggaaaactcaaactggaaaagtatagataggttttggtaatatctgcattttcaagcccccactgggcgtcttggaatgcatcccccgaggataagggggkgctgctgtagtggtatttggccggagctgggtagtggtggtggggttagacctgtaaactcctatttccataaagcagcatcctgtgtcttaaaagctgacaacagtctggttgttacggacaaggaactcctttctctctgtcagaagcctttcctaagggagtaatatttcgaggtaatgaaatccagattgcaaactcagccgcagttcagtctcactgactcctatttttctgaattttgaggtctcaagtagggctgctgtgttgtacatgtggcactgaaatggtccatgcctg

SEQ ID NO: 161599 - DNA, 601 bp, Human
tttccactgtttcagttacccatggtcaactgtggcctggaaatattaaattaaagttccaggaatgaacaattcctaaggcttaggttgtgtgccatctcaccctgtcccgccaggacacgaatcgtccctttgcccagcctatccatgctgtgtgtgctaccccatcatcagtcactaagcagccatcttgttattcataatggccccaggaagctggcaatttgggtatgccaaagagaagccattaagcgcttcctttaagtgaaagcgcttcctttaagtaaattcagtaacaatrtatcttctatctgtaacactgtgaagacagaaaaaaatttctgctggttttgtggaaaactcaaactggaaaagtatagataggttttggtaatatctgcattttcaagcccccactgggcgtcttggaatgcatcccccgaggataagggggtgctgctgtagtggtatttggccggagctgggtagtggtggtggggttagacctgtaaactcctatttccataaagcagcatcctgtgtcttaaaagctgacaacagtctggttgttacggacaaggaactcctttctctctgtcag

SEQ ID NO: 161600 - DNA, 601 bp, Human
atcaaaagatccattattcctcaaccatgcaagaaagcacaaagaggtcacagagtaaccatatctggggccaaggggaacccgtcttctgatgtttccaagataagccctctctggagaatgaaatgaattgtgtgctattaatgtgactgtacctttacaaataaccagccacagccccacagccttgggtcctggcatatagcactgaggtggaaaactaaaccttagaatcctgtgtattgacagcccacaggaatctctgaacccttgttttgaatgatggagatggagcttgccrgcttcatccagaggatgtgagaatcttaccctgcagctccctggtccgggaccttgaggaaatccaggctctctggcgtctgtgacactcggtctgaactggtagactgctgccgaggcaagggcgggcgggccatggaggtgtacaggcttttctgattggacctctggcttccaggagcatggggatatggcacatactggtttctgatgactccgttctgatggtatcctagagagaggaacagagaaggaaataaggctcagatttttggatcctttgccaaaagtctctccacat

SEQ ID NO: 161601 - DNA, 601 bp, Human
tcatatagaatgctgggatgttatgcttaatgttgctgaagactcttaaagctgttgtatttatgcaactgcaggcacagacacaaatcaaaagatccattattcctcaaccatgcaagaaagcacaaagaggtcacagagtaaccatatctggggccaaggggaacccgtcttctgatgtttccaagataagccctctctggagaatgaaatgaattgtgtgctattaatgtgactgtacctttacaaataaccagccacagccccacagccttgggtcctggcatatagcactgaggtrgaaaactaaaccttagaatcctgtgtattgacagcccacaggaatctctgaacccttgttttgaatgatggagatggagcttgccggcttcatccagaggatgtgagaatcttaccctgcagctccctggtccgggaccttgaggaaatccaggctctctggcgtctgtgacactcggtctgaactggtagactgctgccgaggcaagggcgggcgggccatggaggtgtacaggcttttctgattggacctctggcttccaggagcatggggatatggcacatactggtttctgatgac

SEQ ID NO: 161602 - DNA, 601 bp, Human
tgggagcaggccattactagctttagcagacagagccactccaccatggagagtcgtgcagagctggaagattccttacaagtctctagttcaacctccatgaagtgacgggggtccttatgatcatcaccctgtcaccgtcattaccaccctcaagctagagttaagtgagcagacgcctgcatgccaagtaccatgctagagattttatgtatataatttctagtcctcccaacaagtttgctgcaagtttgatggcattacattagtgcttagacaaggaaactgaagctcagagagrgcaaacagcaggtccagtgttagagaggcctctctttccccttatctaccatttgacaacactactctgaacactcctgcctggtgatccccatccacctggtgcctggatgctcccaggaacaaaatgctgtttacatacgagggcaactcatatttgggttgctacgttcttccttttactggagccaaaatctacctcctggcagagttcaccaactggctttcagttggcgctagttccatccctacgactccacaggacatgtcttaacccccttttaaaactgatagctctttt

SEQ ID NO: 161603 - DNA, 601 bp, Human
ggcaggaaaaacatcaaataatagggcataaagatgaatgaggccaggcacagtggctcacgcctgtaatcccagcactttgggaggccaaggcgggtggattacttgaggtcaggagtttgagaccagcctggccaacatggcgaaaccctgtctctactaaaagtaaaaaaattaggctgggtgcggtggctcacatcttaattccagcactttgggaggccaaggcgggtggatcacgaggtcaggagatcaagaccatcctggccaacacagtgaaactcttgtctctacaaaaatccacacacacacacacacacacacacaaattagccgggcatggtggcaggcgcctgtagtcctggctactcgggaggctgaggcaggggaatcgcttgaacccgggaggcagagattgcagtgagccgagattgtggcactgcactccagcctggcaaccgagtgagactccgtctaaaaaaaaaaaaaattagctgggtgtggtggtgcgtgcctgtaatcccagctactcaggaggctgaggcaggagaatcacttgaacctgggaggaggctgcagtgagccgagactgcaccactgc

SEQ ID NO: 161604 - DNA, 601 bp, Human
aaggaatgctgctaggagagaacatggtaaagctcttaagagctctgtggtctttagaaggaagctgccaaggcaggaaaaacatcaaataatagggcataaagatgaatgaggccaggcacagtggctcacgcctgtaatcccagcactttgggaggccaaggcgggtggattacttgaggtcaggagtttgagaccagcctggccaacatggcgaaaccctgtctctactaaaagtaaaaaaattaggctgggtgcggtggctcacatcttaattccagcactttgggaggccaaggcrggtggatcacgaggtcaggagatcaagaccatcctggccaacacagtgaaactcttgtctctacaaaaatacacacacacacacacacacacacacaaattagccgggcatggtggcaggcgcctgtagtcctggctactcgggaggctgaggcaggggaatcgcttgaacccgggaggcagagattgcagtgagccgagattgtggcactgcactccagcctggcaaccgagtgagactccgtctaaaaaaaaaaaaaattagctgggtgtggtggtgcgtgcctgtaatcccagctac

SEQ ID NO: 161605 - DNA, 601 bp, Human
aaaccaactaaggtgctttcatatttgtagcccaaatgaagtgagataagacttgccagggcaaaaggaatgctgctaggagagaacatggtaaagctcttaagagctctgtggtctttagaaggaagctgccaaggcaggaaaaacatcaaataatagggcataaagatgaatgaggccaggcacagtggctcacgcctgtaatcccagcactttgggaggccaaggcgggtggattacttgaggtcaggagtttgagaccagcctggccaacatggcgaaaccctgtctctactaaaartaaaaaaattaggctgggtgcggtggctcacatcttaattccagcactttgggaggccaaggcgggtggatcacgaggtcaggagatcaagaccatcctggccaacacagtgaaactcttgtctctacaaaaatacacacacacacacacacacacacacaaattagccgggcatggtggcaggcgcctgtagtcctggctactcgggaggctgaggcaggggaatcgcttgaacccgggaggcagagattgcagtgagccgagattgtggcactgcactccagcctggcaaccgagtga

SEQ ID NO: 161606 - DNA, 601 bp, Human
caaaaaaattagctgggtgtggtggcacgcacctgtagtcccagctactcaggaggttgacgcaggacagtcacttgaacccaggacatggaggttgcagtgagctgagattgcaccactgcactccagcctggcaacagaacaagactccatctcaaacaaacaaaaaaccccccccaaaaaaaccaactaaggtgctttcatatttgtagcccaaatgaagtgagataagacttgccagggcaaaaggaatgctgctaggagagaacatggtaaagctcttaagagctctgtggtcttkagaaggaagctgccaaggcaggaaaaacatcaaataatagggcataaagatgaatgaggccaggcacagtggctcacgcctgtaatcccagcactttgggaggccaaggcgggtggattacttgaggtcaggagtttgagaccagcctggccaacatggcgaaaccctgtctctactaaaagtaaaaaaattaggctgggtgcggtggctcacatcttaattccagcactttgggaggccaaggcgggtggatcacgaggtcaggagatcaagaccatcctggccaacacagtgaaactc

SEQ ID NO: 161607 - DNA, 601 bp, Human
gagccttttgcccaaggtactattttgtaaggaatgtttgcacagcagatttaaggttacaaagaggaggctggctaagacacagtgtgcctactaattgtgttttacatacaaggaaatcttaatgcctagcagacaggtgtgaaggtgtcctctccttccggcctcatggcctgcctccaagacagcaccacgtgtacccagtctttaggctggagggtggcaaagggtgccataagacttaaatagggaaccacatggcagagggctggaagggagcagccttggttaagacacagtrttcctaaattgcctacttttggctgacagatgctcccagctggctgatgtgcaagtttgcaacttgcaaagtaggctggaaagatggttttgcttgccaaaaccaaagtaagtaggcagctagcacacagagctaagagatttggtgcattctgttgactgcttttaataccctgcctactttgaggcatcaaactgggcctaggtgggattgtgacttagtgatgctcacccacctgaaaggtgtaggtctgggttagagagcaaaaatcccataaacctaacagcacccttgcaattc

SEQ ID NO: 161608 - DNA, 601 bp, Human
tggcatgcccagaagccctaccactgagcacttccaagacttttctgtttttccaacttctagttggattaatctctggagtatcttgaaatttcctgaagttatcctcccacaaaatggaccacaggattaaaaaggtcaacagacatttccagtctgggttttaatgcttccaagaatgaactgcaggtagattaggtacatttcagttataggagggaaaattacaaagcacactggatagtgagatcagagcaaaggtgggtggatgaactgtttttttttttttgttttttttttktttttttttttgagacagagtcttgctctgtcgcccaggctggagtgcagtggcccaatctcagctcactgcaagctctgcctcctgggttcacgccattctcccgcctcagcctcctgattagctgggactacaggcacccaccaccatacccagctaattgtttgtgtttttagtggagacggggtttcaccgtgttaatcaggatggtcttgatctcctgacctcgtgatccacccacctcggcctcccaaagtgctgggattacaggcgtgagccaccgcgcccggcctggatgaa

SEQ ID NO: 161609 - DNA, 601 bp, Human
tttatcactaggctgaatggggttcctagtaactccacaggtgagaggtgggggaggccagggcagctttgagatgggtgtggatagtggggactgtctgatggcagccgggaggagtgggcaggtgggtggaggagggaggacctctgcagtttgcactttgcattaggaagggcaacactgatgctgccaccattggctctgtcttgtgaccacaaagaggcacagctgctttgctggggcggcatattcccaaagcgagccacagtgagagccattctccctggccagcctgcacatgtctacacccttcttgtgagggctagcagacaggatgtcttctgggaaactgccggtagctgtgtgaagtctggataaactcccctcaactcagccaggccttgtcctaggcattttcacagatgctgcttcatttcaccctcacgacactcctgtgagatgactgatgcaggctcctgggatttcctgctggtttcatccctggccaacatggtggcacacgcctaaggctcctggcactgcagccacatggaatctttctggatccttggtctggctatgctcccctggcctctgccca

SEQ ID NO: 161610 - DNA, 601 bp, Human
cccaccccctcattattactcctcaggcttccctcccacccccctcattcctcctcagacttccctcccaacccctcattattactcctcacacttacctcccaccgctcattgttactcatcacacttccctcccatccctcattattactcctcacacttccctcccaccccttcattattactcctcactttcctttcacccgctcattactctgcagacttctttcccacccccttattactctgcagacatccctcctaccccctcattattactcctcagacttccgtctcaccytctcattatttcttgtcaaacttccctcccatccctcattattactctgcagacggccctcctaccccttccttattactctacaggcttttctgccctctcattattactccacagatgtccctcctacccctcattattactctgcagacttccctcctacctcctcattattactcctcagacttccctcccgtccctcattattactcctcacacttccctccgacctgctcattattactctgcagacttccctcataccctcatcattactccacaatcttccctcccaccccc

SEQ ID NO: 161611 - DNA, 601 bp, Human
caccagccagaaggatctgcagggagagagaggtggtggaagtgaagatgagaaagtctgttctgccccagccacacacactccgctcccatgggctcaagtgatttggctccatccatgttgttttccctttgttctttaaatcaaaaagtttgttgaaaaaagtaagatatctaccaaattaataaagcactcagccaagcccatggactgctttaataatggatattcaaggttgtcttcctggcttccactccatccactttcattatgaagaagccaggaagtgtgggtgggacasacctccccgtttctggggacagcccctaccaggtctcatcctctcagggtacagcctttgtcttgctactgaagttggttcagggatggacacatggctaatttggtctgatcagaataaaagtcaggacttttgtccaatgactaagaacagaagtttcagagatgatgcacatttcagacatggtttgatatgttggcctggaattgctgctgccgttttgctaccatgaagaaaaacagcttgacaagggagggaatataaataagggggcagagctgaaagaagcattaaaaaagc

SEQ ID NO: 161612 - DNA, 601 bp, Human
tatatacagtatatgatctgtttttataaatgtacagcttgaaaaaagatccttcttgtagtaagtacagcatttaaacacaaaccaatatgggccagccacattctaattgaagacccagagaaagcaaagccagcagcccagcccccagcccccagcccctgacctgcttggcggccctgatggtcccggcaaagtgtaaaccagtgcccctctgtcgccctgggctcagcaggccagcttacccttggcacgtacatgggaagtgcctgctcacgctaagcccagtctgcagagggcrggtcctccctgaaggaaggtggcagagaggaatgtgtctatcaggtatggacaagagagatgaaagaaatgtgctcttcaactaaaggcacttgtcagcggccacctacagccattctctaggcctggtgagcaagcagggtgctgttttgatagaagcctacaaggtctgagcagacctcacttgtcctctcaccaggtttaaatacaataaataaatcttaatgcatggtggttttgtcctcctgggttcctatgaagaggctaccttttaggatcacttatggagtgatactccctg

SEQ ID NO: 161613 - DNA, 601 bp, Human
ccaaatttccccttttcatcaggacaccattatattggattaagacccactctaatgacttcattttaattagttttgtttgtttgctccataaagactctatttccaaataaggtcatattgtgaggtactggtggctgggactccaacatcttctttggaggcacacaattcaacccataacaaatgtcataaaagaagaaggtgttcgccgattcctttatttatttaggaggtgggggcaggacgcggagtaagtttcctatagggaaagagttgagaagagtctgcagggactgasctagaaagcagtgacactccgtagttggaaaaaagcagagcacatctttaagtacctggtgtgagttttgtaagaaaacctaccttatgaatgagtacagtggaatactacttagtacattcatacatgtttctaccatctcaagatttttatatatacagtatatgatctgtttttataaatgtacagcttgaaaaaagatccttcttgtagtaagtacagcatttaaacacaaaccaatatgggccagccacattctaattgaagacccagagaaagcaaagccagcagcccagcccc

SEQ ID NO: 161614 - DNA, 601 bp, Human
ggatcggataaagaaaatgtgatacatataaaccatggaatactatgcagccataaaaagaatcatagcctttgcagcaacatggatgcagctagagactattattctaagtgaattaactcaggaacagaaaaccaaatactgcgtgttctcacttataagtgggagctaaacattgggtccacttagacattaagatggtaacactagaaaccaggaactaccgggggtggaggaagggttgaaaaactaactagtgggtactatgctcagtacctgggtgacagaatcaatcatatcygaaaccttagcatctcacaatatacccaggtgacaaacttgtatatgtatgccctaaatctaaaataaaagttgaaattatttttatctccatttaattgattcatctctttattgcttcacttagcttcacttcatttgttcattgcctctaagaaactcctgcagatattatacaaacactcacacaacaaaaaggcaagttctgtttgtcagaatagtgatagtattatgaaataacggcaaaaatatatcagttttgaatacactaacattctctactagataattaatgtcaatt

SEQ ID NO: 161615 - DNA, 601 bp, Human
tttttgggatcccataagtttagataccctgtatttttaatgtcacttagctcaaaatgagttatctcattattttatttgcaaatctttcgagatttttaagtgatatttctattagttggttctcatttaaatccacaatgctcagacacttttctctgtaagatttcaatcatttaatatttattgatactgctttatttctcaccatattatttgctttggtaaatactctacattagcaatgtttctctttggtataagattttagaaatatatattttgataaaatgaaaaaatwcattgctgaggtaggttgtttttttccattcttaaatatgattatggacctctttttcctttattctctcacatttgctctatatattttgaagcaatgtaattatatgcatacaacattatgattgctatcttccccttcatcataattaaatattcctcattatttcttctagaacatccttcctttagactactgctatggaccaaattgtctccctcccactccaaattcttatgctgaaaccgtgacccctaacatgactatatctaaagacgtataattgtcgcattgtaaccc

SEQ ID NO: 161616 - DNA, 601 bp, Human
gtcatagaagattctggaaagaggccagcgatatggcgacttgatctctattacaaaggcacaactgtatttatttggaggaaaactaaccttttaaataagttgttatgaagcaattacctatccaatgtgagctaactgattctgtcccctattttacaccaaacaaatttctttaatgtggattatacatctacattgaaaggcaaatcaatcaagcttgtgttagaggatagaatagcttcatgatcttagaatgggcaaacatttcttgaagatgtctctttttacattaagtttrctgagagtattcaatcttgcttttttttgtcctaagtaggttctaaatttaacaaatgtatcttctgtatctattttttaataaagtagattataatgattgatttcaaatataaaattcatcttgtattcctagaataatttctatgtgttcaccatgtcatactcttttgatatattgcagaattctttttgttaacatatagttaacataaatctcaaatcataaaacaaggtgagaattagcccctccttttgtattatctaaagtaacttattacaagcattaaatattttggag

SEQ ID NO: 161617 - DNA, 601 bp, Human
tcttccctccatcaacacttggtaccaattaaagttctttattacttgtgtggaggtactgcaaaggctctacattttgcatgcacatggataaatactccatttatcaaatttccacattttaaatgtatcatctgctttcagagagacagtgttaggaagaagaaggaggaggacgaggaggaggagaaagaagaaaggaatgaaaaggagaaggaaaagaaggagaagaaggggaaggagaaggagagagaatgattctacagggaataaattgaaggattcagctaaatttcaagargctaaatactgtagtagtatattaatactggtactgttattttaaaccccctatttttgagatattgtagaaaaggcttactgacccataaatgcatctttatacttttctctttttctcctgtttcctgttatctcttataattcactaagatggaaacaacaagatccagtgatttcactttaggcatttgtataaaagcagggttttttttttccttcatgttcagttgctcttgccttccctgtattcttactagtacatatatttttgatctttccttttattgtatttcctttc

SEQ ID NO: 161618 - DNA, 601 bp, Human
gtttaatgaataatgctcaacattattaatacaaactatataaatgtcatctgtctttgtttagattggccaggagaaaatactctaaagcatgaacttgattgtaggaattttatgtgggtggtgattctaggaagcaggaataagggtgtaaggatgaagaaagagagggggaggaaaggtcgatatcagcatgtattattgagatggcaataatgacttctttctgcggggcccacaggaaaatgtacagaatatcttacagaattttccctagttggtcaggaatctggtgtttcastaaagtggctgaagtttgctcctagagaaggagtgcgtacatttcattttaagacttttttttagagtgtcctaggaaaaaggctggttgacattcatagatgtcaaagacctggtccttgagtgcttcttttgaagtaaacgctgttctggtggaacttgaaaataaacatctgaatgtgttgtgcccattctaaataaatccacatacttcttccctacactttcttgtctttaaatgtccagttttatagcatctagatcgttcaccaagtatccaagctatttgccacagcatagg

SEQ ID NO: 161619 - DNA, 601 bp, Human
ttaaataatgaatttattataaattgccaagaattcaaatgattactatctaaatacaaggaaccatatagaaaaaaactgatagaaatttaatattactgagaaccaggcaatgcaagatacatttaccatgtgtgaactggtttatagagtatacactttctggtaatgaaattaacattgtcattagaaagtcaaatacgggagggatagcattaggagatatacctaatgtaaatgaccagttaatgggtgcagcacaccgaaatggtgcatgtatacatatgtaacaaaccgcacrttgtgcacatgtaccctagaacttaaaagtataataaaaaaaaagaaagaggggagagagaacggtaaaaaaaaaaaaaaagaaaagaaagtaaaatatcaagcataattgcatccgattagagtacttttttgcagcttgaatcttcatggagatttgctggatgctttcattctctattctctcactttttttttataatggagcctctggttgttagttgaatgcatgacttcattgtacaatgtctaaatttctcagtttttaataaatgagtgaacatatatagaagtcaaataa

SEQ ID NO: 161620 - DNA, 601 bp, Human
ctgttggcattgttgctgtttccatattatttagcaaacaattttgtatatagtttgcaccatggttttcttttttgtttttaacgtcagtgcacatcatccctcaataacttcagagtccctggattttcatgaaatttccttattgtttccacaggtgattttatgcacctgaatgtgtgtgcctgcattaaatgtggtttgaactgtatttatatgacaacttataattactttaatgtctatagtcatattacttattccatatttaccaaaacaagggatggatatgaagtaaaartatagtttgtgttctctctactttcttccttcttgaactcagaagtcccatagactttgaatctttccctctattattttgatgaaagtaattaataatgtaatgatttcacttttaattaaattaatttttaatttctagctactgatattttttctgacagtattctcttttttttttttttcttttgaggtggagtctcactctttctcccaggctggagtgcagtggcgtgatctcagctcactggaacctcagcctcctgagtagctgggattacaggcatgtgccaccacttgc

SEQ ID NO: 161621 - DNA, 601 bp, Human
tgatcagccaattatttgcatagatatatacacaaaattttatatacaataaaatatctatatacctatatctatctatctacagagaggaagagagagtgcagaattacatatccaatggattttgtttctctggtgtagttctggttgatagaattgataaacaaaggggtcggtgatgttttaacttgggcatattctcatttgttctcagtgtctcatgacagatgaaagccagcaggcttacagctaatgaagaggtcacatctccgttggagctctgtgaaagcgctatgcccasaggcagccaataatttatctaaatattttatctaaactttccattccctggaaaaatctctgttaccaggtggctagggctacttgatttgatttagagctcagttaagtgaaaaaaaaaatgaataaaaaaaatcttggctttcagagtgaggtaaattagataggttggtcatagcatcccttaaatgagaacaaacttgcaaaatagatggcgagaataaacctcccaacagtgcaaaaactgcatcctgggatactggttagaacatcctgcagcaaggaggtaaagaaacataag

SEQ ID NO: 161622 - DNA, 601 bp, Human
aaatattatcctagataatgtggatgggcctgattcaattattaatagttgaaagacctttacagcaggcttccctgaaaaagaaaaaaattctgcctgtggacttcaatttatgcttaaaatttctattctgcccttttaattgtcttgccctacagatttcaggcttgcctagccagccccacaatctgatcagccaattatttgcatagatatatacacaaaattttatatacaataaaatatctatatacctatatctatctatctacagagaggaagagagagtgcagaattacawatccaatggattttgtttctctggtgtagttctggttgatagaattgataaacaaaggggtcggtgatgttttaacttgggcatattctcatttgttctcagtgtctcatgacagatgaaagccagcaggcttacagctaatgaagaggtcacatctccgttggagctctgtgaaagcgctatgcccacaggcagccaataatttatctaaatattttatctaaactttccattccctggaaaaatctctgttaccaggtggctagggctacttgatttgatttagagctcagttaagtg

SEQ ID NO: 161623 - DNA, 601 bp, Human
cagcctcctttattatcactaggcggaataggttcctacagaaaccttcttgttatgtaggaactaaaatgctaaatgaaataaaatctgtacatactctttttttttttgagatagggtctcactctgttgcccaggctggagtgcagtggcttggtctcagctcactgcagcctatgcttcctgggttcaagcaattctcgtgcctcagcctctcaagtaactgggattacaggcttgtgccaccacgcccacttaatttttgtattttcagtagagacggggcttcaccatgttggcyaggctcatactctttttttaaaggcatagttgtaccagagataaaaatcatttttaggttcagaaaatgtgaaacagtgtgattttacaaaagcaaccaaaactgaaggcagcactcctccagtggccaccaatgaccaagcattttggatttaaatgatcatttgcaccccctacaacagtggcagaattagaagcaggttatatcaaactttcaataaatagtctggggaggtacatcagaaaaacggtgatatagaaaacaaaacaaaatctggctgaaataacattataggagctc

SEQ ID NO: 161624 - DNA, 601 bp, Human
tatataatttgcagagctattgtccagaaaaaagtaaacctaattttcagaaccattaaatatattaattgtctagagaaacaaaagttgaggaagggttgttggtattactggtaccctttttctgcaatgaagtgtttttgtgggtttttttgtttgtttttgtttttgtctgggttttgtttgtttgtttgtttttgctttaacatgcctgtggcagagtgcttaacttcagttgtatcatgcaggaagctttgctagggaaaagcagcatccaaataaagaagctagctaaaaaaaktaaaaattatttataaccatatagcaatagtaatattacataaaaaaaacaattcttttttattcttcaccaaactctctaaaacagatttatttttgttttgagataagaatcataatgcagcctcctttattatcactaggcggaataggttcctacagaaaccttcttgttatgtaggaactaaaatgctaaatgaaataaaatctgtacatactctttttttttttgagatagggtctcactctgttgcccaggctggagtgcagtggcttggtctcagctcactgcagcctatgc

SEQ ID NO: 161625 - DNA, 601 bp, Human
tcttataatataggatcataacacactaacttttaaagtcagagagttaatctgttcacatagtttttgcccaacattattgagtatgaaaaaatacattattaattgtgttggctaattatggcaatgcatacctccatttaagatttatggggaaatggactaatgatgaatagatggccaggttattttggatggctgtggtagtagtataaaaagtactagctctggatactggatacagattagtgctgctgtagttataaatctatctattctgttagcatgcttccttcacacytaactacaatttaaatacagtagttagatatataatttgcagagctattgtccagaaaaaagtaaacctaattttcagaaccattaaatatattaattgtctagagaaacaaaagttgaggaagggttgttggtattactggtaccctttttctgcaatgaagtgtttttgtgggtttttttgtttgtttttgtttttgtctgggttttgtttgtttgtttgtttttgctttaacatgcctgtggcagagtgcttaacttcagttgtatcatgcaggaagctttgctagggaaaagcagc

SEQ ID NO: 161626 - DNA, 601 bp, Human
cagagatctctttcaacctatatcaaataatgctatgtttcaaaagaacaagaaatgtttaatgcactcatacaaatactcaaagcgactaatggtaagcccaagaacatgtaattagaaatattttttattttaaaagtttgctaaagaatattggcaatattttgggagatttttcctcttataatataggatcataacacactaacttttaaagtcagagagttaatctgttcacatagtttttgcccaacattattgagtatgaaaaaatacattattaattgtgttggctaattayggcaatgcatacctccatttaagatttatggggaaatggactaatgatgaatagatggccaggttattttggatggctgtggtagtagtataaaaagtactagctctggatactggatacagattagtgctgctgtagttataaatctatctattctgttagcatgcttccttcacacctaactacaatttaaatacagtagttagatatataatttgcagagctattgtccagaaaaaagtaaacctaattttcagaaccattaaatatattaattgtctagagaaacaaaagttgagg

SEQ ID NO: 161627 - DNA, 601 bp, Human
aatagcctatagatacaaagttagaatgtcattgctgtggtccacaaaaatgataagcatacaatgaaattgagtggtagtgaggatagaaaccagtagatgtatttgagatagaaagttgaaaccagctgagttggagtaatatgcatagtaaaaagagatgggtgaatgacaccaaggattctgacttgtttaattctcttgctggtagttaaatcaactgagataaagaaagttaagcataaagacaaaggtttagtaattgttttcagagatctctttcaacctatatcaaataatrctatgtttcaaaagaacaagaaatgtttaatgcactcatacaaatactcaaagcgactaatggtaagcccaagaacatgtaattagaaatattttttattttaaaagtttgctaaagaatattggcaatattttgggagatttttcctcttataatataggatcataacacactaacttttaaagtcagagagttaatctgttcacatagtttttgcccaacattattgagtatgaaaaaatacattattaattgtgttggctaattatggcaatgcatacctccatttaagatttatgg

SEQ ID NO: 161628 - DNA, 601 bp, Human
aataaatatttgagtcctacaaatgtacctggccccaagaaggcatcagtgaacaacacaaatctcatcttgttcataccataacaaaagagagagaaacagacaaaaaactcgatattatatgaaagaagatattattggcatgattgtgtagaatcttatattcttcatgagcaagttggtcaaatatagcaatttgctatatttacatattggaagaaggaaagctgataaaagtaggttttggaaaagagaatggaaagggcaatagcctatagatacaaagttagaatgtcattgytgtggtccacaaaaatgataagcatacaatgaaattgagtggtagtgaggatagaaaccagtagatgtatttgagatagaaagttgaaaccagctgagttggagtaatatgcatagtaaaaagagatgggtgaatgacaccaaggattctgacttgtttaattctcttgctggtagttaaatcaactgagataaagaaagttaagcataaagacaaaggtttagtaattgttttcagagatctctttcaacctatatcaaataatgctatgtttcaaaagaacaagaaatgtttaatgca

SEQ ID NO: 161629 - DNA, 601 bp, Human
tttctgatttattattaatacttaccagggagtctggctggtatagctacaggtggaaaattgccactgtcaatactcccaccaggccatagatctgattgaactgagcaatctggaggtaaatatgaagcactacagtgacagtgctttttgttattgcatacctaaaagaaggagaaatatcaccttataagataagcaactagatttatatatgttcaagtagaattataaaataatatgtaggtcagctaaggccaattttcctatatgttttggtgtgtgtgtgtgtgtgtgtgcttgtgtgtgtgtgtagcaatgcagtttcctaaaattaggctcaatgatttctattttcacctcatagtactgctacttacacctctatcattgcatttgtcagtagtacaatcataacccaagtatgaagaactcacacatctttgattcctgcaaacctaaaaaggatgagcaaaaataagttaattgacatgccatctagagttgccatttaattaaaagcattccataccataccatattaccatggactaataaaaagggtattgatttagcaacaagaattagtatactaacaatg

SEQ ID NO: 161630 - DNA, 601 bp, Human
gctatacatccctgaccatagttatatatcatgctaaatggcccagaatctgattctagtaataccacctctttttattgtccctacaaccctaaaaagtggtagtcattttctgggttgcctcacctttctctgattaatcttctcatctatgcaattaccggatgccttacacggtgttctttctgtttgaaagactaaagtgatttctgtctttatgcctgggctctgactgatatatcatatttataacatatgctacatatgttgtaatatattactctctggaagtggaagtaamacatacacattcatgtgcagtttaatgtctaaacatagtctagatataaattggtagacaaaatattatttgttatccaatttaataaattcaaattatgttttaattattttctgatttattattaatacttaccagggagtctggctggtatagctacaggtggaaaattgccactgtcaatactcccaccaggccatagatctgattgaactgagcaatctggaggtaaatatgaagcactacagtgacagtgctttttgttattgcatacctaaaagaaggagaaatatcacctta

SEQ ID NO: 161631 - DNA, 601 bp, Human
taatatctggaggattcgaagagtaaaaatagctctgatattattcccccttcctctccagaatctccaacagtgactgtatattctctatacctccagctcatgctggacagttactctccctgtggtttcaatcctgctatacatccctgaccatagttatatatcatgctaaatggcccagaatctgattctagtaataccacctctttttattgtccctacaaccctaaaaagtggtagtcattttctgggttgcctcacctttctctgattaatcttctcatctatgcaattaccrgatgccttacacggtgttctttctgtttgaaagactaaagtgatttctgtctttatgcctgggctctgactgatatatcatatttataacatatgctacatatgttgtaatatattactctctggaagtggaagtaacacatacacattcatgtgcagtttaatgtctaaacatagtctagatataaattggtagacaaaatattatttgttatccaatttaataaattcaaattatgttttaattattttctgatttattattaatacttaccagggagtctggctggtatagctacag

SEQ ID NO: 161632 - DNA, 601 bp, Human
aatgtcctagagtgccttattaacattttcttccagtagtttcatagtaggcatgagttcaattttccacattaccaaaggcagcagtgatgccaaacaatttaccacttcataataatggtttcactttctgcaacgtgtttttaaactgtccttgaattgctcaccaacttcaacatgtactaagacttcaatagtttcctgcctttctgtcttccatgcactatccaatttcaaagctaaggtcacattttatatttctattacacaacatattgggagctaaatgttttttattatktattgctgtataagaaattacctcaaggcttagtaacttaaaacactagattttgctcacaattttgttggttatgaatttgaggagggcttattagatggttgtatttttgtttctgagtgcaatcaaatttcaaatattgctgataattttcaagaagtgaatgagagaatgagatttcagggaatgagagaagtaagggctgcaaaatacctggctagagtctgtaggaagaccacgagagtcctagaatgttagttcttcacattttattgatcaatcataccactaaaaccaacc

SEQ ID NO: 161633 - DNA, 601 bp, Human
gaggctgttatgaaatgaccagtttaaaattcttagtagccttactgtttgaaactttttatgatgcatttacataaaatacttagaaggccttttgtatagaagaaagagtctctaagatatatcaacttaagtttttctgagattttaacagaggtgtttacagtcaaaggccttgcttaattttgatttgagataaaattttattgctctaatctcaaatttggcctttcattgtttcttactttaagaaacttgtggagaatgaaaattagttttactttcaaaccaataaaatccktgcttggaccaatgtcctagagtgccttattaacattttcttccagtagtttcatagtaggcatgagttcaattttccacattaccaaaggcagcagtgatgccaaacaatttaccacttcataataatggtttcactttctgcaacgtgtttttaaactgtccttgaattgctcaccaacttcaacatgtactaagacttcaatagtttcctgcctttctgtcttccatgcactatccaatttcaaagctaaggtcacattttatatttctattacacaacatattgggagctaaatgt

SEQ ID NO: 161634 - DNA, 601 bp, Human
gaaatatagtaaagatatttctgtattttactacgtctaccaaaataaaatctttgaacaatttaataatttaaaaattaacatattttctatgaaatagataacttgaaaatataaatgcccaaagtgactcttgtaactctttttaaaatggatagctatatatggtgggctgatactttgctgaggatttttgtatctctgttcatgaagaattttttttgtgattttcttctttgttgagttccttgtttgaatttggcatcaggattatgttttcctcatacaatgagttgacagraacttccccaccactgttttctgaaaataatattgctttcttccaagaatttggttcagttcacctgtgaaaccatctatgcctatagttttttgttgtcgtttatttttgttggtggtgacctaaaaaatcataaacccacagattaagaagtgtggtttctgactttttgtttatgccctttggtttataatccaaatagtccttttcacatctgactacctttatcagcctgtttcttgcctatagttgattggggaccaatgaacgtacatgctaccttgatcactttcagtctga

SEQ ID NO: 161635 - DNA, 601 bp, Human
aataaagaaaggaatgaataagaaaaatggccatctcattggtttggaatggtaaatgttctcaatgtagcgcctttctagaagaaaaaaaaatcaaagatttgaaagcaagcaccagaaatatagtaaagatatttctgtattttactacgtctaccaaaataaaatctttgaacaatttaataatttaaaaattaacatattttctatgaaatagataacttgaaaatataaatgcccaaagtgactcttgtaactctttttaaaatggatagctatatatggtgggctgatactttgytgaggatttttgtatctctgttcatgaagaattttttttgtgattttcttctttgttgagttccttgtttgaatttggcatcaggattatgttttcctcatacaatgagttgacaggaacttccccaccactgttttctgaaaataatattgctttcttccaagaatttggttcagttcacctgtgaaaccatctatgcctatagttttttgttgtcgtttatttttgttggtggtgacctaaaaaatcataaacccacagattaagaagtgtggtttctgactttttgtttatgccctt

SEQ ID NO: 161636 - DNA, 601 bp, Human
aaattcactaagatatagaaatattacaaagttatttaagtattattaagttaaaatacatatttaacaagatcaaataataaaagaagatagataaactttaaagataaactttaaacttgaatggacagctaaactttagctaatcttgcccctaaaaagtccagattcttataagattaaaattgcaattattatatgtgtatatatgcatgtgtatgtgtgtgtgtgtgtgcatgtgtgtgtgtgtatatatatataattttttcttttttgagtctcagtctcactctgttgcctmggctagagtgcagtggcacaatctcggctcactgcagcctctgcctcccaggctcaagtgatcctcccacctcagcctcctgagtagctgggactataggtgcatgccaccacgcctggctaatttttgtatatttttggagagatggggtttcatcatgttgcccaggcttgtcttgaactcctggctttaagtgatccactcgccttggcctcagaaagtggtgggatgacaggcgtgagccaccacccctggccattagttattaatatatgagttattaaattcccatataaagac

SEQ ID NO: 161637 - DNA, 601 bp, Human
cctgaagatatttgatatcagttattccacaatagttatccaatataagaaaaccactttagtatatttaaataatgactaagttattactcgtttaggtgctgtatattatttcagcaatttcaaatcaacttttaaaatatattccattttcatttacattgtcattttaagtattttaatgaaattcaattcatttcaagtaaaatgaaggacatagttatataactcccagggagaaatcatttggtagcattttccttgaaaataaataaaccagttttaatgtttacttgtattyttatagcacatattcagatatttttatttttaatagaagttatttgttttatattttctgtagactagctgtggctatcatctagatttttaagtcttttattacttattaacttttaatctttttctacttctaattgctgtgcttcaatttacattactaccaaaaaaaagctaaattactttcctgggttttcctactacctttcattaaaatagcataaaaattcactaagatatagaaatattacaaagttatttaagtattattaagttaaaatacatatttaacaagatcaaa

SEQ ID NO: 161638 - DNA, 601 bp, Human
gggtttggttcgaccgtcatctgaaggaaaaaatgcatcctggtgaacacggctgcgtacgtggctgagcggcagacaaacagttaaaacagaggagtggggtaagtgatgacctaatccagccccgctgctctagttttgttaaacacctcatctgctatcacggtctggcgaaaccctggagaaactattatttccacgacggaaacatgtaatatcgaagcacgttaaattccactcaaagtggcggcgtctgggatccctgacaaagagccctgggctgcttggggcccattgttaycagaagcaacctaggcggctcagtgctggggactgagccagctacaatccctactattttccgggcccgaagccccgaatgtgctcagtacagggtggggaaaggtagaggaaggcggcggtccgcggcagacagactccggtggctcccagacaccgggaacccagggagcatcgcccggctcccctcccgctgcttacacttcttcaaggtgatatagacgctgcccgacgtccggcacttctggaaaagtctggtcagctccgtcaggaactggaaaacaacaggcccagccccgtt

SEQ ID NO: 161639 - DNA, 601 bp, Human
aacaaataaaagcctggttcagaaacgccccatcctctgttaagttcaagtctttacatttcaaaagacagccttagaaattaagctcaccacagtgctgatcttcttcttcccatcggtagctcttaacagacacttgttgtctgcgggctcaaagccctccacagtacctttctttggaatgggtttggttcgaccgtcatctgaaggaaaaaatgcatcctggtgaacacggctgcgtacgtggctgagcggcagacaaacagttaaaacagaggagtggggtaagtgatgacctaayccagccccgctgctctagttttgttaaacacctcatctgctatcacggtctggcgaaaccctggagaaactattatttccacgacggaaacatgtaatatcgaagcacgttaaattccactcaaagtggcggcgtctgggatccctgacaaagagccctgggctgcttggggcccattgttaccagaagcaacctaggcggctcagtgctggggactgagccagctacaatccctactattttccgggcccgaagccccgaatgtgctcagtacagggtggggaaaggtagaggaaggcg

SEQ ID NO: 161640 - DNA, 601 bp, Human
tttccactactaaagtataggaaggtcctggtctcaaaaatagccacacagggcaaaagggaaaaacaaataaaagcctggttcagaaacgccccatcctctgttaagttcaagtctttacatttcaaaagacagccttagaaattaagctcaccacagtgctgatcttcttcttcccatcggtagctcttaacagacacttgttgtctgcgggctcaaagccctccacagtacctttctttggaatgggtttggttcgaccgtcatctgaaggaaaaaatgcatcctggtgaacacggcygcgtacgtggctgagcggcagacaaacagttaaaacagaggagtggggtaagtgatgacctaatccagccccgctgctctagttttgttaaacacctcatctgctatcacggtctggcgaaaccctggagaaactattatttccacgacggaaacatgtaatatcgaagcacgttaaattccactcaaagtggcggcgtctgggatccctgacaaagagccctgggctgcttggggcccattgttaccagaagcaacctaggcggctcagtgctggggactgagccagctacaatcccta

SEQ ID NO: 161641 - DNA, 601 bp, Human
ctgctccttacagtactacgaataaggaccaatatgctactttcatttccacaagagctttagcagaactaacgactgtctgacctctaccttcttattttattcttgaggtttccactactaaagtataggaaggtcctggtctcaaaaatagccacacagggcaaaagggaaaaacaaataaaagcctggttcagaaacgccccatcctctgttaagttcaagtctttacatttcaaaagacagccttagaaattaagctcaccacagtgctgatcttcttcttcccatcggtagctcktaacagacacttgttgtctgcgggctcaaagccctccacagtacctttctttggaatgggtttggttcgaccgtcatctgaaggaaaaaatgcatcctggtgaacacggctgcgtacgtggctgagcggcagacaaacagttaaaacagaggagtggggtaagtgatgacctaatccagccccgctgctctagttttgttaaacacctcatctgctatcacggtctggcgaaaccctggagaaactattatttccacgacggaaacatgtaatatcgaagcacgttaaattccactcaaa

SEQ ID NO: 161642 - DNA, 601 bp, Human
ttcaagcatatttaagcacaatgcgagctaccacaaaataaattctacctctgaagaacactccttaggtttttgttatttcatgatatctaacttaatctgtaaaaccacataagcttgttttactgtagaagtcctctcaagataacttgtcgtgggagacttccaactaagtatagtctacattttcatgcagtcagtatcctacactaatgtgatttctgccacagcagaataaagtagtattcactcaattcaaggagcctcttcctttgccttattcaacctccactgaaagacyagggctcttgactaaatgtatattttctcaagtgtcaaacctaacatctagctgcacattcgccatgtgaaccacaaagataaggaaataatagcatcacctggtaccaagaaactgcttattgaaggcccagcacagtaaggggctaaggaatcaaatatttatgccagctgctccttacagtactacgaataaggaccaatatgctactttcatttccacaagagctttagcagaactaacgactgtctgacctctaccttcttattttattcttgaggtttccactactaaagtata

SEQ ID NO: 161643 - DNA, 601 bp, Human
atcccttagaaaggtggcattgggttttctccctgggttctgagaaaagtcagaggacttctcagtattaattttttatacattaatagaagatatatttaaactactccctccccatcttatttttaaacctgccttccattaattcaagcatatttaagcacaatgcgagctaccacaaaataaattctacctctgaagaacactccttaggtttttgttatttcatgatatctaacttaatctgtaaaaccacataagcttgttttactgtagaagtcctctcaagataacttgtcgygggagacttccaactaagtatagtctacattttcatgcagtcagtatcctacactaatgtgatttctgccacagcagaataaagtagtattcactcaattcaaggagcctcttcctttgccttattcaacctccactgaaagactagggctcttgactaaatgtatattttctcaagtgtcaaacctaacatctagctgcacattcgccatgtgaaccacaaagataaggaaataatagcatcacctggtaccaagaaactgcttattgaaggcccagcacagtaaggggctaaggaatc

SEQ ID NO: 161644 - DNA, 601 bp, Human
atgttagctctaaggaggtttgaataagcctgaaagatacaacagagcataccttagtgggaagatgtgcaaactggcagaacaccagccctatctgcataatggatttagggtagccaaaaatcaggaaagaatatagcaccattggacacttgtaccggaaaatggtataagcataaaacactctttcacattatagcagcttctgcaacacccacagacagttgcacacattttttacgtttttttccaagggaaaattgcaggcaacttcttgttcaactatagtataggtagcatrtatctacagcctaagacaaaatctaacttaaaaaaactagaaaggaagacggtattagcgttgaaattcacaccctggcagcttttacttgaaacatactggtaaaacttatctccggagagcagtgaacccaagtatcaatcttacccagtgttcactatcatactgactcttgccctgagaagggaaacataaggaacacccaaaactcaccatctgaaacttattcacttccttggagctcacctgaaaaagaaggaaaaaagaggtcatacctattatccatataagcatcctctt

SEQ ID NO: 161645 - DNA, 601 bp, Human
tagattcttaccacaactatcctataaacactgcaactattctttccaaaaggaccctaatcttatgtgaaaacacctactgtgggggaaccagaaacctagctatctggccaaaaggaaaaaatagcaattcagtggttaattggtgaaagcaggaaatgtatgccctttactgtgctgctgttgctgctgttgttgctgctgttgttgctgctgttgctgctgcggcaggtgctgctgctgctgctgctgctgctgctttggtcttcttagttttgttctttttgtctctcttcttcarcccatccatgttagctctaaggaggtttgaataagcctgaaagatacaacagagcataccttagtgggaagatgtgcaaactggcagaacaccagccctatctgcataatggatttagggtagccaaaaatcaggaaagaatatagcaccattggacacttgtaccggaaaatggtataagcataaaacactctttcacattatagcagcttctgcaacacccacagacagttgcacacattttttacgtttttttccaagggaaaattgcaggcaacttcttgttcaactatagtatag

SEQ ID NO: 161646 - DNA, 601 bp, Human
aggtttttaagtttcccatgaagcaaaatctaatataagcttaccagggtattccaagaaccttgtatatttagcacaagaaacatgactgagtaacacagggagggaaacctgggtgtattcataaatatatatctcatttaatcagcaaaacaacttattctcacctttagacaaatgaaatttgggatccagagaggtctagtaacttgactcttgtactacaaagttgtgaccactgaatttttttgccaaggtaaaacgattccaaagctcagttttttccagggaaacactgccyctttatagtaaatagaaaaagtatcaggagagtttaaaaatgtttgaaagaaagcaaaattagcaggagcaaacaaagtagcgtggggtattttactattgtgtcttaagtctgtggtattcagaatacgcctgtgtgtgtcatttgagctattgtcctggtgatcaggattttccaaatattttgtcctgttttcctgataagccatttggatgtcctaagttggtttgatagaaagtgttcagtcagggtatctgcagtggaaattctgttgtgggaagaagcttggcgtgttcaaaa

SEQ ID NO: 161647 - DNA, 601 bp, Human
agccacagtaaaaatggaatccctcaaaagaacatagatataccattgccgtcaacatcaatggattaacttgtagaagttaacagaaaactaatatttattgaatttttaataaatattagcatgtttacttttacctttctttattcattataacattcctataaagaatgtagcactatctatgtttgctaggtgagaattccgaggctctaaaaagttaagtaattttccatagttatgatgatatgatagaaaaattgtggccgggactccaaagtcctgaattcttggccagcgrccagttctgacattggttctgaaaggagcaaacattcactcttgagtaaaaggcacatgtattttcctaatgaagtattgattccagttgaatcttcctgtgagctgagatcagtcatatgtgactcacaggggccacatttgtttctttgtcctaagacctatataaatccaggactttctacttccattcctgtaagcacactctactctctaccctccaaatcggtacttctcaggctatctctagtgaaagataattttctctccacaataaattgtatactgatactttgctaaa

SEQ ID NO: 161648 - DNA, 601 bp, Human
cctttctttattcattataacattcctataaagaatgtagcactatctatgtttgctaggtgagaattccgaggctctaaaaagttaagtaattttccatagttatgatgatatgatagaaaaattgtggccgggactccaaagtcctgaattcttggccagcggccagttctgacattggttctgaaaggagcaaacattcactcttgagtaaaaggcacatgtattttcctaatgaagtattgattccagttgaatcttcctgtgagctgagatcagtcatatgtgactcacaggggcyacatttgtttctttgtcctaagacctatataaatccaggactttctacttccattcctgtaagcacactctactctctaccctccaaatcggtacttctcaggctatctctagtgaaagataattttctctccacaataaattgtatactgatactttgctaaattataataaaaaaattcttagaaaaattaatttttaaaatacttacaaaatacatgctccatttttattgcctaatatttaccttcaacagacataaatttgttcctttagattgctatacaagttttcattttta

SEQ ID NO: 161649 - DNA, 601 bp, Human
gaggatttaagcgtgcattgttccagcttgtttgcacgttttaccttgcatactgaatgtcattataaaccatccagggttttattttttccacggttgcccaggccatttaaatattgatctatttaattatttttttccagtagaagatgttgatttcaaaccattgcacctaagagaatggtgggttcttcattagaacttctttttttattattattattattattatactttaagttttaggggacgtgtgcacaatgtgcagctttgttacatatgtatacaacatgtgccatgytggtgtgctgcacccattaactcgtcatttagcattaggtgtatctcctaatgctatccctcccccctccccccaccccacaacagtccccggtgtgtgatgttccccttcctgtgtccatgtgttctcattgttcaattcccacctatgagtgagaacattcagttataagaggctgtgattttaaattcacatatggaggcttttataaggaataactctcctcttgtacctctcattagtcatcaatgagaattttagacggtcccagtttgttgctggagttaatagaaagtgata

SEQ ID NO: 161650 - DNA, 601 bp, Human
tttccacggttgcccaggccatttaaatattgatctatttaattatttttttccagtagaagatgttgatttcaaaccattgcacctaagagaatggtgggttcttcattagaacttctttttttattattattattattattatactttaagttttaggggacgtgtgcacaatgtgcagctttgttacatatgtatacaacatgtgccatgttggtgtgctgcacccattaactcgtcatttagcattaggtgtatctcctaatgctatccctcccccctccccccaccccacaacagkccccggtgtgtgatgttccccttcctgtgtccatgtgttctcattgttcaattcccacctatgagtgagaacattcagttataagaggctgtgattttaaattcacatatggaggcttttataaggaataactctcctcttgtacctctcattagtcatcaatgagaattttagacggtcccagtttgttgctggagttaatagaaagtgatagtgcagggcgctttaaaattatacagagagaactcttgaagatttttgagcagagacaatgtaggatttatcaggcttgctatatgg

SEQ ID NO: 161651 - DNA, 601 bp, Human
ctcttgaagatttttgagcagagacaatgtaggatttatcaggcttgctatatggaatggattagagttaggagaggagagaggaagtcctgcaggaaggctctcagagctgtcaaggtgagatgtggtgagggtccgcattgggtgaaattatactaatgctggttgaatgtaaaaactgagacaatttcaaaaaatcttgtacctcatagaaaaaataaacaaaatgctaaatcatttggcaagggtaccagggaaggatgtctgatagttacatgatcttgaggataaataaaagggrcatctctcacattggtacttcgtcgttaatgttgtaacttcaccttctcccaatactgtgacccctcagaaggaaagccagggaaggggaaagtagactcatatgtatttcacgctatattccgtccactgctatgggaatccatcatctaagatgataggggaaaagaagtaggattctattactttaataattaccacactcagcattcttctttggttacttcacaatcagtagaaaacacttaggcagcttatgatgtctgtccctattcctggaagttaaatgacttttctcttt

SEQ ID NO: 161652 - DNA, 601 bp, Human
atttgtctggaaaagtagtatctgtgaagggccaaaataagtgttcagtaattggtatctatggtttttcatggtaattaatgatgtatattatatggaaatgttagatccttctttttcacaagtttctggacaaaggagatattacaaaatgtttttatgtttattaaatccattttcataaaaggaagtttttggattctcttaacagatcattgacattctccttgttgcaataaaacaaatgatacacatcacttatttccttttcccctagacacacacacacacacacacacaatgactcacacacacacattctgtttctcactttgcttgtttgatcttcagcacagacggatattgtttcacgatgatagaagaggatgactctgggttgcctgtggtcacttctggttgcctaggactagaaggctcagattttcagtgtcgggtaaggtagataacttgattctgtaacctttcattggctagatttccaacaagtttcaagcaagataaaaccattctttttcttggccagcccatttttagtatagtcatgagctgcacaaaaacatttaggtcagcaacagatggt

SEQ ID NO: 161653 - DNA, 601 bp, Human
aactaccatttgtctatatttattttaaaagtaaagaccatataaagggctaaattaaacattatttgctatatggcatttcctttttttatgctagagtaacaccttttagtcaaatcgtatcaatatattgataaaatggggaaggtatctaaaagttttaatttcaaaacttacccatttaagtgttgttcctttaaaatgacaaatattgcctcccaagatattgcctcccaagagaccttttgtttgcaacaggtctcatgttccctttctcctcctccatgctttcagcgcgcggacacacacacacacacacacacacacacacacacacacacacacacacggttttttgttgttgcagagttttaagtcctaaatcttatctaagtgatttaaagtgatttttcatgattgattttatttcttgagaagagaaaaatctttccaacaaaacataatggaatttcatgactttgttttgctttctctctctctctctcttttttttttttgagacagggtcttgctctgttgcccaggctggagtgcatggtgtcatcatagttcattgcaacctccacctcctgggctcagg

SEQ ID NO: 161654 - DNA, 601 bp, Human
agtagttaagtgcagaggtctggtttgtaatattggagagccatttgctaactacaggagtatgaaacagcatgactggttggagaaaaatcccataattaagagagatgagggctgggcacagtggctcacacctgtaatctcagcagtttggaagaccaaagtgggaagatcgcctgggcccagaagttcaagaccagcctgggcaacatagcaaggctccatctctaaaaaaaaaaaaattttaatgatctgggcatggtggtatacatctgtagttgcagctactagggaggctaargtgggaggatcacttgagcccggaagttcgacattacattgcgctacagtcctgccactgcactgcagcctgggtggcagaatgagacactctttctaaaaaaatctttttaaataaataagaaaagagagatggggccagatttcagtccagttaggagtgtgaaggtgagagagcattatctgaggaggatgtaggaatttagaaaaatagtagaataaaactccaaaggacagagtaaaaaggcttagaaaaggagggtaggaacaatgagaagacaagttcttggtccagggcagt

SEQ ID NO: 161655 - DNA, 601 bp, Human
gaactgttcactttctgagactctggctgtggcttgaatgtttacattgttagtgctccgagcacaggtaatggcagattaaaacatgaccagcgtgaccagcagaaacaaaaggtttattgataaggatcacctattcatgagagaagacaaggaggctgccggggatagggttatggggcaaataaaaggcaaatgggaaggtaaagctagccttaaataaagtgcttgatggaaaggaaagaatcccttgatccttctggtctcattgctctcataaatcagaaatataataagatawgtaatacacagtgttcttgcagctcagggtgtatcctgtatcttgcatttacatggaaagtaaaaggcagtgaagcttggagtcttagtaaaattatatcattggaatggaaaagtattatgtgttcatatactgataatatattgacattataattatgtggatagttctagttttggttgagtatctagcattctcctaaaatctaaaatttttgcaaaatctttcgttatctttaaaattggaaatgcatttaagttaagtttccagtcgcagtcttaacgtatttgtgtgttacag

SEQ ID NO: 161656 - DNA, 601 bp, Human
gttaagtttccagtcgcagtcttaacgtatttgtgtgttacagtgtttggatgcttctatctgtataaaaatattgtgagttgtgctttcactggttgaggtattatgataccttgaatttatttttaactctttatataacctaagagagggaggaatggaggaaaaaatttactaagacaatttattgtgttaaattttagcctgcataacattaagagcttacagattattttcaagatttactaagcagcatgtttagacaatgaatgctcaaattatatataattcctgtttgtcytgaatggctccttgaatggctcctgttgagccctgaatgactttttacaagtgctataatatgtcaagttcctgagctcccttttcctggattattggtaacatttcttaatttattcatataataactgctttagtagcctctcatttagtgttttcagatgcagattactttcattaatattttgcaactattacaaatcataaatagctgttaaacatatatattttagactgatgagtaaatcataacactgaccatcatgaagtttggataagaaattcatagtggatttttgtt

SEQ ID NO: 161657 - DNA, 601 bp, Human
ccttccttccttccttccttccttccttccttccttcctttccttccttccttcttctttcttttcttttctttctttctttctctctttctctctctctctctttctctctctctctttctgtctgtctctctctttctctctctctctccctcccttcctcccttcccttccctccccctgctcccctccctcccttccttacttccttttcaagatggagtctctctcagtcacccaggctggagtgcagtgacacgatttctgctcactgcaacctccacctcccgggttcaagcarttctcccgactcagcctcctcagtagctgggattacaggcgtgtgccatcatgcccagctaatttttgtatttttgtagagacggggttttgccatgttggccaggctggtcttgaactcctgaactcaggtgatccgcccaccttggcttcccaaactgctgggattacaggcgtgagccactgtgcccagccagtcagtagcatttctatacaccaataacatccaggctgagagtcaaatcaagaacacactcccatttacaatagccacaaagaatatgaaatacataggaataca

SEQ ID NO: 161658 - DNA, 601 bp, Human
tatttgacaatatgtatgaaaagacttaaaatatatatcttatgaactaacacacctacttctgggaatcttattaaggaaataatcattagcatgtgcaaagatgtatgtgtaagagtgtttattacagaattgtgtataacaaagaagccttatggcagaatctttagaatctcctgaatgtatgacagaagattcactttctaattaggatgattttatgtataatacagtttagtctttaaaagtcaggttgtagctgggcacagtggttcacgcctgtaatcccagcactttgggwgaccgaggatcacttgaggccaggagtttgagaccagccgggccaacgtggcaaaaagccatctctgctaagcatacaaaaataagtggggcgtggtggctcgtacctgtgatctcaactactcagggtgctgaggcacagaatcgcttgaacccagaaggcagaggttgcagtaagctgagattgtgccactgcactccagcctcggccacagaggaagatcctgtatcaaaaaaaaaaaaaagtcatgttgcaataataaataatttcaaataggtgggaggacactgaatgttccca

SEQ ID NO: 161659 - DNA, 601 bp, Human
aacacacctacttctgggaatcttattaaggaaataatcattagcatgtgcaaagatgtatgtgtaagagtgtttattacagaattgtgtataacaaagaagccttatggcagaatctttagaatctcctgaatgtatgacagaagattcactttctaattaggatgattttatgtataatacagtttagtctttaaaagtcaggttgtagctgggcacagtggttcacgcctgtaatcccagcactttgggagaccgaggatcacttgaggccaggagtttgagaccagccgggccaacrtggcaaaaagccatctctgctaagcatacaaaaataagtggggcgtggtggctcgtacctgtgatctcaactactcagggtgctgaggcacagaatcgcttgaacccagaaggcagaggttgcagtaagctgagattgtgccactgcactccagcctcggccacagaggaagatcctgtatcaaaaaaaaaaaaaagtcatgttgcaataataaataatttcaaataggtgggaggacactgaatgttcccaacacaaagaaatgataagtgtttgagatgatggatatgctgtctgatc

SEQ ID NO: 161660 - DNA, 601 bp, Human
aaagtcaggttgtagctgggcacagtggttcacgcctgtaatcccagcactttgggagaccgaggatcacttgaggccaggagtttgagaccagccgggccaacgtggcaaaaagccatctctgctaagcatacaaaaataagtggggcgtggtggctcgtacctgtgatctcaactactcagggtgctgaggcacagaatcgcttgaacccagaaggcagaggttgcagtaagctgagattgtgccactgcactccagcctcggccacagaggaagatcctgtatcaaaaaaaaaaaaaagtcatgttgcaataataaataatttcaaataggtgggaggacactgaatgttcccaacacaaagaaatgataagtgtttgagatgatggatatgctgtctgatcactgttcattatgtatgtattaaaatattataattatgtgtcaatataaaaatcctgttgcagaaaaaaatatttgttgttctggaaaatgttcacagtattataaatgagaacaacctagttataaatcagtatatattatattttgcttatgaacatttttattgaaatgatactgttagcagtaatttttcct

SEQ ID NO: 161661 - DNA, 601 bp, Human
tgtagctgggcacagtggttcacgcctgtaatcccagcactttgggagaccgaggatcacttgaggccaggagtttgagaccagccgggccaacgtggcaaaaagccatctctgctaagcatacaaaaataagtggggcgtggtggctcgtacctgtgatctcaactactcagggtgctgaggcacagaatcgcttgaacccagaaggcagaggttgcagtaagctgagattgtgccactgcactccagcctcggccacagaggaagatcctgtatcaaaaaaaaaaaaaagtcatgttgmaataataaataatttcaaataggtgggaggacactgaatgttcccaacacaaagaaatgataagtgtttgagatgatggatatgctgtctgatcactgttcattatgtatgtattaaaatattataattatgtgtcaatataaaaatcctgttgcagaaaaaaatatttgttgttctggaaaatgttcacagtattataaatgagaacaacctagttataaatcagtatatattatattttgcttatgaacatttttattgaaatgatactgttagcagtaatttttcctgagtgttgaa

SEQ ID NO: 161662 - DNA, 601 bp, Human
aatacaacatatatccacgtcattgcaaatgtaatctctttactggacatcactccaactcatggctcaaggcctacctcatgttttacctctgtgacaacttctcagttaccccagactaagccagtctatttatcttctgtgataacattttatttttagcactaataatggccatttaaaataatgttataattagtggtaatgttcttgtgtcttttggtggagtctgtcctctttggggtagaggttacattttgctcactttctatccccagtagagtggctgatttattatagrcgctgttcaataatttgtttttaaaaagctttcagctcctacttttaatagctataaaaatactgtcttgtttctataatccagataccaaaaaataatatttggctcacatcatataatgattaaaagcatatattctcaagccaaattgtctgggttccaatcctggccagacattggcctttaaaactaaatcaaattctcatttagtcctcatagcaaccctataaggtagtaccagaaatatcagtataaccctgtattacacatcaggggatacaggcccagataggtcagcta

SEQ ID NO: 161663 - DNA, 601 bp, Human
agctcctacttttaatagctataaaaatactgtcttgtttctataatccagataccaaaaaataatatttggctcacatcatataatgattaaaagcatatattctcaagccaaattgtctgggttccaatcctggccagacattggcctttaaaactaaatcaaattctcatttagtcctcatagcaaccctataaggtagtaccagaaatatcagtataaccctgtattacacatcaggggatacaggcccagataggtcagctagctagtacgtggagaagccaggattcaaacccaratgatctgtgctcttaacattagtgagatgtgaactaaatgttggttaaataaaacaagaaagtgcatttgatggcggtaggatgggaaggagggttctataaaactcagttcaataaagaaaaagtctctattacagatttattttctggttttaagatttggttattaagataaacaatgcagaggtatacagttctctctccatatattgatatgtgagtgaatacctcatcttaacattgatttgttattaattttaataacataatgggcaaattagtgccttatatataaccac

SEQ ID NO: 161664 - DNA, 601 bp, Human
ctctataatcttctctcattctctttctttcttctctccctccatttttttttgttctcctttttcctccccattcttggatatttcctttatttccctgtgagcccaggagtgcattacagtttatttcttatgttatacccatgatcaagttgtatggtggcaagagttccttcaaagtactattatcccgccatagtcacggcatgaaaagtattctgcaaatggtttcctcaagagagagcatttgtaatgaggagccttggcatgctaccaacccatagcaaatttagtaccattygatgctctctgcttaatgctgaagccctaggttcagttcctctggttttaaaggagtcagagtttaaactctggattccagttctggtattgttctttgcccagacggcagcttggtttatcgttccctggtctggtctcaactccttccttccctccctccttcctccctccctcccttttttcttcctccctgcatatagatttcctttatttctgtatgtgcctaacaatgcattacaattttgttttgttatatttatacatgattaggtgtatggtgacgagtctcttcagagta

SEQ ID NO: 161665 - DNA, 601 bp, Human
agtttcttcctttgagacacctttttttatttttattttttagacaaagagtggctctgtcacccagactggagtgcagtggcaccatcacaactcactgcagccttgaccttcgaggcccaagcagtcctcccacctcagcctcctgagtaattggaacttcaggcatgtgccaccatgcctggctaattttttttttttttaatagatgggatctcactatgttgccaggctggcctcaaactcctggactcaagtgatcttcctgcatcagcctcccaaaacgctgggattataggcrtgagccaccatgcctggcccacctgctgttttttttttcattatacttttaagttctagggtacacgtgcacaacgtgcaggtttgttacatatgtatacgtgtgccatgttggtgtgatgcacccattaacttgtcatttacattaggtgtatctactaatgctatccctcccccctccaccccacgacaggcctggtgtgtgatgttccccaccctgtgtccaagtgttctcattgttcaattcccacatatgagtgagaacatgcgatgtttggttttctgtccttgcgatagtttg

SEQ ID NO: 161666 - DNA, 601 bp, Human
gactgctgtgctagcaatgagcgaggctccatgggcgtgggaccctccgagccgggcgtgggaccctcggagccatgcgcgggatataatctcctggtgtgccgtttgctaagactgttggaaaagtgcagtattagggtgggagtgttccaattttccaggtaccgtgtgtcatggcttcccttggctaggaaagggaattccctgaccccttgcgcttgccgggtgaggcgatatgccccaccctgcttcggctcacactgtgtgggctgcacccactgtccgacaggccccagtgagrtgagcccagtacctaagttggaaatgcagaaatcactcatcttctgcgtcgctcatggtgggagctatagactggagctgttcctattcggccatcttgtaacttccccacctgctgtttttagtctccgttcttatgtcttctaatgtaactctgtgcttattaccatgaaatgtcttgcctgttatgtagtcatcattgactacttatttgtcattcccaatggaaagtaagccccttgaaagtagataacatgcatttttcagatttgcgtttctagtgcctttccctggtgctcat

SEQ ID NO: 161667 - DNA, 601 bp, Human
ttgtaacttccccacctgctgtttttagtctccgttcttatgtcttctaatgtaactctgtgcttattaccatgaaatgtcttgcctgttatgtagtcatcattgactacttatttgtcattcccaatggaaagtaagccccttgaaagtagataacatgcatttttcagatttgcgtttctagtgcctttccctggtgctcattacttaacttttaatggataaatgattccatatggaacacaggatgaaggaaaaagaacttttttcctaacaccagagatcctacacattctggacraaatccccctttctaatcttacattctacaaactctccaatttgtatgctttcttttgcgaaactgagctgcttgaattttctccttatatattccatgcttgctgttgccttgcttttgattgcacagtccctagcttggaaagtccctgattttccatgtatcttaatccagtctcagaatcacctctaagtcacttgattcatcccccagctgagaataatgacagcatcttctgtactactctttaatttcccggtctttgtctgcttggtattataattattttgggacatgctt

SEQ ID NO: 161668 - DNA, 601 bp, Human
cagcttaccctgtgctgaattctctgacttcatatgagaacttcctgtgagacagtctctgtgtaatggtaagtgttctcttaggcttttcagtcatttctgaaaggctcccagggaagtcgagagccacagagagggagcagactgtgcctgagagatttcctgctcatataaattttaaaacgctgtattggtttcttcatgcattctcttgacagtgacgtaagtgccgatgcatttcctgctcagcagaaatttaatccaggtgatgtgctggcggacatcaccattaccttcaatytctattgggaggagaaaacaatgacacatgaaatgccttgaagaaacttacaaagcttttcactcttcactctgaagaattcagcaaccactctgagacttcagagtcagaacaaaatattttcatatgggaaaaataaatcctggcttagggctctctggtattaaattaaaataaaaaacctgcaataaagactaggctgtcacactgatgtccagtggatgattgagaaattatccaagtacaaaagagatagggtagcttagttcggagggtactgaatttcttgagtcttgctga

SEQ ID NO: 161669 - DNA, 601 bp, Human
atgagaacttcctgtgagacagtctctgtgtaatggtaagtgttctcttaggcttttcagtcatttctgaaaggctcccagggaagtcgagagccacagagagggagcagactgtgcctgagagatttcctgctcatataaattttaaaacgctgtattggtttcttcatgcattctcttgacagtgacgtaagtgccgatgcatttcctgctcagcagaaatttaatccaggtgatgtgctggcggacatcaccattaccttcaatttctattgggaggagaaaacaatgacacatgaartgccttgaagaaacttacaaagcttttcactcttcactctgaagaattcagcaaccactctgagacttcagagtcagaacaaaatattttcatatgggaaaaataaatcctggcttagggctctctggtattaaattaaaataaaaaacctgcaataaagactaggctgtcacactgatgtccagtggatgattgagaaattatccaagtacaaaagagatagggtagcttagttcggagggtactgaatttcttgagtcttgctgatatgattctttttagcactgcttttggtttgca

SEQ ID NO: 161670 - DNA, 601 bp, Human
gcatgtgcccaaaggctcaatgaggtagagccaccttgttggagctagcaactctttccctgcgctcgcctctcattgccacagcgggctgtgcttaggactttcatgagactcttacttcagtttatggtacagtggggaaagtgccctgtgctcagtcaagtagttggggctcttttttttttttttttaacataacacttttagccagaatttctgggtttaggtttataactaaaaggcttaattaacatgaaaaacatttaatatattatgaggctgaagagatactatatttttraaaaactcccccttactccttgccaccgaaacaaaaatcttttgcctgccctcatttaatgcatgatagtcaagagcttaaggcatgcactgttccctgagtccactggggtgctcatgtttcattctccaacctgctcaggatcccagctgaaggctccactttcagcctttctgcacacacaagcagccccatgacttccctcccacagttacactaacacctgcagtgcacacacgccataccaggcagcagtgctgtgctaaggggcacgccaggggtggtacaccaggcacaggc

SEQ ID NO: 161671 - DNA, 601 bp, Human
aagagatactatatttttgaaaaactcccccttactccttgccaccgaaacaaaaatcttttgcctgccctcatttaatgcatgatagtcaagagcttaaggcatgcactgttccctgagtccactggggtgctcatgtttcattctccaacctgctcaggatcccagctgaaggctccactttcagcctttctgcacacacaagcagccccatgacttccctcccacagttacactaacacctgcagtgcacacacgccataccaggcagcagtgctgtgctaaggggcacgccaggggyggtacaccaggcacaggcaggaagggagtacactgtcgataataaaactgattaaaatcctacttttattgtcaccatgtgctgcaattctaaacaatgtcagtggctaaaatatgtctcctggcagagtgagtggctcccatcaccccctccttggtatgtccttccctggcaccttcagaggagaagaggaaaatcatagtttcgtgtgtcttttaattttcttgtctctctctctctcaaagtctttccctttgctccccttccctaccctcaaaaccataacctacagaactgtca

SEQ ID NO: 161672 - DNA, 601 bp, Human
cctggcagagtgagtggctcccatcaccccctccttggtatgtccttccctggcaccttcagaggagaagaggaaaatcatagtttcgtgtgtcttttaattttcttgtctctctctctctcaaagtctttccctttgctccccttccctaccctcaaaaccataacctacagaactgtcactttgttagtgtcttccctggggtagaagagccacttggagtgtccatagacttatgaagccctttgattatcaatgtagacctcatactccaccatgctggcattttctatatcatacyactgtcattcaagtgactttggtcagaaatatgaacttggttttctggcctctttaaataatcctagctgagagcagccctgcattttgagatccagatgaatgcagacattaacctcattcgtacctggtacagtagggaactcagcattattcactgcttgtctgggaattcaaaggagttgtgttcccctttgcattatcagccgatagctcccatatatgttgtgccttttccacattatatagttgctggttcctggcttccaaaatacgaacagctcaggtttgaagatgtttt

SEQ ID NO: 161673 - DNA, 601 bp, Human
tttgagatgaggtctccctctgttgcccaggctagagtgcagtggtgtgatcttggctcactgcaacctctgcctcctgggctcaagtgatcctcctgcttcagcctcgcaagtagctggggctacaggcatgtgccaccacacccagcaaatttttgtatttttagtagagacggggttttaccatgttgcccaggctggtcttgaactcctggactcaagcaagcaatccacctgccttggcctcccaaaatgctgagattacaggcatgaaccaccacaccaggcctttttttttttwaaaaaaaatactcattgaagcatgatttgaaaactaagaaagcttttttcctggagaggaatttatctgacatctctttattttattttcctcaaattgtatttccttctaattctacttaagtctgaatctctttagtactcacattaacagggacaaaagccatgttggatctagtggcagcattgattattgaagtataaaagggcaaaattgtctactcttataattctctgaaccctactcttaataatgacctctttgtgcacacatttccaaccattctccatgggaaagaag

SEQ ID NO: 161674 - DNA, 601 bp, Human
catctctttattttattttcctcaaattgtatttccttctaattctacttaagtctgaatctctttagtactcacattaacagggacaaaagccatgttggatctagtggcagcattgattattgaagtataaaagggcaaaattgtctactcttataattctctgaaccctactcttaataatgacctctttgtgcacacatttccaaccattctccatgggaaagaagaagagagagaacatttcttctgtagtgaatgcaacacttttgtttttaatgggatattttcagttctcctycgtagcagctcattttctctgtaattttatccagtttatttatatcacttttgttcttcccgtccttatgcctataacctgtcctgtaatccttgaaatgtacattttctagttctggatcctgctgggttcttttaacttatactatacttagaaatatatatacttatatttgtgatataaacatacacaaaagtataaaaatgagacacccatgtaatatgaacagatgttagcagtttaccttgtttttctctggtttttctttttaaaagaaataaaatgttgaagatagccctg

SEQ ID NO: 161675 - DNA, 601 bp, Human
acagattacttactcaaatgttactagggagaagatttattcagctactactagggcaaacgtctagggtgggagaggaaggggaggagagagatggcttattgctgaacatgcatatgtatttaagggactatgtaaaggactgatttttggcatttggtggacattcagaatccttgagtgtatgtttttgcagtgtttgagaaaaagaatttagagatgaactatgtatagtccagctgtcacaaattttaattctattattaggtcacaattacctttcatttttctaatagatatstctacatcacacattccattatcttttcctgacctcccaaatccaaataaacattaaggagctaagagtaagaatggaatgaaattgcctaaaatctttatcaactgtggtcagattacacctttggcctttctaaatgcccttctgtgtggattgtcttaagattcttcttgttctggaatacagtggaggtctttaaccatcttcttttcatctgcaaaccctcatgtttgttttctctgcatgggacccaggacttcttacctggggtcaccactatcttcctcatgattaaaaatt

SEQ ID NO: 161676 - DNA, 601 bp, Human
atgttactagggagaagatttattcagctactactagggcaaacgtctagggtgggagaggaaggggaggagagagatggcttattgctgaacatgcatatgtatttaagggactatgtaaaggactgatttttggcatttggtggacattcagaatccttgagtgtatgtttttgcagtgtttgagaaaaagaatttagagatgaactatgtatagtccagctgtcacaaattttaattctattattaggtcacaattacctttcatttttctaatagatatctctacatcacacattcyattatcttttcctgacctcccaaatccaaataaacattaaggagctaagagtaagaatggaatgaaattgcctaaaatctttatcaactgtggtcagattacacctttggcctttctaaatgcccttctgtgtggattgtcttaagattcttcttgttctggaatacagtggaggtctttaaccatcttcttttcatctgcaaaccctcatgtttgttttctctgcatgggacccaggacttcttacctggggtcaccactatcttcctcatgattaaaaattaaaattaggacatgctg

SEQ ID NO: 161677 - DNA, 601 bp, Human
gatgacatatctgttgatatgtcatcttatctaaaacataaaattttagattaagaattctagccggaagtgactttaaaatgttctaaaatgaagttttgcattttatgttttagtaaatgtaaaaattttgagatattcagaatgacacttaaaatgttctcaaatgacaaaaaatgacaccatgtatttcatgttgtagaagtggtcaaggcaatgagatcaaacccagaggtttttgatttttgtttttttcctgaagccactagtgttttggtattgactatctatgacagcaggrtaagtgtgatattcgataaatgaatctgttttccaggctgaggagaaataacatgtaaattcttgaaagtcaatagagtgtaatgaaaagcaaaagcaaaaaaaaaaattgttgggaatcaggaggtagaaaggtttattcaagattttccacagagttcagcttaataatgagtttctgtacctttttggttttatagtataccttatttggttatagtctgttcatctgtcatatctagggtttgttacttttctacctagttcctttactttctgatgagttacagtacttaagtat

SEQ ID NO: 161678 - DNA, 601 bp, Human
tccagtcttacatcatggctgacatgtatagttttggcctcatcctttgggaggttgctaggagatgtgtatcaggaggtaagaaacagtgctgtctttgaaaagctactattggagctactataaatcctttctttctgatcagaaatcaaagttatcatactgtctataagatctggttttattttcccctttatttctgttgatgcagtcatagtgcttccaggaaattatattcgacatcctagaataatctttgactgcttccttcctccagctgccactagacacactgtcagcytaccctgctttttcaagcatcactgttttctgctctgtgtattgtcttatttctgtcttgggttcttcctccagcagttgctcgatgaaatcaaacccccttttctgtccctgccagtttattctcacctagctgctgggccccatccccaactccattccctgggatttcctctgcagagatgacagtaggccataaatgtggggtcggacacccatttcttaccttctgtattttttataaaacttccccataaagcaatttgaaaacatcagttttttatcaaaaggaaattaaagt

SEQ ID NO: 161679 - DNA, 601 bp, Human
cagtcttacatcatggctgacatgtatagttttggcctcatcctttgggaggttgctaggagatgtgtatcaggaggtaagaaacagtgctgtctttgaaaagctactattggagctactataaatcctttctttctgatcagaaatcaaagttatcatactgtctataagatctggttttattttcccctttatttctgttgatgcagtcatagtgcttccaggaaattatattcgacatcctagaataatctttgactgcttccttcctccagctgccactagacacactgtcagcctmccctgctttttcaagcatcactgttttctgctctgtgtattgtcttatttctgtcttgggttcttcctccagcagttgctcgatgaaatcaaacccccttttctgtccctgccagtttattctcacctagctgctgggccccatccccaactccattccctgggatttcctctgcagagatgacagtaggccataaatgtggggtcggacacccatttcttaccttctgtattttttataaaacttccccataaagcaatttgaaaacatcagttttttatcaaaaggaaattaaagtat

SEQ ID NO: 161680 - DNA, 601 bp, Human
aattatattcgacatcctagaataatctttgactgcttccttcctccagctgccactagacacactgtcagcctaccctgctttttcaagcatcactgttttctgctctgtgtattgtcttatttctgtcttgggttcttcctccagcagttgctcgatgaaatcaaacccccttttctgtccctgccagtttattctcacctagctgctgggccccatccccaactccattccctgggatttcctctgcagagatgacagtaggccataaatgtggggtcggacacccatttcttacctkctgtattttttataaaacttccccataaagcaatttgaaaacatcagttttttatcaaaaggaaattaaagtatcagagtattatttttttatattgttttttctacacatatgaggattccctagtaaaaacaattataatgaacaagaagacatatttaaatattcagaagtattattacttgtactattttgattgctctacagtctgtcttcgagtagattctgacaccttttaggcaaggagctgaatctttggcttttctgtatcaactcttctgtatgttattccatggttgt

SEQ ID NO: 161681 - DNA, 601 bp, Human
caactccattccctgggatttcctctgcagagatgacagtaggccataaatgtggggtcggacacccatttcttaccttctgtattttttataaaacttccccataaagcaatttgaaaacatcagttttttatcaaaaggaaattaaagtatcagagtattatttttttatattgttttttctacacatatgaggattccctagtaaaaacaattataatgaacaagaagacatatttaaatattcagaagtattattacttgtactattttgattgctctacagtctgtcttcgagtarattctgacaccttttaggcaaggagctgaatctttggcttttctgtatcaactcttctgtatgttattccatggttgtgctcattaaaaaaccttgatgctgctgctgttcctcataatggccaatttaagtctatcttcatgaaaacatgagcttgctgaagattctgaaagtgcagcatgcacttaactagtactgagatgtgttcttgttcctgctatttatctgtgatgccttggacaggttataaacttttctttgtttcagagtcctcttaaagatgaattgaattattgtatc

SEQ ID NO: 161682 - DNA, 601 bp, Human
ctgtggttgtatggtttcaatgtaaagataatgagaactgcctggcacataaatagcactcaatacatgttagctattattactattaatacttttcattttggttggtagagccataacatctttaggttcatatttaaatacaaagaagaaacagttaatcaacctgcattcacacttcaatagaaagatcattatcagtggcacagtgccttctaataatcactttgggaattctgaacctgttttaagaaatttgaaatagaacacatactctctgaagtgagggaactattttgtscaaaaggaaagttaatgcaggaaattttctctaaccagatattgaataaatttctcattctaagtgtaaagaagaagtaaccaaaaaatttaacaaattgtctatgccttgatttcacgcattataaagagtagataagcctcacgtttgcattcccagcattttgggagtccaagcggggaggatcagttgaagccaggagttgaggactagtctgggcaatagattgggacccagtctgtatttaaaaagaaaaaaaaaaaaaaaacaagtagacgagccttttaaaaaataatatgc

SEQ ID NO: 161683 - DNA, 601 bp, Human
tgctctgtcccataccaactgaatggacttgggcaagttacttaacccctgagagccaagtttcctcatctgagtagtgtggagaataatgtcatctcagaaacgcatttgtgagaatttaataagataatttatatagcatacctgtttccacaactgggatagaggaagctctcaataagcgattttatttttccagagaggcaaagcacacaaaattctattttctaacactttatgaagatattagaagttttttgggcttatctttctagtccaggcccttctgggtgaaagagayacatccagatgtaggcctttccatcttttaaaggagaagaaagacagaaaggtttgaggtttcaaacagagttaaatggcagctaacaggaaattttgaaaacttgattacatgacatggagaaaagaataaggcctattattcaacagttagatttgagtaattcataattttaagtggtgagctctgccttcgtctgttgtagtagatacacctaccccaccccatccatcagtccatccaccagcggaaaataggagatgggttaaagagatgtgggctttgccttcaggctgtttc

SEQ ID NO: 161684 - DNA, 601 bp, Human
gcagcggctagtaaggaagaaatgagtcttgcctttcctgactcctcctcctgttccacattcctctccttccaccctcgcagccttcaaactcaccatgttctagagttctctggcagactggaatgttcaagatgagtttgaagcaccactggaaaaaaaaacaggctcttatcaaacgtaccaaagcactgcaaaggggggacagagcactatttctgaagtgtaaaagccatttaaatataatctctgggccgggcactgtggctcacatctgtaatcccggcactttggcaggccraggcgggtggatcacttgagtccagaagttcgagaccagcctggccaatatagtgaaaacccatctctattaaaaaatacaaacaatagcctagtgtgttggtgcacacctgtattcccacctactcgggagattgatgcacgagaattgcttgaacccggaaggcggaggttgcaatgagccaggatcatgacactgcactcgacagaccgagaccctgtcttaaaacaaataaacaaacaacaacaaaaacaaaaacacctttggctcattggttttgtgtctagttactaaaatgct

SEQ ID NO: 161685 - DNA, 601 bp, Human
cactttggcaggccgaggcgggtggatcacttgagtccagaagttcgagaccagcctggccaatatagtgaaaacccatctctattaaaaaatacaaacaatagcctagtgtgttggtgcacacctgtattcccacctactcgggagattgatgcacgagaattgcttgaacccggaaggcggaggttgcaatgagccaggatcatgacactgcactcgacagaccgagaccctgtcttaaaacaaataaacaaacaacaacaaaaacaaaaacacctttggctcattggttttgtgtctrgttactaaaatgctaaataatatatacgttttccagcaagctgtgcagaaagctttatgagatgctggagctctgttattgtgggcttttggtgttacttgatatctcttcactgaggatttcttatgaagtgaaattgtacttttcaataggaagaccaataattgatgtaccacaggagaaagttttagtgatgctgtgcacaggtcattaatcttgttaaatggtgcagtgtgatgctattactgcagcagacagctatgatttaggaataactgtgtttgtttgcatagtatggaa

SEQ ID NO: 161686 - DNA, 601 bp, Human
ctcatgacagaatgctgggctcacaatcctgcatcaaggctgacagccctgcgggttaagaaaacacttgccaaaatgtcagagtcccaggacattaaactctgataggagaggaaaagtaagcatctctgcagaaagccaacaggtactcttctgtttgtgggcagagcaaaagacatcaaataagcatccacagtacaagccttgaacatcgtcctgcttcccagtgggttcagacctcacctctcagggagcgacctgggcaaagacagagaagctcccagaaggagagattgatccrtgtctgtttgtaggacggagaaaccgcttgggtaacttgttcaagatatgatgcatgttgctttctaagaaagccctgtattttgtgattgcctttttttttttttaagatgctttcattttgccaaaataaaacagataatgtggatggtttaagggttatagtattatagtttaaataataacaacaaaattcttcccaggaactctgctggaaggtaaattaaaatacttgtttttccattggtaaaatattgttgcactctgtgaaccaaaagacagtctaagttggaggacatag

SEQ ID NO: 161687 - DNA, 601 bp, Human
ttttggtagtacaaaaatgtgtctgatagcctataaaatgtactgctgttttaaaaattctattccgttttcaaacttaatggtgtataagctatagttattaacttaaatatattttgcttttaacatgatggaatttgtggcatatagaagacagtctgccgactactgctttttcaaaattgctttgttcttgatacatggcagtaggggtttacattagatgtatactacatgctttcaaaattagttgatggagtttatcttcatgataaaaaatgtaccagattaatcatagccmgtcaatacgaaagctcataactaatattttcactacttttaaacctataatagagaaaaatgaccctttgctaagcaggagaaatacccatattttataaattccttttaagactatgtaagtatatgccttgcattaatcttgaaatctttaaaaaaaaattgtcttaatgagggctagactaagaaatacatttcaaaaatcaatttccttagctgtttttaaaatagtgtttgaagtagcattagtcatattatccttctgcagatctacataatagtctcaaattaactttttctc

SEQ ID NO: 161688 - DNA, 601 bp, Human
tttcaagagaagctaggactctcccaattttaaaatgttgactcagtgtctttaaaacaccatacagcttacagtggcagaaagtctgcaagccagattgggctcctgatggtcccaattgcagcagcatgcatggcccgagagccccaggactgcttctacaaaatattttattttctaaaattctcagaaaattaactaaacaaattttttaaaaccaatattttatgtcagttcctattggcacgtggttatttttctaaactcatcagcccacatactttacatcaaactatgtacrtttctaaactaaagggtaatctagttatttcattcttaaactgaagtagtagttttctgaaacctgaatccatcatggctttatgcatcaatttcatttccaagttctctgattcaggataaactccccctttggaatattgtctttctctctctctctctctctgtctctgtctctggaaatgactgaacttcacccgttgttattaccctgccattgaaattcaaaacatgcactgccctcctggtttccagtgccctttaaaagcaatcagatcagtgttaaaatctatttttccaa

SEQ ID NO: 161689 - DNA, 601 bp, Human
tgatggaattggcaatttcttatatcttgagggggcgggggggtaaaaggaaaattgtgttaatagggtcttaaaatagagattctcttaggttaacctgaagatttactaaatacattatcattacagcttgttttgacatttaattgtagatggcactgtatcagcactgacttatttatacagctttgtttagacatgcctaatttttatttcattggtggaaccaaaccatcagtaataaatcatatatcagtgtttttgtacacattcgtatttacatgacttttaaaattccaawgtaaaggtctcacaacttgaaaaatgaatgaatgcctgagtatttgaacagttgggaaaatgtagttcaatttaagaaagattttttatgacaattcttatgccatatatagaaaatagataataaaggagaaggcctggaggtttagatgggatattggatcaatgagcaaaggaaggggaaaggtgggcgggatatgctgaagggtcatgggcttgagtgcaccctaagtcataaagagggtgtcccattaagaatcaggctgcctgaattctaagtaggaaagaggcaggtcaaaat

SEQ ID NO: 161690 - DNA, 601 bp, Human
ggatcaatgagcaaaggaaggggaaaggtgggcgggatatgctgaagggtcatgggcttgagtgcaccctaagtcataaagagggtgtcccattaagaatcaggctgcctgaattctaagtaggaaagaggcaggtcaaaatggtgtataggccaggcacagtggctcacgcttgtaatcccagcactttaggaggccaaggtgggtggatggcttgagctcaggagtttgagaccagcctgggcaacatagcaaaacccccctcttaaaaaaattacaaaaagtagctggacatggtggygcacacttgcagtcccagctactcaggaggctgaggtgggaggatcacctgagcctgggaggccaaggctgtagtgagccgagatcataccactgcactccagcatgggtgacaaagagagaccctgtctcagaaaaagtgggggagggagggtatggaataaagtaaagctcatgggaaaatggtacctttaccattttcccaccttgggaaatggtgggaaaatttagacattgctttacaaagtctaaatttctgccaacttgtgttacatgtggtttgattctggagaaagataga

SEQ ID NO: 161691 - DNA, 601 bp, Human
gaaaggtgggcgggatatgctgaagggtcatgggcttgagtgcaccctaagtcataaagagggtgtcccattaagaatcaggctgcctgaattctaagtaggaaagaggcaggtcaaaatggtgtataggccaggcacagtggctcacgcttgtaatcccagcactttaggaggccaaggtgggtggatggcttgagctcaggagtttgagaccagcctgggcaacatagcaaaacccccctcttaaaaaaattacaaaaagtagctggacatggtggcgcacacttgcagtcccagctaytcaggaggctgaggtgggaggatcacctgagcctgggaggccaaggctgtagtgagccgagatcataccactgcactccagcatgggtgacaaagagagaccctgtctcagaaaaagtgggggagggagggtatggaataaagtaaagctcatgggaaaatggtacctttaccattttcccaccttgggaaatggtgggaaaatttagacattgctttacaaagtctaaatttctgccaacttgtgttacatgtggtttgattctggagaaagatagactatcatctatccagtcctaaa

SEQ ID NO: 161692 - DNA, 601 bp, Human
taatcccagcactttaggaggccaaggtgggtggatggcttgagctcaggagtttgagaccagcctgggcaacatagcaaaacccccctcttaaaaaaattacaaaaagtagctggacatggtggcgcacacttgcagtcccagctactcaggaggctgaggtgggaggatcacctgagcctgggaggccaaggctgtagtgagccgagatcataccactgcactccagcatgggtgacaaagagagaccctgtctcagaaaaagtgggggagggagggtatggaataaagtaaagctcaygggaaaatggtacctttaccattttcccaccttgggaaatggtgggaaaatttagacattgctttacaaagtctaaatttctgccaacttgtgttacatgtggtttgattctggagaaagatagactatcatctatccagtcctaaattgggcctcttagtctgtcctcccctcagttaccaggaagaatagcaggaatatgtcacagaagcagagaaagcttttattctgagtgtcagaggcatgttctaagcactctgttatctactcccaggcactctaaatgaaattccattttct

SEQ ID NO: 161693 - DNA, 601 bp, Human
ccactgggatattgtctctggggatatatattagctttccttgaggatactaccttgaaaccatttctttggtccttgactatacaaagttcatactagcatggatgtaggaattgtatttttctattctaaatacgaatttagacagtgatataaagattcaaggaaagcttctatcaaggcctgccttcactacttgtcttttggctcctctgagggtcttaggtgagccactttcatctgattctgccctcacttcaggcagaattcatatggctccagccaatggctacactgtccraagtgagactgtggtctcacaaccatctggttaatacaaagacagcaagccaatatgatcacttaggacctaggcaaacctttgggcttaaaatattaccttagctattgttgtttttaatgagtatcaaatagtatgatatttgtaatttgtattatgtaaagaagtaaccaaagcagagattgttgacaaaaaaaaaaacttcctcctaacataaatgaatatgcattttggacttttcaaaaattccctttctgtcttgtcaaaattaagatatttctaaattttatttcggtctca

SEQ ID NO: 161694 - DNA, 601 bp, Human
tttggttctttcccattttgcccaattcatagcacctgattctcttaaccagcaagtctgtttgcatgtctccagtccaatttttcgccatgcccactgcagtgattccaaactctcaccatttcttaagctcttgcatcttttgggctctccttattctcagtataagatctttccttatagtttagagagtaaacacaagcccagttgtttccatgtcacccattattacctctttctgtctcaaaggatgaaacagtcttttctacctaagtcttgaccctgttgttccccacacctktgagcacctcctccctctatcctacccaccttacaactcttcccgtgtttaaaatctccctcaccatttttcttttttaaaaaaattatattttaggctcagtggtacatgcgcagatttgttacataggtaaactcgtgccacagggtttatttcatcacccaggtattaagcctagtacccaatagttatcttttctgctcctctccctcctctgccccctcaagtagaccccaatgtctgttgttcctttctttgtgttcataggttctcatcgtttagctcccacttataagtgag

SEQ ID NO: 161695 - DNA, 601 bp, Human
gcccactgcagtgattccaaactctcaccatttcttaagctcttgcatcttttgggctctccttattctcagtataagatctttccttatagtttagagagtaaacacaagcccagttgtttccatgtcacccattattacctctttctgtctcaaaggatgaaacagtcttttctacctaagtcttgaccctgttgttccccacacctgtgagcacctcctccctctatcctacccaccttacaactcttcccgtgtttaaaatctccctcaccatttttcttttttaaaaaaattataktttaggctcagtggtacatgcgcagatttgttacataggtaaactcgtgccacagggtttatttcatcacccaggtattaagcctagtacccaatagttatcttttctgctcctctccctcctctgccccctcaagtagaccccaatgtctgttgttcctttctttgtgttcataggttctcatcgtttagctcccacttataagtgagaacatgcagtatttggttttctgttcctttgttagtttgctaaggataacagcctccaattccatccatgtttctgcaaaagacagaatct

SEQ ID NO: 161696 - DNA, 601 bp, Human
tgtgatcacggttcactgcagcctcaacctccctagctcaagtgattctcccacctcagcttccacagtagctgggactataggcacatgccaccatgcctggctaatttttttattttttgtagagatggggtttgcccaggctggtctcaaactcctgaactcaagcaatcgtctggcctcagcctcctgaagtgctgggattgctggcgtgagtcacagtgcctggcctgagctaactcttttttaaagagttaaaatactggttcctatttgtttttacttctctagtatgggaggytgttactgtggcttctgtcttggggggcaattttcgaagggcttcaagaacttgaaccgaggttagaggaaaaccacaagatggctaaagggtgggaaaagaagaaataacactatttaaactttagatgagaggactaaagtgatgaaacagtcaccaggtatttggagtggtctcacccaagggactgtgccaacttcctcattttttatgagggcaggcaaaaactggccaaaacacaagttaggataataagcatagtagctattattaaatgctagggtgtgctgcataactgaa

SEQ ID NO: 161697 - DNA, 601 bp, Human
ggaaaccattgtcaaggtagtgtctggctacgatagaagggatttttgacatggcctattgttttatctttttaaagtaaatgtaggtgcttttgatgatcataacactaactgttaagtctttaggcataagaatcaagcattcaactaagcatgtttacaaatttgctttcagcccagtggatctatccacttttccatttaggttgcacatttagatttcggagtttatcctgttatcttcaaatccacggactgtacactctttgagggaagaaactcttagtatctagtcaagtaygtggcatgcaatgggtgctcccaaatacttgattaatatcatatgatataatgtaatatgattcttcataaacagtgagtgtttataaatacagtattttaaatgtcattaggaatcttctattggaatcttaactttattttaatagacctacttttaaagttaataaacataatataaatgtggacagggctaagatttttccctaagatttcactctggcaagtcttcctggagatttagccatggctatttttatgactgtaatttccttaatatggggcctcagccatattccat

SEQ ID NO: 161698 - DNA, 601 bp, Human
ggagtttatcctgttatcttcaaatccacggactgtacactctttgagggaagaaactcttagtatctagtcaagtacgtggcatgcaatgggtgctcccaaatacttgattaatatcatatgatataatgtaatatgattcttcataaacagtgagtgtttataaatacagtattttaaatgtcattaggaatcttctattggaatcttaactttattttaatagacctacttttaaagttaataaacataatataaatgtggacagggctaagatttttccctaagatttcactctggmaagtcttcctggagatttagccatggctatttttatgactgtaatttccttaatatggggcctcagccatattccatcatcataaatccctttcttgcacttaaaagcaatgttgaaatattttccagtttctatatcttaactctttacttagatccattatttccattttgagattatcttatgtaaatattgtagaagattttagaattatataataagaaaatactagtataccacctcagaaatcttaactaatagatatgttttcaaatgcaaagtgaaatatttaaagtaatt

SEQ ID NO: 161699 - DNA, 601 bp, Human
gctaagatttttccctaagatttcactctggcaagtcttcctggagatttagccatggctatttttatgactgtaatttccttaatatggggcctcagccatattccatcatcataaatccctttcttgcacttaaaagcaatgttgaaatattttccagtttctatatcttaactctttacttagatccattatttccattttgagattatcttatgtaaatattgtagaagattttagaattatataataagaaaatactagtataccacctcagaaatcttaactaatagatatgttytcaaatgcaaagtgaaatatttaaagtaattattcaagtaaataaagagaccatctttgtcccaattacttgaatattttacgtaaagttggttttatgcacttgactttgtgtttaaactcaagtttgtagtattgtctactggacattgttagctcaggaccttttcaggagcaaggaatgaaagaatcatttttaaacttatttaaaaaaagaaataaggaagaaaagaagaaattttactggctcgccttagcttaagacatggctggatacagatgctcagacaatcacatcagg

SEQ ID NO: 161700 - DNA, 601 bp, Human
gctccgtgtcaagagaacagagttcgttgaaaggccagcctggtttgcacactcattctgtgttgaaagatgtagaccatgtgattgacagtcccaggagataggagagggagaattttcaaaagagttgccggtataagagacagtggattctgggaaggtaaaaagaggtatttattaaaatactgtgcctttggaataaaaatcttttccaggaaatgcaaataatttaaaacaattcaaataaggatcatacattttaaaacaattagaaatacactcagaagaactgaattgctcrtttagtagatttcagataatattttctcctctttgaacctcagttttgtcatctggaaacacaggataatgcttaccttataaggtaatcatgattagaagagatgatggagctgaccatatctatttactataaagtgctatctacatagttataaattatgacagctaagaaaattaatccctaaagaaagcaaaattacctatgtcacggtttagaaagtctctctcttaagaagaaacttattctattgcctctgttgggttttttcctgaggaatcggtgtttgaatgcaatata

SEQ ID NO: 161701 - DNA, 601 bp, Human
actatagtctgcctatctccactactggcctgagatctcactgacatttggaaagcgttttatttatctttgtatcttcagcactctgtacagtatctgacacttagatgcttataagtgtttgttgggggccatgtacgaacaatagagaacatgcattgacctgctatgtgccaggcagtgttcttagtgatttacatgcattaacttattgaatccttagaataactctcacaagtgaggtaggtactataatcctgcccatattttagatgagaaaatacaggcttagacttacttkcctaaggtaacatagacagtgattggatttaaaccctaaaatctggccagtgcctgtgcacttggcctctcagttgtcactcatttaactagcagttatcatcatagtgcccagctcagcgccaaatacttctaaaaggtctccctcctttccttaggaaggacacaaaacgtttcccagaaaagatctgatctgaccaacacacacctttgttaatggggaagggcctttattaatgggaatgatcaaggaaatggggcgtttttggtgattacattttctcattatctgaggtttaaa

SEQ ID NO: 161702 - DNA, 601 bp, Human
caacgtcctccttgagaccctcacttggcttttgtgacacagtgcaatatttgctctcttgatgcctcactgaccttaaccttccttgactcctgcatagatttctcaactgtgggtatcccctaagatttaggccatttgccttctcttctttcatctagtccattcatgaacacacccattcctggttttaaccatcacctctgtgcagataatgtgcaaagtttatttctagtcggagtggagtctctgttactctgccaatcaagttctaaatttttattccttctagtgcagcagyggcaaatacctgacactcatgtgtctcactcaagacagatactgtttcacccaagactgatcatgccgctttcccagtcaaggcaggcttctcagaatccttctcatttccgcctctgttctttggcactaatgctctgtctgcccagagttttcattcttcacttgttccaggcacctgcttcctggtgaataatgtaaaacctgctagtcatccttataggagaatatgcactcatttcccagcagcacacccgactcaacgtggttaaaaccaatctaccattcccatatattcagc

SEQ ID NO: 161703 - DNA, 601 bp, Human
cactgaccttaaccttccttgactcctgcatagatttctcaactgtgggtatcccctaagatttaggccatttgccttctcttctttcatctagtccattcatgaacacacccattcctggttttaaccatcacctctgtgcagataatgtgcaaagtttatttctagtcggagtggagtctctgttactctgccaatcaagttctaaatttttattccttctagtgcagcagtggcaaatacctgacactcatgtgtctcactcaagacagatactgtttcacccaagactgatcatgcygctttcccagtcaaggcaggcttctcagaatccttctcatttccgcctctgttctttggcactaatgctctgtctgcccagagttttcattcttcacttgttccaggcacctgcttcctggtgaataatgtaaaacctgctagtcatccttataggagaatatgcactcatttcccagcagcacacccgactcaacgtggttaaaaccaatctaccattcccatatattcagcctaacttcccagtgcagtctaccctagttttataacttgttctactttttccagataactgctaatc

SEQ ID NO: 161704 - DNA, 601 bp, Human
actgaccttaaccttccttgactcctgcatagatttctcaactgtgggtatcccctaagatttaggccatttgccttctcttctttcatctagtccattcatgaacacacccattcctggttttaaccatcacctctgtgcagataatgtgcaaagtttatttctagtcggagtggagtctctgttactctgccaatcaagttctaaatttttattccttctagtgcagcagtggcaaatacctgacactcatgtgtctcactcaagacagatactgtttcacccaagactgatcatgccrctttcccagtcaaggcaggcttctcagaatccttctcatttccgcctctgttctttggcactaatgctctgtctgcccagagttttcattcttcacttgttccaggcacctgcttcctggtgaataatgtaaaacctgctagtcatccttataggagaatatgcactcatttcccagcagcacacccgactcaacgtggttaaaaccaatctaccattcccatatattcagcctaacttcccagtgcagtctaccctagttttataacttgttctactttttccagataactgctaatca

SEQ ID NO: 161705 - DNA, 601 bp, Human
tcaagttctaaatttttattccttctagtgcagcagtggcaaatacctgacactcatgtgtctcactcaagacagatactgtttcacccaagactgatcatgccgctttcccagtcaaggcaggcttctcagaatccttctcatttccgcctctgttctttggcactaatgctctgtctgcccagagttttcattcttcacttgttccaggcacctgcttcctggtgaataatgtaaaacctgctagtcatccttataggagaatatgcactcatttcccagcagcacacccgactcaacrtggttaaaaccaatctaccattcccatatattcagcctaacttcccagtgcagtctaccctagttttataacttgttctactttttccagataactgctaatcatctttgtttgtctttgctttcttttttgcactgtgtttgatatattagggtatcaaatcctacttattcaaatatgtcccttattcattccttctatccttggtgctaccatatttgttctggctcttgttacctcattatgggatataaaaatagcctgtcaactggtctttccattgccaggatctctctgttc

SEQ ID NO: 161706 - DNA, 601 bp, Human
aacttgctagagtttttgttttccttctatgtaaaagtccagttgggaagctttatttctgatagattaaatggtataggtctttcagttttctcttcatttctgacaactgaactgctctcgccttgaacctgttttggcagataaacctctcataatgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcrgaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgacacctactatgatgatcaactcattagctgtggcagcgtcaacagagggacctgccagcgacatgtctttccccac

SEQ ID NO: 161707 - DNA, 601 bp, Human
ttccctatcaaatatgtcaacgacttcttcaacaagatcgtcaacaaaaacaatgtgagatgtctccagcatttttacggacccaatcatgagcactgctttaatagggtaagtcacatcagttccccacttataaactgtgaggtataaattagaaataagtatcagtctcaaaaagaatatccagggcttcttttgtgctttgtaaatggtgtttatccaaaatagttgcagattttttccaagaaaattgaggaattgaatcttcatttacacctaaaattatatctttaaaatgtatatggtaactaaaagaaaaatgtttttacaattcagatttgcatgttcgtgacatttcagattatattaaagttatttcccatataagcttttttatatttacacagattttatcagatttacacagattttatcagatttacacagatttttatcacagcagcaattcccataaaacataattattgacatttctatataatctctgcaacatttacaagatgttcaagctaatttgtatgccttaaagaattgttccttatgagattatattctctcactgatacacaactgattaatc

SEQ ID NO: 161708 - DNA, 601 bp, Human
aatgtgagatgtctccagcatttttacggacccaatcatgagcactgctttaatagggtaagtcacatcagttccccacttataaactgtgaggtataaattagaaataagtatcagtctcaaaaagaatatccagggcttcttttgtgctttgtaaatggtgtttatccaaaatagttgcagattttttccaagaaaattgaggaattgaatcttcatttacacctaaaattatatctttaaaatgtaaatggtaactaaaagaaaaatgtttttacaattcagatttgcatgttcgtgmcatttcagattatattaaagttatttcccatataagcttttttatatttacacagattttatcagatttacacagattttatcagatttacacagatttttatcacagcagcaattcccataaaacataattattgacatttctatataatctctgcaacatttacaagatgttcaagctaatttgtatgccttaaagaattgttccttatgagattatattctctcactgatacacaactgattaatctatattcttgacattacttaaaggaacttaactttaaaaaacctcttctga

SEQ ID NO: 161709 - DNA, 601 bp, Human
atattttggttgatgattatttatacttatatgaaatggtattttcttaggagctgttagagatattcttggtgctgtgatttaaatatagtaacagctaccagctatacctggagatttatcctgctagtcagttgatcacctggtctgagtgtttattgtggctttgagtttcttgatctgggccagatttggaatacggacctgactatgaccatcattgaatgaacaaatagtatagcttttctaaagacagtttgactttggcatggtatgtttcacttactttaacaggtttcartctaagatataaaggttataattgcaatcaggtagaacattaaacatgtcctcagtagcataaagtatataatttgctgaggggtaaaggcatatgaattcagaaacatttggttgacttttgctgaaatgtctgggacacttctctagatggaaactatagttaactttttatgatgctaggaaaatacttccaagaaagtcagttcatcttttggtgaactaaaaacaaaacttccttcctctctcttccaaagtctatgaatatacataacataaatgcacatacattccaactaag

SEQ ID NO: 161710 - DNA, 601 bp, Human
tatacctggagatttatcctgctagtcagttgatcacctggtctgagtgtttattgtggctttgagtttcttgatctgggccagatttggaatacggacctgactatgaccatcattgaatgaacaaatagtatagcttttctaaagacagtttgactttggcatggtatgtttcacttactttaacaggtttcagtctaagatataaaggttataattgcaatcaggtagaacattaaacatgtcctcagtagcataaagtatataatttgctgaggggtaaaggcatatgaattcagaracatttggttgacttttgctgaaatgtctgggacacttctctagatggaaactatagttaactttttatgatgctaggaaaatacttccaagaaagtcagttcatcttttggtgaactaaaaacaaaacttccttcctctctcttccaaagtctatgaatatacataacataaatgcacatacattccaactaagacttatttccccctacatacatttaatatatgttgcaaagaagcaatagaattccttatgaagctcccccgtttctttactagaaactacaaaagaatgaaagga

SEQ ID NO: 161711 - DNA, 601 bp, Human
aatttgctgaggggtaaaggcatatgaattcagaaacatttggttgacttttgctgaaatgtctgggacacttctctagatggaaactatagttaactttttatgatgctaggaaaatacttccaagaaagtcagttcatcttttggtgaactaaaaacaaaacttccttcctctctcttccaaagtctatgaatatacataacataaatgcacatacattccaactaagacttatttccccctacatacatttaatatatgttgcaaagaagcaatagaattccttatgaagctcccccktttctttactagaaactacaaaagaatgaaaggaaacaaaatgattttcagaaacctgggattaggaaataaaaatataatattaatagcattacagagaagatatttttctgcatccagtaagttgattctgagacacaagttttaaaagagtctattaggaattcctccagggctcctagagcacatggatttgctatttaaatctttctttgttaaaaattaaaaagaagggtagggcaagaaaaaaattaaaaagagaattcataaaggtatattgatatctcattttttaaattt

SEQ ID NO: 161712 - DNA, 601 bp, Human
acttttacactggccaaattccatagacaaataccttcaaacctcctctatttatttgcctgtttatcttctctggttacaaagatcaaaattcttctgagactgagactacacatattctctctctccatataccccatccagacctcagattgttccaataatgagcatataatcatttcctagcttaatgccaaaatgaaggcacctagagccattcatcacacacaaaaaaaacaaaatgattacaagatcaaagctgtttagcaggactctcaagcaataagatgactccattttktcttggcagatttacttggccagaaatcaagtgacccttttaataatttcttggaactgagtttttactttggcatcaagtttggtgaaaagacacacatattgtagttttgttattaacatctctaatacatttataaagggactcttgtggacaaggttaagaaagctgagctgcagcagtaactttctacttatgcttctgcccagtcctcagtgttgacacattgctgaaagagggatttcctggcactccaagagctctccaccatgtgcaaaaagtgtttctatcacaagatca

SEQ ID NO: 161713 - DNA, 601 bp, Human
aatacagaataagagaattttttaaatccccaaatcagcaaagatcctgttccctaagttatagaatatttattaaaacaagtgaaatcgtacattttagaaaaaattttaatcaaagttgaaattagaaaagcattcttgaaatagctctcgcctctcagaaaatacaattagcacacaacactgtttttcttgaagttctattatcaaagttttgctctatagataagcatttgaaagacctgtagcaagtattttcgccaacatcttgatgaccttaatgaccaaagttggatcaagygaaggggaaaagcatttggtgccagacacacctgggtggaagtcctggtttactgcataccaaccatgtgacttctgccacattacctgacttcttggaggctgagtctcattggtatcatgcagataacaatacctacttcacaggtttttgtgaaaatttgggataatatatatgaggtacctggcacaagatgactataaatttagcccgttgggagacagcatggactaatggaaagagactaaaatcagagatgttggttcaaatctgaaccccaccgtcttctacctggatggc

SEQ ID NO: 161714 - DNA, 601 bp, Human
atggccatgaaagcattatttaaactctgaacccatcgtcctgcgtgcaggactatagtgtggacaagtatattaataacatctgtaaaaggtcccaacttggtccttggcacaaaataaatagcagctattattgtaaggaatacttgcgtaaagaaagacaaattcaaatgattggattattctctggaagaggcacattctggttctattgtttacaagtctttcacttccctctctaactgttatgagtgacctacctccataatggttaatttgtgttatgttgttcttaagattataatagttccaaaaaagagatggggtgaggagtggtggtagtttgagggggcagaggatggggagaaagacaattgaatcaaaactgtactatagtcaagttagaaggtataaattgttctccttcctctcactttcaatcctaactatccatgacctaagatattactcttatgtactttgtcatatcttgcattcaagaatttgcagataatgcagttttagaaaaagtcaacctcataggttgtttgtattgggcttccttgtttttaaatatcatttatactcaaattcaaagagt

SEQ ID NO: 161715 - DNA, 601 bp, Human
atttaaactctgaacccatcgtcctgcgtgcaggactatagtgtggacaagtatattaataacatctgtaaaaggtcccaacttggtccttggcacaaaataaatagcagctattattgtaaggaatacttgcgtaaagaaagacaaattcaaatgattggattattctctggaagaggcacattctggttctattgtttacaagtctttcacttccctctctaactgttatgagtgacctacctccataatggttaatttgtgttatgttgttcttaagattataatagttccaaaaaaragatggggtgaggagtggtggtagtttgagggggcagaggatggggagaaagacaattgaatcaaaactgtactatagtcaagttagaaggtataaattgttctccttcctctcactttcaatcctaactatccatgacctaagatattactcttatgtactttgtcatatcttgcattcaagaatttgcagataatgcagttttagaaaaagtcaacctcataggttgtttgtattgggcttccttgtttttaaatatcatttatactcaaattcaaagagtagccaactgcttcccaa

SEQ ID NO: 161716 - DNA, 601 bp, Human
ggccatcccaccctatgttcttatctcctcagtctaaaaagaaaaatggggacccatcagaatttggatagaagaccctccaggaatttctgccactgcttattcatgggttggcacagacactgattcagtgggcacacagagttcagaatgattcagagcccagatatgtgccctaagtcacatctccagcgtccagggaggactgtaaagtgctcgttatcaggaaaatgaaaccaagggctcagctactcctgaagtcattaaaactccttcccttgatttttttttttttttttttaaatagtatatgtggtaaccgaatctaggatcctggatacattccagtctgctaattacatatttttttctaactaaaatgttccaggcaggttcatttgcatgtgaattacttgctgagccatgttgacttcctattctaaaagcctcactctgccttgggaagcagtttactgcacttcaccctagacctagtctaatgttggagcagacaaagtgtagctacccatatatacttcaaaaatattttccagtctccccacaagaggaaagaaaaatgtctagcaattgcatgctaatt

SEQ ID NO: 161717 - DNA, 601 bp, Human
ccagatgtctgaaatcaaggcatcagccagggccatgctccctctggaggctctagggaggactccttccttgcctcttgcaattctggtgtcccaggcatcttaggttgtggcagctttactcccctctctgcctccatctttatgtggcagtccaccatgtctctctgtgtcccctcttcttataaggacaacagtcattgaattcagggcactcactaaatccaggatgatttcatctcaagatccttaactaatcacatatcaaagagcctatttccaaataaggtcacgatctgactttccaggtggacatgaattttgggaagacattattcggcctactgtaggtcttctaaatgaagtgaccatttaatatgtttctggcactggattcatttcatttaagcctcaaaacaaatctgttatgtagatatgtgttttcccactttacaagtgaagaactgaggtttagagatctaggaatcctaaagctgcacagccaggaagggcagggccacccctgacccaagttctctgctaggttagcatggttgtcacaggacaagctgagaaggtatttagggagcattacactaaa

SEQ ID NO: 161718 - DNA, 601 bp, Human
gatgtctgaaatcaaggcatcagccagggccatgctccctctggaggctctagggaggactccttccttgcctcttgcaattctggtgtcccaggcatcttaggttgtggcagctttactcccctctctgcctccatctttatgtggcagtccaccatgtctctctgtgtcccctcttcttataaggacaacagtcattgaattcagggcactcactaaatccaggatgatttcatctcaagatccttaactaatcacatatcaaagagcctatttccaaataaggtcacgatctgacttwccaggtggacatgaattttgggaagacattattcggcctactgtaggtcttctaaatgaagtgaccatttaatatgtttctggcactggattcatttcatttaagcctcaaaacaaatctgttatgtagatatgtgttttcccactttacaagtgaagaactgaggtttagagatctaggaatcctaaagctgcacagccaggaagggcagggccacccctgacccaagttctctgctaggttagcatggttgtcacaggacaagctgagaaggtatttagggagcattacactaaaaag

SEQ ID NO: 161719 - DNA, 601 bp, Human
atgtctgaaatcaaggcatcagccagggccatgctccctctggaggctctagggaggactccttccttgcctcttgcaattctggtgtcccaggcatcttaggttgtggcagctttactcccctctctgcctccatctttatgtggcagtccaccatgtctctctgtgtcccctcttcttataaggacaacagtcattgaattcagggcactcactaaatccaggatgatttcatctcaagatccttaactaatcacatatcaaagagcctatttccaaataaggtcacgatctgactttycaggtggacatgaattttgggaagacattattcggcctactgtaggtcttctaaatgaagtgaccatttaatatgtttctggcactggattcatttcatttaagcctcaaaacaaatctgttatgtagatatgtgttttcccactttacaagtgaagaactgaggtttagagatctaggaatcctaaagctgcacagccaggaagggcagggccacccctgacccaagttctctgctaggttagcatggttgtcacaggacaagctgagaaggtatttagggagcattacactaaaaagt

SEQ ID NO: 161720 - DNA, 601 bp, Human
tgtctgaaatcaaggcatcagccagggccatgctccctctggaggctctagggaggactccttccttgcctcttgcaattctggtgtcccaggcatcttaggttgtggcagctttactcccctctctgcctccatctttatgtggcagtccaccatgtctctctgtgtcccctcttcttataaggacaacagtcattgaattcagggcactcactaaatccaggatgatttcatctcaagatccttaactaatcacatatcaaagagcctatttccaaataaggtcacgatctgactttcyaggtggacatgaattttgggaagacattattcggcctactgtaggtcttctaaatgaagtgaccatttaatatgtttctggcactggattcatttcatttaagcctcaaaacaaatctgttatgtagatatgtgttttcccactttacaagtgaagaactgaggtttagagatctaggaatcctaaagctgcacagccaggaagggcagggccacccctgacccaagttctctgctaggttagcatggttgtcacaggacaagctgagaaggtatttagggagcattacactaaaaagtt

SEQ ID NO: 161721 - DNA, 601 bp, Human
gtctgaaatcaaggcatcagccagggccatgctccctctggaggctctagggaggactccttccttgcctcttgcaattctggtgtcccaggcatcttaggttgtggcagctttactcccctctctgcctccatctttatgtggcagtccaccatgtctctctgtgtcccctcttcttataaggacaacagtcattgaattcagggcactcactaaatccaggatgatttcatctcaagatccttaactaatcacatatcaaagagcctatttccaaataaggtcacgatctgactttccwggtggacatgaattttgggaagacattattcggcctactgtaggtcttctaaatgaagtgaccatttaatatgtttctggcactggattcatttcatttaagcctcaaaacaaatctgttatgtagatatgtgttttcccactttacaagtgaagaactgaggtttagagatctaggaatcctaaagctgcacagccaggaagggcagggccacccctgacccaagttctctgctaggttagcatggttgtcacaggacaagctgagaaggtatttagggagcattacactaaaaagttg

SEQ ID NO: 161722 - DNA, 601 bp, Human
cctgcttatgctgtgctcccggctgtctggctgcacacacaaccgcagagcatgccctctctggctagggcagaaagaaattgaagcctcttaaattttgccccccccagctttgctcccttgctaggacttccaggccatgactattgaagccatagggcaggattacttcctcaagaggcgttagtggaaacagatgtgttgaggaagcctctttcttttcaactgtgccctgagcacatcagatggagtcctcttcatagcacaaaacaacttggtcagattcttagggtttgaccayagcaccctaacagcctggccgtgcattaaggaccccaaagagaaggatctgctttgccagagagctgactcttctgtattttacagacaattctgaattcaatgtcaacatcttagacatctcagtacagacagtaaagagttaaaatatgtctataagaaacagcgccagaccctgaaattgaaagctctgtgcctccctgcgtgcagtcagttccacactgtcctctctcccagttctatttaataaaaaaaacacatgagtgaaatttagggaaataagaattcctgaaattaaagc

SEQ ID NO: 161723 - DNA, 601 bp, Human
gggcaggattacttcctcaagaggcgttagtggaaacagatgtgttgaggaagcctctttcttttcaactgtgccctgagcacatcagatggagtcctcttcatagcacaaaacaacttggtcagattcttagggtttgaccacagcaccctaacagcctggccgtgcattaaggaccccaaagagaaggatctgctttgccagagagctgactcttctgtattttacagacaattctgaattcaatgtcaacatcttagacatctcagtacagacagtaaagagttaaaatatgtctatragaaacagcgccagaccctgaaattgaaagctctgtgcctccctgcgtgcagtcagttccacactgtcctctctcccagttctatttaataaaaaaaacacatgagtgaaatttagggaaataagaattcctgaaattaaagcaattaagttttcagtcaactgtatgaaaagctctagacaaagaggtactttctatttcaaaatatgtatttcccagaaaaccattaccatatctagctagaatttctacaaagaatgattatgaataaagtatatattcaaatgcttctggtaattt

SEQ ID NO: 161724 - DNA, 601 bp, Human
attttatttgcaagactgatttaaattatctatagatgagctaaatctgtcctatagatcaattaaatgaatcactattttaaatatatcacattcttaattacactgaattaaatataattacatattcactgcatacatcataatgttaattaggggaaacattttgaatcaaatatattgagatatatagcacttcaattttctttttataaaaaaagctatatgactaagtcaggtaaaaagaatctggcaagtactcatagaaagctaaaggaagactagattaattgatgtatcrcatcaaggcttacaaattgtagaggaattcctattctttaactctatgacagtatataagactttgggctaaggaagcaagtttgcaacaagtttttaaaaaataataaaacaggaggcagggcacggtggctcacacctgtaatcccagcactttgggaagccgagacaggtggatcacaaggtcaggggttcaagaccaacctggccaaaatggtgaaacccagtctctaataaaaatacaaaaaagttagccagatatggtggcgggcacctgtagtctcagctattcaggaggctg

SEQ ID NO: 161725 - DNA, 601 bp, Human
tattcggccatcttggctccgtggataagccttaaaaggctcaatactttttaaaaatttcctataaaatccagaatctatctagatttttgagcagcctgtagtggttggaggaccatgattgtttactcatttggtcacctaaacatcccaagcaatgatttgttctgacagcagactgataacagttttttttactccttggaatcggaaaaaaaatcagcaagggaagcttttggaagccacccggtagagctggaagagaatttcgaaatcaattcgctcaacctctccctttacaggcagaaaatgtgctagattggaggtgaagaccctggagccagagagcctaggcttagtcctagccctgcactgaaggtaatgtgaacactcagtgcctcagtttccttctaggcttcttgttctgagattccatgaattaatatttgtaaaatgcttagaactgtgtctaacacattgtaaacactaggaacaaatgctaaggtcatgcaactcatcaatgcctccctggggtagaaccagccttggcccatgggcatgctcattcttcttttagacaaggctcttaggcatccctaga

SEQ ID NO: 161726 - DNA, 601 bp, Human
ttggctcctttgttatgctgaagaaaaaatttacaattgttccccagaacatttatatgttgtatgtgtttgttagagtacaaagcagttaattattgctgtaattttcattcccattatacgaatgagaaagctgaggtagagggagtgactatgtaatcgtaatctcacagatgtccatgtttgtcctgtgatttcatacccatcgcgagtaaatgcatgttcaatgcaatgtaaaaggctattagagatgttgggcaatttcacaaagtagatttcaagtctagggctgtgctgagcytcctccaccttcatgtatatgcaacccagtggcctacttaagagtgaaagtttctctgagaactccaacaccctcctaaaaatctaagtgttcatgtaagataatcatttggattttatcccaattgttgtcaattatgctctgaactttattattactgggttctaggaacaggacagatggaaattagatagctgggaaacatcccaaattttaaaaacctgaaagcaaaaatgacatcaatcatcaaacctcatttcccgggcattgttaaaaccatcaggccttattttaaagcca

SEQ ID NO: 161727 - DNA, 601 bp, Human
gtgacagttagcattcttcctgcaaaacataagacagactcgaggtgggtgttaagatggccgagtaggaacagctccggtctgcagctcgcagcaagatcagtgcagaaggcaggtgatttctgcatgtccaacagaggtacacggctcatctcattgggactggttagacagtgggtgcagcccacagaggttgagctgaagcaaggtgggatgttgcctcacctgggaagggcaagggattggggaactccctcccctagcaaaaggaatccttgagggactgtgttgtgaggaacartgcattccggcccagatactacacttccctatggttttggcaactaacagaccaggagattccctcatttgcctacaccaccaggaccctgggtttgaagcacaaaactgggcggccatttgggcagacaccgagcaggagttttttttcataccccagtggtgcctggaatgccagcaagacagaaccattcactcccctggaaagggggctgaagccagggagccaagtggtctagctcagtggatcccacccctacagaacccagcaagctaagatgcactggcttcaaattctcac

SEQ ID NO: 161728 - DNA, 601 bp, Human
aataataataggagactttaacaccccactatcaacatcagacagatcaaggagacagaaagttaacaagggtatccaggacttgaactcggctctggaccaagcagacctaatagacatctacagaactctccattccaaatcagtagaatatacattcttctcagcaccacatagcacttattctaaaattggccacataattggcagtaaaacactcctcagcaaatgcaaacaaacagtctctcagatgacactacaatcaaattagaactcgagtttaagaaactcacttaaggcygggtgcagtggcttacgcctgtaatcccagcactttgggaggctgaggcgggcggatcacaaggtcaggagatccagacatcctgactaacatggtgaaaccccatctccactaaaaatactaaaaattagctgggcatggtggcgggcgcctgtagtcccagctactcgggaggctgaggcaggagaatggtgtgaacccaggaggcggagcttgtagtgagccgcgaaggcgccactgcactccagcctgggcaacagagcaagactccatgtcaaaaacaaaaacaacaacaacaaa

SEQ ID NO: 161729 - DNA, 601 bp, Human
ggctgcagtgagccatgatcacgccactgcactccagcctgaacaacagagccagactctgtctgaaaaagaaaagaaaagaaagaaggaagaaaggaagggagggaaagaaaaagaaagaaagagagagagagagaaagagagaaagaaagaaagaaagaaagaaagaaagaaagaaagaaagaaagaaagaaagaaagagaaagaaagagaaggaaggaagcagagaaaggaaagaaagaaagaaagaaagaaagaaagaaagaaagaaagaaagaaagaaagaaagaaagaaagaaaaaaaagaaagaaagaacggaaggactcgaaaagcccctttattcctaccaagctgcatctgctctttgtcccatctttggatctcctgaaaacaacttgtttcattaacatgtcatgtagttttaatgtttgttccagatgctctgaaatttgtgaccctttttcctttagtgaaaattaaatttttactaaattgtgggaaaatgaaagaatttcagactatttaaggatatacattttgtttgttcgttttccatatatgtgaaaaattataatatattgggtttttttaaaagttcta

SEQ ID NO: 161730 - DNA, 601 bp, Human
gcaagatcctgtctctttttacataaaaataaaagttaagtttatcatagtatagaaataggattatataatttttggccttaatgcttatcttgaaactctgcttgctattcaaagcagtcagctcaccatttagagttaatgtcacttcctataaaacaacctaaccagaaaattccttggatttgtcatgtattaaactttgggttttttttccagattgaaatgcacagttggtcctgccatgaataagcatttcaatatgtccataattatttcaaatggccacgggacaacacartacagtacattctcctatgtggtaaggaagattctatcctatcatgtttgatttttacttaatctatttaaattataagatgaacaagttactttgttttgtttttatctcccctccaggatcctgtaataacaagtatttcgccgaaatacggtcctatggctggtggcactttacttactttaactggaaattacctaaacagtgggaattctagacacatttcaattggtggaaaaacatgtactttaaaaaggtgttgtaaatttattttttgttgcatctgtcaatttgaattaa

SEQ ID NO: 161731 - DNA, 601 bp, Human
ccacatattaccattttagtgactgaaatcaccctgaagcagttgaatgacttttatttaataatagttaatattcaataataaatattaatataattaatagtaaaatttctaaatataagttttttagcatctcaataaagctatgtttactttcttttattttaaatgacaaaaattagcctataccttttaaaatttttccttttttgggccccattgttatatagaagtgagctaccagtatcacttttgtaatatctgggactttacgcttctaatatgcatatatatatatatrtgtgtgtgtgtgtgtgtgtgtgtgtgtgtgtatacatatgtgtgtgtgtgtatatatatatatatataactgatagtagttgcttatataagtcactacttaccatgtgtcctttggtatctacatataaaatgagacacagtggatgtgtgatctgtttttgttttagagaagcctttatgcaacaaccagggagatcctaagcctgaaaccataagtattggaaacacaaatgttgtacattcatcccttcccccaaccttagttattatctaagcaagcaagacacattttagacct

SEQ ID NO: 161732 - DNA, 601 bp, Human
ccctgaagcagttgaatgacttttatttaataatagttaatattcaataataaatattaatataattaatagtaaaatttctaaatataagttttttagcatctcaataaagctatgtttactttcttttattttaaatgacaaaaattagcctataccttttaaaatttttccttttttgggccccattgttatatagaagtgagctaccagtatcacttttgtaatatctgggactttacgcttctaatatgcatatatatatatatgtgtgtgtgtgtgtgtgtgtgtgtgtgtgtgtatacatatgtgtgtgtgtgtatatatatatatatataactgatagtagttgcttatataagtcactacttaccatgtgtcctttggtatctacatataaaatgagacacagtggatgtgtgatctgtttttgttttagagaagcctttatgcaacaaccagggagatcctaagcctgaaaccataagtattggaaacacaaatgttgtacattcatcccttcccccaaccttagttattatctaagcaagcaagacacattttagaccttttctcataaatcaaatcctacagctcttta

SEQ ID NO: 161733 - DNA, 601 bp, Human
cctgcttatttgcaaacaaatgatacattttggtgctaatgaggaacccccacataaccttctccctgtgttacatactaatacatttcaatactatgcctagtttatcttcatgtcagttgctgtggctatgatgccccctccttgatatgtgtgaattcccagtggaaagagaaagggaaagtggaaatgccctatttggcattaagaaattgactatcagcaccatttcttcccctgaaataaaaaaaaaaattctccttgcaaaagggaactttgcctgaggttcttacagagctttggttataaagatcaacttataaagaatgcttacccctttcatagtgtccttaactaaacaacaaggatggtccactaaccgagatctaacctgccttctctaaacaacagtaacactaaatccagtgccatcactgcacagtggagaatttaccactaatgtgaaaagctttcagttttgggaatatagccattatttatttctaatcatatgtgtatttttcccttggccaggaatccataggttttgcacaatagtaattaattccattaacaaatagtagtgtctcaaaaggcatct

SEQ ID NO: 161734 - DNA, 601 bp, Human
aaggttgtgccacagcactccagcctgggcagcagagcgagactccatgtcaaaaaaataaatacttataaataaataaatatcactcctttaattttgagtatttttattcaatctctctccagtctttctttaccctgagaacagtgacaaactctatgaagcctggtttatagcagtttgtacactgctggacagcatcagaagacagagaatttatagcattctcctgatctaaagcaacatatatcatctctacaatgcactccaatttctttatacaaagataaatgaatatttktaataagctagccaaagcagcaataacagctagcataaacagtatttgtggaaatatttagcaggaaaagaaaccaatcaaaaaccgggaaatgaacttcattcttcttgttgtttttttttttctaaaaagcttttacccttaatactaaatggcctctgatcccttttattctatatgtgctgcaagaggttgtacaggcatctgccagtgtgatacaagagaagctgatggcgtgatttcccttatatgaacacaaggccttctcactttcctgtggtagcatccacacattcttct

SEQ ID NO: 161735 - DNA, 601 bp, Human
gcagcaataacagctagcataaacagtatttgtggaaatatttagcaggaaaagaaaccaatcaaaaaccgggaaatgaacttcattcttcttgttgtttttttttttctaaaaagcttttacccttaatactaaatggcctctgatcccttttattctatatgtgctgcaagaggttgtacaggcatctgccagtgtgatacaagagaagctgatggcgtgatttcccttatatgaacacaaggccttctcactttcctgtggtagcatccacacattcttctgtcaaacaccccagagygtaatcctttgtgtgctccttcttccccaagagtggcttcactgttaacaaacatctttccatttctcttcagagtaatatatagttctgtcataggcctataaatcccagtaattgcatcaattttagagtgtgtggactcactaattgtgttctaattctacacatttggaaaactagaattttttatcatgaaaggtactaaaatggcaattatttctcttttgaagttataatcattaacagctctataaatattagctactatgtatttatatgtttttctgcaggagaatagga

SEQ ID NO: 161736 - DNA, 601 bp, Human
ggagtatacttttgtggtttgcaacctaataaatagcttataataaaacgttgatttacactttccccttgtggaaaaatcagctaccactgaaattatgggcctaatcctgaaaatttgttttgttctagacttttattgaactacttcccctgaaatgatccctcagagccctcattagtaagggggtaggagaaatgaggttcttggatgaactgagtatcatttaactataactatgtttggtttataatatttgttttgcaagtgacatttctggaaactattggaagcatgttgscacctacagtagtaatgactcattttacccagaggcattactataattattttttaaccacaacttccattaaaaagataaaaaatgaaataagacaaacaggagaaaactacgctggccaaaaattgaaaaatcataagtatggtaatacctcatttatccacatttttggagagtgaggcattccacatacatgaacttcctaaataaatgaaacctacccctttttaatgctggaacattacttaaaattttagctgttattgagaaaatctttttaagatgaaatgcatactctgt

SEQ ID NO: 161737 - DNA, 601 bp, Human
ggaccagggagggtgggaataagaatctcaagaactgaattcatagaaggcctcaagctccgtctcggttcctgctctccaagtctctgtgggaggtaatgaagttgatcaaaagcaactttataaatatggggtcaaattatcagagaaaataagctctaggagagtaatgagatattactcagccaaaagaataaaacattccctggcagtgaacttttgcagataaggcgaattgaccttacaaagcacacagctgccctgacagaccccactttcccacttcaacttttgttattamcctgatggattaatgtggctggaggtgctaccttctctagggtactgttaccccaggattaaagcatgatagagatttcctgttatccagaacggaatagtgccatggccttttttaatccaaggagctgatactgagagcaaccacaaacccagatgtgtcttaaagagaaacctaaaaccaggaactggcctttctctatgctgtgtgcattgagtggggctacagcccttttgcagggtccccactgactacatcttgcactgacaaactcctcagtgactgttgaaggggaatacc

SEQ ID NO: 161738 - DNA, 601 bp, Human
gctggagtgcagtggcacagtcatagtgcactgcagtatccaactcctgggctcaagcaatcctccttcctcagactcctaagcagctgggactataggtgcacaccaccacaccaggctaatttttttgtgggcggtggatgggagtaaagacaggatctcactgtgttgcccaggctgatctcaaactcctggcctcaagccatcctctcgccttggcctctcaaagttctgggattacaggcttgagccattaagaccaaactaatttttgagacaagataattttttataaataaayatttcagaattctaaggtcaaaattagaacagtagatgcttagtttatgcttttctaactctctttgactgcagaatccaactgtaaaagatcttattggctttggtcttcaagtagccaaaggcatgaaatatcttgcaagcaaaaagtttgtccacagagacttggctgcaagaaactgtatgtaagtatcagaatctctgtgccacaatccaaattaagtgacaaggaggaatctgtttcccactgttcaatgctagttaagctgttttctcttcttatgcaaaagtcctttatttc

SEQ ID NO: 161739 - DNA, 601 bp, Human
atcctagttctctattacctcagtggtgggatatatgagttttgtgtgctaacctagctcatttaagaatgaaaaagtaaagtatcagtcccctgtcatgctctcccataaaactgagtatcgctaatcagttgacaagcgaagattggtgattgcttgggtagttaattagcatacttcatttagcaaccaaagtaaacccacaggggagacagccttactactgcagatctacattaaagcaaaaaggactttcttatgccatacaattcatgatctctttcctcagcctgttgaattrgcaatgtcaatgtcaagcatttttattcaagaattctgttgtaatttagtgttagtcaatagaggccagatgaaatacttccttcagaagttatggatttcaaatactgaagccacttgtttaatctgtagatattcagcatcattgtaaattattctatttcagccacgggtaataatttttgtcctttctgtaggctggatgaaaaattcacagtcaaggttgctgattttggtcttgccagagacatgtatgataaagaatactatagtgtacacaacaaaacaggtgcaaagctgc

SEQ ID NO: 161740 - DNA, 601 bp, Human
ggccttgggcagctctgctcctgtggctctacagggctcagccccatggctgctttcatcggctggcattgagtgcctgcagcttttccaggcacacggtgcaaactgtcagtggatctacctttctggggtctagaggatggtggccctcttctcacagccccacctggcaaagccccagcactaaggggaggtctcagggagctttttacccatggcagaaggcaaagcaggagcaggcatcttgcatggcaggagcaggaccaagtggggggagggggagcatcttatatggcaggarcaggaccaaggtggtgacaagctttcaccaaggggagaggtgccacacacttttaaacaaccagatctccgtagaattctatcacgagaacagcaccaaagggagaaatctacctccatgatgcagtcacctcccaccaggcctcagctcccacactggggattataattcaacatgagatttgaatggggacacaaatccaaaccatatcaatcattctccaagacaacttgaaaggagtagaagcaggaagatgaagtgagaagtggaacttgaaataagacacaatgagaatggaaa

SEQ ID NO: 161741 - DNA, 601 bp, Human
tacaccagaagggtcttggaagctgagtaacttgagtgatttggaggtctagagtgtgcttaggagcacaggtgttgaatggaatggagagtacacttattctattcacatgttgtaagtcagaggactgtgatgtctgaagatagagaaacatttgatgtttcagtccttaaggatgacaactaaaaaaggaaaatgtgcaaacaaagtagtcagaaaataatgttcatgggggacatgcacttgaagagaaagggttggtagcttttgagagatgatgggtcagagatctgagtgtggcatgggaagcaagaagtcatctcatccacctctctgtgaatcagcaagagggagaggtgtgacccctattggcaagagttgcaaagaaattgtgacttcaactgaaagctgagtttcagttcctgtgaggaggtaggggaactattagagaataagacgaggtgactgggagtttgttttcaatgagtaagtaggtcataggtcatggtggaggaccaggacttcagcatgcatgagattggtaagagaaagtgatagtgccatgtagagcttaatgcctgggattttgatcctgaaagat

SEQ ID NO: 161742 - DNA, 601 bp, Human
ttctattcacatgttgtaagtcagaggactgtgatgtctgaagatagagaaacatttgatgtttcagtccttaaggatgacaactaaaaaaggaaaatgtgcaaacaaagtagtcagaaaataatgttcatgggggacatgcacttgaagagaaagggttggtagcttttgagagatgatgggtcagagatctgagtgtggcatgggaagcaagaagtcatctcatccacctctctgtgaatcagcaagagggagaggtgtgacccctattggcaagagttgcaaagaaattgtgacttcractgaaagctgagtttcagttcctgtgaggaggtaggggaactattagagaataagacgaggtgactgggagtttgttttcaatgagtaagtaggtcataggtcatggtggaggaccaggacttcagcatgcatgagattggtaagagaaagtgatagtgccatgtagagcttaatgcctgggattttgatcctgaaagattctgaaagaggtgaaagaagtgggtgctagagagggagactggggacatgttagtgacagtggcaggtgaaggcaaaagatagggagaattaacccatc

SEQ ID NO: 161743 - DNA, 601 bp, Human
ctttctttttttttttttttgagacggagtctcactctatcgcccaagctggagtgcaggggcgcgatctcagctcactgcaacttccacctcccaggttcaagcgattgtcctgcttcagcctcccaagtagctgggattacaggtgcacaccaccatgcctggctaatttttgtatttttagtagagacagggtttcaccatgttggccaggctggtcccgaactcttgacctcaagtgatctgcccacccccgcctcccaaagtgctgggattacagatgtgaaccaccttgtcccgycctgtctaacccactttcaacatttaaaaacctccacagcacagtcccatttcaatcttatgggtccctaatcccttcccctactccaacatgtcaagcaacgtgaactattatactttatggtttaataagaacacatatgcagccaggcgccgtggctcatgcctgtaatcccagcactttgggaggccaaggagggtggatcacctgaggtcaggagttagagaccagcctggccaacatggagaaaccccgtctctactaaaaatacaaaaattagcctggcatggtggcaggcgc

SEQ ID NO: 161744 - DNA, 601 bp, Human
gcgattgtcctgcttcagcctcccaagtagctgggattacaggtgcacaccaccatgcctggctaatttttgtatttttagtagagacagggtttcaccatgttggccaggctggtcccgaactcttgacctcaagtgatctgcccacccccgcctcccaaagtgctgggattacagatgtgaaccaccttgtcccgtcctgtctaacccactttcaacatttaaaaacctccacagcacagtcccatttcaatcttatgggtccctaatcccttcccctactccaacatgtcaagcaacrtgaactattatactttatggtttaataagaacacatatgcagccaggcgccgtggctcatgcctgtaatcccagcactttgggaggccaaggagggtggatcacctgaggtcaggagttagagaccagcctggccaacatggagaaaccccgtctctactaaaaatacaaaaattagcctggcatggtggcaggcgcctataatcccagctactcaggaggctgaggcaggagaatcgcttgaacccgggaggaagaggttgcagtacaccaagattgcaccacttcactccagcctggg

SEQ ID NO: 161745 - DNA, 601 bp, Human
tcccctactccaacatgtcaagcaacgtgaactattatactttatggtttaataagaacacatatgcagccaggcgccgtggctcatgcctgtaatcccagcactttgggaggccaaggagggtggatcacctgaggtcaggagttagagaccagcctggccaacatggagaaaccccgtctctactaaaaatacaaaaattagcctggcatggtggcaggcgcctataatcccagctactcaggaggctgaggcaggagaatcgcttgaacccgggaggaagaggttgcagtacaccaagattgcaccacttcactccagcctgggcaaaagagcgaaactccatctcaaaaaataaaaaaggaaagaaagaacacatgtgtactgttactcctggccccaccccctccacccaaaactctccctctgccctcatattacctgcacctataaaacaaagtctccctgttcctcaagacccaccttactgtcactctcttcctgcagcctttctcagtaccctactattatctctttgacttttggcaacctttgtacctctttgatattactgctctatattacagctattatcttattg

SEQ ID NO: 161746 - DNA, 601 bp, Human
atattacctgcacctataaaacaaagtctccctgttcctcaagacccaccttactgtcactctcttcctgcagcctttctcagtaccctactattatctctttgacttttggcaacctttgtacctctttgatattactgctctatattacagctattatcttattgtcctgtgtggcagttatctgctcaattctcttaaccctgttcattcagccctgggacctatctagtaacttgaacagtaacctactcgtatgtgatcaagggtcaattgatacttgttaaattgattttaaatrttaatgcatattctgggacttgaaagttaacacgatgatgttgtcagaagtgattgttgattgttaagattttcagactttgaaaacttctactttgcaaagctgaattagacagcaaagttctgtagctccctcctggcaaggggtttgagttttctgttgggatcaaggcagtcagcagccatcaagggttcttgcacttgggcaaagaagtcattaatggtaatttgtatcagcaattacagcatctacctcatttctttctttcagtcgcagcgttcaaaggcaggctttattctc

SEQ ID NO: 161747 - DNA, 601 bp, Human
ttctgttgggatcaaggcagtcagcagccatcaagggttcttgcacttgggcaaagaagtcattaatggtaatttgtatcagcaattacagcatctacctcatttctttctttcagtcgcagcgttcaaaggcaggctttattctccttcttgctgggtactgcaagctacacttgcctctcagttttatgtcttcctactccagctgtctggtgtggattttccttctgctccaagcttccttcatttcttcctccttatgcttcctactcttagagtggcctggaagtgttgctgggcmagaactgcccccctgggtcctgtccacaggggcggcctctgcccatgctgactctcctcgtgtcattcttgcatgggcacatgtccagggggagataatatgtatgacctggtctatcctgagcacagtgttttaaatcaagaaattgcatgtttattgaagttcagtagaccaaacaagacctaagggtcaggaactcttaaatgtttatcccagtgtggactcagatgtattggggaattttagcaagtcacttaacctctccgtgtccctgtgatcttcctatatagtactgatacg

SEQ ID NO: 161748 - DNA, 601 bp, Human
gggcggcctctgcccatgctgactctcctcgtgtcattcttgcatgggcacatgtccagggggagataatatgtatgacctggtctatcctgagcacagtgttttaaatcaagaaattgcatgtttattgaagttcagtagaccaaacaagacctaagggtcaggaactcttaaatgtttatcccagtgtggactcagatgtattggggaattttagcaagtcacttaacctctccgtgtccctgtgatcttcctatatagtactgatacggctattttatatgaatctagtactttcacrtcttcatgtgacagttttattgaaattaattttcaatagagaaacttgttgccttgcagttttttttatttctgatttttaatatgtatttttacttatgttgatttagaccttcccatttaatagtaacctttcaatgtggttacatttcttaaagagtatttatgttcagtttgaaaccacacaaatttaaattttgggaggctttcttcttcttttacaagtaatgtaaaattgtagtgaagctattggaaaagaaaaggatagaaacatgttagtgctttgacacagcgggagaga

SEQ ID NO: 161749 - DNA, 601 bp, Human
ctttcacatcttcatgtgacagttttattgaaattaattttcaatagagaaacttgttgccttgcagttttttttatttctgatttttaatatgtatttttacttatgttgatttagaccttcccatttaatagtaacctttcaatgtggttacatttcttaaagagtatttatgttcagtttgaaaccacacaaatttaaattttgggaggctttcttcttcttttacaagtaatgtaaaattgtagtgaagctattggaaaagaaaaggatagaaacatgttagtgctttgacacagcrggagagaattttggaagagatattctaccaactacagatggaatcttcatcatcatgtagacttcagatattcttttagaaaactttacatttacttataatctaaaccttacttgtttaaacaagtcatgaaatgtatagcttaataattgcctttaagaaaattgttgcccaaaacagaaaccgtattgagtatgtaaagccaagtttagttaccaagacctactgatttcctttcatatatgtatggtcacatctctcacctcatctgtcctgtttcttgttttactagtggtcctt

SEQ ID NO: 161750 - DNA, 601 bp, Human
tgctcctctgggagctgatgacaagaggagccccaccttatcctgacgtaaacacctttgatataactgtttacttgttgcaagggagaagactcctacaacccgaatactgcccagaccccttgtaagtagtctttctgtacctcttacgttctttacttttacagaaatgcctgccttcaaagggtctcttacagcatgtctttctttttggaacagatatgaagtaatgctaaaatgctggcaccctaaagccgaaatgcgcccatccttttctgaactggtgtcccggatatcagcratcttctctactttcattggggagcactatgtccatgtgaacgctacttatgtgaacgtaaaatgtgtcgctccatatccttctctgttgtcatcagaagataacgctgatgatgaggtggacacacgaccagcctccttctgggagacatcatagtgctagtactatgtcaaagcaacagtccacactttgtccaatggttttttcactgcctgacctttaaaaggccatcgatattctttgctcttgccaaaattgcactattataggacttgtattgttatttaaattactggattc

SEQ ID NO: 161751 - DNA, 601 bp, Human
tgttgcaagggagaagactcctacaacccgaatactgcccagaccccttgtaagtagtctttctgtacctcttacgttctttacttttacagaaatgcctgccttcaaagggtctcttacagcatgtctttctttttggaacagatatgaagtaatgctaaaatgctggcaccctaaagccgaaatgcgcccatccttttctgaactggtgtcccggatatcagcaatcttctctactttcattggggagcactatgtccatgtgaacgctacttatgtgaacgtaaaatgtgtcgctccrtatccttctctgttgtcatcagaagataacgctgatgatgaggtggacacacgaccagcctccttctgggagacatcatagtgctagtactatgtcaaagcaacagtccacactttgtccaatggttttttcactgcctgacctttaaaaggccatcgatattctttgctcttgccaaaattgcactattataggacttgtattgttatttaaattactggattctaaggaatttcttatctgacagagcatcagaaccagaggcttggtcccacaggccacggaccaatggcctgcagc

SEQ ID NO: 161752 - DNA, 601 bp, Human
aataatcattcacttttctactcacttatagaggtagttttacttagaatagtcattgccaagcaaactagcaccacggtggctgttagtttaattcaaggatatgttgattgtgttcccaaccatattcacaatatgaaagacaaaaataaacaaataaataaaattggggcttgaacagatgtgaaaattggaatagcagtattataaaaagtaacagttgtcaaagatcgaaacaagcacaccaggggtgcaatcctggcttcagtatggtctagttccatgattttgagcaactcarttgatgtctgtgaacctcagtttcttcatatggaaactacagatttaatacaaggaatgtcaataaaaataaaactttgcagggttctcgttcagataaaaatgaatgaaaagtgcttagatgcatgctcctcacagaataggtgctcaacaactcaaattttgctagtaccatgattattttgagttgtgttgccatcatgaatatgatgaatcagaaaacttatttttcaaattaattttaatttaaagttagagcaatttgagtggttgaaataaaataaaacaaatttaaaggagt

SEQ ID NO: 161753 - DNA, 601 bp, Human
tcattgccaagcaaactagcaccacggtggctgttagtttaattcaaggatatgttgattgtgttcccaaccatattcacaatatgaaagacaaaaataaacaaataaataaaattggggcttgaacagatgtgaaaattggaatagcagtattataaaaagtaacagttgtcaaagatcgaaacaagcacaccaggggtgcaatcctggcttcagtatggtctagttccatgattttgagcaactcagttgatgtctgtgaacctcagtttcttcatatggaaactacagatttaatacraggaatgtcaataaaaataaaactttgcagggttctcgttcagataaaaatgaatgaaaagtgcttagatgcatgctcctcacagaataggtgctcaacaactcaaattttgctagtaccatgattattttgagttgtgttgccatcatgaatatgatgaatcagaaaacttatttttcaaattaattttaatttaaagttagagcaatttgagtggttgaaataaaataaaacaaatttaaaggagtgttgttaaagagggttttcaaaagaagtgatagtcaaatcaaaataaacaaa

SEQ ID NO: 161754 - DNA, 601 bp, Human
tctaacaaaaataatcttaaactccttctatagaaaagtactaactgcatgtagggattctcttatttgaggtcctggagagcctgaggttttcttttagtaatcctttccattaccaagattccttactcattaggccatgcaaatgacaatggcattagagaaaagcctaggtccttcacttttggacacagtgctgctgcaaacccttgatatggtcaaaagaagtccttcgtactttcatttgattggcaaataataataataatagtagcaaacacttatatggcatctgttactmgtactctactattgtcagtgaatatattcactcatttaatcattactataactccataaagaagaggaagatttttatcattatttctttacagagggattaagtagcttacctaaggtcacttggctaacaaagctcagggcaaagactcaaatccaagctggctggctttagagttgtagctctcagctcctacattacactcccttggcaggtacagtctcttatcacaagtgggaagataagcgtgaccagttcacttcccagctcgtgaggcttcacaggctattggttgcctcc

SEQ ID NO: 161755 - DNA, 601 bp, Human
ttaaactccttctatagaaaagtactaactgcatgtagggattctcttatttgaggtcctggagagcctgaggttttcttttagtaatcctttccattaccaagattccttactcattaggccatgcaaatgacaatggcattagagaaaagcctaggtccttcacttttggacacagtgctgctgcaaacccttgatatggtcaaaagaagtccttcgtactttcatttgattggcaaataataataataatagtagcaaacacttatatggcatctgttactagtactctactattgtsagtgaatatattcactcatttaatcattactataactccataaagaagaggaagatttttatcattatttctttacagagggattaagtagcttacctaaggtcacttggctaacaaagctcagggcaaagactcaaatccaagctggctggctttagagttgtagctctcagctcctacattacactcccttggcaggtacagtctcttatcacaagtgggaagataagcgtgaccagttcacttcccagctcgtgaggcttcacaggctattggttgcctccagaatacaatctagat

SEQ ID NO: 161756 - DNA, 601 bp, Human
tcacttttggacacagtgctgctgcaaacccttgatatggtcaaaagaagtccttcgtactttcatttgattggcaaataataataataatagtagcaaacacttatatggcatctgttactagtactctactattgtcagtgaatatattcactcatttaatcattactataactccataaagaagaggaagatttttatcattatttctttacagagggattaagtagcttacctaaggtcacttggctaacaaagctcagggcaaagactcaaatccaagctggctggctttagagtygtagctctcagctcctacattacactcccttggcaggtacagtctcttatcacaagtgggaagataagcgtgaccagttcacttcccagctcgtgaggcttcacaggctattggttgcctccagaatacaatctagatttgttacccagttagtcacacgatgccatcctagatctgcctcctgcctacctccccaacctcatcttccgccacttccggctattcaaataagtggttctctggtacaatatgtgctgtttgttaaacccacctttcttccctgtctgcccctgtgactaa

SEQ ID NO: 161757 - DNA, 601 bp, Human
agggattaagtagcttacctaaggtcacttggctaacaaagctcagggcaaagactcaaatccaagctggctggctttagagttgtagctctcagctcctacattacactcccttggcaggtacagtctcttatcacaagtgggaagataagcgtgaccagttcacttcccagctcgtgaggcttcacaggctattggttgcctccagaatacaatctagatttgttacccagttagtcacacgatgccatcctagatctgcctcctgcctacctccccaacctcatcttccgccacttcsggctattcaaataagtggttctctggtacaatatgtgctgtttgttaaacccacctttcttccctgtctgcccctgtgactaacaatgggccctcttttgccatcgttctctcttttcacacctaataataactccaggaagccttctcaggtgaagttaggtggcctttctaatcgctcctacaggtctctttgaattcccctgttcactgcacttacgacactacataataatcataatgaatttgtagtatctttgcatatagggacttattttcagagctagcaaagtctctggtt

SEQ ID NO: 161758 - DNA, 601 bp, Human
cagggcaaagactcaaatccaagctggctggctttagagttgtagctctcagctcctacattacactcccttggcaggtacagtctcttatcacaagtgggaagataagcgtgaccagttcacttcccagctcgtgaggcttcacaggctattggttgcctccagaatacaatctagatttgttacccagttagtcacacgatgccatcctagatctgcctcctgcctacctccccaacctcatcttccgccacttccggctattcaaataagtggttctctggtacaatatgtgctgttkgttaaacccacctttcttccctgtctgcccctgtgactaacaatgggccctcttttgccatcgttctctcttttcacacctaataataactccaggaagccttctcaggtgaagttaggtggcctttctaatcgctcctacaggtctctttgaattcccctgttcactgcacttacgacactacataataatcataatgaatttgtagtatctttgcatatagggacttattttcagagctagcaaagtctctggtttatagcaggtacacaatcaatatttaatcatactgaatgtgaa

SEQ ID NO: 161759 - DNA, 601 bp, Human
cgtgaggcttcacaggctattggttgcctccagaatacaatctagatttgttacccagttagtcacacgatgccatcctagatctgcctcctgcctacctccccaacctcatcttccgccacttccggctattcaaataagtggttctctggtacaatatgtgctgtttgttaaacccacctttcttccctgtctgcccctgtgactaacaatgggccctcttttgccatcgttctctcttttcacacctaataataactccaggaagccttctcaggtgaagttaggtggcctttctaaycgctcctacaggtctctttgaattcccctgttcactgcacttacgacactacataataatcataatgaatttgtagtatctttgcatatagggacttattttcagagctagcaaagtctctggtttatagcaggtacacaatcaatatttaatcatactgaatgtgaaatatgaggattaatatgtgaatataaagaagaaagcttcccaaatatttgcatttgtttatgaaaaaaacctggttgatttagaataaactcatatttgttcttttttctaccattcttggaattttataat

SEQ ID NO: 161760 - DNA, 601 bp, Human
gcttatatattcctaataattaagtgggaactttttgtattcgcacaacttctgcttttctgaatataaaactataattttaaatttattatttgggggtaaatgctaagagagtcagtttacaggaactggattaagcatagaattctgcatcacggcatccgttagcctgcctttgtggtctgcacgctgggaaagcctgacacctactggaatagaaacagtttacaacgcccggaatatgctcaagtcacagttttgcaaggaagggggaaacaaaaaataaaattaggtaaaaaaragtatgttcaattcccacaggaaggggaatatcacactctggggactgtggtggggtagggggaggggggagggatagcattgggagatatatctaatgctagatgacaagttagtgggtgcagcgcaccagcatggcacatgtatacatatgtaactaacctgcacaatgtgcacatgtaccctaaaacttaaagtataataaaaaaaataaataaataagttatagaagagaaaaaaaacaaatttatggaaaaggttatattaaaggttgactttaagaatcattacttataaaata

SEQ ID NO: 161761 - DNA, 601 bp, Human
ttatatattcctaataattaagtgggaactttttgtattcgcacaacttctgcttttctgaatataaaactataattttaaatttattatttgggggtaaatgctaagagagtcagtttacaggaactggattaagcatagaattctgcatcacggcatccgttagcctgcctttgtggtctgcacgctgggaaagcctgacacctactggaatagaaacagtttacaacgcccggaatatgctcaagtcacagttttgcaaggaagggggaaacaaaaaataaaattaggtaaaaaagaktatgttcaattcccacaggaaggggaatatcacactctggggactgtggtggggtagggggaggggggagggatagcattgggagatatatctaatgctagatgacaagttagtgggtgcagcgcaccagcatggcacatgtatacatatgtaactaacctgcacaatgtgcacatgtaccctaaaacttaaagtataataaaaaaaataaataaataagttatagaagagaaaaaaaacaaatttatggaaaaggttatattaaaggttgactttaagaatcattacttataaaatata

SEQ ID NO: 161762 - DNA, 601 bp, Human
atttaattattataagcagtgatagcagcaaatattttacttttcttaaaacatttagtctcacgacaatcgtgtgaggtagataatattattgtagatgcttcgtagatgaggtagtcacttttgccagacaaagtcatggctataaattgtggagtcaagatctaaaagcaggtagcctggctccagcgacgaactatgttatgggaaatttttcagggaaatttttctttattttcttttgcttatgcagatgtgcccactgcccccacccctcacccttgcctaattcaggattagaaaaaaaaaaaaaaaactctaggcacagaaatacactctcttctttattcacacctatgtgtgcagttaaaaggagaataaaaatcttgtccagcaggcagaacttcatcatcagaaatgaccttctaattctgatctacgaggtgaaaaaagcatgtattgatgacaactctgatgttgccagaaatgcctcattcccctcctcctctcttcttttcccctttcctgttattttgtcctattttttcatcctttgctctatttcttactttttcttcttcaactctctctgattttgaca

SEQ ID NO: 161763 - DNA, 601 bp, Human
gaaatgaccttctaattctgatctacgaggtgaaaaaagcatgtattgatgacaactctgatgttgccagaaatgcctcattcccctcctcctctcttcttttcccctttcctgttattttgtcctattttttcatcctttgctctatttcttactttttcttcttcaactctctctgattttgacaagagatatgcaaaattattatttttcactttgtgtggcatttttttcagtatgtatgtatttatttatttttattgtggtaaaatatacattaaaaaatttaccattctatccrtctttaaatgtacagttctgtggctttaagtaggttcacattgttttgcagtcatcactgccatctatttctggaacgttttcatcttcccaaactgaagctctgtacccattaaataataacttcccattgcaccctccctaccatccctagcaatcaccattctattttctgtctctatgaatttaaccacttaagtacatcatataagtgaaactgtacaatatttgtccttttgtgtcttgtttatttcacttagcatagtattttcaaggttcttccttttcaaaggttgaataa

SEQ ID NO: 161764 - DNA, 601 bp, Human
tataactgaataatgttagttcttagattatccctttatttcttgggaaaatattctgtgtggtcattatttaaagccatcttttttgcttcagtcctctctcactcagttcaggataagaattggtatgactgggccattatttagtcaattaatggaagttttttacattagtcttttcactagtttcctgaaagactgagtttctaaaatgtcaaaataaaaaatatagtaaactgtttatttatgatgccttctcttagttcattatccacaagtctttgagttttatgaatcatawtagaatcctttcccctctctattttatatgttcaacaagctaggcatttgctcataaccaaagatgtctgcttttccctagaacaaaccttttacctattaacttggaaaatccaaagaatcaatacaagctttttttcagtacatgttgctgcacaaaagcaacagagttattaccctgaaagagaatcccaaatgtggtctgctggatggaaggttatgaccccatggaaaactaaacacttcaaagtaactgctctccatccaccataatcagtctagaaaggtacaaaggattact

SEQ ID NO: 161765 - DNA, 601 bp, Human
catatactggtcctgttttgctgctttttctcatagttagttttgtctgcttttcatgctgggcattgtggatactatgttattagtgtctggattttgttgtttgcaagcacaaaatagtattcagtccaagattcaagggcacccctatattgacttttaaaatgatatttctgtctggccccctcattttattaatctttaacacattttttaaccatcctagtatccccaaactcagatctctattttctttacttggtgtcttttctggaatccatccttctgtgatgcagtttgraaattgttcccaggcacaaaactagattgaatgtggagctaacatcacatattttccctcaagaatcatatcactgcattgtctactgcccaacatctgaaaactgttgctttatacatcttgtccagatttataatttttgccataaaaggtaaatctgatagtttatatagccagggacaaaattctctgaaatttatgtttttagtttattatatgaaaaattatagaataagctcatttaactccttatatcaagctaagatttgttgtgaaaattcatagaatttgaagattaat

SEQ ID NO: 161766 - DNA, 601 bp, Human
tcactgcattgtctactgcccaacatctgaaaactgttgctttatacatcttgtccagatttataatttttgccataaaaggtaaatctgatagtttatatagccagggacaaaattctctgaaatttatgtttttagtttattatatgaaaaattatagaataagctcatttaactccttatatcaagctaagatttgttgtgaaaattcatagaatttgaagattaatttgaggaaaattgacatatttgcattgggtttcccattaattaacatgattcattggctttttctttaaarcttttcaataaagtttaaaatttttacttattaaatctaacacttcttttgctgaatttattcttaggtacattattcttgttgttattttttgctactgttaatagtgtcttttttaatttgttgttggtacagagaaatgtaactgatcttaattttgtgattgaattaatataaattagtattgtattaactcataaacatttatatttgattacattgctgaattgtctttttaattataataatcggcatctagaccattttgcattttgtttggttacaatcatatccactgca

SEQ ID NO: 161767 - DNA, 601 bp, Human; identical to SEQ ID NO: 36279

SEQ ID NO: 161768 - DNA, 601 bp, Human; identical to SEQ ID NO: 36280

SEQ ID NO: 161769 - DNA, 601 bp, Human; identical to SEQ ID NO: 36281

SEQ ID NO: 161770 - DNA, 601 bp, Human; identical to SEQ ID NO: 36282

SEQ ID NO: 161771 - DNA, 601 bp, Human; identical to SEQ ID NO: 36283

SEQ ID NO: 161772 - DNA, 601 bp, Human
cctccaattgctcaactctctagatctcagaagatatccaatcctgtctataggatgcaacataaaattgtcacctcattggattggaggtgctgtcctggatacagtgggccgaaatgtcaactaagaggtacactctaatattaataatcacaattctgaacaataagaaactgattctattgaagaaaagaatagcatttccccttttgaaccaaggtaaattaacatgtagccaaactcctaggactgttatactttctaagctttctaacttggtagcttttataacactctgaartctcataagctattctttaacttctccccccatttttatgttggatttatatgatgagcaaatggaaatctgatgaaagatcttacttattcttaacaacaagctatagaggcatgccttattaaaatatcaggaatgctaattttcaatttttaaataaagtgttattagaagtgactcaatataaaaataagactaccatctagttttgttccagttcagttatttgaaataatgtgcatatgaatgaaatttagtattaaaggacatacaaggtatgtcatgaataattctctcttt

SEQ ID NO: 161773 - DNA, 601 bp, Human
ccacttttgtacccttctttccatttctttcttttatacccttctttctatttctttggggatgtggatccatctcgaaactgttagaaagagatgtggtgactcagaatacatggcgattctctctttattccacaatatgctaatctgctacgcacgtactttagctgcaactcagataatcaaaatactggtagccacagttctagattaccttataaaaatattcatcatattatcaaaaggaaaccaatttttaaaaatctaaatgaatagaactttattgggggaaaaaaggagyactaagtccaacatcaaagtaatagttctgatatgttttacatttgttatgtcattttctcttttcaaacatatatatttgtacataatgaggagtgagtcatcaaagacagtttgcacaagggttttgcctttagaaaggacctaattttgtgatatggtattcaagatacttttcaaaaagtcagcagtaacatacacttaaatctgttttataaaatttgcaataatgctcttttccagtagatgtctctaaaatattctgaagtggaacaaggaaagtgtgacttgctttaatgac

SEQ ID NO: 161774 - DNA, 601 bp, Human
aatcacattttctttcaaattagtgatgttgaaactataaaatatgaaaaaagcttaatttttctcattttatatatattattttcatatactgaggaatgaatcatcaaattttagtgtgcaggaaaactagattttcacttgatacttctatgtatgtttattttttatctttttcaattgcttgttttttttctttctgacagcttttcaatttactctctcctctccttcttctcactgattttaaagttttttcttacgtttttggttactattttcaatctattgattatctccygcatatcactgtctattcccttttttaatggaataacattttccaagatcacatgaatgatatatgtctcaaattcttttgaccctgaggtcaatagaaaattaaactttgatgctcttcatttgcttcctttctattcttgacactttacctctcacctaggtaaatttttacttcttgaacattcaggatctttcctagactgggtagcacggagggaactatatcttgatgacatgctcctactgaagtctcaaataggatcctagaagagttaaaatccccccacacatcctcgtg

SEQ ID NO: 161775 - DNA, 601 bp, Human
tttactctctcctctccttcttctcactgattttaaagttttttcttacgtttttggttactattttcaatctattgattatctcccgcatatcactgtctattcccttttttaatggaataacattttccaagatcacatgaatgatatatgtctcaaattcttttgaccctgaggtcaatagaaaattaaactttgatgctcttcatttgcttcctttctattcttgacactttacctctcacctaggtaaatttttacttcttgaacattcaggatctttcctagactgggtagcacrgagggaactatatcttgatgacatgctcctactgaagtctcaaataggatcctagaagagttaaaatccccccacacatcctcgtgtgtgtgtttgtgtgtgtgtgtatgtgtgaaagagacagagagagcccttgcccttgtttccccagtctttgaaggatgttaagtaaaacattgttataatcttcatattaaatatgcagcatgtaatactttgtaagaagtaaaattaagagacctgattacaattccattataaaatgcaacttaaaataacatgtcactatttataataaag

SEQ ID NO: 161776 - DNA, 601 bp, Human
atcttcatattaaatatgcagcatgtaatactttgtaagaagtaaaattaagagacctgattacaattccattataaaatgcaacttaaaataacatgtcactatttataataaagctttaccaaagtattttgaacccctggaaataaatcctgtgtaaaatgcttttgtgatttgtattgaggtctctccacttcgggatcacgagcacccaaaccaatctgcctcttgattatgatgattggtgggaaggggcagcagccacagtcaatattgtatataaatcaaaaattaagaatgyattactttttattttcttaaattagagcattgtctataatacagtctaaaactacagaccaagtaatatacatcataccaaaaatcactcatatcattctaataatttctaagcaatttattgatttctacaaattatattgatgtcgtctttcttttgccatggatgataccagctaaatgatgtccttgtcagagaggtaatttaatatagggaaccctctcaacctcctttaatgatttacccatcagatttagagtcactgggtgacatgaggtctcaataagtttgtaattttat

SEQ ID NO: 161777 - DNA, 601 bp, Human
attttatttctgagacattctaaaattgtcattgggctgtagatttgattgctgtgaaggcagcacaaacactcttcatatgtttccatgcttaacagtgcctctttagggatcttgtgttataacaatagaaagaatggtaatatctgcatgaggaaatcaggaagctgtgaaaggtaccttccacccccatcccacttcacttactctttaaggaattgtatgagactcaaggttttcatttcttaaactttattaaatctgtcttcaacacacacctttgttattaacaggaatgctrtttaaaagtctatgaagattgatttctggattgcaattttagtattaatatatctagtattttctgcattataacaatgaatttacctcttagaagtagaaagcttagcaatttgttcaaaattagtgttcctaaccagggccatatatagaaatcacctgtagagttttgttttttttgtttgtttgttttttttaaatacgcacctgccccattcctcaaaatagagctactgaatgagaatctcaggtgagggagtggaaagaacatggacacttaatgtttcaaagtatacaggaa

SEQ ID NO: 161778 - DNA, 601 bp, Human
aattaatttaaacttacactataataaccttattgctaggtcttagaagaagatttacacttttccccacgcaatccatcccctaaataattacactattccccaagctgcagattgcttttgtccatcagataagtcaacaattacacaggactttatagaatacagcagaggaaatgaaaatcaaaaagaaacagcatcaaaacaaaaatcttggacatgaatggaaattcattaatttagctcaatgccctgaagaaaaacaatgcaaaattcaatctaacaatatagactcacccamattaatgccaaatatacttcctgtggagtagagaagcttaagtattatagtcaaagccacatatggcttagggagcataattaacatgtgccagagatgcagagtttcattggttcataaactcacctgggaagaagcacggctagacacaaaacacttgtttcctcatgtctgtcatgcagactttaatggataaatttgtttgttagaagtctgcaaattaaagccatattatttgatgttctcaatattttattttatttatttttattttaattattgattgattgattgattgat

SEQ ID NO: 161779 - DNA, 601 bp, Human
gatgttctcaatattttattttatttatttttattttaattattgattgattgattgattgattgattggcagagtcctgctctatcccccagctggagtgcagtgatgccatctcggctcactgcaacctccgcctcccgggttcaatagactctcctgcctcagcctcccaagtagctggaattacaggcacctgagccaccacatctgactaatttttgtatttttagtagagacgggctttcactatgttggccaggctggtcttgagctccgacctcaagtgatccacctgcctcrgcctcccaaagtgctgggattacaggtgtgagccaccgcacctggcctgtactcaatattttaaatagatcatttctctaaattgttttccccaatgaaaaactatattgccatttaaaatattatttgattcatgggaattattacttgccatttaaaatattacttgattcatggtaaattcttcagtagagtagatttattttacaagaatttctattgaaatttcactgactttaccagttgatttgcttgaaatgtgcctgcaatagtttacttttatttttagtccagtttgag

SEQ ID NO: 161780 - DNA, 601 bp, Human; identical to SEQ ID NO: 36284

SEQ ID NO: 161781 - DNA, 601 bp, Human; identical to SEQ ID NO: 36285

SEQ ID NO: 161782 - DNA, 601 bp, Human; identical to SEQ ID NO: 36286

SEQ ID NO: 161783 - DNA, 601 bp, Human; identical to SEQ ID NO: 36287

SEQ ID NO: 161784 - DNA, 601 bp, Human
ctcagaagcaagtaaaatcattgccaaagaaaattaacgcacttaagaaaccaacggtaaatcttaccacagtcctgataggccggactcaaagaaacacggacaacataatatatcctggtaagctgttactgaaaagtaacttttaatctctctttttacttaaatgatatttaatagatctgtacagttgagcaagaccattaaacataaaactacatacttgaacttggatagatagtcaagttgtgaagatcactgacattatttaaatctgaatctatcttacagtatttcagayatcaatacaaaacaaatatttctagtgtatatttggctatgtgtttttaaaatttttctgactagacctctataaaataattaaatttgctcctatggaacaatttgctttgcacaagtaattaaacaaagctattaggcaaggagatctttaatagaccagatttacttattttggcattttaccatatctgatatgcaataggaactcagtaaatacctgttgaatgatcatctgacaatgaatgttcaggaaatagatttgggtaaatcatagaaggccatcaatgccaagctaagt

SEQ ID NO: 161785 - DNA, 601 bp, Human
tccgcatatgcttataacttagcttatggtcatcatgcaatgataaatcaaaaagaataggatacaaaatataaagactgtgtaaaaacatgtgcattgataagcactgaaaataaatgtcaaagaatggttttctccaagcgattttctactatttatatgattttccatattataaaatattttcaaatatacctcaagataactaataggttatcttctgtacaaaatggctgaatataagcccgttaaattttgaaagctatctgcttcaatttagagtttagatgtgttttagaartcccccaaatacgtgtacgcatttggtaattcaatagaagtgctcacaggatctggcatatccatagtgttcacatctgtggcttattatggcaaaaagttcgtaacaggatcagctaaggaaaaagatacaagcagagtctggagaaatttaggcacaggattttttatgtttatccctcccatgaaggacaacatttctgtgtgctctttttttctagtcacacacacatacacaaaattagtaacgtgtacattaattctgcccatacaagcccatcagatactcagcacttagttt

SEQ ID NO: 161786 - DNA, 601 bp, Human
ccccaaatacgtgtacgcatttggtaattcaatagaagtgctcacaggatctggcatatccatagtgttcacatctgtggcttattatggcaaaaagttcgtaacaggatcagctaaggaaaaagatacaagcagagtctggagaaatttaggcacaggattttttatgtttatccctcccatgaaggacaacatttctgtgtgctctttttttctagtcacacacacatacacaaaattagtaacgtgtacattaattctgcccatacaagcccatcagatactcagcacttagttttaytgggggctggtcacataagcatcctctgcctaggacataccaaaactccatactctcagaagggaagcagatattcagcataaatcatattgtttgtacaaagagtctgggcatggtgaatgacacttaccagttagggaatggagagaagtcaagttcccagatgctaaccaactgcaaaattttccaagtaggcctttctaaagatatcagtctctggcctactatgttcactcttctctgcagattatcttaaagatattcttcatgtcagaactggttaggaggcctgtctgctgg

SEQ ID NO: 161787 - DNA, 601 bp, Human
caagcccatcagatactcagcacttagttttactgggggctggtcacataagcatcctctgcctaggacataccaaaactccatactctcagaagggaagcagatattcagcataaatcatattgtttgtacaaagagtctgggcatggtgaatgacacttaccagttagggaatggagagaagtcaagttcccagatgctaaccaactgcaaaattttccaagtaggcctttctaaagatatcagtctctggcctactatgttcactcttctctgcagattatcttaaagatattcttcrtgtcagaactggttaggaggcctgtctgctggggatggcctccccaatttgtgtcaataaaacatatcagtgttgaaggaaatagtaaatgaactactttttgttcatggctctctgggagaagaacagactcccccagatttccatatgattcccttcatatggaagaatgatgacagctaaagagcaaatgctgacaaaattgacaaccttttctgtcaccttgtcctcaataaagtagccaggctatctaaggtgcatagtcagaaacccagacgtttaatgatcacattctctgaa

SEQ ID NO: 161788 - DNA, 601 bp, Human
tttgttctagaagaatttgatagtgaggctgggagcggtggctcaccactgtaatcccaacactttgggaggctaaggtgtgcagatcacttaaggccaagagttcgagaccagcctggccaacctggcgaaaccccatctctaataaaaatacaaaaattagccaggtgtagtggcacgtgcccaactactagggaggctgaggcaggagaatatcttgaacccaggaggaggaggttgcagtgagccgagatcatgccactgcactccagcttgggcagcagagcgagactctgtctcaaaaaaaaaaaaatgatagtgaaagatatacctatagagcagtgcaatgttctgttatattttatactttttttgatattttggtatgtgcataagaataccatgttattatgaagctattttgaatgtgaaagaaaagaaacaacataccacagcatattctaactatttatctaacttgtattcaatttttgacttttgtacattttaatttttttctctattttaaatagtgccacactaattaatttttgtgaccatctctaatcttatttccttaagataacatccaagaagtaaa

SEQ ID NO: 161789 - DNA, 601 bp, Human
accacagcatattctaactatttatctaacttgtattcaatttttgacttttgtacattttaatttttttctctattttaaatagtgccacactaattaatttttgtgaccatctctaatcttatttccttaagataacatccaagaagtaaaattactggtgcaaagcccatgcacattttgaaagaatttgataaatattgccaagtttctcttcagagagtatcaatttacgctcccttgagcaacttatgaaagggccaagtgttatacctgtgtgcacatatatacacatgggcaygttaactttgcccaaaaagtttgtccaaaaaattaaaaaatatttaaatatgagacttttaacagacaatgatgacactatggatatcttttatttttatcattttaataggcgtgcagttatatctcattgtaattagggaagcagatttcacagctatatggatgagggttgtttagaggcaggcaaagcgatgttaagacggctataatcatctagatatgagaaaatgagagcatcaattagaaaagttaatggggatggaatggaaatcaaagagcagggagattacttttgaga

SEQ ID NO: 161790 - DNA, 601 bp, Human
tgataaatattgccaagtttctcttcagagagtatcaatttacgctcccttgagcaacttatgaaagggccaagtgttatacctgtgtgcacatatatacacatgggcacgttaactttgcccaaaaagtttgtccaaaaaattaaaaaatatttaaatatgagacttttaacagacaatgatgacactatggatatcttttatttttatcattttaataggcgtgcagttatatctcattgtaattagggaagcagatttcacagctatatggatgagggttgtttagaggcaggcaaarcgatgttaagacggctataatcatctagatatgagaaaatgagagcatcaattagaaaagttaatggggatggaatggaaatcaaagagcagggagattacttttgagaagttacatttggtaaaataataagttttatagacaacaaagaaggtgggatgatgaactacaatattcttagtgattttgaaatccaaggtaggaaattaagggacttgaaacaacgcgagtttatttgtttgtggtataacttacatttagttaaatgtactaatgttgatagatagcctatgagttttg

SEQ ID NO: 161791 - DNA, 601 bp, Human
tttctcttcagagagtatcaatttacgctcccttgagcaacttatgaaagggccaagtgttatacctgtgtgcacatatatacacatgggcacgttaactttgcccaaaaagtttgtccaaaaaattaaaaaatatttaaatatgagacttttaacagacaatgatgacactatggatatcttttatttttatcattttaataggcgtgcagttatatctcattgtaattagggaagcagatttcacagctatatggatgagggttgtttagaggcaggcaaagcgatgttaagacggctrtaatcatctagatatgagaaaatgagagcatcaattagaaaagttaatggggatggaatggaaatcaaagagcagggagattacttttgagaagttacatttggtaaaataataagttttatagacaacaaagaaggtgggatgatgaactacaatattcttagtgattttgaaatccaaggtaggaaattaagggacttgaaacaacgcgagtttatttgtttgtggtataacttacatttagttaaatgtactaatgttgatagatagcctatgagttttgacaaatacatagtcgta

SEQ ID NO: 161792 - DNA, 601 bp, Human
gatctccattaaaaaaaatggacaggaaggagtttaagaggttattgaagctcaaggtaaggggagaagttgtggaaagttcgcttaaatggattcacttctgggcacagtggctcacactgtaatcccacattttgggaggccaaggcaggtggatcacctgaggttggaagtttgagaccagcttggcccacacggtgaaaccccgtctctgctaaaaatacaaaaaatagcctggcatggtggtgcacacctgtagtcccagctacttgggaggctgaggcaggagaatagcttaagyccaggaggcagaggttgcagtgagccaagatcatgctactgcactccagcctggacgacagagcgagactccatctcaaaaataaaacaaataaataaataaatagattcatgtctctaggataacatgacaatgatagcatagtgtcaaactctgtgacatttgagaaactgggaagaaggttgaaatttgataagaatgtggtattctattccatcttttattaatttgtctattcatttttaaaactactttagtattttctatatgtcaggcactgtgctaataaggttgatatga

SEQ ID NO: 161793 - DNA, 601 bp, Human
ctgtgtgcagtctcaagaagtttgggctactgtaacagtagtagtagatgcagaccttcaattaaacttaagtgtagccctactccagatgaatgaccctaaaaagaaattggaaaatggggtaaaatagcaccctctgaaatgactcaaagaactacagcaaggcaagacccaattcctaaagtaatggaacataaagaagcaaaaaatggaatgctgctcctggacattaaatagcaggcagaatccttgatcctgaagattcagagtagagccaacagcaatgcagataaatctaatkttttccacagtttcttaagttctccttatagcacagctttgatccctgattcatgaacagggccaaggttacaggtgactgtgattttttatatttgggaaaattaaaattatagagctgatcaaattacataaataagttagtgttccccccaactctactgcacaattgatacattcctagtgaaacccattaattgaaacttctcctgtgagttgatcactgtgctaaattcagagaatgtaaaaataaatgaagcaaatgctttgatacagaatattcacattactataagtaatg

SEQ ID NO: 161794 - DNA, 601 bp, Human
gtttgggctactgtaacagtagtagtagatgcagaccttcaattaaacttaagtgtagccctactccagatgaatgaccctaaaaagaaattggaaaatggggtaaaatagcaccctctgaaatgactcaaagaactacagcaaggcaagacccaattcctaaagtaatggaacataaagaagcaaaaaatggaatgctgctcctggacattaaatagcaggcagaatccttgatcctgaagattcagagtagagccaacagcaatgcagataaatctaattttttccacagtttcttaarttctccttatagcacagctttgatccctgattcatgaacagggccaaggttacaggtgactgtgattttttatatttgggaaaattaaaattatagagctgatcaaattacataaataagttagtgttccccccaactctactgcacaattgatacattcctagtgaaacccattaattgaaacttctcctgtgagttgatcactgtgctaaattcagagaatgtaaaaataaatgaagcaaatgctttgatacagaatattcacattactataagtaatgaaaagtcattgatgttttt

SEQ ID NO: 161795 - DNA, 601 bp, Human
ctatatgtaatgtgtgagctgtaactttctgtcttcagtaaaccaaacctgttggagaatctacctcattctttaattgctgtctaatattcctcagtgggaatatgttacaatttatttaacaagtcctgcatcagtgatcatttaggagtctttaaatttttcaagaatgcaagtgatatcattttgaattgaagaattgtctttgtgcacatggacaagtatgtctggagtatatatatactgccagaagaaatgtttggctcaaagtaaattaacctttttaatactgataaatatygtcacattgtcctattaacagctatagcagtttacactccagccagcattgcatgaaaaggcccattttcccttatattgacatgactggatattttctacgtatctttttaaatgttgccaccttatatttaaataatgttattattgctaaatttattatttctgaattagtaatgaggttgcatatgctttaaaacttttagtgaccttttgtgggttttgttcaatgatttgcctactgatacattctccgttttttaacttatttttttctgatctgtaagtgaagaccattttc

SEQ ID NO: 161796 - DNA, 601 bp, Human; identical to SEQ ID NO: 36288

SEQ ID NO: 161797 - DNA, 601 bp, Human; identical to SEQ ID NO: 36289

SEQ ID NO: 161798 - DNA, 601 bp, Human
ctgagtagctgggattataggtgtgtgccaccacgcccagctaatttttgtatttttagtagagatggggtttcaccttgttgggcaggctggtctcaaacttctgacctcgtgatccgcccacctcagcctcccaaagtgctgggattataggcttgaaccaccacacccggccattgttttgttttaaagggaaggataggctggcaattctttttgttttttcctttaatggaaacagtctcactatgttgtctgggctggtcttgagctccggtactcaagaaatcctcctgcctcrgcctcccaaagtgctgggattataggcatgagccactgtgcccggcctgagctggcaatttttaaagatagaatagcatcatgaatttggcctgtgatcagatttttttttctacatattttggaatgctaaaattctgtgttctttcctagtctctggaaagtacgaggagaatcctgggtttagccattgaggtaagaaaatgttagtcatcaacttaagtatagaaatttataggagcgatcctaatacttctggctggaattagtattaaagggtaatgtatcaatatgctttatt

SEQ ID NO: 161799 - DNA, 601 bp, Human
ctgtgatgccaaaaagccctatcaaattagccacatacaaatttcagcctttgggagagccttccctttgtaaaataagaatgttatgtttacttcttgtcttctgatttgaattatatatcatgttcactgtctatttgggatggcaggcaacaatgcccaattgtatataccaagtatgtgttaggccagcatggcttattttgtgtattggttatatgtgccttagacattatgatagtaacatagctgggattacaggcacctgccaccacacccaactatgtttttcttttttttkggggtgggggacggagtttcgctatttttgtctagttttgggggtgggggatgaagtttcgctcttcttgcccaggctggagtgcaatggcgtgatcttggctcactgcaacctcctcctcctgggttcaagtgattctcctgcctcagcttcctgagtagctgagattactggtgcccaccaccacacccggctaagtttttgtatttttagtagagacgggttttaccatgttggccaggctggtctcgaactcctaacctcaggtgatccacccgccttgacctcccaaagtgctgg

SEQ ID NO: 161800 - DNA, 601 bp, Human
agtggcgtgatcacagctcactgcagcctctctttcctgggcacaagagatcctcccaccttggcctcccaaagtgctaggattacaggcatgagccactgcacacagccaaagtatccttttttttttgagacggagtctcactctgttaccaggctggaatgcagtggcgcagtctcagctcactgcaacctccgtctcctgggttcaagtgatttctcctgcctcagcctcccgagtagctgggactacaggcgcatgccaccacacccagctaatttttgtatttttagtagagacrgggtttcactatgttggccaggatggtcttgatctcttgacctcatgatccgcccgccttaacctcctcaagtgctgggattacaggtgtgagccaccacacccggcctcaatgtattcatttttaaagaggttcttagacattaatatttcatccagttctcagctggtcttgtaaaccaacagcggttatatttttatattttcagtaagtgtttttatgaaacaacatttttatgccatttctgttatagaaagtagagattaattgcttgtcagtcaactttagtgtttgttttgg

SEQ ID NO: 161801 - DNA, 601 bp, Human
caaatagctgggattactggtgcctgccaccacgcccagctaatttttgtatttttagtagagatgggggttcaccatgttggccaggctggtcttgaactcctgacctcaggtgatccgcctgcctcggcctcccaaagtgctgggattacaagcatgagccaccatgcctgaccctgtttcttttcttttctttttcttttttttttttgagacagagttttacgttgtcacccagactggagtgcagtggtacaatctcggctcactgcaaccttcgcttcctgggttcaatcgattctcatgcctcaaccacccaagtagctgggattagaggcatgcaccaacaccttgctaactaatgtatttttagtagagacggggttttgccatgttggccaggatggtcttgaactcctgacctcaagtgatccacccacctcggcctcccaacgtgctggggttacaggcatgagccaccgtacctggactttaaaaagtttttgtagagatgagttctcactatgttgctcaggctggtctcaaactcctaagctcaagcaatcctcccacattggcctcccaaagtgctggtattaca

SEQ ID NO: 161802 - DNA, 601 bp, Human
ttgtcagcttactgtttattattgtgtctgactcttaagtttagatctttatgagaattatgaacatgattaaatgttaaaaaattaagtatttgatttctaccctttgtttcctgccctccttttttcttcttttcttagtttgactatccaaagcatacacacactcacattcactctttattattagttaatagttatttggtcccttttctccttgatgtgaaatagtcacagctaatatttagttttatttttgctatttttaattcagttaaaactaatattgatgcaaccaaamctaaaaaaaaaaaaaaaaaaaagaaattatcgtttttgtgctcataccttgatatttacagttttatgcttgataccagcttcctgaattgactaagggatatttcagattcttacttaaaacttgccttttttttttttttttttttttgagacagagtctcgttctgtcccccaggctagagtatagtggctcagtctcagctcactgcaacctctgctcccaggttcaagcgattctcctgcctcagcctcacgagtaactgggattacaagcgtgcgccaccacacccggctaatt

SEQ ID NO: 161803 - DNA, 601 bp, Human
cactcacattcactctttattattagttaatagttatttggtcccttttctccttgatgtgaaatagtcacagctaatatttagttttatttttgctatttttaattcagttaaaactaatattgatgcaaccaaaactaaaaaaaaaaaaaaaaaaaagaaattatcgtttttgtgctcataccttgatatttacagttttatgcttgataccagcttcctgaattgactaagggatatttcagattcttacttaaaacttgccttttttttttttttttttttttgagacagagtctcsttctgtcccccaggctagagtatagtggctcagtctcagctcactgcaacctctgctcccaggttcaagcgattctcctgcctcagcctcacgagtaactgggattacaagcgtgcgccaccacacccggctaattttttgtatttttagtacagaataggtttcaccatgttggtcaggctggtcttgaactcctgacctcaagtaattcacccgccttggcctcccaaaatgctgaaattacaggcgtgagccacacacccgaaaacttgccatttttgaatgagacgtttaagtggg

SEQ ID NO: 161804 - DNA, 601 bp, Human
gttgtaaatctaagtttctagatggagttctgaacttcattaaaatttatcacaaatttacttaggcattttatcatgaagactaatttcttcccagaggggctgtacattttattttcaagagtcctgtcacagattagaactattctttcttactgtagactaaaacaacctggtcctagtaatctttcatgtcacgatattccaactacattcatgtacctgtagatctcaaagccaagaaatggtaatggaccaaaaagtaaacatgccagttggtaacccatgcacttacaggcawgaactgttgactaaaggtcaggttgaagttgaagccaatgaatgaaaatatttatccagtgatttacaaagcagttttatgtctgttatcaacagaacattttacagccctgctaaacattaagtattgttattatcctagttttacgtacaaagaaagggatgctctgacactgaagtttgctcaagattctgtagcttctgaatgacatgcctaggattgggatttagttattttactccaaatgctgttacttttttgttttttgttttttgtttgtttgtttgtttgtttattttt

SEQ ID NO: 161805 - DNA, 601 bp, Human
taatgttaatgataaagtctaagattcaattctaggtttgccgaaaatgaatcctcacatgcctattaaggaagaagtcacttttttcataaaatctcttccctacctttttaatttttgcaattttaaaacttccttattaatgtaaaatgtagaataaatcagagatcaatatttgagcaacatactatttcgtttttgtttatagaaaagtgaaaactaaaattgaatgaaagcttgactttagccaaataatcaagaaaagttttgtgtcacttttccgtaacagccattttttttyccctgtaatagccactttttctttctttttaagacacttagacttatgatttttttttttttttgagatggagtgtctcgctctgttgcccaggctggagtgcagtggtgtgatcttggctccttgcaacctccgcctcctgggttcaagcgattctcctgcctcagcctccccagtagctgggattataggcacgtggtgccacacccagctaatttttgtatttttagtagagatggggtttcaccatgttgcccaggctggtcttgaactcctgacctcaggtgatccacccacctt

SEQ ID NO: 161806 - DNA, 601 bp, Human
atcctcacatgcctattaaggaagaagtcacttttttcataaaatctcttccctacctttttaatttttgcaattttaaaacttccttattaatgtaaaatgtagaataaatcagagatcaatatttgagcaacatactatttcgtttttgtttatagaaaagtgaaaactaaaattgaatgaaagcttgactttagccaaataatcaagaaaagttttgtgtcacttttccgtaacagccatttttttttccctgtaatagccactttttctttctttttaagacacttagacttatgatttttttttttttttgagatggagtgtctcgctctgttgcccaggctggagtgcagtggtgtgatcttggctccttgcaacctccgcctcctgggttcaagcgattctcctgcctcagcctccccagtagctgggattataggcacgtggtgccacacccagctaatttttgtatttttagtagagatggggtttcaccatgttgcccaggctggtcttgaactcctgacctcaggtgatccacccaccttggcctcccaaagtgctgggattaccggtgtgagctactgtgcccggcctt

SEQ ID NO: 161807 - DNA, 601 bp, Human
tatttcgtttttgtttatagaaaagtgaaaactaaaattgaatgaaagcttgactttagccaaataatcaagaaaagttttgtgtcacttttccgtaacagccatttttttttccctgtaatagccactttttctttctttttaagacacttagacttatgatttttttttttttttgagatggagtgtctcgctctgttgcccaggctggagtgcagtggtgtgatcttggctccttgcaacctccgcctcctgggttcaagcgattctcctgcctcagcctccccagtagctgggattwtaggcacgtggtgccacacccagctaatttttgtatttttagtagagatggggtttcaccatgttgcccaggctggtcttgaactcctgacctcaggtgatccacccaccttggcctcccaaagtgctgggattaccggtgtgagctactgtgcccggccttgatcgtttttttaaagaggaaactcttaaatgaaaaactcctacactacaggatttatgaatgaccgcttgtgtggtcaaggtacttatttgtccgctgattgtccaatttggaaattattcatgcctttctttcctg

SEQ ID NO: 161808 - DNA, 601 bp, Human
ggaggtccaaactgttcattcattgagaattgagccaaaaaaaaaccctggcctggatttctctgactaaagagctcaatctagctggtctccagctgcctttaaactgtggatcagttgaactcagagagctggggctgaaagcaatgtggtttgggaagtggccatcctgtcccctatctcttcctcagtctgtcctggggtctggtgggatttcctgcatcctgggattgagcagcagagaactgagggttctgggaaaattccttcattgatctgaccactcttcaaaaggaggtayatgtgacagcagctggaaatttccagggaagtgtccctaaggagtctgagtcctggctctgtcactgattgctgggggactttggacaagtcagcgctgcttcccccaaatgttaaatgaggctaaaggatcagatgatccctaattcccctgagaacatgattttcctaagtgtggtgggtaggactcggggtgatacaccttgattatgtgtttattttaatgtgttaggggaaaaatcaaacttgtactttcacatagatattgtttatgatgatatgtaggtagatttaaagttga

SEQ ID NO: 161809 - DNA, 601 bp, Human
tagtgtaatgcattaccttttctatttttaggtacacaaacacttaactttatgtaacaattgcctgtagtattcaataccaacatgctgcacaggtttgtagcctaggagcaatagattataccatatagcctaggtgtggctatgccatctaggtttgtgtaagtgctctctgtgatgttcattcaacaaccaatttgcctcctaactcatttctgagaatgtatccccatcgttaagtgaagtaggactgtattgtaatacagcatgtatcatggaatatagtcatctattcacttcyccccacacaacccatactctcaactgtaagctctgtctagagacacatctgccatctaaacatctaacatagttactggcacatggcagttcaataaagcctactaaataaactgaatctatataacatagaacactgccaacatatatcctattaatttggtgcccaaagtccacaacaattggtagaacagtcaatctgtgaagaaaaccacctgaacgggcagctttacctcctttgtgtttcctctcttgctacatctataaataaaaaaatgcagttttgatctagtaacatcca

SEQ ID NO: 161810 - DNA, 601 bp, Human
tttatttacaaaacatattgtttgtctttacttctcagagcccatttcttcctcagtcccctacaatatagcttataccacgctactctgctgaagatgtttttgctagaaaatcagtgagcttctatttgttatgtacaatgatcacttttcagtcctttccacactctctgctgtttgaccctattggtagtccctgctgtgacttcctggaatctggctcagattttctcctaaaaggagcccactaaataaactgaatcatgtgcctactggccattacctgttgacatggcctaarccaaatttcttgtcttccccctaagacagcttctatacatcctctctcaataaagggtatctttaaacagaaacttggaagtcatctcatatttctacctgtcccttatgccttacttctatttgttcaccaagtcaattcaattatactttctcaatctttctgattgacatctctttttccctattgccagtgttttagggcataccctgatcatttcttgctttctaacttacctctttcttactccttttacatatatactctatctgctgccaaagtgatcttttgaaaatgtaa

SEQ ID NO: 161811 - DNA, 601 bp, Human
tcactgcaatctccgcctcccgggttcaagagattctcctgcctcagcctcccaagtagctgggattataggcacgtgccaccacagcctgctaagttttgtatttttagtagagacagggtttcactatattggccaggctagtcttgaactcctgacctcaggtgatccgtctgcctcggcctcccaaagtgctaggattacaggtatgagccacccacctggcccatatttttgtattcttacagcttttctatttctctaatgcttgtttatgtgttgatcatgtactaaatgtgcrtcaactcagagtaaggctagaaaacttcaggtgtctgaaattttttaaaaatgaagactttcaaggaacaagaaaacacaatgcttattttcacagtggcctgattctttcctgtgttcaacttggttctttcccacatttagctctcttttcagtattatccgactgtgaggaggcacccatcaccaatgaggcttgatctttctcccacgaatgatcatgttaattatgggacttggtggccttagatgaagcccagtggacaaactgcaccaaaatgggccatcaagtagtgttagg

SEQ ID NO: 161812 - DNA, 601 bp, Human
agttacctttccaaagacccgtcaagccttcggttgttgctattattctgtacgcattataagtccccgtgtagcgaggtttgattccgtggagatggctctgtgcttgaagtctgactttcacgacctctgtgggttgcccaatgaatactgccactcctccagtcgttagaccagctaaaatcttgcttcctaaactaggtgctgctatccagagagaaaaaaaattattaagaaaaaaaattaaagacctagaatgcatgcatgtctttttaattttcagtggttcatatttttgtattttttttttttttgagatggagtcttgctctgttatctaggctagagtgcagtggtgtgatcttggctcactgcaatctccgcctcccgggttcaagagattctcctgcctcagcctcccaagtagctgggattataggcacgtgccaccacagcctgctaagttttgtatttttagtagagacagggtttcactatattggccaggctagtcttgaactcctgacctcaggtgatccgtctgcctcggcctcccaaagtgctaggattacaggtatgagccacccacctggcccatatt

SEQ ID NO: 161813 - DNA, 601 bp, Human; identical to SEQ ID NO: 160932

SEQ ID NO: 161814 - DNA, 601 bp, Human; identical to SEQ ID NO: 160933

SEQ ID NO: 161815 - DNA, 601 bp, Human; identical to SEQ ID NO: 160934

SEQ ID NO: 161816 - DNA, 601 bp, Human; identical to SEQ ID NO: 160935

SEQ ID NO: 161817 - DNA, 601 bp, Human; identical to SEQ ID NO: 160936

SEQ ID NO: 161818 - DNA, 601 bp, Human; identical to SEQ ID NO: 160937

SEQ ID NO: 161819 - DNA, 601 bp, Human; identical to SEQ ID NO: 160938

SEQ ID NO: 161820 - DNA, 601 bp, Human; identical to SEQ ID NO: 160939

SEQ ID NO: 161821 - DNA, 601 bp, Human; identical to SEQ ID NO: 160940

SEQ ID NO: 161822 - DNA, 601 bp, Human; identical to SEQ ID NO: 160941

SEQ ID NO: 161823 - DNA, 601 bp, Human; identical to SEQ ID NO: 160942

SEQ ID NO: 161824 - DNA, 601 bp, Human; identical to SEQ ID NO: 160943

SEQ ID NO: 161825 - DNA, 601 bp, Human; identical to SEQ ID NO: 160944

SEQ ID NO: 161826 - DNA, 601 bp, Human; identical to SEQ ID NO: 160945

SEQ ID NO: 161827 - DNA, 601 bp, Human; identical to SEQ ID NO: 160946

SEQ ID NO: 161828 - DNA, 601 bp, Human; identical to SEQ ID NO: 160947

SEQ ID NO: 161829 - DNA, 601 bp, Human; identical to SEQ ID NO: 160948

SEQ ID NO: 161830 - DNA, 601 bp, Human; identical to SEQ ID NO: 160949

SEQ ID NO: 161831 - DNA, 601 bp, Human; identical to SEQ ID NO: 30375

SEQ ID NO: 161832 - DNA, 601 bp, Human; identical to SEQ ID NO: 30376

SEQ ID NO: 161833 - DNA, 601 bp, Human; identical to SEQ ID NO: 30377

SEQ ID NO: 161834 - DNA, 601 bp, Human; identical to SEQ ID NO: 30378

SEQ ID NO: 161835 - DNA, 601 bp, Human; identical to SEQ ID NO: 30379

SEQ ID NO: 161836 - DNA, 601 bp, Human; identical to SEQ ID NO: 30380

SEQ ID NO: 161837 - DNA, 601 bp, Human
caagactgtgtctcaaaaaaaaagaaagaaaatgaatgaggtagatccatatgagttaatagatggatgcattaaagatacataaaaagtaagtaaagttcagaatattgcatgtacaatacattccatgtattaaaaaggatacacacacacatgtgtatgtatacatatatatttgtgtttatttgtacatgtatacatatgcctaaaagatttatagaaaaatacacaagaaaatggtctctgaaaggtggcagggaaatacttttaattgtatatatttttaaattattattttcaccccccgtgtatgtgtgtgtgtgtgtgtgtgtgtatatatatatatcacttattataaaatcttataattaacatgagaattaggaacacacataattacaattctattaataccctgtttttaggaaggctttataaatagtttacaataggataaggtctgtgttaatgatcaaatactgtgaggagcacagagaggtatctctctataatcacaaacaaatttaaaaccagagagaaaaagcacaagtgtgagtaaaagtgtggcatcctgttaagcaacaaagtaaagcttagtttc

SEQ ID NO: 161838 - DNA, 601 bp, Human
aacagggggggaggagaggaagacaagctgggactgcacatccagtgagcagaaaatgaggcagttttctaatctaggaagagagggagctgacaagaaaggaatatatatgcatttgaagaataccaaggcggattttgtagtcacctgccacatcagagaaaaacaagaaggcagtatttgctggggagaaggaaccagtgcacagcagatactgatgagtttaaggtaccttttaactagaggaaagattagtgaggtgctgaaagttgctgccaccaactgggcatcaggcagactsgggggttacaaatcactttcacttcataaactgtgcatctccaatcagaatggtaaacaggtttcactgtagtcaaagaggtgagttttgaagccggtaatattttaacagacaaaaacagaaattttaagcaataactggaaaaatgtagtacataactgctttttctgatgatttatacagcagggcaccgttaaaggatttattcatatgagactgtaacggcaataagcagagggaataaatttaaaatgttattcaaatttaacataagaattggggtttgcttaaaatctatgg

SEQ ID NO: 161839 - DNA, 601 bp, Human
cgctgtccaaagtcccactggctctaacatcctatgattctttctgttttattaatgtctttgcagaaagtttcttgttggactaaataatactgtgtgattaaccatacttaggatttgtgaactagcatgaaagaatattaggaattttaagtggaattttaccaatgtcttgggcctgcatttttgtctggtggaatgaaaaaccaaaaccataactaaaattaatggagaaagaaaagttaacgttaagttttgtctttagaacttaacctctgcatacctcggctctcacatctgygaagggaagcttatgaaagcacccagcttgtagagtggctatgaggattcaatgaattatcatatgcaaaacagtaagaacagtgcttagcaacatatagtgcttagtaacatatagatgttacctaaatgttacctaccatggctgcaattgttattatgtatttgtttagacttaataccagaccccctttccagggacgctgtccttctgtgcactcacggttcctgaagtacccccagggttatggggtatatgtctctggccttccacagaactaaactcaagctagcattcaat

SEQ ID NO: 161840 - DNA, 601 bp, Human
cttccttcccctaacaaaaaccttaaccctgttttgctttttgaacaccccaatgttcccaggtaaaaattttgtattttacttagaccttgtttacttttcttaaggttttaactctcatttgatattcctatcctccctattttatttgcagcacagcttatgaaattacttacaaaaagaagatgaaacaatgatgatgaagaaaaagaagaaaaggaaaagatggcaacaaagaaggagaaacagaaccggaaaaggaagaagaagaaaccaaaaaaaaaaaaaaaaaccacacacacacacacacacacacacacacacacacacacacacacaaaatgaaaccctgcctctggaatacattgtctttattaataaagatattaccatacttcagttcaaaaccatgaaacttgacagcagacaatgtgtctttagggcagacataaatcctgtctcccaacaccaacatcataaaatggttgtactatatttggacttagatgtgtttggatacttatatttgaatgtaagtatgactgatggtctaggaattcataatccttcaaaatgttgaactaaaccacttgtttaatgg

SEQ ID NO: 161841 - DNA, 601 bp, Human
ctccttccttcccctaacaaaaaccttaaccctgttttgctttttgaacaccccaatgttcccaggtaaaaattttgtattttacttagaccttgtttacttttcttaaggttttaactctcatttgatattcctatcctccctattttatttgcagcacagcttatgaaattacttacaaaaagaagatgaaacaatgatgatgaagaaaaagaagaaaaggaaaagatggcaacaaagaaggagaaacagaaccggaaaaggaagaagaagaaaccaaaaaaaaaaaaaaaaaccacacacacacacacacacacacacacacacacacacacacacacaaaatgaaaccctgcctctggaatacattgtctttattaataaagatattaccatacttcagttcaaaaccatgaaacttgacagcagacaatgtgtctttagggcagacataaatcctgtctcccaacaccaacatcataaaatggttgtactatatttggacttagatgtgtttggatacttatatttgaatgtaagtatgactgatggtctaggaattcataatccttcaaaatgttgaactaaaccacttgtttaa

SEQ ID NO: 161842 - DNA, 601 bp, Human
ttctccttccttcccctaacaaaaaccttaaccctgttttgctttttgaacaccccaatgttcccaggtaaaaattttgtattttacttagaccttgtttacttttcttaaggttttaactctcatttgatattcctatcctccctattttatttgcagcacagcttatgaaattacttacaaaaagaagatgaaacaatgatgatgaagaaaaagaagaaaaggaaaagatggcaacaaagaaggagaaacagaaccggaaaaggaagaagaagaaaccaaaaaaaaaaaaaaaaaccacacacacacacacacacacacacacacacacacacacacacacaaaatgaaaccctgcctctggaatacattgtctttattaataaagatattaccatacttcagttcaaaaccatgaaacttgacagcagacaatgtgtctttagggcagacataaatcctgtctcccaacaccaacatcataaaatggttgtactatatttggacttagatgtgtttggatacttatatttgaatgtaagtatgactgatggtctaggaattcataatccttcaaaatgttgaactaaaccacttgttt

SEQ ID NO: 161843 - DNA, 601 bp, Human
gagcacttgttcctggaccttctctgggcctcagtttcagtatttatacatttctaaaatctgtcctactataactaatttataatacgaatttttctaaagatggatggtctggctatggaagaagatataagccataatttcaatggcaaaaataaaagcatttaaaaataagaaggtcctttaaaagttattcatcaaaggcccaaacctattagggtctgattacacaatcttacaaattagcactgaatgaacaggggaaatgatacacaataaaccattagttacaagaagcagratgcatcaaactttacatagtaccatatacacaggtgcataccagacaatggattaacctgcttttccactgcattcctctaaatgttttcatacgaatcttttctggcatccaagtgtctttcttttatgtcctgactctcctccataagctctctgtcccctaaaagaggctgattaaggccacaggtcgcctggtcccaatgctgccgggagtgaaggggttgtcatcaatctctttcaaaacccagcatctgctctgtccagcctaggtccactggctggcaagactttcactcca

SEQ ID NO: 161844 - DNA, 601 bp, Human
aaatgagagaaagaaaacacccatgcccacaggattgataaggtttggttatttcaagtatagcagagaacttgcagataccagtccacctcttgagggtatgaacacaaagaggcccaatctattacccaacaacgcgcctcttaggtcagctctcgctaccacgtgactcagcttccacacctacgaaccggagaggaaaataagcaccttgagcacttgttcctggaccttctctgggcctcagtttcagtatttatacatttctaaaatctgtcctactataactaatttataataygaatttttctaaagatggatggtctggctatggaagaagatataagccataatttcaatggcaaaaataaaagcatttaaaaataagaaggtcctttaaaagttattcatcaaaggcccaaacctattagggtctgattacacaatcttacaaattagcactgaatgaacaggggaaatgatacacaataaaccattagttacaagaagcaggatgcatcaaactttacatagtaccatatacacaggtgcataccagacaatggattaacctgcttttccactgcattcctctaaatgt

SEQ ID NO: 161845 - DNA, 601 bp, Human
actatttctctttttccaaccacctgactgataccctcattgacaactacctccctcaaaaagtcccatcccacccaatcctttctaatgtggaggttcccactgagagcagggtagtactgaggatctaaaactctgctacagtatcaccccttcagggctgaccgctgagagagtaatcacactgcctaagatcaaataaatgagagaaagaaaacacccatgcccacaggattgataaggtttggttatttcaagtatagcagagaacttgcagataccagtccacctcttgagggtrtgaacacaaagaggcccaatctattacccaacaacgcgcctcttaggtcagctctcgctaccacgtgactcagcttccacacctacgaaccggagaggaaaataagcaccttgagcacttgttcctggaccttctctgggcctcagtttcagtatttatacatttctaaaatctgtcctactataactaatttataatacgaatttttctaaagatggatggtctggctatggaagaagatataagccataatttcaatggcaaaaataaaagcatttaaaaataagaaggtcctttaaa

SEQ ID NO: 161846 - DNA, 601 bp, Human
tctcagattccagctaaaacaccgactatgtgaccctggggagcacagagctcacagggtggtaatgggatataaaatttgcaaacttgaggtcagtggcctcaactctggggtgtgaagcaccagcagtccatgaaagattaaaaaactatttgtctacttaaaggctgcacatcaagtccttcactgaaaagcatttgcctacatctcctcagacattaaccccatcagaaagggagagaaagatattccaaatggcagttctgcctagaatcattggaaaaaaagataataatatcamcaagcccaagacagggtgttcattctgaaaatgaagcattgggtcctattcaaacgcagctaatgctcataacatagttgtcacttggagtaggcagatgttttacagtattactaggtgagatgatatggaggaaaacacaagaatttaagaatttttttctttctttagcatgtttattacataaactcttaatgtatagtttggataactgagccagcaagttacacaacaagaaaccaagcttaatcacagacccagaactgccttagttgatcccaggtcatttgactctttgac

SEQ ID NO: 161847 - DNA, 601 bp, Human
cactgacatgaaacacacgggtgatgtgcctggcacacatgcacatgcgcacgtatcatcccctacaaacagtcggggaggtgctcctggggcagctcttgtccctaccttcctttccccaaaggggactgggtgtaccagtaattttcagaatctttcatttgaatcactaaggttgtacttgttccaatttcttgaagaaaaaaaaaaaaaagagcattcctgagagagcaatgccgaaatgaaggtacaaaaattcacttctgaatattaaaatctctgcagatatcttctttattaycctcatagtccaaaatcttaccaacttttcataaggttcttgcctgaaatcccttactttaaaataaaaacacattgagtgcttccaccttgacactcacaaaagatcatgggataaatggacctttgcagaattattttcttccctttcaaatgccaggctccttctgtgtgaattttccacaatttcatagctcataatagcctatccttactgttagatattaaataatttttctacaacaaagtcgcagataagaaaaatcagacccagcatattgcaaacattactggctgtgaa

SEQ ID NO: 161848 - DNA, 601 bp, Human
tccaaagagaatgtattctcttttttgtataaactaatttgtacatcattttttgtgctctgatttttttactaggtttgcaaaataaataaataagacagtgttttggaagtgtattagcaaaggaaaacaatgtaaagagaacacattttaggaacattcactcctatagattggcacttctgtttctgaaatagtttctgcatttcccaacagagaatgagtattctgtcctgcaccctccggtaaaaacattagtcagctcttaacatgctcaacgtttgagggagtggatgtgtasagagcacaagaaagattcaacatgtggataattcaaaacctactcagagctggcattggaatgtgttagtacacacacttcaacatgggtgtggcttgtcttttgaaaagtagctcaaagcaaaaccatcaggacacgcaggcaactgtctgacccggcttaggaagacaatgagctgctcgaaggcctgggtgatccagatgatcttctaaaaaaaaccctccaatttcacgtctctgtgacttaattcagaggctgctgggatattgtccattacacagagaaagtggtgactgtcct

SEQ ID NO: 161849 - DNA, 601 bp, Human
taagtttctataaagtcagaggaagttaggtaaaagcatgcagtttgctgagattatttcattgaaattaacacttcacaatattagcagtcaaaaacttaagttttttttttaattttgaaattgaaacaaagttgtaagcatttattttttaaacatttagatatgtggaaaacttttaataaaaatagtctaatttaaatttaagggaatttaaccaaatcagtactttagtccacatgaagtcattcagtggaataaaaataataattagcaactattagagagctttaatttatamaatttactcttcccccaaaccctatcaagaaaatgtattggtgtgctcattctcagatgaggaaactgaaaatgtgagaagtgaagtaatttttcaaaggctacacaatggaaacgtcataaatccctaattaaaaaccaaaagactttattaataacattccaaggttagtgttaaagatttttagattagagattagaaagatgtttccataaatactccaaagagaatgtattctcttttttgtataaactaatttgtacatcattttttgtgctctgatttttttactaggtttgc

SEQ ID NO: 161850 - DNA, 601 bp, Human
aaattttagaaaattaaaaggaaaaaatctaacacataacaacaattacccataagtggaatacatggagtacgagagtgaaattcttccatgtttcagttgcatcatttagaaacatttatagctacaaaagcttcagagatcttgtagctcaaaccatatttcatagcagtcaacaggccatggatctttaaaacatttctctatctagccctcccatcaaaacagggacaatattgttgctcaggaacaaaaataaataaataaatcactaacagattttaagtttctataaagtcasaggaagttaggtaaaagcatgcagtttgctgagattatttcattgaaattaacacttcacaatattagcagtcaaaaacttaagttttttttttaattttgaaattgaaacaaagttgtaagcatttattttttaaacatttagatatgtggaaaacttttaataaaaatagtctaatttaaatttaagggaatttaaccaaatcagtactttagtccacatgaagtcattcagtggaataaaaataataattagcaactattagagagctttaatttataaaatttactcttcccccaa

SEQ ID NO: 161851 - DNA, 601 bp, Human
gggagatgattctagggctgggcaggaaatagacaagctgaatctgtagcatcttgcagtgacagaaagtataaggaagtgctaaacaaacatccacactgaggggagcatggcaagggacacagaagccaaatgaaggaagtgtaaatggccaaagctagaacccttttggagcaacaaaataacaaaagcagcattggattacaataccaagtaaaaaataaatatccataagtccatactgataaataaatgattgaagaaataaatgggagagaaaagacaaatctcttgtgcttcygactttcaaataattttgtagatgctctgccttcaaaaagatgaagcataactccccactccttacatgtgagctacacatactgactgtcttccaaagagtacagtataaagggagggggaggaagtggaaaatcctgacaaatcctatctcagccaggcaatgaagggttacagcaacaatggaaaatcatgttgatactataaacccttaatattatgtgataaaaatggaactttacctctgtggtctttttcccaaaaacccataatttcaatgtaatcatgacaaaaacatcaa

SEQ ID NO: 161852 - DNA, 601 bp, Human
ctgagcaatcatttcaaataggaagcactatgggaattcttaggaagggagagtgagactatcatggctggaatgatccagctccagatattccttacagaagactgggaagagagatgaagagatgacgatgtatgtaatgttacacatcattgagggtttgggaaacaaagacaaaacaccatagttccatcagcctcacaataatcactatattaatcatatctattgagtgcttatcctatttcagtcacagcactcatttacctccccacaatacttctatgaaataagttattayttttatcattactgttgcattataattaatgtgaggaagctgggccatagagattaatccatctaaattcatatgttaataaactggggagccaaaattcaaatctagctccccatgttagcattttttgcacgagtctctgcttgttttgcatgagtgttattacaatcttcattttttgttactttttcacttatgttattgtataaatctaatgatcatttttgatagatacataatattttattgagtcatttgtaccatcagttactcaacattccattactgctggctgttcag

SEQ ID NO: 161853 - DNA, 601 bp, Human
ctcaaactcaatttatccaagatcaatagctcctcttcctgtgtagccagtaagttcactgccaggtccacaaccggatacatcaggactattcaccttgcccacaagcacaaagctgttcaacaattttttttttttaccaacccaaaggttttttttaagtttcttgtttttttgtgactatggaaataaaatatgattaagaaacaaactgaaataatttgtacctcaaacaatcatgacacgagtttacctgtataacaaacctgcacatgtacccctgaacctaaaataaaagttaaaaaaaaaaaaacaggagaagaactaacatttattgaagtctggatactctacatgcttcgacctatatgaatgccaaatcaacatgttttaaaaattaaattaacctattgagatacatttggttgtgcgctgaagggctcatgagagggactcaagctgcccctttcctgagagccatggtcgggggactggaggagcatgtatgtacaaagggtagtgatgaaccccagacaacataaaaacattgctgagcaatcatttcaaataggaagcactatgggaattcttaggaagggag

SEQ ID NO: 161854 - DNA, 601 bp, Human
ttgtctgagttgacactgcttgggacacgggcaattctggcttcctcctttgaggatgcaagccagccaaccactctaacttactttgtgcagtttgggatttttttttattttttagatgaaagtaatctgaaaaggaacagaatgaataatagatttattctggttttcaagagctttatccccttcttgccttctccatcaccagtagattggtgactctattacgttttcctcccaagccatggtccatctgtttctctctccctccttctctccctcccttcctcatctccccttycctatctgcctttcttccactctgtctcttttcttctctcttcagttcctgttttcagggcatttagaattaaatgttttgttaccatctcaaactcaatttatccaagatcaatagctcctcttcctgtgtagccagtaagttcactgccaggtccacaaccggatacatcaggactattcaccttgcccacaagcacaaagctgttcaacaattttttttttttaccaacccaaaggttttttttaagtttcttgtttttttgtgactatggaaataaaatatgattaagaaacaaac

SEQ ID NO: 161855 - DNA, 601 bp, Human
ctatgatttagccccttaagtataaatctggaggggatcaaaaggtacatgccctcacacaacaaaggacacccaacttcccatgtaatgtgtcccatgttaatatcttaacatcctactgttccaaggttaaaataacttccactataaaaaatgtgatagatcatgaaacaattacaatacataaatgagctgcctgtattgtgaactacacatcatgattttatttgctctttgacaattttcttatcaagataaaaaaagaaaaaacatcatgagtactgtctgatgaaggggcccrtactattctaacgaacctttcaaatattccccctctttattttagtgcctttattctggccctcttcactgaagtcagaggtcaagtctcccagtagtgatgtgaatacctcatgtgactgttacagtccatctgccagtcacaatgcaacctgggtaacaaaacttcaaaccctggtaatgagaacagcttccatgacctccctaagcttcagcttgactctctagactggggtccccaacccctgggccacagaccagtaacggtccatgtcctgttaggaactgggccacacagcag

SEQ ID NO: 161856 - DNA, 601 bp, Human
acggagcaaacagctggcctctaccacgtctgaccacatcattgcaagacttggcctctgtgcaagatgtctgcagtgtgtccacattccttagccaaagcccacttctgcaatttggcctcttacagcaagatagcctttctgtttcctatgcaaagtgcaaactccttttcagaaaaggttaaggtaataaaaacaaggtcaggaggctcttatttcatatatgttagtttctcaacatatttgttagtgattaaactcttgggcaaggagaacaagtactaggtaagggctaatgagrctgaccctgctccattaactgcttttttttttaacctttaaggaaaaaaactatgatttagccccttaagtataaatctggaggggatcaaaaggtacatgccctcacacaacaaaggacacccaacttcccatgtaatgtgtcccatgttaatatcttaacatcctactgttccaaggttaaaataacttccactataaaaaatgtgatagatcatgaaacaattacaatacataaatgagctgcctgtattgtgaactacacatcatgattttatttgctctttgacaattttcttat

SEQ ID NO: 161857 - DNA, 601 bp, Human
gctggagatagtccaatccctaccaaatcctggaatagtgtcagagcactcctgagcctttgcagggtgccctgtggttgacataacaaggttttattttttttttttactacaatcatacattgtctgacataatatgtcacagtcatagtgtctgacaaaaatatgtatgtcataacacatacacaagatgaagaagctcagaaacaaaggatccagaataacaatttcagtcctacaaagcaaaatattctaaagattttccaaggaatttgaaaaagcatggtaatataaacattcyttttttaatgtttagaatcaatctacagccaaaacatggaagattttacaatttactatagttacaaaagaaaatgtaaatgttgtaaaccttcacaagagtaaaagtaatgggacagatgacataactcgggaaacaatttgggaggaaaggtgtggcagtcaataaagcagctgatcctagaaacagagtcttatatatattacactgtgttttaaaataaccaatacataaaagttatactaaaactatattttaaagttgtgaagaagaagagagaaagagggtacagatacttta

SEQ ID NO: 161858 - DNA, 601 bp, Human
aagcaaactcatgagactcaatgctgggttggtagcttgggacactaacatagtgatatcaacagggacatcccttaatatcacctatgcatatggcccatcagggaaataaaaaccagagatacaaaatgtagcacattctgtcacaattcatgaagccatacaagtcttaaattagacaataaacttaaacaataaatttcttaccaatatggttaagaaagtttgtaataaaatctaatgcacataagacttcacatttctacactttgaagccatatatatatatatattttcctayggcccatctcacctctataattttacatattctccctttcactaaaattacaggaacgcaaactctgacatgagtcagaaaaaaataaaggccaaaacatgtaaatatttctttagcaaaagtttggaaacaggccaggcgcggtggctcacgcctgtaatcccagcactttgggaagccgaggtgggcaggtcacttgaggtaatgaattcaagaccagcctggccaacatggtgaaaccccatctctaccaaaaatacaaaaattagcttggcatggtggcacgcacctgtagtccca

SEQ ID NO: 161859 - DNA, 601 bp, Human
actttgaaccttctggaaatgcaatctctcattcaggtcactaagagatcattttctattctcagagtcacaggacactcaagtcaaaaaccacctgaaagaacaacacttcttccattctgttcatattcaagtgggaaaactaagcctctctgaggtcccacgacttgcctagacctccttgatccctatcatataaaaagtataaaatttttcagaggaaaaattcgttcagtgatctaaattgatcctttttagtagaaccacatgtagtgaatgcaaacatttcactgagtagaaytgtccttctattagcaggaaagttagcaaagtgatcaggatgttctgtggaatggcacagctgttccctagaacatcactccaaaagatgagaaatgaattctgatcatccccagctatccttaatttaaaatattttgccatctttaattttgcaagccatttagacaatattagtgcagagagaatcaaagccaacaattttaaagatttcaagtaaccccaaagatcctgatgaaaccagaacctcctccttacactactctcatccacaagctacttggggactttgtctaacgtc

SEQ ID NO: 161860 - DNA, 601 bp, Human
attacaaaatagaaaatacaaaattacaaaatataaactataggaaacaacttttatcatgtatcatatataattatatatataattagacaattatatatatacacatacatatacatatatatatatatatatattattgtctaaatgtttgtgtccccacaaaattcatatgttgaaacttagtccctaatgggagagtatggagcagtggggcctttggggaggtgattaagttatgcaggcagagccctcatgaaaggattagtatccttataaaaaaaaaaaaaggcctgggagrcctgtttgtcccttctgccatgtgaggacacacagaaagcaccatctaggaggagaaggccttcaccagacatgtaatctgctggcctcttgatcttggacttcccagcctctagaactgtaaaaaaatacatttttattgtttataaatgacccagtctacagtattttgttatagaagcccaaactgacaaatatatatgtaaagttatagagtttattaatcccagtgttacaagctaatatatatttgaatgtgtgtatacacatattagaacaatgagtaaattcatacatcagt

SEQ ID NO: 161861 - DNA, 601 bp, Human
acaaatgccccaaactcttgctcccagctgattaaagccccttcctaaaaccggtgtccgagaggttttgtctgcgactggtcctgctgacactctcattgaattgaagtaaattaaatgagaaaatgtgatcaaactataaggggtttgaaaagtgtaaagggccccaaattgatatacaggtttgatgcaattcctatcaaaatcctaaaaggttttgtaaatatagacaagattaatctacagtttttacagaaaagaactagaatagctaaaacaaaaaaaggataaagtggggaaratctgcctacccatctgggtggcagagcaagaccctgtctcaaagaataagtaaataaaaataaaactatgaaaccatcagaaaaaagttggagaaaatcttcagaatctaggagtagacaaagcattcctagacttgacaatgaaagcatgatccagtaaagggaaaactgataagttagacttactcaaatttgaaaacatttgctctatgaaagatcccattaaaaatattaaaaagcaagctacagagtgtgataaaatgcctgcaaataacatatctgataaacagctagtattt

SEQ ID NO: 161862 - DNA, 601 bp, Human
tgcaccatactccctcaaacttgctaacacactggtctagaattgttctgctggccttcttacacccttagagctcagatttgcattgggagtacaaatgccccaaactcttgctcccagctgattaaagccccttcctaaaaccggtgtccgagaggttttgtctgcgactggtcctgctgacactctcattgaattgaagtaaattaaatgagaaaatgtgatcaaactataaggggtttgaaaagtgtaaagggccccaaattgatatacaggtttgatgcaattcctatcaaaatcstaaaaggttttgtaaatatagacaagattaatctacagtttttacagaaaagaactagaatagctaaaacaaaaaaaggataaagtggggaaaatctgcctacccatctgggtggcagagcaagaccctgtctcaaagaataagtaaataaaaataaaactatgaaaccatcagaaaaaagttggagaaaatcttcagaatctaggagtagacaaagcattcctagacttgacaatgaaagcatgatccagtaaagggaaaactgataagttagacttactcaaatttgaaaacatttgc

SEQ ID NO: 161863 - DNA, 601 bp, Human
aagaattctagatgtatcataattaggagaccaagttctacgtctcttaaaaaagccaactgaaacctaggggttcctcctacacccataatgatgctgtattctttactggatgcactaagtaccccaagtcagaagatattcctaaactcaatctgtgttaagattttactagaaattgaaaacactaggggaatcaaagtgcacagatccagccatatgcagtgaaccctgagtgtcctagggtcccagtgaggacctgcccttgaagacgagcagacagccgtaaagggtttcatgwaaggctcaataacccagagctaacagaaaatgttgccatctccccatatccataaaagatcccaaattaattttgtgttcatatcagatgtcagtcagtcatttcagtcattcaacagtgacttactgaacgtctttcatttggcagcattggccagaaagagcagaagaaattttctttagattacagcccagcacagattagttcttaaatgattcatcagaaaagaacaatgtgagcacgctatgggaatgagagagaggcagggctggcacctggatctcaatacctcaggtaatg

SEQ ID NO: 161864 - DNA, 601 bp, Human
tagagtagcaccttgctttatatgtaagtgctgtataaaactgtgctaaattaatttttatttacttaactcatgctgcctgatgatgacatcaaaagccatgcccaaagaccaaactgagacttagaagttgtccattgtgtccgaggcacttatacagccctactaagtaggttgctattaaaaatatttttatctttgtttccccatgtatgaatgcagaaataactcctttgttggagtaatgaaatcaagcaaccccggaaactgattgcagttattttaggctcttatgattccrttaaaacatctcagccaagatgcttttttaactaaaaatctgtctatacgtatacaaagaaaaaaaatgatttagtgaaaactttgaataatattctaagtaggtcatgaaaaggtgtatagttgctttaaatttgaagttaaacttagcttcatcctatcttagaaaaacagtgaggattgggaaaagcacaggaaatgatgtcatctgtcaagcagcataggaactcagccttcaaactgatttcaattaaagcagttcatgccaagagctaatttccattcccacatgagcaacaaa

SEQ ID NO: 161865 - DNA, 601 bp, Human
tccttgcccctaactcctaaaccccaacacaacacacacacagttctcccccaaacctgaaatcctatctatctccaaaacccatttcaaatattgcttccttccgctaatcttttctgatatctcccaaaccaaatgtgagccctctctcctttccaattacttcatatttctcttttgaagcatatattatataatccagcctatttttacttattttgccccatctcatttgtttaaaaacttcttcagagtggggagtgggagagcattaattatgcaatacctcttaagtgcctasagtagcaccttgctttatatgtaagtgctgtataaaactgtgctaaattaatttttatttacttaactcatgctgcctgatgatgacatcaaaagccatgcccaaagaccaaactgagacttagaagttgtccattgtgtccgaggcacttatacagccctactaagtaggttgctattaaaaatatttttatctttgtttccccatgtatgaatgcagaaataactcctttgttggagtaatgaaatcaagcaaccccggaaactgattgcagttattttaggctcttatgattccgtt

SEQ ID NO: 161866 - DNA, 601 bp, Human
tataaggagctacacaaatctcagcctgccaacagggaaggaaagtgcagaacccactatcttctatacccttccttttacagcacaaagaagttaggttgagttgaaagttaaatgccttttcaacaacatgccacacactgaaacaccatcaaaggcctgtttctactgaactagagccacctccatctctccacattcacggtcccctcagcatggccccaggtatctttcgaggctccttggcacatgcccactatgtcctatgactccatcccctgatctacttatcagtcattcwttcactcaatgaacatttctgagtgcctactatgtgccatgcaaaacacccggcactttccttgtcctagtccctctgtagaaccctctctcttacctgcctctttgtctccttgcccctaactcctaaaccccaacacaacacacacacagttctcccccaaacctgaaatcctatctatctccaaaacccatttcaaatattgcttccttccgctaatcttttctgatatctcccaaaccaaatgtgagccctctctcctttccaattacttcatatttctcttttgaagcatatatt

SEQ ID NO: 161867 - DNA, 601 bp, Human
gcctgtaatcccaacactttgggaggccaaggtaggcggatcacctgaggtcaggagtttgagaccagcctggccaacatggtggaaccccgtccctactaaaaatacaaaaattagccaggcgtaatggcgcatgcctgtaatcccagccactccggaggctgaggcaagagaatcgcttgaacctgggggggcagaggttgtagtgagcggagatcgcaccactgtactccagcctgagtgacagagcgagcgaaagaaagaaaaaaaaatcatttaccatgcaatgcaattgtttctytggcattcactttaatagtgctaaatgacttctttaatttaacagaaattacaactcaatgtcatttctgtaatttataccaacaagaaagtattgccttgagtaaccatatgagacaagattatgatggcaataattttcccgtgaaaagatttagaatcccaggtagatggcacaggggaacagttaagagtagcaaattccaaagaattttgttaaaagaaattttagaggcagaatagagaaaaaagaaaatacctacaaagacatttaataacaacactgcctgacgacagggac

SEQ ID NO: 161868 - DNA, 601 bp, Human
ggctcatgcctgtaatcccaacactttgggaggccaaggtaggcggatcacctgaggtcaggagtttgagaccagcctggccaacatggtggaaccccgtccctactaaaaatacaaaaattagccaggcgtaatggcgcatgcctgtaatcccagccactccggaggctgaggcaagagaatcgcttgaacctgggggggcagaggttgtagtgagcggagatcgcaccactgtactccagcctgagtgacagagcgagcgaaagaaagaaaaaaaaatcatttaccatgcaatgcaatygtttctttggcattcactttaatagtgctaaatgacttctttaatttaacagaaattacaactcaatgtcatttctgtaatttataccaacaagaaagtattgccttgagtaaccatatgagacaagattatgatggcaataattttcccgtgaaaagatttagaatcccaggtagatggcacaggggaacagttaagagtagcaaattccaaagaattttgttaaaagaaattttagaggcagaatagagaaaaaagaaaatacctacaaagacatttaataacaacactgcctgacga

SEQ ID NO: 161869 - DNA, 601 bp, Human
gaaccttcaaactgaacaccatgtgataagtacttcggtagcagaatctagattaggaaatgagagggatgcagataccaccaatcaagataaaggacatgtttagagagaatgatgaggctgagttttgaaatattttatttgagatgcttcctgaaaatccaagtgttgaagttcagcaagtgggtggaaggtatgtgtctggaatgaacaagaattctgctcctttggtggtgactagaaatcaaggagatcaggcaagcaaggtggtgaaggtaaatgagaggaaaatgaatcaaayaacctgtaaccaatcaaggttccaattggaaatttggtgttaagttttttgagtaagtgatttgttcatctgtaaaggtcactggacacttgtaaacatgctgtgtcccaggtaatcgaagaaaatccatcagcacttatctctttattctacttgtctacaaacaggttaacatctagaatacttataactacagtgtacttacgttgtccacagtgagtccctatgtatcctttctggcatagacagtgatcgtcactgcagctacctccattcatacagcgaatattgcagtgttgt

SEQ ID NO: 161870 - DNA, 601 bp, Human
gtgatctttctcactgtaaaccttcgtaagtgaagggtaataaggttggtatttcacaagagtaaacacatgggctatggagtcagactgcttgggttccaaccccaactctgccgattaccatctatatacccttagaggaactactgaggtccctgtgttccagttccctcatctgccagagggtaacatttatgtcctctaatacaaagagttgttgtcatattaaatgagttaacacacatagagttctaaaatgtgcctagcacacagtaagcacagagtaactgaaaagatgtakgttattgatgttgttagtgttgtttattgttgtggtctcactcttctttcctagccctactttggaagaaaacatagtatgtataaaggcatcaaaacctggcccatgacatcctatctgaccttacttcctttcccctcactctcctctgcatttaagctctagcaacaccaaagcacttgctatgtcccacatcccttgctgtgtcttgtgctggtgctttggtcatgctctaccatctgcccaaaaaggtccattccccatcacctgacaggtaagctcctacccatccctcaagac

SEQ ID NO: 161871 - DNA, 601 bp, Human
ctaagccaaccctcccagattacagatgaggaagctgaagtttaggaaaagttttctaattctgccagtgttaattaagcacttgtgtgttgggcattgggctaaactccctcagggagcaccaaggggagcagaagagatgcccagcagcccctcctgattctcctggaatgccttgggatccagccccatctcgccatctccacagccatagccttagttaggacttgtcttcctgctcctgttttgtcctcctccagttgcgcttccacactgtgatctttctcactgtaaaccttcrtaagtgaagggtaataaggttggtatttcacaagagtaaacacatgggctatggagtcagactgcttgggttccaaccccaactctgccgattaccatctatatacccttagaggaactactgaggtccctgtgttccagttccctcatctgccagagggtaacatttatgtcctctaatacaaagagttgttgtcatattaaatgagttaacacacatagagttctaaaatgtgcctagcacacagtaagcacagagtaactgaaaagatgtaggttattgatgttgttagtgttgttt

SEQ ID NO: 161872 - DNA, 601 bp, Human
atgtaatttacctagtaatcaaagtaatcgacctggaatttcttgctcaaataggtattactgcattattagcaaataactgaatttagataaattataaacacagacagaaaataatttctcacaaaccactctctgctctttgttttcctctattacatgttttaaatgacatattcaacatctgctactgaatctttactttccatcttagaataagatgtctatacaactttggctaaaagtgattactgcagtttaaaagttcatgcaaattttcaattacagttttgtgtaacayaaaacttctaaactttcattataaaactagggatgatgagaaaaaaatctataaatgtagagacaagattattagtaagaccaaagttcagggaaaaaaacttaagaatattgcatatccacacatatctcaatatcatacttgtatttttaggtaggcaaatcaggtagaatgtttcttttaattaagagcagcagtaaacattagacttgaagagacaaaacacacattcaaattaaaggtttcttatgtatgtggccttggggacatccctggacctctttgtgccttcatcttctc

SEQ ID NO: 161873 - DNA, 601 bp, Human
gatcccaaacagctaaaatgtgtgattacccactgtagtcactagaattaacagtaaattactgtaggctgtttctgaaaactcaaatgcctcctcaaaagggaaaaaaaaaaatcacacactgatttgaatgtattgctgattctgtaaaggcacctccaaaaaagagttccaaacacattttgagctgttgtaatattacaagaaaatgatataactttccatgataactgcactaaatgacaatattcattccatatgtctacttccaggcatgttagttcagtcctttggagcacayttatatgtcctgtaaacacacaggaatctctctctttccaagagcagattcgtacgttgaaatcaatcaaatagaggaatattccaaaaccctacatttgaaacatccaagaatatgcaagaatcctttcttttgccttttcatcttgacttccattctaagattcatagttctaggtttcttcttaccgttcctcagaaaagtctttagagttatgagtggcccctttccagtgaggtctttagagttacgagtggcccctttccagtgaggtctttagagttatgagtggcccctttc

SEQ ID NO: 161874 - DNA, 601 bp, Human
atttttgaaagtcattcaataaaatcattagaaagatatctgtgcaaaatcatttttacatcatcagagaaacaaggtgtgaggacaagtttctcaaacgtcaactgcacatataagaaggaggtggaattacaatcaacctagctgttgtttgttctattctgtttcattgttgtgctaacaaatacaaaaaccttttcagcttcattaagactgtaatttcctaggaagcaagtacctgcatgaagagctagttcactttcaactgttctgcttctctaatgaactaaggattatttcmatcctctcatttttattctactccactttggccccaattgttccttttccttaaggctatcagttcaacaatgctttcccctatactttatctactgatagccagcataacagccaacagactttcttaagttggcagaaatccaagtattgtcttcacagtttagacttgggtaggaatttaacacagaacaaatgcaccaggatttagaagagtccacgtgcatgctaatattctgaggatacatgatgagcagcttcagatggagaaatgagagaaaacttcttgctatttgcattt

SEQ ID NO: 161875 - DNA, 601 bp, Human
gggacagtgagtgggagacaaaaatcaagcttctttctggttgcatcccatccccactgcttgttcataccacatatgtgcagcctgcgagacagaggagcatgtgtgccctcagtgtatacagttacccagccacaaaaaaacgagtgtgtgtgtcaaaagatgcaattcctggaactattctaggaaaatctagtttattcagtgatccaccagctgccacaaatgttgcaataccactgtagacgcacagtaacatttagggcattgtgcccctgctatctacacattgttactttcytttttttttttttttttttttgagacggcgtctcgctctgtcgcccaggctggagtgcagtggcgtgatctcggctcactgcaagctccacctcctgggttcacgccattctcccgcttcagcctcccgagtaactgggactataggtgcccaccaccacgcccggctaattttgtttttctatttgtagtagagacagggtttcacagtagagccaggatggtctcgatctcctgacctcgtgattcgcctgccccggcctcccaaagtgctgggattacaggcgtgagccaccacgcc

SEQ ID NO: 161876 - DNA, 601 bp, Human
aaacatctatctagaatatgaaaatgttgtcatgcagatgtcaagtgactttcaaaatgactgtcaaaataataagaatccagatctccaagatgaagacattaaaggtgttaagggaaaacaaattggaaagaagaaattctaaaattcatgggcttggagatgtgagttaaactaagtaaaaacagtttccttcctgcaggactcccaagagctaacaaacccgatgcctccccaagaagacatgggatggagtttccaaaaatgatattatatccatggcaacttaatttcatggaayccctcatgggactgatgttctacaaaaagtactttggcacatcgtcgggaccatgaagccccatgtatttgtccaacatatgttcataaaccaaaaacagcatagactctctagagaccataactactgggaacataaacattaagtgttctgaagtactctcagttgggcatataaaattggtaaggatttcctgaatgccgtctataagaaagtgaaaacagtttcagaaatagaccagtcttcccactaatttatacatacaaaggggcattttttaatcccaatatcctgcttcag

SEQ ID NO: 161877 - DNA, 601 bp, Human
aacaggaaagtcctgggtacactcccagttggctccgtcaagggatgggatgccttctaggcactgccttttgtttagttttgtgatagcttattctgcttggcaatgtggagaacactgtagaaagaaatgaggcctaaataaggtctgaaaagaaatagcccaatcccactccaaattatgccgtctgaaaaaataaataaataaagaattttcgatggtgatttagggttgttttcctccaaggacaatctgaattctattacatacttctttccaaagccagttttatatcattaaratactgtggatgcttctgcttttatcttctccatagtagaacaagaaagttccaaaattttctccagttttcaagtgaagttttcaaatgattatataaagaatgagtcaaaatttacttctggcttcgcttttgccttttaacgttcacgagtcttagtttaaagaatatatcattggaatccctaacagaatatgatcatttccattgggacttcaggaaacaaatggttcatgaagagctaatgtatgtttataaaaacattttcaatttggataaaagttgcctccatcctgtaag

SEQ ID NO: 161878 - DNA, 601 bp, Human
ctgtatgtcagtaaaagtaagcaaatctttcaggaatttttggttagctattgggagaacaaatgcttcccagacacagtcaccattacattttatggaaatagttttccccttaccccttcattttctctttctttattactatttgcactattgtagttttagccttcattacaactgcaacagttgaatgtgtactaaagaaaagcacacggttgatgtgcttctttcttgatgttgacctttctatatccagctcaagaatgttgggtttcatctgaataggggatccaaaaaataygctgttcaagtaaaataacaaaacttctaagtggaaaaaatggtcaaaatgaggcctttaagtttaggtgtaatttcagggatatgtgaacatttcatgatactgttaatgaaatgatacttgtcaaccaagattaccctcattttcatgtgaatttaaaatagttaacatttcttatacatgtattatgtgccagatcctgtgctaagtactttgtggatgatctcacttaatcttcctgacaatcttactagataaatactataattaccctcattgtatagattaggaaactgtgcc

SEQ ID NO: 161879 - DNA, 601 bp, Human
acaaaccaaccatcgtttacatgcaatctacaaaaaaaaaattgaagattggcatatgtatttttggacagagaatgggagtagggaattgaaagtgatgctactggttcgtgtatttgagaagaaaatatattttaaaatcaaaccttctaaggttggcaagtagttcaaattcatttttagttcattcattaaaagggagaaagtggaaagaaaaatcaaatctgcatgggaagaagcacaaagcagctacatccacatggctgttcccaagcctgtccacagggataatgactgaatrttagggatgatagttttgctggtactaatgttattttttcaggctgtgtggcaatactgtgaactggatccactagaagtgtctgtggtttgacgtatcctttgttaatgttccactcctaggcgtgtgctctccaaagcgcatcctataatttatttttaagtgaaaaatgtcagctgtagaaatgcatctccaagtcttttgggtatatacccagtaatgggatggctgggtcaaatggtacttctagttctagatccctgaggaatcgccacattgacttccacaatggcaaatgtc

SEQ ID NO: 161880 - DNA, 601 bp, Human
aaagaaattaagctgttactatgtgcttgttactaaagtaatatttatctttatacaaaccaaccatcgtttacatgcaatctacaaaaaaaaaattgaagattggcatatgtatttttggacagagaatgggagtagggaattgaaagtgatgctactggttcgtgtatttgagaagaaaatatattttaaaatcaaaccttctaaggttggcaagtagttcaaattcatttttagttcattcattaaaagggagaaagtggaaagaaaaatcaaatctgcatgggaagaagcacaaagyagctacatccacatggctgttcccaagcctgtccacagggataatgactgaatgttagggatgatagttttgctggtactaatgttattttttcaggctgtgtggcaatactgtgaactggatccactagaagtgtctgtggtttgacgtatcctttgttaatgttccactcctaggcgtgtgctctccaaagcgcatcctataatttatttttaagtgaaaaatgtcagctgtagaaatgcatctccaagtcttttgggtatatacccagtaatgggatggctgggtcaaatggtactt

SEQ ID NO: 161881 - DNA, 601 bp, Human
ataaataagtaatgtgctttctgtaaaaagaaatcatgtattattaatctctacctttgtaggggcaagaggaggtcagaaaaagaaaaggccaaccaagttttcaataaaggggagaattaaaattagattttccaagactgtcacaaaatcactgaagaagctccagaccagaaacagtaaaaaaatttttaagaaataagcaacaatttaattagtttgttaaaaaaaaaaacaaagacccctcaaagaataggaagcaaagagcccccaaggatcagtactggggattgtctaaaayggcatttttaaaaaaatcttggagagaaagtgtacaagtaaaatctacacagttacaaatggccacgaaatcatacacatagtaaattgacaagattaaaaactctagcacaaattcatgatggcagtcacctctggagagaggaatggcaaaggaactagggagaaaaagagggacataagctttatctgagatgctctggttcgttcatttaaaattcatgaaatgttgacatttgttaataccaggtagacagtttaaatatggttgtcttattagtcactgcactgttttgcattt

SEQ ID NO: 161882 - DNA, 601 bp, Human
gaaaacacagggttatatagtattttaaaatgtgtatgtgtggaaaacatataatacaaactgaatttatgttgtgattgcaaagaaatttactatgtaaagaaaaatagaaactagaaggaaatatagtcaggcaaatattaactgtgattatattagtatggtaggtagtttcttcgctacttcccaaactttcttaaatgagcatattaaacattaatagcagtcactcagggacctatgagtattttctccaatttctctgcacttttctaaattaaaaaaaatacttttcacattrtctattatgaatatggattactttgatatcaggatttcttaagtaaaggatcgaaatgttaaaaggtctttgagaaaaattctgaacattataaatgaaggattctcaatgctgaaactaccaagctaataaataagtaatgtgctttctgtaaaaagaaatcatgtattattaatctctacctttgtaggggcaagaggaggtcagaaaaagaaaaggccaaccaagttttcaataaaggggagaattaaaattagattttccaagactgtcacaaaatcactgaagaagctccagacc

SEQ ID NO: 161883 - DNA, 601 bp, Human
aatttcactccattctaaatacaaaaaacactctgtgttcaaagatgttacacataacgaaataacagaaaaaaattaaagctaagggtagagcccaaatgcttaaaaaatgaaaacacagggttatatagtattttaaaatgtgtatgtgtggaaaacatataatacaaactgaatttatgttgtgattgcaaagaaatttactatgtaaagaaaaatagaaactagaaggaaatatagtcaggcaaatattaactgtgattatattagtatggtaggtagtttcttcgctacttcccaractttcttaaatgagcatattaaacattaatagcagtcactcagggacctatgagtattttctccaatttctctgcacttttctaaattaaaaaaaatacttttcacattgtctattatgaatatggattactttgatatcaggatttcttaagtaaaggatcgaaatgttaaaaggtctttgagaaaaattctgaacattataaatgaaggattctcaatgctgaaactaccaagctaataaataagtaatgtgctttctgtaaaaagaaatcatgtattattaatctctacctttgta

SEQ ID NO: 161884 - DNA, 601 bp, Human
actaatacaaatttaaatacctgcaaaaatatttaaagtaaagaagattaaaaaaagatttaagaacctatttcaataaagagtaaatgtctattgttgggaataagcaaggatttttctttcttttttattatttaaaaaatccctatgatggcaagaatgaggtgaaaccaaaacttagacatgcaggtgcacacgtgaccacattcataataggtagtaagggctttaaagtgcctgtagccatcctccaacaatttcactccattctaaatacaaaaaacactctgtgttcaaagaygttacacataacgaaataacagaaaaaaattaaagctaagggtagagcccaaatgcttaaaaaatgaaaacacagggttatatagtattttaaaatgtgtatgtgtggaaaacatataatacaaactgaatttatgttgtgattgcaaagaaatttactatgtaaagaaaaatagaaactagaaggaaatatagtcaggcaaatattaactgtgattatattagtatggtaggtagtttcttcgctacttcccaaactttcttaaatgagcatattaaacattaatagcagtcactcagg

SEQ ID NO: 161885 - DNA, 601 bp, Human
ctgatagcatttatcactggtttaaactaggtatagcagaacaatggcaccctggtagatctgtcttaggcctacaacaaatccaaattagattaaagcatcaaatatatttaaaaatcgaaccacaaaaaactggaagaacatgaataaaaatatttattgaatctttgaaagcacaaagactttctaatcttaaaagccatagataaatcacgaggaaaaggaccacatgtaaaatgaaaataaaaatatatgtacactaatacaaatttaaatacctgcaaaaatatttaaagtaaaraagattaaaaaaagatttaagaacctatttcaataaagagtaaatgtctattgttgggaataagcaaggatttttctttcttttttattatttaaaaaatccctatgatggcaagaatgaggtgaaaccaaaacttagacatgcaggtgcacacgtgaccacattcataataggtagtaagggctttaaagtgcctgtagccatcctccaacaatttcactccattctaaatacaaaaaacactctgtgttcaaagatgttacacataacgaaataacagaaaaaaattaaagctaaggg

SEQ ID NO: 161886 - DNA, 601 bp, Human
cttcaaaaggcgccattacgaaaattaaaaagacaagtcacaggctggaagaaaatatttccaatatctgataaagaacttgcattaaaaactacaaggaactcttacaactcaataagaagataacccaattttaaaagccggcaagacattagagtaaacatgttaccaaagaagatacatgaataggcacatgaaaagatgttcaacaccactaatcattaggaaaataaaaatgaaaaccacaggacatcatttcacatccactagaatggttataatgaaaaagaaagacagtaamatagttgtgagaatatggagaaactagaaccctcactcattgtttaatgggaatgtaaaatggtacagctaccttggaaaataattaggcagtttcttaaaaagttaaatataaacttggcatataatccagcaattctacacctaaatatccacccaagagaagaaatacatatggtcagacaaagacttgtatgtgaatgttaatagcaatattattcataatagccccatactggaaacaatcaaaatgtccatcagctggtgaatgtatgaacaaaatatgatatatccttacaat

SEQ ID NO: 161887 - DNA, 601 bp, Human
gactgataatttagacatcatcaaaattaaaaatgtttatacttcaaaaggcgccattacgaaaattaaaaagacaagtcacaggctggaagaaaatatttccaatatctgataaagaacttgcattaaaaactacaaggaactcttacaactcaataagaagataacccaattttaaaagccggcaagacattagagtaaacatgttaccaaagaagatacatgaataggcacatgaaaagatgttcaacaccactaatcattaggaaaataaaaatgaaaaccacaggacatcatttcrcatccactagaatggttataatgaaaaagaaagacagtaaaatagttgtgagaatatggagaaactagaaccctcactcattgtttaatgggaatgtaaaatggtacagctaccttggaaaataattaggcagtttcttaaaaagttaaatataaacttggcatataatccagcaattctacacctaaatatccacccaagagaagaaatacatatggtcagacaaagacttgtatgtgaatgttaatagcaatattattcataatagccccatactggaaacaatcaaaatgtccatca

SEQ ID NO: 161888 - DNA, 601 bp, Human
gacccagaaaggtcacaggccaagaaaaacaactgatatctagagaatcctgacagctgagtaacaatccaacaatcttggaaaatccaaaatatgtcccaaagcaatttatgacagggttatttaaaaatcacatttacgttgctgtctgcattgtttttcatagccttggcactcaaagtgtgacctgtggcccagcagcagccgcatcaccatcacccgggagtttgatggaaatgcagagactcaggccctgcccccaacctgccaaatcggaatctgctcttgaacaggatccccrggtgatttctatgaacattaaagtttgagaagcatgggtttacaccagtgctttacaccagactaaaagctggttcacagatttgtgagaactgttttgtgtccagtctgtgatgaggtaaacacagaaattaagagtaaacctttaggaacgtttttatcaatttcatggagtaatttaatataggctgaatataattcatcagtggggcttttatttgtatatttttgtatgacttttctagtaattcagttttattatatttttaaagtatcaattcacaagataagaaatgatttt

SEQ ID NO: 161889 - DNA, 601 bp, Human
cagtcacttgagaaggctttttattgtataggattatttgttggacagcaccccttgcaaccagatcaataaaacaaacttattagaatcaactgctgggacaggaaagcatttctgtgatacaaagccaatgcggttttgtgtgtgctttgttgtggggtcacagaaaagacactttggggagaattaagttgaagtttctggactcaatgtctctgtctaaactgctttcagtgattcaggacttttttttttgtctaggtatatctttgccttctcaaatgcttattgtctattaatrtaaaattaatttaattaattaaaaagcaaaaatcccaggtggccctcacatatcgatgaaataaatatttatagttgcacaactacataataaatcctagtttctcactatccttcatgataaaactagaactgcattctcagagaaaggtcccaacagaaacttggcttggaaggaattaagttaataaaccaaacttttagtggttggtatttaaaaggatgccacgtggaagaataactgcagaaatgggggaggtatctcagagatgaatgtcacctgggtatctggtctcacctt

SEQ ID NO: 161890 - DNA, 601 bp, Human
cataataaagagttttgaggcaagaaggcagaattcatgggcctcctttactcatgggcccactaaaggcgactcaaattgctactgcatgaaatcaggctcaccctgggtattggcagaggtacgttaagttttctcttcaacatacccttatctgaaaccacgctacgtgtactcttagacaagaagacgagccaggcatgagacaaagcgcacacaccttaaatcaataaaggatcctaactttcctgtaggagatagcaataaaaataacaataataataaggaccctggttggtgwtgggctttaccacctacaagccttattcaaatcacttaatctctaagtcttgtttccttatcctataaaattgggataataatacctgcctcagaggatgtggtaaggattaaatgtgataatacgtaacaaatgcttgccttactgggtgctcaaagagcagttgctagtatcatttaggagaggatgagagagtcaaatgttattctctgaggtttgggattccccatccccttggtagttaggtgcagagtttgtgctatgtgatatgagatctggtatatttgtaatttgcataac

SEQ ID NO: 161891 - DNA, 601 bp, Human
ctacaacacatttcatgtatttctctgcacacacctttgtttccttcagccatttcctatcccagaatatcttcttccagtttatctaaacaaaacagttcagcacataaaaaattataaacacttgggtatcattttgaaaaccatttcaacttcaacattattagcataaggtttagttttagaccttggtaattccaggagagagggtttaaattattagacctattccaagccaggatataaaaccctttctaaacaggtactcccccaagtatggtgaagggaagcataaattatstaagtcatcttacagcccagtcaagcaaagcatagttttttttgttaaagctgttttggctgttttggcacactaacaactagctttggaaattctatacctaagaagttaggcagaattatgaaaaagcaaagaaaaagcacacaaattagcaaaatatctggctacagcacatactaataaaacaacagaaatatatgaatagcagacagatcagattcagagagaaaatttagtaggaatggatatcaaatgtgttcaaagacgcaaagcctgcaaaatgagataactaggtctgtt

SEQ ID NO: 161892 - DNA, 601 bp, Human
cactcccattcacatgtggtttcctattttttaaaaactcttaaacaagctaggcataaataataatcagcactccaagtcctctcagccaggccaagttaccatccaactccatttcccctctccctatttgaggtctccttgttccatataaactgttaaatctttgatcctacaacacatttcatgtatttctctgcacacacctttgtttccttcagccatttcctatcccagaatatcttcttccagtttatctaaacaaaacagttcagcacataaaaaattataaacacttggktatcattttgaaaaccatttcaacttcaacattattagcataaggtttagttttagaccttggtaattccaggagagagggtttaaattattagacctattccaagccaggatataaaaccctttctaaacaggtactcccccaagtatggtgaagggaagcataaattatctaagtcatcttacagcccagtcaagcaaagcatagttttttttgttaaagctgttttggctgttttggcacactaacaactagctttggaaattctatacctaagaagttaggcagaattatgaaaaa

SEQ ID NO: 161893 - DNA, 601 bp, Human
ccttaggaggagagagtcttgtttatctctgaactcttatcttctatccccaacttcctggaatagaagacactcaatatatctttcttaaaccaaactgttaactaggtataaaaattgctcttgcttcccctgggccacacaactacacacattccttagatgagctcatgtgaagttaattagacaagttaattaattctccaactcagcaggttatcagaactgaatgtacccaactcatctaaatgcaaagataataaataggcttttgccttctacatttctaatgggggtttcygaaagaaactttccactagctctataactctaatgtctcccaaatagaagactctatgctaaaaggcctttccaaagtagtaatatacctaacctccacaaataccttttatctcaaagacaatttttctctacaccatcccaggggaaaatgcaacatctatgattttaattttttaccctcatagatcacatccatgcacaattcaactacttaatggggtaaggctgtaggtgagtgcaacaaacctcacgaacctcaaaggttagtgactgtctataccactggaatcctggtaaa

SEQ ID NO: 161894 - DNA, 601 bp, Human
tgttaatcccagctgctcattatcgaggactgtgcacaaccccctttcgcccagcatgagcttctaacgctctgattcacctccgcagagtcaccccactccacgtctataaacagagcagaaatctgtggagactatttggcattgtctgtattacccaagaacatgtctggttgtctcgcccttgaccctgcctttaaaagccttcttatccttcaagaccaaacttaaacactgcattttgggaaaagcctgtccagcttcatatatcaaaatgaacatcttcatcttctgagctccyatggtgtattgctgtacattgactatttgccagtcataccatttggccatggtccaaagagaagcatataggttataacctaccaaatggtaggttccttaggaggagagagtcttgtttatctctgaactcttatcttctatccccaacttcctggaatagaagacactcaatatatctttcttaaaccaaactgttaactaggtataaaaattgctcttgcttcccctgggccacacaactacacacattccttagatgagctcatgtgaagttaattagacaagttaattaattctc

SEQ ID NO: 161895 - DNA, 601 bp, Human
tctcacatactgttccttcacatcttgttcccttccttgtccctttcctgtgttttcttcttgatccaaggctaaactgtcccagccctgaaaatctgtgctcggttaaaaactgtcatgttaatcccagctgctcattatcgaggactgtgcacaaccccctttcgcccagcatgagcttctaacgctctgattcacctccgcagagtcaccccactccacgtctataaacagagcagaaatctgtggagactatttggcattgtctgtattacccaagaacatgtctggttgtctcgcmcttgaccctgcctttaaaagccttcttatccttcaagaccaaacttaaacactgcattttgggaaaagcctgtccagcttcatatatcaaaatgaacatcttcatcttctgagctcccatggtgtattgctgtacattgactatttgccagtcataccatttggccatggtccaaagagaagcatataggttataacctaccaaatggtaggttccttaggaggagagagtcttgtttatctctgaactcttatcttctatccccaacttcctggaatagaagacactcaatatatcttt

SEQ ID NO: 161896 - DNA, 601 bp, Human
taatttcaaaagattcatccagaccttggaaagtcttctaatgacaagtctgatttgagagaaatgttgagccctttaatacaggaaattccataattatgagctggttgtgcttcagtcgtttatgtataagatgagcactggaatctcctattttagaattggaaggaaacttatagaagaagaaaaagaaaatgagcatttatggagcatggtgctggctacaagggagacatgctgtctcacttaattctcacaacaattctctgaggaagacttttgcttcattttataaagaagraaactgaggctcaaagtaaagttaagaaatttgcccaaggttctacaaacagtaagtggcagaatgagaattcagcttttggtgtttctgattctaaaagctgtgctttccccactactttgccttcctcaaaatgacggtacaatgtacacaagggtaaatcaaaacacagagcggcaaagttattttctcaatgtcacagaacaaattagtggcagatggaacgacaatctacatctttcaaatcccagatcaggccctgttggttacttcatgcctcccctttggcctcatttttgc

SEQ ID NO: 161897 - DNA, 601 bp, Human
aattgaaagtaaagaccaccatcccctcccctcagttcccaaatgttacatatttgattgcttaccataacaatcataaaaatataaacagagtggacacatggaaataatggaattttggagttattcccaaacagtggccaatttcaaacaatacgtcaataagaatggattgaaaagaaagcaaagaactatgtaaatgcctaggtaggttcccgggagacagtaaaaggtaagtattgcattcacagtgacattcaacctttaaatagggtaacggtactgacactttatgcaaatrcagatggcttatgaaacaataaaaatgaagtcgcagctttatagtctattgttttggctcagggaacgggagaatcaagggtagtaaatgaacttatataatacttctcactcctttctctctactctgtgagtgtgagatgagccattttttttttccagatgttattgttaatttcaaaagattcatccagaccttggaaagtcttctaatgacaagtctgatttgagagaaatgttgagccctttaatacaggaaattccataattatgagctggttgtgcttcagtcgtttatgta

SEQ ID NO: 161898 - DNA, 601 bp, Human
tgtctttataatataatgatttatgttcctttgggtatatacccggtagtggtattgctgggtcaaatggtatttctgtaattaggtctttgaggaatcaccacactgtcttccacaatggttgaactaattacacttccaacaacagtgtataagtgttcctttttctccacaacctctgcagcatctgttattttttgactttttaatagcagctttaataggtgttagatggtatctcattgtggttttataaagcacaaagaaagaagaacctcagtttcaatgactttttttttcttttttttttttttgagacagaatctcattgtgtcgccctagctagagttcagtggtgggatcacagctcactatatcctcaacctcctgggctcaagcaatcctcccacctcagcctcccaaatagctgagactacaggcacatgtcaccatgcctgcctatttttttattttttgtagagatggggtctccctatgttgcccaggctggtcttgaagtcctgggctcaagcgatcctcccacctcagcctcccaaagtgcagggattacaggcgtgagccactggctggcctgatgaca

SEQ ID NO: 161899 - DNA, 601 bp, Human
atcatgaaccattcagacgccctcgtggcctttcagctggcctgagccaggatggcttcagctaggttaggaagagaaggttgtttccatagtgcaggaagggcagagcgtgtagaaagatgtctgatagaagcttgttttgccattagacttgctcctcccacacttcttattttgggaaagggcatcaccacagcccacatcacagggccacagactcagggcagcggggattacagagtatccctcacacccccacctaatcacccgcaaactttgtcaaatttaccacctcaacagyttctttattgcccctcctctgaaattcaattgctactgctttagtgtagaccctcatttccctttgccctgctggagtgaacctaacttcagttagaccctaaaacgctctgtgaaatgctccctacttggcttcctctctggcctcttccctaaatgccttccccctccattgacactgagtgaactgcagttcctcaactcacggtgctgtttctcttccacacgtctttgcaaatgccatctcctctacctggaatgcctttcctctccctatttttccaccaaattcctccacttg

SEQ ID NO: 161900 - DNA, 601 bp, Human
tggatcctttggcaggggctggattatgcaggacatctcgggatatgatgaggagtctggatctggctcaaagctcaataaaaagccactgaaaataaaagccactgttatttgagaagtgtgctcctttaagggctcaggagttgaaatggaaagggtttcagggaggctactgaaggatttgaggtgaaagttggcgagagtggtggcatagaaagggtggaaggccagcaggtaggggacgtccttgggccaaagaaccaacagcacgtgtggatggatcagatgggaagcgtgaggraaaccggaaggctcccgggcttctggcttccatcactgaataaatggtcatttgctgaaacggggaaactagggaagattaggctgtaaatactaataatccgttaacaagttcttcccattctcacaataaggtacctggtgtagaacaggtaacttgaattagtgaggctgtccctaaataaaatcatattatctgtaaatcttaatgctatcaaaatgaacaaaaacaaaacctgtgtataatgtaattataccctgacttgtgtgtttttgcttttttataaatttcttttccttc

SEQ ID NO: 161901 - DNA, 601 bp, Human
gtgaccagagctttgagtgcaaaggggaaggggcatgccatgaggttggatcctttggcaggggctggattatgcaggacatctcgggatatgatgaggagtctggatctggctcaaagctcaataaaaagccactgaaaataaaagccactgttatttgagaagtgtgctcctttaagggctcaggagttgaaatggaaagggtttcagggaggctactgaaggatttgaggtgaaagttggcgagagtggtggcatagaaagggtggaaggccagcaggtaggggacgtccttgggccraagaaccaacagcacgtgtggatggatcagatgggaagcgtgagggaaaccggaaggctcccgggcttctggcttccatcactgaataaatggtcatttgctgaaacggggaaactagggaagattaggctgtaaatactaataatccgttaacaagttcttcccattctcacaataaggtacctggtgtagaacaggtaacttgaattagtgaggctgtccctaaataaaatcatattatctgtaaatcttaatgctatcaaaatgaacaaaaacaaaacctgtgtataatgtaattat

SEQ ID NO: 161902 - DNA, 601 bp, Human
gttttatgaaaatcactggctgtgctaatgaaactactgggatgctttcattattttcttctttctttaagtagctcataggacatcgcagacatgctatttactaaggaaaaaaggacaacttttcattacagtaccagcaagagtcaacattctggatcgtaacaatgttttggcaatagctgaatcttatctgctggcatccctctatcctgtgtgttctctcttgctttctttttcttgcatctccactccaacccctcccttggaatttcaactccatctgctccccatcactacrtgctcttcctccctctcctctgctatctgcaatgaaccacctctgttcaatggtgttgcagaaacagcactgctctgatgcccatgctgtaagatcaaccttctgaagaattccaaaaacaaaactccatgccagtcatatatgtaaagaagactaccatatccaagctatggcagcactggagagacagacaggatggtccaaatgccgagtccccagttccccagctccctccctccatgccagtgttatgtcccactcacaggatgcaagataattttagattttagtagtcacata

SEQ ID NO: 161903 - DNA, 601 bp, Human
tttacatataggcagaactagctgtcttgttgatcatgatttctggccaacagaaaatatagacaaggcaattctccactggctgtatactccaggtctgaagacagaataagctcctttatgaacccatttgcccacagcccctcacatctgacccaaggactggaaacaccagcaaggagcaagagccacaacctggtggcagaatctcttagaaaaaacaacaacaacaacaacaacaacaaccaaacatgaagaatttcactctcaaaatagcaatataactgccattgtgattcartgggttttcaaaacttttcttataaaaaacattttttttcttggatgttgaatagcagagttagaaagaaacaggaagcaaatgctggaaagatccagatttatgaaacgaatagcaaagctaaagagaaggcagttcattatccccacccccccaattccattagcaccctaacctctgacaatgggtcactgatgggcagctgaggcagttaaaagtctagctctctggtcactgtcaacaagttcatgggtattagctaactttgtaatcccaagatgaacaaattcttcaaaactc

SEQ ID NO: 161904 - DNA, 601 bp, Human
acaagtattttttgttttcccaccttccatgtttcctaatgtagaggagagtgcattaacttttgcgggttttagcacatatgcagcaaagtataaagatacgtttaaaaggccattattcacggcctcatttttatctccagattggtagtaataatcagagttattcaaaaaatcttgcaaatcaaaatgcaatacatttctacaatgaaactacctttaagagttgtactgagtgatttagttaaaacggaatttattgaaggtcactcagactacacgagacagctaatgtttttgmgcaaatgaagtggaaatgttcacttcacattctggagaagtgccttgcacagtaaaaattaaacaactcagaaaattaggccaagaagtgagagagattgttaggtgagtgagtgtgtagtttcagctgcagacttaccttgctggcacagtggccaccagaagccacttttgtaaatgtcagtgagatcatgtctttccccagctcaacgtgcaagtgtgtactacgtcctggggagttcgacatgacttctctgatcttttacccattttccaccctcctatctctcccaccacactg

SEQ ID NO: 161905 - DNA, 601 bp, Human
cagctataaatctcaatcttttccttcttaaatgtatgaaaatttaataattgttatttaaatcccttcaacttgttaatttacatttcaaaatgtcctccaattatatgtatttataaaacacttttccgtaacatttcttttttttttagtttttggaaagagggacattttaggaaggaagtgagaattctgcaagaggaagatctcatggaaagcaactcgaataatggcattctcagatctgagagcgtgagggttagcatcttgtgaatttgctaaagccaatttgatggaattsgtttttcttgaaaaaattctatgaaaagtactcaattccttcccctccaagtctaaaggaagctacctttaaaaagccactcaaagcaatggcaaaggtaccaggacattttcacaagggcacagaaccccatggttatactcatcatctttctagggaacatattcagtgattacgggccagacttcctgggttccctctattggccatctagacaccagccgatgcccagagttatgccatttccacagtgagacactgtaaccggaaaagagcaaggacgtcgaaaaagtgaacccg

SEQ ID NO: 161906 - DNA, 601 bp, Human
tggatttaaaagctacacttttaaaaaggtcctgtgcatcatgcagtgctattataattgctaaaggctgggctggcgataatctaaatcccaaaatattagtggttaattaggaatccaacggacttcttccagaaataaaacttaatcccttaattacgctttttatttcttaatttcctcccatagtaacctatgcaaatatggacttggtttccaaagaaaaatgttcatgtgttctttcagcatgcgtactctacagtcattggaaagatcaacaaagaaggtgggcatgaactctttccttttttctcaaatcacagctataaatctcaatcttttccttcttaaatgtatgaaaatttaataattgttatttaaatcccttcaacttgttaatttacatttcaaaatgtcctccaattatatgtatttataaaacacttttccgtaacatttcttttttttttagtttttggaaagagggacattttaggaaggaagtgagaattctgcaagaggaagatctcatggaaagcaactcgaataatggcattctcagatctgagagcgtgagggttagcatcttgtgaatttgcta

SEQ ID NO: 161907 - DNA, 601 bp, Human
gccagcttttatccatgctgcatccgccgcccgatcacaacttgaaaatggagtctgaattcttatccatgctgcatccgccgcccgatcacaacttgaaaatggagtctgaattcttatccatgctgcatccgccgcccgatcacaacttgaaaatggagtctgaattcttatccatgctgcatccgccgcccgatcacaacttgaaaatggagtctgaattcttatccatgctgcatccgccgcccgatcacaacttgaaaatggagtctgaattcttatccatgctgcatccgccgcgtcacaacttgaaaatggagtctgaattcttatccatgctgcatccgccgcctcatcacaacttgaaaatggagtctgaattcttatccatgctgcatccgccgcctgatcacaacttgaaaatggagtctgaattcttatccatgctgcatccgccgcctgatcacaacttgaaaatggagtctgaattcttattcatgctgcatccgccgcccgatcacaacttgaaaatggagtctgaattctggaactggaaagaacccccacatagcatcttgttcaaccccctcatttgaaagct

SEQ ID NO: 161908 - DNA, 601 bp, Human
agatctcttccttccttattcgccacctgtcctttgtttctgctccttcccatccttcagtctcatctgttctcccagagcattcttcccatgcctaagccccttcatcctagggctcctctggcagaatgggaggaaagagtgtggagggcagatggatggagcttggtgtctgttctgggacaggcatcaccatctattacttggctatctagaagctccatccaagattgtggacttgacaagagaaacctgatcctgacagttaacctgatcctgactgcctagatactaatacaaygagagaaaaaaactaaaaactgtggcagctgtttaaaagtaacatgtgacacactaatgatcatgaatgccactgagcctgtgagcttaactttgattgtacaaactcaacccagtgtaaaatgtatcactaaaaactaaacaagctgactcttcatgttgacaaaaacgtcagccatactattttatagtcacatcacgtacgccagcttttatccatgctgcatccgccgcccgatcacaacttgaaaatggagtctgaattcttatccatgctgcatccgccgcccgatcacaactt

SEQ ID NO: 161909 - DNA, 601 bp, Human
tgctggggagtagctgtcccatggtagctgtccatgaccccactggcttcttgctgtgaccttaagaagagtcacaaatggcagatctcttccttccttattcgccacctgtcctttgtttctgctccttcccatccttcagtctcatctgttctcccagagcattcttcccatgcctaagccccttcatcctagggctcctctggcagaatgggaggaaagagtgtggagggcagatggatggagcttggtgtctgttctgggacaggcatcaccatctattacttggctatctagaagstccatccaagattgtggacttgacaagagaaacctgatcctgacagttaacctgatcctgactgcctagatactaatacaatgagagaaaaaaactaaaaactgtggcagctgtttaaaagtaacatgtgacacactaatgatcatgaatgccactgagcctgtgagcttaactttgattgtacaaactcaacccagtgtaaaatgtatcactaaaaactaaacaagctgactcttcatgttgacaaaaacgtcagccatactattttatagtcacatcacgtacgccagcttttatcca

SEQ ID NO: 161910 - DNA, 601 bp, Human
aagaggcccatcatttataaagtgaggctaaacccaagtctccaactggcaggggtttttagggtgggtgtggggagtttccacctaggtacatgcctttgaaagccagcaggtcaggaaatatgtcatagtgcacacctccctgagttcacacagattaagataaaatgggactaggccaaattgttacatttgaaagagcttaaacgacttcaaattccccttaatatgtccccttctcagtgacacacccttttgccttcaggtgtctagtgcctttcccctttcctaaaccaccttrtttctcagtggcatggcttcgtaacaaataaaagcaagagttctatctattaccaggctgtggtggaaagttcccgacagcaaaggccagaataaggtgtttgaataggattgactcacactctgaaactcattcatatgaatttattatttctccaagttcttcccactctgtgttcatctccttttaattgaatttgaggcatcccaagttaagagggaatttgagaacggtcactttctcagtttctataaatcaggctgtgtcaaatgccagccatgaaagcaaaccaggtgggga

SEQ ID NO: 161911 - DNA, 601 bp, Human
aatgctttatgtgtacccaatcatctaatccttataatgcaggtaggactgtgggcctgattctatacctctggtgcccaggtacgcctcttgcattacactgaggccttcagaaaactgacatgaatcaaacctgaaataagagcaaagaggcccatcatttataaagtgaggctaaacccaagtctccaactggcaggggtttttagggtgggtgtggggagtttccacctaggtacatgcctttgaaagccagcaggtcaggaaatatgtcatagtgcacacctccctgagttcacayagattaagataaaatgggactaggccaaattgttacatttgaaagagcttaaacgacttcaaattccccttaatatgtccccttctcagtgacacacccttttgccttcaggtgtctagtgcctttcccctttcctaaaccaccttgtttctcagtggcatggcttcgtaacaaataaaagcaagagttctatctattaccaggctgtggtggaaagttcccgacagcaaaggccagaataaggtgtttgaataggattgactcacactctgaaactcattcatatgaatttattatttc

SEQ ID NO: 161912 - DNA, 601 bp, Human
aagtctggtgcatcctgccccaatgggagacaacactgaaggcccctccgattccccaattccttctggggccagtggaggctgttgatgggctgcaccccagcttgccttctctgcacgctcttgcctcttcctcttctcttctgcaggtgttgatcccaaggacatcctctaataaacatcctgaatgctatggaggccaaagctggggttagccctcagggcttgacaccactggttcccatcaaggaagcagtaaaattcccttaggacaaatatggccatttccttcaaggagagrttttcaatagcctgacccacacactgacaaatgtcaacagatacggcaccagcagaagaagagaaaaaaatgacagcttccttcttaggctagaagtaaactcagggcacagggaatctgcatggcctcctctctgagaccagcagagctttctgcactgaccttgggaaaggagacatttgagccaggcctcctgggagtattacaatggccaggctgacaccgttaaaactgggaaaggcttacaacccccaataagaacatttattctacaggctaagtactctcttcatttataag

SEQ ID NO: 161913 - DNA, 601 bp, Human
ccatctgatatgtaaatatgtcttaatcctcatgtagtttgaagctctcttaaaatccttaaatatcagactgtgcactttggaacttgaattttaatctagaacactgcacttttaaagaagtcttaacaattattaaatccagcagctgtcaaatctatttttttttttttcagatgaagtctcgttctatcgcccaggctggagtgcagtggcgtgatctcagctcactggaacctccacgtcctggcttccagtgattctcctgcttcagcctcctgagtagctgggattacaggcrcccgccacgacgcctggcaaatttttgtatttttagtagagacagggtttcaccatgttggccaggctggtcttgaactcctgacctgactgaagcaaactgcccgcctcggcctcccaaagtgctgggattagaggtgtgagctactgcgcccagccaaatctattttttaaacaatagaacccctgatttaattgatacctgacatggaagtctaacactcacagcagataaagtgaaattgctatgcctagaatgtgtgtgggagtgtggggggacaagagccctttccactcagct

SEQ ID NO: 161914 - DNA, 601 bp, Human
aaacctacaggctaataagtaaaggaagaaaaaactgaaaattggaaaccatttggagtaaatgacctccaggacacagcagcctgaagtttttcacttcgttaggcagcagtgccacaccaagggtggctgggggcggggaaccgttgtggtggtatgtcactttgtacagagggtaaggggtggctgtagaataacttgaagaccttcaggactcaagctaaggggacataaagggacacagaaggaaccacaaacaccttccattttaaatctgccctggccaagacatctggcgaaraggaggaggaaatctcactcttttctccccttttgaatcacttggcccttattctcaggacccagaaatcacattatatcaaagcaaatatattatggattaaataggcgtttgcaggtcgtctagcctgtcaacaggcttctcctaacctgtcacgaacatggttgtgtacaaccaggagttaggagttgtgaggctcaaactagggaaaggacatctttatgactcctaggagtcgaagagagagaacacaacaatataaaaagacaaccctacaggcaatattacaaatgccacagg

SEQ ID NO: 161915 - DNA, 601 bp, Human
gaatgttgggggtaaaaaaaattacaaatcaagtttgggttactggcagtccctgatttacagatggcacctgcacatataataataatttttctaatttatttttttgctgaagaagcacctttgttaaaaatacacatttatataacttataattttaatgaaaacctacaggctaataagtaaaggaagaaaaaactgaaaattggaaaccatttggagtaaatgacctccaggacacagcagcctgaagtttttcacttcgttaggcagcagtgccacaccaagggtggctgggggsggggaaccgttgtggtggtatgtcactttgtacagagggtaaggggtggctgtagaataacttgaagaccttcaggactcaagctaaggggacataaagggacacagaaggaaccacaaacaccttccattttaaatctgccctggccaagacatctggcgaaaaggaggaggaaatctcactcttttctccccttttgaatcacttggcccttattctcaggacccagaaatcacattatatcaaagcaaatatattatggattaaataggcgtttgcaggtcgtctagcctgtcaaca

SEQ ID NO: 161916 - DNA, 601 bp, Human
atggtgaatgttgggggtaaaaaaaattacaaatcaagtttgggttactggcagtccctgatttacagatggcacctgcacatataataataatttttctaatttatttttttgctgaagaagcacctttgttaaaaatacacatttatataacttataattttaatgaaaacctacaggctaataagtaaaggaagaaaaaactgaaaattggaaaccatttggagtaaatgacctccaggacacagcagcctgaagtttttcacttcgttaggcagcagtgccacaccaagggtggctgggggcggggaaccgttgtggtggtatgtcactttgtacagagggtaaggggtggctgtagaataacttgaagaccttcaggactcaagctaaggggacataaagggacacagaaggaaccacaaacaccttccattttaaatctgccctggccaagacatctggcgaaaaggaggaggaaatctcactcttttctccccttttgaatcacttggcccttattctcaggacccagaaatcacattatatcaaagcaaatatattatggattaaataggcgtttgcaggtcgtctagcctgt

SEQ ID NO: 161917 - DNA, 601 bp, Human
tgtgagggctgggatgggatattctgcagataactggaagggctcttaccggttgctctgatgggacacatctcaggggcgacagtgacccctggagaccagcatcggccggcatcacagcagcactgcattttggttatggactgtggcagctggttagagcagcgcccgtttgtcagagctgtgtaacagtatcctgggcgaacatctgaggacaaagaaacacatacacacacacacatcgctgagataatacttgtaacaacactcccctgcccgagcagctccatacttcacactkgggctacggcaggattaactcacacctctgccccccggaagggaagctgcgagcgctgcacaggaacagtgctcagtcagaaatccctggtctcacaccttttgcccctgtgtgctagtgcacttggctgaagtcccacattccatacccaaggtgggaacgagtgattaaaaccatgtgtgccataggaaaagagagactaagaaaatcactagcagtgacagtttattatttataaagacatgtctctatgctgaagagagactgggttgtccctggtttcaaactgcttaattcgag

SEQ ID NO: 161918 - DNA, 601 bp, Human
gagttcatcctggggaaatatttttggacatctttctcgactaacgaaagtgtgctgtatttatgtatttgtttagttatgtatttttaaactaatgaataaaaattgtatgcattcattgtgtacaacatggtgttttgaaataggctcaattagtcaaaaggtgtctcctttttctcccctagacacaattttttaaactgaacttcactgactcatactttgggaaaggtacatggcaatggtggatttcagagactagttaggagactactggaacagtccagactagagaaaataygcttctaatagaaacaaaaaaatggacagataaaagagatactgtgaaggaaaaaaaaaacaagcaggacttagcaggaaggaaagagtccaatgttaggaaaaaggaaatgtgtctcctgaacaacttacctgaaaaattctgaaagctgagttttactctactgagcttttgagtactccatgagagccattaagtactaaaatgagaataagtacttccccaaaaggtttctgtttagtagtaataagccagctaagtaaaaagcagtacctgaaaacagtactctttgtacagacc

SEQ ID NO: 161919 - DNA, 601 bp, Human
agccagaaccacaggagcacaaggaagaagggagcacttccagctgcaggtacctcgggatattcatggattaggtcatgtttgagcagatccttaacaagaaaagaggatatataacaggcaaggatggcaggagtagggagaaagagcctgaactggcaagaagttttagaaaaaaaagccaacttgaattcagaaatgctcggattgggtgcaatgaaaactcaatcatataatttaaactactataaagaacaagaattaaaaagatgaactgggattagatttgggactctaaatrctgtgctaagtagcaaatgttctttgcaagaaatggagtgaattggccactaaatattgcctgagttcatcctggggaaatatttttggacatctttctcgactaacgaaagtgtgctgtatttatgtatttgtttagttatgtatttttaaactaatgaataaaaattgtatgcattcattgtgtacaacatggtgttttgaaataggctcaattagtcaaaaggtgtctcctttttctcccctagacacaattttttaaactgaacttcactgactcatactttgggaaaggtacatg

SEQ ID NO: 161920 - DNA, 601 bp, Human
aaatttcttcattcatatttgacatttccatctcaggtcaagtttatgttttcagataattctcttacagcattttaattacgatttcactggaatttcaaattacagagatactgacgtacttgaatgtatttgtaaaggaattctatgttgttcatgcttccctgactcaagatgtctcaatcctgtttgtcaaccaacagtgattcttcctatagatttatcatctgtacgtgccatatccaccattccctgggaacctgctctcaccaaattcccaccactaagactgtgtagtctktgaagtcagggatcatctctaactcatgactagttcccactctcagccttgccctgcaaattgcacataacaggaattcattaactatgtgttaattttattaaatgacagttacattaaggaactcactttgcttccaagcatttgtaggtaccaattcggcctttctttttaagactttttgaatttatataaaagaaatttaatagcttatcagcatttctgctaattaggtgggtattttactttaagaatgccattaaattcatcttaacctctctaggaaactgtatcagactg

SEQ ID NO: 161921 - DNA, 601 bp, Human
atgttcctcccaaaacctcagagtctttatctgtatcaaaattcacctcatggaaaacataaaagtactactttctccatccagtcccacctgtggattccacagggctctacagaatacattaaaaaatttgaattttattttatgcgcagtgcaaaaccactggatgtcttcaacgggggtgggacatgatcagatgaccattttcagaagatcatgcttacaattacaacatatgaagaacattactgcggggaggcaaggctgttgcagaagaccaagggggagatgatgatgtccrgatgggggagtcagtgattgaatcggacagaagtggacaaatctgaagcacattttagagataaatgtgtagtgttcagtgaagtagatttttgagataaatgtatagtgctcagtgaagtagtaagtgtcagagctcaggacacaagaagtcaagaatgactcctagttttctggttgagcaattgggtgaatgttggtgcccttgcctggacgggaaaaatcatggtgatagcagatttggtgggtagaaaccaagttccattttgaacataggagttttgagatatcagacatccaa

SEQ ID NO: 161922 - DNA, 601 bp, Human
cagcttaaatgcctcatcagcaatttaaactttctttcttccatttaaaataactagtctaagagagttggtaagctacacatttagactagtataatgtgcaaaattccataatttggggatatttttaacgctttcttttaatggtagggcttttggtagggtgtcttaaattggagttaccagaaatgatttgagtatcttttacaatgaaagttaaaagtaactttaataggcagaataatgacctcccaaatatgctcatgtcttaattcccagaacctatggatatgtttagctagcaaaggagaattaaagttgtagatggaattaaggtagctaatcagtgatcttgagatggagagtctcctggattatacaggtggccaaatgcagtcacaaatatccttaaatgtggaagagggaattgcaagagagagccagagagagacaaagagatttgaagatgcaacactgctggctttgaaaatggaggaaggggtcatgagctaaggacacaggcagctgctagtagctgaaaaaggcaaagagatggattcctcccaagagccaccaaaaggaagacagccctcccaacacc

SEQ ID NO: 161923 - DNA, 601 bp, Human
gacaaatcataaatttataattataaaagtagaattcataacagaactaagaggtgaacttattttaaaaacaagttgataggagctgagtgttcttatccaatccaaaaattgattattctttcattacatttcctcccttcaccagcttaaatgcctcatcagcaatttaaactttctttcttccatttaaaataactagtctaagagagttggtaagctacacatttagactagtataatgtgcaaaattccataatttggggatatttttaacgctttcttttaatggtagggcttytggtagggtgtcttaaattggagttaccagaaatgatttgagtatcttttacaatgaaagttaaaagtaactttaataggcagaataatgacctcccaaatatgctcatgtcttaattcccagaacctatggatatgtttagctagcaaaggagaattaaagttgtagatggaattaaggtagctaatcagtgatcttgagatggagagtctcctggattatacaggtggccaaatgcagtcacaaatatccttaaatgtggaagagggaattgcaagagagagccagagagagacaaag

SEQ ID NO: 161924 - DNA, 601 bp, Human
ttatttaaactccatggaactcctttgaagccaacccccagttagcatatatgtcccacattccacgtcaggagccaggaccatacctcggcattctgtccgcgtgagtgtgctctgatatccagctcggcactgacaggtgtacgaaccctggttgttaatacactcaccaccagcacaggggtttttctcacattcatcaacatctgcaaagcacaatgtattttagtgcaaaattacatagcaatacctcataattctaagactttctgggttccttttatacatataaaacattttycttttgagaaataaataacataataaaaggatcttttttctttccactacaatatgtcattagccatttgaagactggttgagcagttaaagtgtattattttcatgtgtcattttgcagagaaaaattccaaacatgtagcaactcaacaatctgatctaataaacattttttcttccttgagtctgatctaagaggaccaaacagactaacatttcagaagtggcttctggataggattccgagtatctcttgaagctctgtttttttccaataaaaagaaggtctaaccatatccaa

SEQ ID NO: 161925 - DNA, 601 bp, Human
aagcagcaagggcttagagtgacatccctatcttttagaactttccattaagaaattaattgcacataatttcaactgaaattttcctcagttgctgtgtcataaaggacaattccactctctacttctcagatgaaaacttaagaggcaataatagtgacgagacaacaatactgaaaataagattttccttcaggcatagacgcatcttataaaataacttcaatgcttgccagattttatgacactgtctttcagaatgacaataggtggaactaagttcaaaaaagccacgggactrtattagtctcttccggcatgggttatttaaactccatggaactcctttgaagccaacccccagttagcatatatgtcccacattccacgtcaggagccaggaccatacctcggcattctgtccgcgtgagtgtgctctgatatccagctcggcactgacaggtgtacgaaccctggttgttaatacactcaccaccagcacaggggtttttctcacattcatcaacatctgcaaagcacaatgtattttagtgcaaaattacatagcaatacctcataattctaagactttctgggttcc

SEQ ID NO: 161926 - DNA, 601 bp, Human
gagtattctaccaaccaaataaaatattgattctatgagggtatttttcctttttttctattgtggttaatattatgccaaggtacacaacagagcttgacacggaagtgttaaaataacaataactgaaacaacctgtatctgatttctcccttaaatattaacaatctacccaaagtggatagcatggttccctggattatctgtttctctcagtttctagaagctacaaacctggataaacatcaaagaggatgaacacaaacctctttgtctacacaggcacacaatcacttccagrgcttattcccagaagacagggaccaagaaactatgtggagttggatgcgagcattcctatctatgcagagttgaggtcacatttgtctgagtataagtgccctaaatatcccctgaacaatgagcacgtgcgttcatggcatgtcagttactctgactgtttaccctgtgtctgtgtggtgtcttgtggttggccctcagatgcactttctttctgggcagatcctgcagtggtttccacacaagtcattggacgagctgaggcagtctgggcttttcttctgtctgatctttgtgccaa

SEQ ID NO: 161927 - DNA, 601 bp, Human
atatatatattagacatatataatgtattttaaatatatattatttatattttagatatatattatttatatttaaatatgtattttatgaatattatctattacatattcagaaatacatatatacataatatatatacacatattacatatatagaaaatatacataacatgtatttttacattatatctattttagatatatatttcagatactgattagtagcattttattactaggcagacactttaaacaaaaagattataaacggctagataatacacagacttaggtgtgtcytatttttaaaaaatgtacaaattctgattgtaaaaaattagaaagtatgaaattgtgccacagaagtttcatcacaccagggatctttaaatggcaagctctcctagcatattaaaatgttatttgattcacacaaatgtaaattaagaaatgaatatcatggaaaattaggcttccttttgagataaaatatataaaacatatttgatactttgacatttcactcattatttggtcttgttaaagacccctgatattgaaactgcaatggaaggagaggactaacattagtatactatt

SEQ ID NO: 161928 - DNA, 601 bp, Human
gttattttatttgatattaaagctgtcttgggaggcacttgctcttttagacacagtgttttcacttacaggctttagaaagaccaaagtgatttattatatatacatattttagatatatataatatatatattagacatatataatgtattttaaatatatattatttatattttagatatatattatttatatttaaatatgtattttatgaatattatctattacatattcagaaatacatatatacataatatatatacacatattacatatatagaaaatatacataacatgtatttttacattatatctattttagatatatatttcagatactgattagtagcattttattactaggcagacactttaaacaaaaagattataaacggctagataatacacagacttaggtgtgtcctatttttaaaaaatgtacaaattctgattgtaaaaaattagaaagtatgaaattgtgccacagaagtttcatcacaccagggatctttaaatggcaagctctcctagcatattaaaatgttatttgattcacacaaatgtaaattaagaaatgaatatcatggaaaattaggcttc

SEQ ID NO: 161929 - DNA, 601 bp, Human
tcactatgttattttatttgatattaaagctgtcttgggaggcacttgctcttttagacacagtgttttcacttacaggctttagaaagaccaaagtgatttattatatatacatattttagatatatataatatatatattagacatatataatgtattttaaatatatattatttatattttagatatatattatttatatttaaatatgtattttatgaatattatctattacatattcagaaatacatatatacataatatatatacacatattacatatatagaaaatatacatarcatgtatttttacattatatctattttagatatatatttcagatactgattagtagcattttattactaggcagacactttaaacaaaaagattataaacggctagataatacacagacttaggtgtgtcctatttttaaaaaatgtacaaattctgattgtaaaaaattagaaagtatgaaattgtgccacagaagtttcatcacaccagggatctttaaatggcaagctctcctagcatattaaaatgttatttgattcacacaaatgtaaattaagaaatgaatatcatggaaaatt

SEQ ID NO: 161930 - DNA, 601 bp, Human
agaagaggcaccataggactttattctgctttcctctaccttgaatagcttgaccctctacacttctgcatctgaaactatgcccagaagctctaagtgcagcattttagcagattttctggacctgctttgagtatgaggttctttaagaagtctggttccaactcagatcctggaccaagtgcagtaatcactgatccctacataagacaggagacactaagcacaaatttgtctccagtaacttttcttaggaccccaattctcaacagcaaaaataaaaatcctcatttttgcttcratacctggggcaatgagattatttcaaaatggtttaccaaactaaaaaaatggttcttggttgtttatttattctgcttaatcctgtttcccttcttgcttatgtaacttgataaagccgaaataaattatccttaaaaaaaatttctgtgtcttaagatgcctagaggaaattatgaggaagagatcattgcaaataacagtctacactattctgtccaggtaaagatgtaagaggtggcaaataacagccaccaagaagcctaaccaccattattccctaactggaaagaagaggtag

SEQ ID NO: 161931 - DNA, 601 bp, Human
agtgagactgtgtcttagaaaaaaaaagaaaaagaaaaaagcaaatgattttataacaactccttttataatatacaactagtgtatgggactattaactttctcctgaccttaaaaaggcaaattgagagtaaaacaccttcgtgttttacttagcttgtgttgtttggcacaaaatatattcgggtggtccaaggttctgtgtacagattgtatttgaaacagcagttatatttaaatacaggaactcaaattggttagttattctggtcaactttttattcaaattgtgacacacagyaaaacgtggagactacaacctgaaaggtaacacaaagggtttttaataagaacggagatgtaaggtagatccaaagggaggtaaccttggtcaaagttagtggcttcaactttcagagagtgaacagagaagccatgttgttgatcagatgagttaactgtggagactgaattagcattgatgattcagctttgaacagtcacatctttgtgggctcagaactaagtgctcagggctaggagaaaatcttaccctatggcataaagacaaaaattataaaaaggaagaaatccagtatac

SEQ ID NO: 161932 - DNA, 601 bp, Human
ttatggtattttatgtgtatacttaaggaggtctggtaaaagactttatcggacacatattaataatagcagagggttttttccccccttaatatggggaagtacaaaaggcaccaaaattgtggtttggaaaacatacaacacttagaagtaaatgattttaggccaggtgcagtggctcacacttgtgatcccagcactttgggaggctaaggtgggcagatcacttgaggccaggagttcaagatcagcctggccaacatggggaaactccatctctactaaaaatacaaaaatcagytgggcatgatggcatgcggctataatcccagcaacttgggaggctgaggcgcaagaattacttgaacccaggaagcagaggttgcagtgagctgagattgtgccactgcactccatccagcctgggagacagagtgagactgtgtcttagaaaaaaaaagaaaaagaaaaaagcaaatgattttataacaactccttttataatatacaactagtgtatgggactattaactttctcctgaccttaaaaaggcaaattgagagtaaaacaccttcgtgttttacttagcttgtgttgttt

SEQ ID NO: 161933 - DNA, 601 bp, Human
tcttatctgctacagtagagagcgtttgttaccattgggctttattgagtgacagaggctgaacctctctcataaggttagccatgatgttttcttaccaacacacacacggccatccagacccacagccagtccagggaagcattcacatctgtaggagccatcagtgttgacgcaacgcccattcatgcagatcccaggggtttcacactcgttaatgtctgtggcagagaaaggcacttattaaaaatgaagtgacatttatctaaaattataacatgttgacaattatgttttaacmcttgaaaatggggaagataggaaataatatgcagcatcagcaacaaaagctcaaatggcattctcattttcctttgaaagaacagtaacaaaatcaagagaaatcaactgttggaacttattttccataaaaagtaactttaatatattctcccaagagatttttgtatccaaaataatcacaaaggcaaaaacagaatcagaggaaggagaacaatggctgctaaaagacaaagggttttgtgaaatgtataaccagggtagctcttccagggctctcagaaatctagggtaatagtaa

SEQ ID NO: 161934 - DNA, 601 bp, Human
ggtggggattcccttgcttttcacttagctcatctttctaatcctcaaattaatgttcaatttacacaaaaagagaactgaccctgttggtttgttgctctgcaaatattctttatatcttatctgctacagtagagagcgtttgttaccattgggctttattgagtgacagaggctgaacctctctcataaggttagccatgatgttttcttaccaacacacacacggccatccagacccacagccagtccagggaagcattcacatctgtaggagccatcagtgttgacgcaacgcccrttcatgcagatcccaggggtttcacactcgttaatgtctgtggcagagaaaggcacttattaaaaatgaagtgacatttatctaaaattataacatgttgacaattatgttttaacccttgaaaatggggaagataggaaataatatgcagcatcagcaacaaaagctcaaatggcattctcattttcctttgaaagaacagtaacaaaatcaagagaaatcaactgttggaacttattttccataaaaagtaactttaatatattctcccaagagatttttgtatccaaaataatcaca

SEQ ID NO: 161935 - DNA, 601 bp, Human
gtttctggattatccatattctcctttgcattctatactgcccatggacatcaattctctattaaaatgttcatcatgagataatagcatatgcacatcaatttcaatgaccaatatcaacaaaggaggcctggagaaaactgaagacagctacgggattagggaagaaaagggggaaggataggtggggattcccttgcttttcacttagctcatctttctaatcctcaaattaatgttcaatttacacaaaaagagaactgaccctgttggtttgttgctctgcaaatattctttatawcttatctgctacagtagagagcgtttgttaccattgggctttattgagtgacagaggctgaacctctctcataaggttagccatgatgttttcttaccaacacacacacggccatccagacccacagccagtccagggaagcattcacatctgtaggagccatcagtgttgacgcaacgcccattcatgcagatcccaggggtttcacactcgttaatgtctgtggcagagaaaggcacttattaaaaatgaagtgacatttatctaaaattataacatgttgacaattatgttttaacc

SEQ ID NO: 161936 - DNA, 601 bp, Human
ctggcgcaacagcattcagatttagtgacagcaccaaacaaaggtttgatacactggcctctcttgtatccaccatagcatgtgctccgcatgtgtgtgtctaaacaggaagaagcatctgtcatcacactgtcacttcaaacagatgagaaccccccaagtcaaagttgaagagggctttatttatccatcatccctggtgtaactcacagggaatgcctctgatatcggggctccatttgaagaaaaaataaacaaaaacagaaaaacaaaacacgttcagcttctaagcactggaaaycaatggccagattgcttcagttttctagggagtatcatggtttactaaaatgtgaggcccttcaatgctggaattatatctcacttattttgtctttctcgggcctgtgcagagcaggcacttaataaatgttgaattaatgatggatgaatgttgaatctcacatcctgctaaataagacctttattagaaatgcggcctatcccaaaataaacacgcaattactgaatgtctgaattaggtatactttccaaaaaggagaaagtttaatctgtaaaaggttcgttatataaatatgta

SEQ ID NO: 161937 - DNA, 601 bp, Human
gaagcaaatagttcctatcccctgcatgccagagaattgcatcctgatgacattggaggtaaatgagttatacaaccaaagattatcatgtcttctaacaaatgtgaatttgagaaagcagtgatgatttaattttcaaaccatcttagaaggggtcaaaaaaacaacagatgggaaggtgtgtttgaaagccaggtgtgggaacaaaaagaaattcatcttttttattctgctgtatcagcaaaaagctaaaatatgcatgaaatactgtaagtaataaaacaagaaaaccaaaatcatrccagttttataaaaaggacttttagagataatgacaattttgctgatgtttggcctaaatggaagcaaattattgtcaccattgttttccatttaggcaggatctggtactagaccattttttgtagtgagttcaaataagcatgggttttaataccgatgacaacgctaattgctgggagttttggaagcagcccttttcctctgttagtttcttctcccataaatttggaatgacaactcccatttcacctggtggctgtacagaattaacattacatgtttaatgattgaacgtgta

SEQ ID NO: 161938 - DNA, 601 bp, Human
ctaacatccgaagtataaagtgtccatttgcccagtcctctaagctactcaaaggcagttttctcccagcaatgaaagaaggaatgcattatgcaggcaatgtttcagaaaatgggtaaaacttctcaccaacgcagtttttcccagttgaatccacttcatatcctgaattgcatatacatttataggtcccacgaaggttttcacagattccatttgggcaaatatcaggatctagtgcacattcatttatatctgcaccacaaaaaaggtcaaaatcaattaagattataaaataaayactgaatgaattgttaaaaatataacactacaataaatgtaatgaccttaggagctacaggaggaaaaaaatcgatttcactggaaagagaacactctgtctctttttctcactgtaagatattctgagtccaatctttctcccacaagttcctgagaggaactttgcatctcagctggaactacaagataaccaatccttaatcaagctgaaggagacctcctggacttctcctagtccaagcaccaagatggaaaaatggatcgacagcagatcccaagtcccgacaactggtctccc

SEQ ID NO: 161939 - DNA, 601 bp, Human
gattgtcatggggaatttagcttcatgattcagggacctcaggaaaactgcttgcttttagctgaataatatgcctgtctgaagcaaaacccaactttaagagagcaggtattcctgaaaataagctgtgtttttttctgattaagtctaataaatggttgggagaagagctgcttctctctcagtaaaatcaaggttgactttgtagtcacatgagaatggctcagaatctctgcatcttatatctaaggagcttctctttgaaggagtgaaatctgatacatcattattttaaggagcaaatcatttcaaggagtgaatctgatacatcgttattcataaactgtgaagattcagtgatgtaaatttttgttactaaagatatgtatatgctgtgctaacatccgaagtataaagtgtccatttgcccagtcctctaagctactcaaaggcagttttctcccagcaatgaaagaaggaatgcattatgcaggcaatgtttcagaaaatgggtaaaacttctcaccaacgcagtttttcccagttgaatccacttcatatcctgaattgcatatacatttataggtcccacgaaggtttt

SEQ ID NO: 161940 - DNA, 601 bp, Human
gttaataaattattattagaaaaataatgagctcagtatttaccaagacagatccttcctgtggcatccaaagtcattccactgggacactgacacttgaatgaccccctagtgttaacacacaggccatttttacacactcctgggaacacttcacattcatctatatctaaaaagaaaaaaaaagtataaagttaatatatctttataatatcattctaccttattctactcatagagtcataattattccccattttgaacctggtaagttcataaaactagtttgcctacaagtagyttgtgtagaatttctagggtgcctgaatagcaaccagaacgagcccacctattactaaatatgtaagagtttctccattggtttcagggaataacttttgagttgtagagacaggcagctggtgtgagttcttggagacagctctggtagctgcggacatttcaggtaaggttcccagcaatataatttgctttatgagaccagatgtctggaaatgagtagagaagcaaaaacctggtttttcaaactagcaaagaagaaacagcttgaagttcagcatagaaaaatatcccaccaagg

SEQ ID NO: 161941 - DNA, 601 bp, Human
ctttttttttttttagagacggagtctcactcttttgcctaggccggactgcagtggcactatctcggctcactgcaagctccaactcccgggttcatgccattctcctgcctcagcctcccgagtagctgggattacaggtgcccgccaccgtgcctggctactttttttgtatttttagtagaaacggggtttcaccatgttagcaaagatggtctcgatctcctgacctcgtgatccacctgcctcggcctcccgaagtgctgggattacaggcgtgagccatcgcacccggcccacttttttaactacctacaatagtcttcactgagcctacacttcaaagtaatgtggtttcagatgcaaagtacaggtaagcatcatttccagagtcatgaactcagaaaccagtgatccaagggatatactctaggcaggcagaagccatagtagtaacaccagaataagtctgccagaccttagatgcatgagatgtgcgatctcaaacttgccactatcacgagcccatagggacttaggacttagagttctaaggacttagggttggggtgagacaatttggctagaggatcccatttgg

SEQ ID NO: 161942 - DNA, 601 bp, Human
aataatgaagtgtaattgaaatgtaagatgtatcttccttctctttctccttcacaatggggtcattaacaatatatctaactccctgggtttcctctaacgttagaaagtttttgaagtctttatattcagctttatattcagactgcccatattaagataaattatttttaagtgaatcctaaattaaacactgaagcatctttcaactgaagaacctagaagaagattctcattaaatactgattcttcctaaacaaataaactaagactcagaatagcattaactgacatccttaaytacaaaaatacttttggctttgaattcccggttccattccatattatttatttacactataaactataaagttcaatatttaaaggtttgttaattctaattcgtaagtgatcaaaatccttcactgtataccactttctttttctttttcttttctttttttttttttagagacggagtctcactcttttgcctaggccggactgcagtggcactatctcggctcactgcaagctccaactcccgggttcatgccattctcctgcctcagcctcccgagtagctgggattacaggtgcc

SEQ ID NO: 161943 - DNA, 601 bp, Human
tcttctgtaactcagtggattgtcttcaataaattatcctaaacctgaatttccacatctgttacaggatgttgcactcatctctcagaaggttctgtgaagctcaactgagattatgcatctgaaaataatgaagtgtaattgaaatgtaagatgtatcttccttctctttctccttcacaatggggtcattaacaatatatctaactccctgggtttcctctaacgttagaaagtttttgaagtctttatattcagctttatattcagactgcccatattaagataaattatttttaartgaatcctaaattaaacactgaagcatctttcaactgaagaacctagaagaagattctcattaaatactgattcttcctaaacaaataaactaagactcagaatagcattaactgacatccttaattacaaaaatacttttggctttgaattcccggttccattccatattatttatttacactataaactataaagttcaatatttaaaggtttgttaattctaattcgtaagtgatcaaaatccttcactgtataccactttctttttctttttcttttctttttttttttttagaga

SEQ ID NO: 161944 - DNA, 601 bp, Human
ctttttccaaaacaagaccaaacactcaagaaatacgcaagtaatttctacatgtaagacagaactgggagattaaatctccagaacaccaagtccttcttcagcaatgaattaccatagcttttggaagcaaaattaaagttcctttgagtttacgtaactgacatttaagagggccacctagaaactatctgaaactatctctccatacagaacaattttaacccccaggacttcttggaccaaacagttaaaaacaaaaagttcatacttttctaaacaaagataattatataattcagaaagcaaaaagtccatgctgggatgatcaagtagagtgctgagatcatgaaaatgcatcctatttgtctaaaaagggaggcaattggccatggaaaacgtaacattgtacctttgaagaaaggctttccatttgtaatttcttttgtggcaaatccgggtcctctcggacacagctcctcgtactcaggagtatttctcatgggacactcctcgcattcctcagtaccccaggctgccccgacggagcagcagcaggcgtccatgcggtggcggccagcaataggcagggtgcactcct

SEQ ID NO: 161945 - DNA, 601 bp, Human
gtagcagaatgagatattcacttaatactgtttggtgcttttttggatatgccaaaaatataaaaatttcaaagatataatttataatttaaattatttgcaaataatttgtacaatttaaaaatattttcttaatgtatataccttaagatgtctttctttctttttttgagacaggatctgctctgtcatcaaggctggagtacagtggtgtgcttggctcactgcaacctctgcctcccagattcaagcaattcttgtgcctcagccatctgagtagctgggattacaggtgtgcacyaccatgcctagatatttttttttttttttttttttttttttttgtagacacagggtttcaccatgttgcccaggctggtcttgaactcctggactcaagtaatctgcccaccttggcctctcaaagtgctgggattataggcatgagccaccgcatccagctcaagatctcattaatataatttaaagagcttcttgtacactagaaaactgcatacatgtaacatgtgacctgagtttcccactacagggcctttttccaaaacaagaccaaacactcaagaaatacgcaagtaatttc

SEQ ID NO: 161946 - DNA, 601 bp, Human
aataccacttttgcaagaatctccatttcaaactttgtttctaggaaaccagacctaaagcaacaagtttaccaatcaccttttctagaagtgttggacagacatcttgtaaagggacctctactacagcttctgtctcaattgtcctctcttccgcctgggtatccatttcaggtgttaaaatcacttctcaagggcccacaactggtctccgccatcacccacaaacccacagcatgaattccctcattctttctacctcagtctccctctgttgcagactgattcctaacttcactgrttgcactggggcagcaggaagaacctggaacataggctatgagccatcaaagcttcatggaatccttctctttctgtgttgatcaaatgatcccaaacttacccatgcagttcttcatcatcatgaatccactttcatagccttcgtcacacttgcattcaaagtccccaggggtgttcacacactggcctctgccacagaggtcaggagatatgcggcattcgtcaatgtctgcacaaaaacagcaagtggcagcaaatgagtctcaggacagccttaattcttgcgacaatatgttaa

SEQ ID NO: 161947 - DNA, 601 bp, Human
caggatcagactaaaaccaaaatgcagccaaactcttggtttattttcttctcctgcactaccctgctctccttacttcctgacaagtaccttctgagagaatttgctcacagtaagaaataccacttttgcaagaatctccatttcaaactttgtttctaggaaaccagacctaaagcaacaagtttaccaatcaccttttctagaagtgttggacagacatcttgtaaagggacctctactacagcttctgtctcaattgtcctctcttccgcctgggtatccatttcaggtgttaaamtcacttctcaagggcccacaactggtctccgccatcacccacaaacccacagcatgaattccctcattctttctacctcagtctccctctgttgcagactgattcctaacttcactggttgcactggggcagcaggaagaacctggaacataggctatgagccatcaaagcttcatggaatccttctctttctgtgttgatcaaatgatcccaaacttacccatgcagttcttcatcatcatgaatccactttcatagccttcgtcacacttgcattcaaagtccccaggggtgttcaca

SEQ ID NO: 161948 - DNA, 601 bp, Human
ctgctcaagggcaacgtccacacctgcttaaaagtctattatttatttaaaatctttctttcatttaatttatcattcaaaaattattataaatcttattttccctattgtcaaattataaatgcctgaattctatcaactgttttagcaatattttaaggtaagaattacttgaaataaccatacctacttagatgctcttagtaataatatttactttcaacaatttttttttttttttgagacagagtctcactctgtcaccaggctggagtgcaatggcgcgatcttggctcactgmaaccaccgcctcccaggttcaagcgattctcctgcctcagcctcccaagtagctgggattacaggcatgtgccaccacacccaactaattttgtatttttagtagaaatggggtttcaccatgttggtcaggctggtcttgaactcctgaactcaggtgatctgcctgcctcagcctcccacagtgctgggattacaagtgtaagccaccgtgcctggccttattttcaacaatttttgtagccaaatttatatctagattttttaagggacatttttctaggtcagtaaaataattttg

SEQ ID NO: 161949 - DNA, 601 bp, Human
actgctcaagggcaacgtccacacctgcttaaaagtctattatttatttaaaatctttctttcatttaatttatcattcaaaaattattataaatcttattttccctattgtcaaattataaatgcctgaattctatcaactgttttagcaatattttaaggtaagaattacttgaaataaccatacctacttagatgctcttagtaataatatttactttcaacaatttttttttttttttgagacagagtctcactctgtcaccaggctggagtgcaatggcgcgatcttggctcactrcaaccaccgcctcccaggttcaagcgattctcctgcctcagcctcccaagtagctgggattacaggcatgtgccaccacacccaactaattttgtatttttagtagaaatggggtttcaccatgttggtcaggctggtcttgaactcctgaactcaggtgatctgcctgcctcagcctcccacagtgctgggattacaagtgtaagccaccgtgcctggccttattttcaacaatttttgtagccaaatttatatctagattttttaagggacatttttctaggtcagtaaaataatttt

SEQ ID NO: 161950 - DNA, 601 bp, Human
gtactttcccctcgagacataataactatgacaaatacattagaaaaggtaaaatgctttccctcagaaaaacaatgttaaattttagaggccaatttacatttgctcttcattctttacattgcaagctcattattcagactggctttcatctggcccataagcagcaggccagttaatcaaataaacagatgggctccatgctgagtttagagctcgtttatgtgacagtctagaaaactttttagaacagcatactctattgcaggatgaaaagtttaattcagtctgcatgatgatwacaatttagttttcatattttgaaagaaaggatagatgaactggttgtcttagtgtaagtagtttaagacttcacttcttttccaaattaaaaattattcattttttatgacattcattttaattctaggacttcaaacattttcagtaaaggctttcagaagataaatgtgataaaaatgtaaatataatcaataccagactcttgcttctggccaagatagaataacaggaattaaaattatattctcagatgaaacaaccaaaaaaaatagacaatagataccttaaaaagtggttt

SEQ ID NO: 161951 - DNA, 601 bp, Human
tatatactattaatatatgtagctatttgatatcattgagtactttcccctcgagacataataactatgacaaatacattagaaaaggtaaaatgctttccctcagaaaaacaatgttaaattttagaggccaatttacatttgctcttcattctttacattgcaagctcattattcagactggctttcatctggcccataagcagcaggccagttaatcaaataaacagatgggctccatgctgagtttagagctcgtttatgtgacagtctagaaaactttttagaacagcatactctrttgcaggatgaaaagtttaattcagtctgcatgatgataacaatttagttttcatattttgaaagaaaggatagatgaactggttgtcttagtgtaagtagtttaagacttcacttcttttccaaattaaaaattattcattttttatgacattcattttaattctaggacttcaaacattttcagtaaaggctttcagaagataaatgtgataaaaatgtaaatataatcaataccagactcttgcttctggccaagatagaataacaggaattaaaattatattctcagatgaaacaa

SEQ ID NO: 161952 - DNA, 601 bp, Human
tttaaacactgtgccatttatcagaatggacccctagacaggcttcatgtaaggagtagcatagtgaaaatgaaaacattccagcttcatgcttcttctcataatttggctagcatctgttatttttgaaccaacaataatattattgcccttatcctacatatcaataaatttgaaatagcattattggccagtttgaaacaataataaatatattttggtgttttcttgaaatatgttgatataattaagaggaggatctgcacatttgccccactgccaatctgcaaatattttaatrtttgttttaagtcataagagcttgccaaactggtttttggaattaaagactgttatttattaagaaattattcagttacctaattcaagctcaccatggtttccattatgttttaaattatgttatatgccataatctgtcaaattaatataagtaactagagtaaaactttattatatcattccatggacttaatgtcattgcctcatatttgaaaataccaactaaacacttataaactaaacacaatgtcattagcacagagtaacttcttccatttggcatttaataggatagtct

SEQ ID NO: 161953 - DNA, 601 bp, Human
tatatttatactggaagctaaaaataaagcttgaaccatagacatacaaagctaggcaccatttgtaccgagaggccgtataggagttgagagtttaaacactgtgccatttatcagaatggacccctagacaggcttcatgtaaggagtagcatagtgaaaatgaaaacattccagcttcatgcttcttctcataatttggctagcatctgttatttttgaaccaacaataatattattgcccttatcctacatatcaataaatttgaaatagcattattggccagtttgaaacaataayaaatatattttggtgttttcttgaaatatgttgatataattaagaggaggatctgcacatttgccccactgccaatctgcaaatattttaatgtttgttttaagtcataagagcttgccaaactggtttttggaattaaagactgttatttattaagaaattattcagttacctaattcaagctcaccatggtttccattatgttttaaattatgttatatgccataatctgtcaaattaatataagtaactagagtaaaactttattatatcattccatggacttaatgtcattgcctc

SEQ ID NO: 161954 - DNA, 601 bp, Human
gcccagaggtctttttcttagttctcatgaagcaaaatttctccttataaaatagcatacatattttcataattcttttcattaaacaataatctatctaaataaataaatagataaataagtagacatattccttttgtctgcttgcttatccaattaggcaagatacctatctctacttacattagttgcctggaacattattagcaaagccatcaccaaggtaacctgacggtgttctaagttgtgaatgacacgaattttaaactaaaagcagctaaaagagccttagtgacatggsattcaaaaaacattttgccccagatttttaaaaacacgttttcaagtataccaaacttactgtttggttaagccatttccaatcaaatgtgatgcccttccacaggtcagggctgttacttacccaaggagaacatttgagtaactgcagagcaccctggtgatttgttcaagatcatgaatgagtggatttactaagaacacaattcagggtactactccttcagatgagaatatcacatgccatgttactctggtatcaaaggggcataaaactcaagtcttcctacagtgctagctg

SEQ ID NO: 161955 - DNA, 601 bp, Human
aggatagaagagctgtgttctgcgtttcaaggaaatgtgttctctctccattaaatggaacattcccccttggcaatacccagggtctgaacaaagcttacggagtaaaaagaaacccttagcatctgtgtgggctgggaatgtaagtcagtgggtggattctgaacattgctaaagtgattgggggaaaaaacatgtttatttgttaaaatggaaatactcagtaatgacagggagctgaaatatttagacaaaactgtaatggagcccagaggtctttttcttagttctcatgaagcaraatttctccttataaaatagcatacatattttcataattcttttcattaaacaataatctatctaaataaataaatagataaataagtagacatattccttttgtctgcttgcttatccaattaggcaagatacctatctctacttacattagttgcctggaacattattagcaaagccatcaccaaggtaacctgacggtgttctaagttgtgaatgacacgaattttaaactaaaagcagctaaaagagccttagtgacatgggattcaaaaaacattttgccccagatttttaaaaa

SEQ ID NO: 161956 - DNA, 601 bp, Human
gtcttaaaattagcttgtgaaagccaggaccacccatcaaagatgacacctagcagggccttaattatgtagaacaagcagcagaagccttacattgggtcatagaaaaattgtaatccagcccacttaagccaaggatagaagagctgtgttctgcgtttcaaggaaatgtgttctctctccattaaatggaacattcccccttggcaatacccagggtctgaacaaagcttacggagtaaaaagaaacccttagcatctgtgtgggctgggaatgtaagtcagtgggtggattctgaayattgctaaagtgattgggggaaaaaacatgtttatttgttaaaatggaaatactcagtaatgacagggagctgaaatatttagacaaaactgtaatggagcccagaggtctttttcttagttctcatgaagcaaaatttctccttataaaatagcatacatattttcataattcttttcattaaacaataatctatctaaataaataaatagataaataagtagacatattccttttgtctgcttgcttatccaattaggcaagatacctatctctacttacattagttgcctggaacat

SEQ ID NO: 161957 - DNA, 601 bp, Human
cacttaatggtatgcttgctttattcattaactaagtaagcacatgatgggaggtagggtcttaaaattagcttgtgaaagccaggaccacccatcaaagatgacacctagcagggccttaattatgtagaacaagcagcagaagccttacattgggtcatagaaaaattgtaatccagcccacttaagccaaggatagaagagctgtgttctgcgtttcaaggaaatgtgttctctctccattaaatggaacattcccccttggcaatacccagggtctgaacaaagcttacggagtaamaagaaacccttagcatctgtgtgggctgggaatgtaagtcagtgggtggattctgaacattgctaaagtgattgggggaaaaaacatgtttatttgttaaaatggaaatactcagtaatgacagggagctgaaatatttagacaaaactgtaatggagcccagaggtctttttcttagttctcatgaagcaaaatttctccttataaaatagcatacatattttcataattcttttcattaaacaataatctatctaaataaataaatagataaataagtagacatattccttttgtctg

SEQ ID NO: 161958 - DNA, 601 bp, Human
aagaaaccagctagtttccaatatggaattacccagaaatcccgctattttaactgaaaacaagtctgatttaattccacttaatggtatgcttgctttattcattaactaagtaagcacatgatgggaggtagggtcttaaaattagcttgtgaaagccaggaccacccatcaaagatgacacctagcagggccttaattatgtagaacaagcagcagaagccttacattgggtcatagaaaaattgtaatccagcccacttaagccaaggatagaagagctgtgttctgcgtttcaagsaaatgtgttctctctccattaaatggaacattcccccttggcaatacccagggtctgaacaaagcttacggagtaaaaagaaacccttagcatctgtgtgggctgggaatgtaagtcagtgggtggattctgaacattgctaaagtgattgggggaaaaaacatgtttatttgttaaaatggaaatactcagtaatgacagggagctgaaatatttagacaaaactgtaatggagcccagaggtctttttcttagttctcatgaagcaaaatttctccttataaaatagcatacatattt

SEQ ID NO: 161959 - DNA, 601 bp, Human
ggggaaagtgagccataaggaaaacaagcaaacaaaaatgctgtattgaaacactcttcaataacatgaaggaaacatagtacatgtttgccaagaatatctctttctgtaaaaatgttctctttcctgcacaagttcgctgcaaacagaaaattcctgtttaagattaagaatagcataagccaagaaaagcaaagaaattcaaacttaaagtgacaccgcaaccttcttaaccccaccaaacctttgtcacaaagactcaaaggtcctcttgcatggctctcttgaagggcaagggtgyggtgtgagcagaccctgctcacaggctctgggtatgtcccatgcaagtatgtcatccaagtatgggcttgtgcccggggctgctgtggcctcctcttacagtcacgcagggagaggctgtatcacccacacaaacacctgccttctctgccatctgggcatctgtctcctggatcctaacctggcagagctgtgcactgcagaaactccttgattaggcattgaggaagagggcgttaccatgaatggagaggccaaacgtgaaggctacttggatttcttaatttggatccaaatttga

SEQ ID NO: 161960 - DNA, 601 bp, Human
agaggtactcttattttatgagtattatcattttcatatggcttttaccttccatgtttaatcttgcaattaagaaaattatcatttctttttaatggaaagtctcctttaaaaatcatcagtaatatgctaatagaaatttacaactttagaaagtgttttcagttttatggcaatgttttcaaggtgaaaagaaactatatttacaacaggctgtgtatcatgggcttttgggtaataggagagagtaactcaggagccaatattcaattctccattttgtgactatttgtataagttwttatctcaatgttttacactctcagtatgtaacaattggagagacttcaagtggtcataaagtataaaagcatctccaaataaaaggtttttgcatgtgggtgtgtgtgcatgcatgcaccaactatcattcattaattgtttctgtggcagacttggactgtaattcatcataaaagcaaacagaaggggaaagtgagccataaggaaaacaagcaaacaaaaatgctgtattgaaacactcttcaataacatgaaggaaacatagtacatgtttgccaagaatatctctttctgtaaa

SEQ ID NO: 161961 - DNA, 601 bp, Human
cagagatgaccacaacctattaatctagtaattctgtaatctttttctttccagttttctaatgaccagaggtactcttattttatgagtattatcattttcatatggcttttaccttccatgtttaatcttgcaattaagaaaattatcatttctttttaatggaaagtctcctttaaaaatcatcagtaatatgctaatagaaatttacaactttagaaagtgttttcagttttatggcaatgttttcaaggtgaaaagaaactatatttacaacaggctgtgtatcatgggcttttgrgtaataggagagagtaactcaggagccaatattcaattctccattttgtgactatttgtataagttattatctcaatgttttacactctcagtatgtaacaattggagagacttcaagtggtcataaagtataaaagcatctccaaataaaaggtttttgcatgtgggtgtgtgtgcatgcatgcaccaactatcattcattaattgtttctgtggcagacttggactgtaattcatcataaaagcaaacagaaggggaaagtgagccataaggaaaacaagcaaacaaaaatgctgtat

SEQ ID NO: 161962 - DNA, 601 bp, Human
tagctgggattacaggtgcctgccaccacgcctggcttttttttttttttttttttttttttgtatttttagtagggatggggtatcaccatgttggtgaggctggtcctgaactcctaacctcaggtgatccacccgccttggcctcccaaagtgttgggattaaggcgtgaaccactgcgcccagctgagcgcatttctttagtcatatcaggattttattctaagccttgctttatggagttaccaaaatattggtgaatattaactgacttatagaaatactcactaatatcttctmctaagcataattttcagagatgaccacaacctattaatctagtaattctgtaatctttttctttccagttttctaatgaccagaggtactcttattttatgagtattatcattttcatatggcttttaccttccatgtttaatcttgcaattaagaaaattatcatttctttttaatggaaagtctcctttaaaaatcatcagtaatatgctaatagaaatttacaactttagaaagtgttttcagttttatggcaatgttttcaaggtgaaaagaaactatatttacaacaggctgtgt

SEQ ID NO: 161963 - DNA, 601 bp, Human
tgattggcactccttcccttgggccacagctgcctagctgagcttctttctttcttttcttttctttttttttttttttttttgatggagttttgctcttgtcgcccaggctggagtgcaatggtgcgatctcggttcacagcaacctccgccacctgggttcaagcaattctcctgcctcagcctccctagtagctgggattacaggtgcctgccaccacgcctggcttttttttttttttttttttttttttgtatttttagtagggatggggtatcaccatgttggtgaggctggtcytgaactcctaacctcaggtgatccacccgccttggcctcccaaagtgttgggattaaggcgtgaaccactgcgcccagctgagcgcatttctttagtcatatcaggattttattctaagccttgctttatggagttaccaaaatattggtgaatattaactgacttatagaaatactcactaatatcttctactaagcataattttcagagatgaccacaacctattaatctagtaattctgtaatctttttctttccagttttctaatgaccagaggtactcttattttatgagtatta

SEQ ID NO: 161964 - DNA, 601 bp, Human
gctcagcacaaatgtcttttggtttttaaaataagtaatattcaaaagttgacttgccttcaaacttcccatggtatagtatagactggttttgcatccatatataaactctacatatatcaaacagctttaaatttcaaattataaagatataacaatatgattgtactagctattgttaactctaattattttccgtattttaatgtaagtttccagtcactgcaaagtgactttttacagctgaagaccataaaaaatgagttgcttaattttctatggttttaatactccttgtcayatattttcttttgctagtatttttagtaagtcaactatggagtaatgatgcacattattttcatatcttgtatagacaaaaaatacaaacttgttggcaaattagaaaatttttgcattatattctatatataaaatatattttattcttaaacttaaaacacttatttaattatgctttatttctacaaaagctttcctttaggtattgctaatttaagcatttgcagaaaatgttccttaagacagtatataagccatcttttccctagcttcttagagtcctagcacattggagagc

SEQ ID NO: 161965 - DNA, 601 bp, Human
ctcaggtctatcaactttccagtgcagcaatgttttggcataacttcaatttgacacatttaaagtcatttatttttctctttggtaggctaacactgaatatgaaatttacatgtggctgattcagaatcctgaatgataatttaccctgaatgatataaaatgaataagccgaaggaatcatgcaaactaaggcctgttcaagaagggtcatccgcatggagggcacacccatgacaggaaatgacacatcatgtttgtgtctatttctcaagtttcaggcttagcttagatgggcacsaaaagtgcaaaagaatggcaaccatagggagaagaaaaattccatctgcttaatctctacctagttttcttaataatcacaggcatttaaatatcaaacacataaaccacacatgcctaatacatggaatttgaatatgttctcaaaatgatgggaggtttttgatgacaaaacatcaataagttaggcaaaaatgatttcatctgagataaaactttcagggaataaaaaaaaattccaggtaaatcacttaatgagccttagcctctattgtgcttaaatgactttttatgaacaaag

SEQ ID NO: 161966 - DNA, 601 bp, Human
atagatacatatctcatttgtagtgttccacgtaggtccacatcactttcgtaaagtaagaggcaagcaagccaccttatgctaaattcgttttttttttttaatctatctatgtagtcactgtttttgttgtgaattaaaatttcacaagccacaatgtctttcagggaactgtcataattagttgcataatctccagtgtccctagtcctatggcatgtgtttgcctttgttgacggagattggaaaaccgcacacgcttcttccaggcctctgtctctgcctcctgttaacattcttygtgtgcagttgacacacagtcacattttcaggcttgagactagctttaaatagccatgaccactccaccagccatgatttatattaagaacaaacaaacaaacaaaaccttctcttatagcaataagagaagcaaaactttcactgtgactatttgtgtcaccagaggtggcacagtacctgttttccttggatatttggagtaacaaaagtaaacaaggtattaggcacatgatcaagagcataatctggtttcttgactccaaggagttttatatcaaactctgcatatttaatataa

SEQ ID NO: 161967 - DNA, 601 bp, Human
gaaaaaagcaaaaaacttaacttatatttttctaaaaaaaacctgccaaatataattaggcaactaatgtaaatactaagaaaatgcagagtatctaacaccaatctgggcacttctcctatagacttttagatgatttgccatgcacagtgaagtctcgtaggtgagaggttacttttcctcagtctctattacatgccaagcagcgggctgagcattttatagatacatatctcatttgtagtgttccacgtaggtccacatcactttcgtaaagtaagaggcaagcaagccaccttaygctaaattcgttttttttttttaatctatctatgtagtcactgtttttgttgtgaattaaaatttcacaagccacaatgtctttcagggaactgtcataattagttgcataatctccagtgtccctagtcctatggcatgtgtttgcctttgttgacggagattggaaaaccgcacacgcttcttccaggcctctgtctctgcctcctgttaacattcttcgtgtgcagttgacacacagtcacattttcaggcttgagactagctttaaatagccatgaccactccaccagccatgatt

SEQ ID NO: 161968 - DNA, 601 bp, Human
aactttgggccgggcacggtggctcacgcctgtaatcccagcactttgggaggccgaggcaggcagatcacgaggtcaggagatcgagaccatcctggctaacacagtgaaacctcatctctactaaaaatacaaaaaattagccaggcgtggtggtgggtgcctgtagtcccagctactcgggaggctgaggcaggagaatggcatgaacctgggaggcggagcttgcagtgagccaagatggtaccactgtactccagcctgggcgacagagcgagactccgtctcaaaaaaaaaaaattatatatatatataaaatataatatatattacatatatatataaaatataatatatattacatatatatatataactttggcactaggaaaaatattccagtcaaggtaactgaaggcaaaacactgttgtgacctcggtcaaccaaaaattcagacacaggttttaagaaaatatattgagtatatgtggcttgttatttcatcaaattagagcaagatgtcccaggaaaccctcagaagggcaactcttgctgcttcccctgacacacacgcgtgaggcttagtgtgttccctgaggt

SEQ ID NO: 161969 - DNA, 601 bp, Human
aggaaggaaatatgatatagtctttggtggtctttccccagaacacatttaccattcaaatttgtcatcaggataaaatataactttgggccgggcacggtggctcacgcctgtaatcccagcactttgggaggccgaggcaggcagatcacgaggtcaggagatcgagaccatcctggctaacacagtgaaacctcatctctactaaaaatacaaaaaattagccaggcgtggtggtgggtgcctgtagtcccagctactcgggaggctgaggcaggagaatggcatgaacctgggaggyggagcttgcagtgagccaagatggtaccactgtactccagcctgggcgacagagcgagactccgtctcaaaaaaaaaaaaatatatatatatataaaatataatatatattacatatatatataaaatataatatatattacatatatatatataactttggcactaggaaaaatattccagtcaaggtaactgaaggcaaaacactgttgtgacctcggtcaaccaaaaattcagacacaggttttaagaaaatatattgagtatatgtggcttgttatttcatcaaattagagcaaga

SEQ ID NO: 161970 - DNA, 601 bp, Human
ttaaggtcttaccaacacagccaactcgagttgggttcagttcaaaatcaggtgggcagtcacagatatagctgcctggagtgttgacacagttcccactgatgcacgtggttggatccaggcattcattcacatctaaaaccgaacagtgagtagtggagttatcacctgagccagtgtaggcagacatcaccataaaagaacagggcccaatctagagctccaaacaagaattttaaagctactagttataactacatctagaaatgcagtcttccacttcagagataaaacacctcargaaggaaatatgatatagtctttggtggtctttccccagaacacatttaccattcaaatttgtcatcaggataaaatataactttgggccgggcacggtggctcacgcctgtaatcccagcactttgggaggccgaggcaggcagatcacgaggtcaggagatcgagaccatcctggctaacacagtgaaacctcatctctactaaaaatacaaaaaattagccaggcgtggtggtgggtgcctgtagtcccagctactcgggaggctgaggcaggagaatggcatgaacctgggaggcg

SEQ ID NO: 161971 - DNA, 601 bp, Human
ttcttatgctcacaaaatctatgatagggtatatagtatcccgaagccattaacagctggcttcatgaatctgcattggtaaggcagcatggagcatatttcacatcctctccccacttccaaatgaaggagttgattctaatctttgttaactccatgggtcttagagctgtgccatatacactgtgatgttcaactaatactcaataaggttgccattgtctgggtgacctaataagccattaaagagccaggggaatatttcttatgcagagcacaaggaggtctctttcctaaacarttgtgtgattcctccatgtagatgaaaaccatggctcatggctgaagtgctctgaaacctgtaagtggttaatattctccacctttccagtaacacaggatgaacaagggccaccactcatagcataaagccaaagggccgccttctaggagaagcttatttgaatacatgagcaccaatggtaagtggtgaaggattaaaagaagagggcccagaactcctccaaatagagaaggaacactgaaattggacctgtgccattcacgtaaaaaatggcttttctgaagagcatggaaaaat

SEQ ID NO: 161972 - DNA, 601 bp, Human
agtggtatgtgaatatgaaaacttcacattttggaatggcctgatacttaatgaatgttgacattagaggagaaaatctatagggtattttcaaataagataacgaaaataggtatttcattcatccgtgtcctctctctgtgtaaatgtgtgccttttgaggaaagagggttttagaaaaggaactcttggctgggcatggcggctcatgcctgtaatcccagcattttgggaggccaaggtgggtggatcacttgaggtcaggagttccagactagcctggccaacatggtgaaacccsatctctactaaaaatacaaaaattagccaggcgtggtggtgcacacctgtagtcccagctactctactcgggaggctgaggcaggagaattgcttgaactctacatgcagaggttgcagtgagccaagatcatgccattgcactccagcctgggcaacagagcaagactctgtctcgaaacaaacaaacaaaaaacaaaaacaaaaaagaaaaggaactcttgccttctgacatgaggcattatcaaatataataatgagtctcctaataaattaacctataatatcctcaaaggtaggc

SEQ ID NO: 161973 - DNA, 601 bp, Human
aatttttcaacctatatttttgataatggagaaactaaaactcacctgtacttgggatgggacactgttcacagggcttgttccacgcccggccaatgttgtaggaacagcagcacatcttcttggtcatgttgaataacaattctccatcacaggtctggttgtcagcatagtagtttctgtagcacaaacttcttctcatatctagaagggaggtaaaaaaaaggattggagggttggtgatgccatgtgggaaatcacaacaaatttctaagtggatactcaacaagcaagtttcatytgaattgtattgtagcttgactttgataaggacacaaaaaacttgctcttacacaactttctagctacctatgctgctacaagataaaggactttgagaaatacattccctgatatttcatgccacagaactaagtcattatatagctgtagcattaataaactttaaatgactctctgcccagtctcctagtaacaattccctactgccatttggcaataagtttctcgtttccgactcgtgatgttttaatactgtaggtcagcactgtaaatataattgtacaaagatacacccaaa

SEQ ID NO: 161974 - DNA, 601 bp, Human
tgagccgtttttttccccgtaaagataaacaatgcacactttgcttccttcgctaagactgatttccccaacaattcatgggtaatttttcaacctatatttttgataatggagaaactaaaactcacctgtacttgggatgggacactgttcacagggcttgttccacgcccggccaatgttgtaggaacagcagcacatcttcttggtcatgttgaataacaattctccatcacaggtctggttgtcagcatagtagtttctgtagcacaaacttcttctcatatctagaagggaggtaaaaaaaaggattggagggttggtgatgccatgtgggaaatcacaacaaatttctaagtggatactcaacaagcaagtttcatttgaattgtattgtagcttgactttgataaggacacaaaaaacttgctcttacacaactttctagctacctatgctgctacaagataaaggactttgagaaatacattccctgatatttcatgccacagaactaagtcattatatagctgtagcattaataaactttaaatgactctctgcccagtctcctagtaacaattccctactgccatttggc

SEQ ID NO: 161975 - DNA, 601 bp, Human
gttgtaaagaccattattcaagatcaagggtcagcaaactttttaataaagggacagagagtaaatatcttaggctttgcaggctgtacagtcagtcaaaactatttaatgttgccatgaaagcagtagtagacaatatggaaataaattagtgagctctaaaaaagttttatttatgggaaacaaaatctgaagttcatgtaactttcatattatgaaatacgattctcctgattttttccaaccatttaaaatgtagaaatccttcttagcttgcaggccattcaaaagtagatggtgrgacagatttggcccatggggtgtattttgccaagccctggtctagaaacattttgcagggtggaggtaaatcagaattctaagtggtggttattatattatttctggagtaaacaatggatggaataatacattttactaaaaaacaattttctgttgcatgcaatgtcaggtagtaccaaacaacagatttaatattttatatatcactgtggaaaatggtgtaggattccctttatagaataccctaatcaattccttgcatgataatttcaactaacccaaatcataatcttggcaa

SEQ ID NO: 161976 - DNA, 601 bp, Human
tttttaccaacaggtaagtaccacctaaagttgtaaagaccattattcaagatcaagggtcagcaaactttttaataaagggacagagagtaaatatcttaggctttgcaggctgtacagtcagtcaaaactatttaatgttgccatgaaagcagtagtagacaatatggaaataaattagtgagctctaaaaaagttttatttatgggaaacaaaatctgaagttcatgtaactttcatattatgaaatacgattctcctgattttttccaaccatttaaaatgtagaaatccttcttakcttgcaggccattcaaaagtagatggtgggacagatttggcccatggggtgtattttgccaagccctggtctagaaacattttgcagggtggaggtaaatcagaattctaagtggtggttattatattatttctggagtaaacaatggatggaataatacattttactaaaaaacaattttctgttgcatgcaatgtcaggtagtaccaaacaacagatttaatattttatatatcactgtggaaaatggtgtaggattccctttatagaataccctaatcaattccttgcatgataatt

SEQ ID NO: 161977 - DNA, 601 bp, Human
agctaatgaaaagccatgactgaatttggtgaatatccaacatcaagaagaaatcttgcattttacacaagagtatgtagatattcaaaactcaggcaatcatttctaaaagtaaatgttagtctacattaagggtttccaaagtggtctccagaggaatatgcaataatccattaggataaaaaagaaaatgcgaggacttctatctatctttggaaaaatctaatctttaaaaaaattaattttgtgtacactttatattagaacagctcagaaaaataataaatgtatttttcaatakaattgaaaacaaatacatatacacatacatagatatatatacatagacttttacatataaatgcacaccaggtgtgcataagcttcagattttttaccaacaggtaagtaccacctaaagttgtaaagaccattattcaagatcaagggtcagcaaactttttaataaagggacagagagtaaatatcttaggctttgcaggctgtacagtcagtcaaaactatttaatgttgccatgaaagcagtagtagacaatatggaaataaattagtgagctctaaaaaagttttatttatggga

SEQ ID NO: 161978 - DNA, 601 bp, Human
gttttgtctccttaatctatgagtgttcacttccaacactgtaacgccagctgacattggtcacctaaagaaattacagggactcttaaaatatgtgcagatttcacagctaatgaaaagccatgactgaatttggtgaatatccaacatcaagaagaaatcttgcattttacacaagagtatgtagatattcaaaactcaggcaatcatttctaaaagtaaatgttagtctacattaagggtttccaaagtggtctccagaggaatatgcaataatccattaggataaaaaagaaaatgmgaggacttctatctatctttggaaaaatctaatctttaaaaaaattaattttgtgtacactttatattagaacagctcagaaaaataataaatgtatttttcaatataattgaaaacaaatacatatacacatacatagatatatatacatagacttttacatataaatgcacaccaggtgtgcataagcttcagattttttaccaacaggtaagtaccacctaaagttgtaaagaccattattcaagatcaagggtcagcaaactttttaataaagggacagagagtaaatatcttagg

SEQ ID NO: 161979 - DNA, 601 bp, Human
tgcctctctctactctgcatttagagatctagggtttgaggaacacgtataaaagccattttctcggtagattataggagaccatagcaaatctagccacattcttgacatcagatctattaatgactaatttgggtcaatcaaccaaccttcaccagtttttcagtttttggagctggatttcatttggtacagctctgtcatattctctccctctccctctctccttttctgtctctctctgtctttctctcacttgaattagtcaaatttaacagataataaaggatgaactaaattmtatcagcagtcccttctaactgtgagattttgtgattccagatcatgactgtaactggtaaggtatggtatcaatctaagcttcagatggccattgccttattggtcacgctcagtgaaaatcagtaaaagatttctggaagtattttaatcaaaatacagcatgttattctccttgtgttttgtctccttaatctatgagtgttcacttccaacactgtaacgccagctgacattggtcacctaaagaaattacagggactcttaaaatatgtgcagatttcacagctaatgaaaagcc

SEQ ID NO: 161980 - DNA, 601 bp, Human
catcagccccttggctgggtttgatgaaacacctcagctgggaggtatgcaaagccttggtctacaatccaaagtcttccaattcactagtttctatgactgttgttgagatacgttgtttacttattatagtcaggagcctttgcaaggtacatactttgcttgcatacttgtgagaagatgatcacggactgaagtggagcctacaagagctgctgcaattttagaagaaccacactctataaccaatctgttttaaaggagaaatttgatgtcatagatttattttagaccatttttaaaaaagggcttgattttgtgtgaaggcaaaattgacctatttaatgaaaagaaacagcttagaatctcaaagggttcattgctattttgaatacacgcaattatgtctttagatctttcacacctttgtcattcatgtcatgaaaatgccatataaagttacatcacaactgtgtatcataagtaaacaaaaaacaaattcagatgccattcattcagtgtgggttagaacacgaaacatcatattcacattcgttttaaatataagtgatatattattatcaagtttaacaataacggg

SEQ ID NO: 161981 - DNA, 601 bp, Human
ccatcagccccttggctgggtttgatgaaacacctcagctgggaggtatgcaaagccttggtctacaatccaaagtcttccaattcactagtttctatgactgttgttgagatacgttgtttacttattatagtcaggagcctttgcaaggtacatactttgcttgcatacttgtgagaagatgatcacggactgaagtggagcctacaagagctgctgcaattttagaagaaccacactctataaccaatctgttttaaaggagaaatttgatgtcatagatttattttagaccattttyaaaaaagggcttgattttgtgtgaaggcaaaattgacctatttaatgaaaagaaacagcttagaatctcaaagggttcattgctattttgaatacacgcaattatgtctttagatctttcacacctttgtcattcatgtcatgaaaatgccatataaagttacatcacaactgtgtatcataagtaaacaaaaaacaaattcagatgccattcattcagtgtgggttagaacacgaaacatcatattcacattcgttttaaatataagtgatatattattatcaagtttaacaataacgg

SEQ ID NO: 161982 - DNA, 601 bp, Human
cccttccatcagccccttggctgggtttgatgaaacacctcagctgggaggtatgcaaagccttggtctacaatccaaagtcttccaattcactagtttctatgactgttgttgagatacgttgtttacttattatagtcaggagcctttgcaaggtacatactttgcttgcatacttgtgagaagatgatcacggactgaagtggagcctacaagagctgctgcaattttagaagaaccacactctataaccaatctgttttaaaggagaaatttgatgtcatagatttattttagaccmtttttaaaaaagggcttgattttgtgtgaaggcaaaattgacctatttaatgaaaagaaacagcttagaatctcaaagggttcattgctattttgaatacacgcaattatgtctttagatctttcacacctttgtcattcatgtcatgaaaatgccatataaagttacatcacaactgtgtatcataagtaaacaaaaaacaaattcagatgccattcattcagtgtgggttagaacacgaaacatcatattcacattcgttttaaatataagtgatatattattatcaagtttaacaat

SEQ ID NO: 161983 - DNA, 601 bp, Human
tttattgccagaatttggaagcaaccaagatgtccttcgataggtgaattaacaaataaactgtggtacattcagacaatggaatgttacttagcactaaaaagaaatgagctatcaagccatgaaaagacatggaagaaaattaaatatggccaggtgcggttgctcacacctgtaatcctagcactttgggaagctaaggcgggcggatcacctgaggtcaggagtttgagaccagcctgaccaacatggtgaaaccccgtctctactaaaaatacaaagttagctgggcatggtggcrggcacctgcaatcccagctacttgggaagctggggcaggagaaccgtttgagcctgggagatggaggtagcagcgagccaagatcatgccattgcattccagcctgggcaacaagtgcaaaactccaagtccaaaacaaacaaacaaacaaacaaaaaataaaacaaaaaaaaaaaaacacacacaaaaaaaaaggaaaaaaaaaggaaaaagaaaaagaagaaaaaagaaaattaaatgtatattactaagcgaatcagaagccaatctggaaaggcgacataatgtatgattccaacc

SEQ ID NO: 161984 - DNA, 601 bp, Human
tccagtcaacaaagcctctcacatgaaaacaaatttatattttattttgatctgttctattgaaaagacaacatagatgtgtacagcagctttatttattgccagaatttggaagcaaccaagatgtccttcgataggtgaattaacaaataaactgtggtacattcagacaatggaatgttacttagcactaaaaagaaatgagctatcaagccatgaaaagacatggaagaaaattaaatatggccaggtgcggttgctcacacctgtaatcctagcactttgggaagctaaggcgggyggatcacctgaggtcaggagtttgagaccagcctgaccaacatggtgaaaccccgtctctactaaaaatacaaagttagctgggcatggtggcgggcacctgcaatcccagctacttgggaagctggggcaggagaaccgtttgagcctgggagatggaggtagcagcgagccaagatcatgccattgcattccagcctgggcaacaagtgcaaaactccaagtccaaaacaaacaaacaaacaaacaaaaaataaaacaaaaaaaaaaaaacacacacaaaaaaaaaggaaaaaaaaag

SEQ ID NO: 161985 - DNA, 601 bp, Human
aatctggtgtccagtcaacaaagcctctcacatgaaaacaaatttatattttattttgatctgttctattgaaaagacaacatagatgtgtacagcagctttatttattgccagaatttggaagcaaccaagatgtccttcgataggtgaattaacaaataaactgtggtacattcagacaatggaatgttacttagcactaaaaagaaatgagctatcaagccatgaaaagacatggaagaaaattaaatatggccaggtgcggttgctcacacctgtaatcctagcactttgggaagcwaaggcgggcggatcacctgaggtcaggagtttgagaccagcctgaccaacatggtgaaaccccgtctctactaaaaatacaaagttagctgggcatggtggcgggcacctgcaatcccagctacttgggaagctggggcaggagaaccgtttgagcctgggagatggaggtagcagcgagccaagatcatgccattgcattccagcctgggcaacaagtgcaaaactccaagtccaaaacaaacaaacaaacaaacaaaaaataaaacaaaaaaaaaaaaacacacacaaaaaaaaagga

SEQ ID NO: 161986 - DNA, 601 bp, Human
agctaataaaggctgttgatgtttgctgccttcagtgagtgaccctttccctgtaagatgactgggaagaaaagcgatggctttgtttgttctgtttctgcagattaatctgacccagctcaggagagcttcactgtctagatttggggtatgcagccaagatggtgaaaacctcacctttctgagagggattctgtggaaggaaaaaaatcatttggtcctaaatgttgcttaggggaatgtgtgtatgcataattgtgtgtgtgtgtaatgtgtgggggtgagtgtttgcaggcagggmagcagacaggcaaatacgaaatctatgtatgcgaatgatttacttcttgttttgaaaatatctcatccagaaagaggattaaaaagctaagtgtttagatattttgacaatatccctttttccaatttagtttaatattagagttcatcaatctaaatcttaactcatatattcttcagcttaactatctgaaaataaatccagatatctgaagcttcatgaagacaaactcttgggtaggcatgtccagcctgtggggcactacataccattgcactgtcctgtggaggtgaagcggta

SEQ ID NO: 161987 - DNA, 601 bp, Human
aatttcctttcatctactgccctatttcatgatggtttaaataaatgaaaaatgaaacatggggagtactttggagttctactggtaaaactagagcagaaatctaggtttccacaagcaccagaatttgaactcttagatgatcatatttgaggttgggataggaggtctgaacaggctactgtggaaagaaacccaaatagtcaacagagaaagagaggaaaccacaaggaagtagctgggaagaaactgttccttgtcttttgtggggcaagacatttcagaagggggttgcatttgytctaactatccagcttctgctgtcagactagcatcctgagctcagatatctaattattctctcagctctctcagcaataatgtgggtgctatggccaggtgtgatttgggatttgaaataatgtgcttatgaattcaaataaggatctcatgatggagagaaagttttagttattttcattttaaacagatgcacaaaggagtactttgcagcatgcctgaaaaaaaaaatgccaagtatagaatagcatttaaagatattttaaaagtaagacataaataaagacatttctagaatgag

SEQ ID NO: 161988 - DNA, 601 bp, Human
catcctgataatagagaaatcaggaaagagatttaaaatcctgagctctttttcctctagaaaaatgattaacttttctttgcctttgtaggatttataaatttgcctttgagaatctggtacacactataaacccttccaaaaaaatggtcatctcacactcaaaaactcaaaagaaaatccacatcaatattacatatgaataatagcctattaacattaatatttttgtattaatatctttttcaatttaccccttagtcaattttttctaaactgacagccaaatgaataacaaagraagaggtttatcatgttcagattgccaaagattaaataggatatcactgctgcatatctgtctgtgtttttattttgtatatagcaaaaatactactaaaagacttagtattaaattttatccatatttagaatcaaatgaagctttcaacagcatatgaaaaaaataataataattgcatacttacccaagcacatggtttggtcatcatttgttttaaaaccagtgtggcaaaggcaataaaagcttccaactgtgtcaatgcactgcccatgactgcatatattggggatttcttga

SEQ ID NO: 161989 - DNA, 601 bp, Human
ttaaacattactatattaattgttctttcagctgtgaatctgatttatgttcttaatgtcccaaaaagacttaatggtattgctttaaagtagaaaaataaaggaaggaaaagaagaaaatgattcattacacactgaagtttattctaaatcagcatcctgataatagagaaatcaggaaagagatttaaaatcctgagctctttttcctctagaaaaatgattaacttttctttgcctttgtaggatttataaatttgcctttgagaatctggtacacactataaacccttccaaaaaratggtcatctcacactcaaaaactcaaaagaaaatccacatcaatattacatatgaataatagcctattaacattaatatttttgtattaatatctttttcaatttaccccttagtcaattttttctaaactgacagccaaatgaataacaaaggaagaggtttatcatgttcagattgccaaagattaaataggatatcactgctgcatatctgtctgtgtttttattttgtatatagcaaaaatactactaaaagacttagtattaaattttatccatatttagaatcaaatgaagct

SEQ ID NO: 161990 - DNA, 601 bp, Human
cggcaagttccattcccacaggcatctctttcacattcatttatgtctagtaggaagaaaggccataaagaaacataattataagtagaaaaagtggttacacggttacagtggctaaagagcattttagggttcaccaggcctcatccataggctgagaacttcttgatgttggtatcagctccagcagcagtcatccctgcaagataccaggcagcggcaaagctctaaatcttgggaataaatggtttccttggctggccagtgaaaggaggcaagctaaggacatgagacctgaacragaattattttattctatttacttctagaattctccacccttgccacttttctcaaatattttcacttgaaaatggaaaaaactctgtgtgcatctgggtcttgaggtgttgccacctttggcaaacttcaaccttcaagattctcactccagtttaccaaaaagcagtgactcacctggcattaccccacaatcagcaacaaaataactcagctttctagctcacctgtcatttcagacaacttttcctttttccctacacccataaaaacatagaacaacttccaccaatgatgactt

SEQ ID NO: 161991 - DNA, 601 bp, Human
ttgttatgcataagatagcatacatttttaaaagacagctggaacactagagatgatgctaattacaaagaacacatataaaactgacttcctttgctgatgcacaattttgcacacgcacctatacagtcattgttgtgagaaaggatgaaaccatgattgcagcggcagttgaaggaaccaattgtgttccggcaagttccattcccacaggcatctctttcacattcatttatgtctagtaggaagaaaggccataaagaaacataattataagtagaaaaagtggttacacggttamagtggctaaagagcattttagggttcaccaggcctcatccataggctgagaacttcttgatgttggtatcagctccagcagcagtcatccctgcaagataccaggcagcggcaaagctctaaatcttgggaataaatggtttccttggctggccagtgaaaggaggcaagctaaggacatgagacctgaacaagaattattttattctatttacttctagaattctccacccttgccacttttctcaaatattttcacttgaaaatggaaaaaactctgtgtgcatctgggtcttgaggt

SEQ ID NO: 161992 - DNA, 601 bp, Human
gcaaagtagacataaaaattatagctgctaataagcattttaataaaagtaatggatatagttacagtggttccctcttatctatggttttgctttctgggggttcagttatccaaggtcagctgctacccaaaaataggtgagtatagtacaataaaatattttgagagagagagagacagtgcacaagaaagtacagtcatataacttttattacagtatactgttataattgttctattttcttattagttattgatgttaatctattaccatgcctaatttataaattaaactttargtatgtatgtgtaggaaaaaacatggtatatagagggttcagtactatctgtggtttcaggcatctgctgggggtctcagaatgtatccctcacggataaggggagacttctgtaatatatttcatgttgagcacattgtatttgacaagtcccataaccaattgttatgcataagatagcatacatttttaaaagacagctggaacactagagatgatgctaattacaaagaacacatataaaactgacttcctttgctgatgcacaattttgcacacgcacctatacagtcattgttg

SEQ ID NO: 161993 - DNA, 601 bp, Human
taaatggaatcaggagctatttttagctgcaaagaatcgccacttaaaaaatgtagttcggaaatactgggagtaggacacagcattcctaacaaatgtgtgaaagcacagtggaaaagagtcaggatcatatgatcagtcatatgcacagaacaaaataacttcattagagattagcatgataattagtgcttcttgtcttgccagaaggatgagaccatgtcatacctatgcccttgcatttgtttctgataaagtattccaaaatgaagacgtcattacaaaaattctcattctgctwagtccagtggacacccgacactcctcatttgctacaactgatagctttcctaccttcacacttctcattttgaagactgtatccaggtgggcaaatgcatctgtaggacccatccaagttttgacaggtacctggtgcacattttctgggttctagaagacattcattgatatctgcaaagaaaagggaaaaataaggaagaggttcccactggcatgacttccatcaaacaattaaaattcaaaaaaactagaatgaatcaaagaaatacataaagcaaattaaagttcataaaattcc

SEQ ID NO: 161994 - DNA, 601 bp, Human
tgtgggttaatctttctgaagacacaaaaatacctttcttgtacaggctttttctttcatcatatagacaataggaaactgtacacttagaattgtggcatgttttctttagtatattatacatcttagctcctgtacagtggtagttaagagtagccaataagaagtttgaatggcttgagtaaccatatgtcctagtttgcctgggggagccccagctcatgccagttggcctgactttattgttaatagtgcccttttctactttcaaaattggcttgggttggtcaataaaacataygattacctatggaaaaatatgcccactctattccaacaaactcacttatctttcctcctgactttcagcaggaatttttagtgaacaaagtggtaagtcttaattctgagccatgctacttttatgagaatacttttttattttttcaacaaaacacaaaatatccttgtatcctgggctctttatttttatatttgtgcaaaggtttctactcacaccaaaatgtacttgcattatacaactttattctcaagaggcccaactaaggaaaagttgagaaattaaccttattatcttgac

SEQ ID NO: 161995 - DNA, 601 bp, Human
tcaggaagcagaaatgctgagactttaagcacattgctagtgactcactcaatgtgagatctaggcctttgatccaaatttactcccctccaaccacccacagaacttttcccaataccctatgctatagccctaaaactgtgaattttacaagaacactaagactcatgaaaataagtataatcctatgaagtgcaaactaacgatatcatagaagatgacactcctgatttgtgggttaatctttctgaagacacaaaaatacctttcttgtacaggctttttctttcatcatatagayaataggaaactgtacacttagaattgtggcatgttttctttagtatattatacatcttagctcctgtacagtggtagttaagagtagccaataagaagtttgaatggcttgagtaaccatatgtcctagtttgcctgggggagccccagctcatgccagttggcctgactttattgttaatagtgcccttttctactttcaaaattggcttgggttggtcaataaaacatacgattacctatggaaaaatatgcccactctattccaacaaactcacttatctttcctcctgactttcag

SEQ ID NO: 161996 - DNA, 601 bp, Human
actcttacaataataaaggtatttttctgtaccataacactgtggactggacttctaggttgtcatgacttcaaaagaattagttttgacagttattgatataaaaatggaatgtgcaactgccttctaaggggtgcagtgacaaacgtctcttacccagactgagttgcttggctaactagaaaagtcagagtaatttcatagtaccctaggccaggaaagaagcatgaaattctagagtcacactgcaccattgttcaggaagcagaaatgctgagactttaagcacattgctagtgastcactcaatgtgagatctaggcctttgatccaaatttactcccctccaaccacccacagaacttttcccaataccctatgctatagccctaaaactgtgaattttacaagaacactaagactcatgaaaataagtataatcctatgaagtgcaaactaacgatatcatagaagatgacactcctgatttgtgggttaatctttctgaagacacaaaaatacctttcttgtacaggctttttctttcatcatatagacaataggaaactgtacacttagaattgtggcatgttttctttag

SEQ ID NO: 161997 - DNA, 601 bp, Human
cttttgatttttgtttaaaatttgaaagtcattggcaaacccttgaaaatctttactcaaatagttgacaagtattattcctaaaaatgaacaatggcccagcaagaatcctgatcagtttaaatttatttttgttttcttggagaatttgtgatataagggatggttaccatattgtgggggcaaatgggttaatgtgcagtttttcagtctcaagtctaactttggacccacatttttcagcttatctcttcagaggtaggggatatgtagctcaacttcccccaggctttgctgtttyggtggctcaaggtgtttccccactgatgggcctatcagcatttgtgttcttagtgggagagaggtttatgtgtcagtacaattgtataagcaaccataacttgatggatgagtttttaaccttaaaagtgaaaatgaaccttctgacatatggttatcattagacctctgggtgaatgaaaactctccatcttcctgttcacaaagaaacagagctttgccatgtttgaaaaataagaccaccacaaataaacatgcagcattgaaagcccaaagccttcaaagacacttaccttggcac

SEQ ID NO: 161998 - DNA, 601 bp, Human
cttaatgacctcgaaatttcatcagaactacaaaagtcactttccctgcttgcattcctcagttctggctctgcctcctggagctgagcatgtggcagggctgctcacagctgggctgattcttcctgcagcgttagcttgctctgtgatgggccagtgcaaattgaattaatagcctaggagtttcctctggcctgccacatcggcagattcacacctggtttctcactgctttctttccaaattcaggccaagccaaaggcacacaaaaacaagggagtaggagttagaatttatctgrctggtctgtaccatgcagaatatctgttcgaattaagcaccaccctgaaatccacacagaccactgacaactaccaacaagctgaaatcaaccggagaactctcaaccctctccttcttacttcccaaataactagttgaaaagtaaaaagttaatcagatcattagaataaaaacaagagtctacaaaggactcagaaactaacaaagctttgtcacagtaaggctggttgggcaaatattattgttgtttaaaatgaggaaattgagcttccaaaagattaaatgacttgctctagac

SEQ ID NO: 161999 - DNA, 601 bp, Human
aaatttttaaaagaagcttgtttagctcaacacagagagggaaggaagaggagggcagggctgtgggtgggtgggaacagaatagtctttctttgaaagaatatatttcaatattgattattgctttgatgactccaacaaagaagatgggatctacttcctataaaattctccaacattgcttgacataattttggaaacgggcttttccatttctcatacaacacattgactccaaaaagtgagctcaaccagaggtatggactgtgttttccctcgaacttgacttcttaaagccttscaaaactcctctcattacacagaggccacaatctgcaggtttaaaagaaatgctttcatacccatattgtactattcttctttctttatatctgaccacctctgcctttttcattcacttccatcactgtttttcaatcccaggaaccatactatcataaccacctaagcacttctgttaagacagtctcaccagcttttatttcatgacaaagaagacaatgtaggaataacagagttgccagagataacaaaggaaaggttttcatgaattaaagtttctatctatctatctattata

SEQ ID NO: 162000 - DNA, 601 bp, Human
gtggtttattctgtgtcccctaaactctggaactaaaataaaatcccagatcacaggcacagaacaaatacagaagtggcaactttgtagatgggcaaaaatacaacacaagggttggtcactgaagcagatactcccggagatgctggctacaaaatgcaagtggggctttttgtagattttacacacacacacatatgcagagctgtgtcaatgttaaatttttaaaagaagcttgtttagctcaacacagagagggaaggaagaggagggcagggctgtgggtgggtgggaacagaayagtctttctttgaaagaatatatttcaatattgattattgctttgatgactccaacaaagaagatgggatctacttcctataaaattctccaacattgcttgacataattttggaaacgggcttttccatttctcatacaacacattgactccaaaaagtgagctcaaccagaggtatggactgtgttttccctcgaacttgacttcttaaagccttccaaaactcctctcattacacagaggccacaatctgcaggtttaaaagaaatgctttcatacccatattgtactattcttctt

SEQ ID NO: 162001 - DNA, 601 bp, Human
tgtttaatcaaaagattatctaataatgcaataatataattgctatctaaatgaagggacaaaaaagtagcacttaattttccaagatagatggagaaaaataagaataactagagaagaagcagattgagaatactgagaaatgctgagaatccagcacaggcaactgaccaactgctgaatcatcaggtcccacgatgatcccacttccataaggacatatctggcggaaggcctctgtggtggagacactcattaatagatagaacaatagcaattcattacaagcttctccacaagyattttgaggtagaaaattgctacatgctgtgcatattgataaatgatggaaaaaacaagcccagaaaccagaggaagttatttaacgagactccctaagatgttgtgtctactccttgggcatctgtgattcatgacataattaaaaagaaaataactaccaagctcctgagataaaataatttttaatgaacattctaattagacttacaattaaattaaattgtgttactgtctttaaggcctacagtcttacttacatcatggccagtctgcaccctgcatggcccagagagaaatg

SEQ ID NO: 162002 - DNA, 601 bp, Human
ctgtcaagaatattatttctgtttcaagttaataaaaatcccgataccattgatctttagagctgcaaaggtaattagaaatgttattttacttgcataatattatattctaaggcctagaaaagctaaaaaaactgcttaaactcccacagccatagctggagctgaaatcttcataacctgatttcttgtatggaaaaagtactttctaattcacacagacaaactctcagcatttatgctagtattaattatgttatattgaatcactctggaattcttagataactaaatatgatcyttggatttaagttagagttagtgttgattaagggtcaaaggccagccagaggagccattatttgacattttaaaaacagggttacaaaaaaaagattgtgtactggttatatagcctttcatcttactaaatgtaaaagaatccagataaaatttttatttgataagggaataagattatgaccattaacaatttttaaaaaatttcacaaagactttcattatgatgttgtcctttctagtatctcttctgatatgtccagtgtctgccttcaccattaggctgtaaggtccatgaaag

SEQ ID NO: 162003 - DNA, 601 bp, Human
ctcaactatcatgttgctccccaaggccagtgctgactaagaacacgagtgagagcccagatcatgacttagtcacaacctttaaagatttaccacaactctgacaatgggcatttgatagatcatatctgatgaagagctctctttgctaccaactttattctctgccttcacctctccttcattctttccttaggccagtgaatccctacttgagagtgtatcagatcacctagagggctgctgggctccaccccactctcggagtttctgatttaggaggtcttggatgaggcctcamaatgtgcatttctaataagttcccaggtgatgctgatacagctgctcctgggaaccaccctttgagagccactgctctagacactccctccctttccttctttccatacattccaccaggcttacggatggacacttttcagatgcttatatattacaggcaaccgcttttgctgtgattgcctccaaatggctacaggatgatggtgggtatcttagtgtgcagtgctcctagaaatagaaaagaagagaaaaagagaaaagaaaaagaaagggagtatgagagacagaaagaaggaga

SEQ ID NO: 162004 - DNA, 601 bp, Human
ctgttcatttaagatattgacaggagcaaatcagagctcttcaagagcaaactctatgattactgcagtttgtgaaatagagcctagttcagtgcttaggaaattgcaggtgttcaggaggtatttttaatggagatggtttagctaaagtagattccacgtgttaccccattcttgaaatagaatatcctttggtgttctcagagcattttgtatatataatcaccatagcatttatcacactgtattatgagaacgtatttatatctgtctcaatctcttcatattgggttttttgaaygtggggaaatgtctttttctttctattcccatatcttgtagaaatactggcgtgttgtgagcatgcgatgcacagtgagacctaataaaggatgtgcagtgcagtcctcaacttggcttgatgatgcttccagctacaatttagggggaaacgtggcagtgacaacccccgtattgtccacggactatttatattccaattcccagccttctcctactaagggaagctttgagggacatctcccctcacagataaagcttcctggcttagatgaccttgaacacgatgactcacctttgc

SEQ ID NO: 162005 - DNA, 601 bp, Human
taatcaactgatgacctcttcaagaagcatgattctgatcatgccttttctctcttctccttcccttattttttatttatttttatttttatttatttatgtttttgaaagagtctctctctgttgcccaggctggagtgcagtggcccgatctcagctcacttcaacctctgcctcccgggttcaagtgattctcatacctcagtctcccaagtatctgggattacaggcatgcaccaccacgcctggctaattttttttgtatttttagtagagatggggtttcaccatgttgtccagkctggtctcaaactcctggcctcaagtgatccacccacctcagcctcccaaagtgctgggattacaggcatgagccatcgtgcctggctgtccctttatgttttatactcctttgttgaagcatgatttctaattcttgttgactaattgaactaaaagggcctcatgtaattataatataatggatatatcttaatataacaataattataacagcattataatcacaatatatgataaggcaataattataatagtactacaatcataatggattgtaagagtaacaaaccaaagctta

SEQ ID NO: 162006 - DNA, 601 bp, Human
gtgttgaggcagcgcccattctcacagatccctggcttcgtctgacattcattctcatctgtttgattttattgaaggaccaaaaacaagaagagtcatctgaccattttatagaggatggagctccttccttcgttccttccttcctccctccctccttccctccctttgttcctttctcctttccttcctcccttccctccctctcaccttccttccctctctcacatctttccttcttaacttagcttttgaatcactaatctgttcacatggctcaaaatttaaaaggtataaaagrgacttcaattcattcttaactgtttggtttcattgaaagactgaaaacagaaagagccatctgaatcttttatagaagaatagattttcttctttcctatatagtttgtaaatagcttatctcttcacatggttcaaaattaaaaaggtacaaaaggagattcagcaaaagtacccccttcatttcctatttcccagacaccaaactcccctcctgaaaagcaaccaattctggggccgatttctaatgtatccttccagagctggattatgcatataaaagcaaatacatacataatat

SEQ ID NO: 162007 - DNA, 601 bp, Human
acactcacaggtgtagctcccacgggtgttgaggcagcgcccattctcacagatccctggcttcgtctgacattcattctcatctgtttgattttattgaaggaccaaaaacaagaagagtcatctgaccattttatagaggatggagctccttccttcgttccttccttcctccctccctccttccctccctttgttcctttctcctttccttcctcccttccctccctctcaccttccttccctctctcacatctttccttcttaacttagcttttgaatcactaatctgttcacatgrctcaaaatttaaaaggtataaaagagacttcaattcattcttaactgtttggtttcattgaaagactgaaaacagaaagagccatctgaatcttttatagaagaatagattttcttctttcctatatagtttgtaaatagcttatctcttcacatggttcaaaattaaaaaggtacaaaaggagattcagcaaaagtacccccttcatttcctatttcccagacaccaaactcccctcctgaaaagcaaccaattctggggccgatttctaatgtatccttccagagctggattatgcat

SEQ ID NO: 162008 - DNA, 601 bp, Human
gaagaatttagctgcagggtggtgctgagcccaatggacaatcacagtcattacggcatctccaaaatatgaacattttttatccttcctcagattttgacattttcttgtattttaaataagaagtctgggtttccagcatcccagtgtggaggctgaggttaggaaagtgcggtgccaactgtactcaccaaggcactcgtcctggttggggctggcggtaaacccatcattacactcacaggtgtagctcccacgggtgttgaggcagcgcccattctcacagatccctggcttcgtytgacattcattctcatctgtttgattttattgaaggaccaaaaacaagaagagtcatctgaccattttatagaggatggagctccttccttcgttccttccttcctccctccctccttccctccctttgttcctttctcctttccttcctcccttccctccctctcaccttccttccctctctcacatctttccttcttaacttagcttttgaatcactaatctgttcacatggctcaaaatttaaaaggtataaaagagacttcaattcattcttaactgtttggtttcattgaaagac

SEQ ID NO: 162009 - DNA, 601 bp, Human
ctggaagggacattatatggcaaaggggatgtcaggaaattttaagagcaaacaaaatattaaaaatttggtcagatataaaaaccaaaaaaggatgtaacactttaccctgggtgagaagaagcaagaggggaaagctggagacagcagtaaaagagaaaggatgacgtctgagggaaacaaataagacattcagtaagtaggcagaaagacattggcctagacaagcttataactctctctgctcccagaaatacaggggaatagccatgcttacagacagaggggcagagaaacatayggaagtggatcctgatcaccaagggcttcaaaggcagccaagaaattccaaacaagtgattcaggatccaattagcaaaggaagaatttagctgcagggtggtgctgagcccaatggacaatcacagtcattacggcatctccaaaatatgaacattttttatccttcctcagattttgacattttcttgtattttaaataagaagtctgggtttccagcatcccagtgtggaggctgaggttaggaaagtgcggtgccaactgtactcaccaaggcactcgtcctggttggggctggcg

SEQ ID NO: 162010 - DNA, 601 bp, Human
aaaaacaaaaaacaaaaaaaacaaaaatccaaaactgacaactgcctgcagtgtttatccaacattgtttcccacatctcaataaaaccctctgctttgaccaggcctcttttctcaacgcctcaacttctaagttgcattctcaactccaatgttatttcaaaataccaagagatgaaatgttgtgttctagcttctagctaaactttaatgataattttaaaattgtcgcatattcaggaaaaaacattagtgactttattttatcacaaattcaaccactatgccctcaccatctgcrcaactgctttggagctgcagatcagtgccagctttgccagtgactgcttccactccacagggccagttcctggctagagtaacatctggagtggacctacactgagagaccctcccgagacctgtcctagttccggcttctcttataatgctgcctgtcctgtgctctttccactgctgagatcttgactgatatgcactctctgttcagctttctcagagtctgtggactggtttcccctgtctatggcccaaggagcttggctggagcatcatgacacatttgctgaagctcacctgc

SEQ ID NO: 162011 - DNA, 601 bp, Human
ctttgagctcacgagtttgagaccagcctgggcaacatggcaaaacctgtctctagtgaatatacaaaaattagctgggtgtggtggtgtgtgcatgtaatcccagctacctgggaggcagaggttgcagtgagctgagatcgcaccactgcactccagcctgggcaacagagtgaaacttcgtctcaaaacaaaaacaaaaacaaaaacaaaaaacaaaaaacaaaaaaaacaaaaatccaaaactgacaactgcctgcagtgtttatccaacattgtttcccacatctcaataaaaccstctgctttgaccaggcctcttttctcaacgcctcaacttctaagttgcattctcaactccaatgttatttcaaaataccaagagatgaaatgttgtgttctagcttctagctaaactttaatgataattttaaaattgtcgcatattcaggaaaaaacattagtgactttattttatcacaaattcaaccactatgccctcaccatctgcacaactgctttggagctgcagatcagtgccagctttgccagtgactgcttccactccacagggccagttcctggctagagtaacatctgg

SEQ ID NO: 162012 - DNA, 601 bp, Human
gttaaaacataaagagaaatgttgaagctggaaatgaatttgctggcttagttctcttctgtttgctgtttttaatctactcaaatgaagtcatcaaaaacaaaatctgatttctttagtcgtgattcttcttaggataaaccaaaattgagcaatcaggaaggaaacaaagcaaaggaaaaattcattttaatagctaaaggcacttttaataaaactgcctccaggccaagcgtggtggctcatgcctgtattcccagcactttgggaggccaaggcaggctgatcactttgagctcasgagtttgagaccagcctgggcaacatggcaaaacctgtctctagtgaatatacaaaaattagctgggtgtggtggtgtgtgcatgtaatcccagctacctgggaggcagaggttgcagtgagctgagatcgcaccactgcactccagcctgggcaacagagtgaaacttcgtctcaaaacaaaaacaaaaacaaaaacaaaaaacaaaaaacaaaaaaaacaaaaatccaaaactgacaactgcctgcagtgtttatccaacattgtttcccacatctcaataaaaccctctgctttgac

SEQ ID NO: 162013 - DNA, 601 bp, Human
cctcaacaaaggaatttcaaataaatcatgacattttaaacaaatttttaaatgaagcgaaagatgaatgattctgcaaattttccagagctttgaaaagatctatttaagttaaaacataaagagaaatgttgaagctggaaatgaatttgctggcttagttctcttctgtttgctgtttttaatctactcaaatgaagtcatcaaaaacaaaatctgatttctttagtcgtgattcttcttaggataaaccaaaattgagcaatcaggaaggaaacaaagcaaaggaaaaattcatttkaatagctaaaggcacttttaataaaactgcctccaggccaagcgtggtggctcatgcctgtattcccagcactttgggaggccaaggcaggctgatcactttgagctcacgagtttgagaccagcctgggcaacatggcaaaacctgtctctagtgaatatacaaaaattagctgggtgtggtggtgtgtgcatgtaatcccagctacctgggaggcagaggttgcagtgagctgagatcgcaccactgcactccagcctgggcaacagagtgaaacttcgtctcaaaacaaaaacaaaa

SEQ ID NO: 162014 - DNA, 601 bp, Human
caaggtgtcaatttagaccctcctcccctcaaaaaaatataaagagatctttaggggatccaagaaaacacaattctaattggagaaatgcaggaattcctcaacaaaggaatttcaaataaatcatgacattttaaacaaatttttaaatgaagcgaaagatgaatgattctgcaaattttccagagctttgaaaagatctatttaagttaaaacataaagagaaatgttgaagctggaaatgaatttgctggcttagttctcttctgtttgctgtttttaatctactcaaatgaagtcrtcaaaaacaaaatctgatttctttagtcgtgattcttcttaggataaaccaaaattgagcaatcaggaaggaaacaaagcaaaggaaaaattcattttaatagctaaaggcacttttaataaaactgcctccaggccaagcgtggtggctcatgcctgtattcccagcactttgggaggccaaggcaggctgatcactttgagctcacgagtttgagaccagcctgggcaacatggcaaaacctgtctctagtgaatatacaaaaattagctgggtgtggtggtgtgtgcatgtaatccc

SEQ ID NO: 162015 - DNA, 601 bp, Human
cacacaggccacctccacaaggattcaccagctggatcgcagctgaagtctccacccaccttcacagctggagccggtctgatcaagtgagaatccccgctggcattcacaggtgaagcttccaggagtgttctggcaaatgcccttagacccgcacagattgatgtcagaggtgcattcattgttatctatgagaagcagtgggggcaaagaggggttaaaattccccaaagctctctttgtatcatttaaaagaaaattagaaggataactcggaaaaggccaaataaggccaacaackcttcacatacatgtacaggtgtgctcacacatacatgcactcatatatttctttgagcttttattttcttatcccaacagcagaggaaatagaaaataatcccttaaaagaatcgctacaatccatgtaggattttttcctctcctactcaccaatgcaggacgtatggtgttgggtaaatccgggaggacatttgcatgtgaagccgccaatggtgttaacacataggaactggcagttgtgttgcttggttgcacactcatcaagatctacaagaaaatgcaagagaggcatttgagt

SEQ ID NO: 162016 - DNA, 601 bp, Human
ggttaccctcacactcgtccacgtctgaaaaagaagcagagccaccatgatgccaactcaacatctctctctgaagccagatggattctaataagaaatctggcccctacacatcctacacattattctaccaccaaaaacttcaagaatctctcttctggaactgctgctaagtccaaggagaaaatcattcagagagccctggcaaagtctacaaataaaaattgtcaggaaattagtgcaaagcccaaagcactctctgggacagctctgtaagttataagttatttgtgtttgctcttttttttttttatttttggtgccacaattagaaaccaaaacgtgtcaaagccacagtcaacttctaaaaatatcatttaaacttctaattaaatgtcatcagaagagctattcctcatatgtttagtccacatgggggaaatccctttatggctctggacccagtgaccagaaaattaatgaatcaaaatcaagtatatttttcttgactgagttattccctattaggttaaattaaaaacttagcagaaaaagtcttgatatacttaggaaaggcatgtgtgttagacacaatcaagca

SEQ ID NO: 162017 - DNA, 601 bp, Human
aaaacaaaacaaaacacacaaaaaaacacaaccttgctgtgtttcctgcttgcgctctgtctcaaaatgtgtagagctgaacagaactactttggcatcttcaggccaaaagccactcaaaatagcctttggctggctgatatttttcagtcataagtaagattttttgacccctgatatgaacataactcaagtgtgggctgatgactagcagtgcagcgggagggtggaggatattgcgcttcaagaaattctgggggcatttcatttcagatgctctcaaagcaccctcaattataattttttttcttagtttgctgttttgcaaagactgttacttacctcgggtttcaaccaggttagggcaattttaaatgagtatttgttgcttcaataacacatttacagcttcagaaagcaagcagtgttttgcttcataggacctgatagccatgcatcttgagagtgaggaaaagttacttgccaacacactggttccactggtagtgctggaggtagccctgggggcagctgcacctgtagcccccaatgatgttctggcagccatgctggcagcggtggttaccctcacactcgtcca

SEQ ID NO: 162018 - DNA, 601 bp, Human
aaagttaagagttgtgggttctagttccaagcatgtcacaaaagaactgggcaaggaaatattaccgtccctttctggacttctaggtccttatctgtaaaacaaagtgcctgagctaagtggcttctggtatccctccaaactcacaatgttttgattctctgatgtgcattaagagttattttcccatgacattgtagaatcaaagatgacatcatttcaatttaatgagagagtcagtagatctcccttaattatcaaaagaatttagcaatcttgaaaaacaaaacaaaacaaaacaaaacacacaaaaaaacacaaccttgctgtgtttcctgcttgcgctctgtctcaaaatgtgtagagctgaacagaactactttggcatcttcaggccaaaagccactcaaaatagcctttggctggctgatatttttcagtcataagtaagattttttgacccctgatatgaacataactcaagtgtgggctgatgactagcagtgcagcgggagggtggaggatattgcgcttcaagaaattctgggggcatttcatttcagatgctctcaaagcaccctcaattataattttttttctt

SEQ ID NO: 162019 - DNA, 601 bp, Human
ctctacatcagaaagttaagagttgtgggttctagttccaagcatgtcacaaaagaactgggcaaggaaatattaccgtccctttctggacttctaggtccttatctgtaaaacaaagtgcctgagctaagtggcttctggtatccctccaaactcacaatgttttgattctctgatgtgcattaagagttattttcccatgacattgtagaatcaaagatgacatcatttcaatttaatgagagagtcagtagatctcccttaattatcaaaagaatttagcaatcttgaaaaacaaaayaaaacaaaacaaaacacacaaaaaaacacaaccttgctgtgtttcctgcttgcgctctgtctcaaaatgtgtagagctgaacagaactactttggcatcttcaggccaaaagccactcaaaatagcctttggctggctgatatttttcagtcataagtaagattttttgacccctgatatgaacataactcaagtgtgggctgatgactagcagtgcagcgggagggtggaggatattgcgcttcaagaaattctgggggcatttcatttcagatgctctcaaagcaccctcaattataa

SEQ ID NO: 162020 - DNA, 601 bp, Human
gggaccctgactaataaaacctgcaaggcgtgggtatatgagggggaagacttgtcattctatagcttagatttattctgtgttttttcctccaaagagcagaagtaggaccaatggtgagaaattagagggaggagaaatgattttttttatagcaaaaaaagacatttctaagtattaaaagctgtctatacatagattgggctatcttgggagaaagtgggcacccttcaaggtggtatttaagccaaactgggataagcaaggaagttagagaaggatttatatattaggaaagagrgaaggctagatctctaaggttctttttaactttgagcatctatctgtgttactacaactatcaagagttctccccctctcctttcacattcttttaaattttattttacattttctcccttccctgagaatttaataaagtttaaattaaacttgcttatctaggttggagaggtaggatggagtagagcacagattaaaataagaaattggcaaatattcagtgtttacagtttgaaaacagcatgtttgtgcactcgccctttttatcaatatacaaacaccacgatttggttaacat

SEQ ID NO: 162021 - DNA, 601 bp, Human
ttcctcggcccatgcccattccagaaacacagtgcctgcagcagaaggggagcatagatgtttttcattagaatgggaagacaaggtaggtggtacaagagttctggtgaagcctgttccttgcagttgtgagatacagcccttgcttgtccactggaggatcagctagttctgagaactacattgaggtcctctgtttggcctctaattcccagttccctgaatgtattgatttccttctactgcctatcaagaccctgtcttggatatttatttatctcttcattcccaaacctaacayggaaagcattttgcagtacttatactggggaggagacacagagtggaaacaagagaatagtagatgagggaggccatgtaacttgggaggctaaataaaaatggcttctttttatgaaacaggctccatgggagtgagcaaggtgtgagacatcactgttgagtttcttgcattctcccacttccatcattacttttcctcactcaagctttggagcaattgctcctattccttgacgtttcacttttgcttatgctactgaggataagaagaaagctccggttgataatgaaggttaat

SEQ ID NO: 162022 - DNA, 601 bp, Human
cttctcaacatcccaacttgcaagactcacattggcttctgtctcagactgatcctggaaagacacatggcaatatgttaaatacaatgtacatatgccacttagctctcatattaaagaaaaaatgactcaaatttcacactaatacaattttctgccttatgctgcatacacaatattgaaagcattttgtttagaccacaagtgtattaaattggcacatatttgtaatatttgaaaatattaactgatgtcaggaagaaaggcaggttgaaatcatttgtatctggaggtctcaaartgtagtccctgaacaagctgcatcagcatcacctgggaatctgttagaaatgcaaattctcggcatcaccccagaactactgaatcagaaaccctgggatgtctcccaacaatcaattttaacaagacctagtaggtgattcagatgcatgctaaagtttgagaaccactgttttaatagattatgttctttccaaagacttatctcatttcttaaatgacagcagatgggttgcagcaccaatacgaagaaccagactatttcaatttgattcattgacgtaaaaccatcttctcctaa

SEQ ID NO: 162023 - DNA, 601 bp, Human
aaaaaatagcacgattacagtatacacacacttaatttacatgtaatgtattatactcataactgagataagctactgaactaactttggttgattgaaattaatgaagtattggaactgaatacttgtaatttggtttctaagttgtgtacatattacagtgcatttataaatctagtttgaaaatttactagcaccaaataggtaccataaatggacaacctagtacttgtatttggagaagcaaagtttacaaatttgcaaaaaatagagtagtccatcaattgaaagcacattcccrtacgtttgctggaaggatggcatgtcagcataaatggccaacccccaatggaaatacacgtcccagttttcaagaatcaacacatatgacaaggtagcttagctacacacatgagaagcctgagaaagtggttgttttgaactagggtagtcacctgtaccttgctttggtaatacaaagaatagtgcttatttatacaaatttacttggtgaaagattgtacctatgatatgatgattctgattgggggaaaatatagttctacctatctatatttgtttttcttttaattatttggtc

SEQ ID NO: 162024 - DNA, 601 bp, Human
tttcataagccataagtaagagacccaggataatttaaatccaggagactttatttagcctccggaatggcccctccaaccccaaatccatgcaagaacacaaagccaaggggtaaactaaaaaaaagaagagattgttttattgtgacatttatgacattgaccccttgttgacaggaatgaccgagggtaatcttggcatattgcacatgctgtgatgaaggatgcactggtgatcctctggccactgaggctgtttcctggtcctcccagacctctatgcacgtgtgggccagtcacmgaaatttcattaccacttggtgtatacatttaacaagtctttggtcttaataagcaccattacaaaccctcacattaagggcattattattctagtttataaatgtttcaatgataaaaaatagcacgattacagtatacacacacttaatttacatgtaatgtattatactcataactgagataagctactgaactaactttggttgattgaaattaatgaagtattggaactgaatacttgtaatttggtttctaagttgtgtacatattacagtgcatttataaatctagtttgaaa

SEQ ID NO: 162025 - DNA, 601 bp, Human; identical to SEQ ID NO: 32089

SEQ ID NO: 162026 - DNA, 601 bp, Human
gttttttaatatatttacttggactttaatctttatgggcatttgtttattaatgtggacgtggctgggcgcagtggctcacatctgtaatcctagcactttgggaggcggaggtgggcggatcactgaggtcaggagttcgagatcagcctggccaacatggcgaaacccggtctctactaaaaatacaaaattagctgggcgtggtggtgcacgcctgtagtcccagctactctggaggctgaggcaggagaatcgcttgaacctggaaagcgaaggttgcagtgagccgagattgcgycattgcactccagcctgggtgacaagagcaaaactccgtctcaaaaaataaaaaataaaaagcgtggacataatggaaaataatcaaaatgacttttgggtaagacagttggaaaataaagccagtacattaaatttttttcataagtctagcactatattacgaacttttctccatgaaaatgcactcatatttatggaagtgaaaggaaaaaaatgtcttcaggtatgtgttgctaataaaattagatataattaaggaaacatttaaaaaataccttgttgttgtcccagttaccta

SEQ ID NO: 162027 - DNA, 601 bp, Human
tgagccgagattgcgtcattgcactccagcctgggtgacaagagcaaaactccgtctcaaaaaataaaaaataaaaagcgtggacataatggaaaataatcaaaatgacttttgggtaagacagttggaaaataaagccagtacattaaatttttttcataagtctagcactatattacgaacttttctccatgaaaatgcactcatatttatggaagtgaaaggaaaaaaatgtcttcaggtatgtgttgctaataaaattagatataattaaggaaacatttaaaaaataccttgttgytgtcccagttacctattgctgcataacaaatcactccaaaacatagtgacttaaaactgtaatttagtatctctcctgtttctctggcctgcctggacttagctaagtggttttcacctagagtttaatgcgtttgtattcagataagcagctgagtttggagtcaaccgagagctcagctggtctggacatccaaaatggctaattcacgtgaaggcgtttgatgttggctaggagttcagctggaaatgtcaactggaatgcccacacatagcctcttcacgtgacttgaacagtatg

SEQ ID NO: 162028 - DNA, 601 bp, Human
tggttttcacctagagtttaatgcgtttgtattcagataagcagctgagtttggagtcaaccgagagctcagctggtctggacatccaaaatggctaattcacgtgaaggcgtttgatgttggctaggagttcagctggaaatgtcaactggaatgcccacacatagcctcttcacgtgacttgaacagtatggcggctaggttccgagaatacatgtttgaggagtcaggaagtagaagctgccagtctcccaaaaagcctgagcccagaaattcgcacaacattacttccaacatactstgttggttagagcaaagaccagcgtacaaccctcacctttgaaaggaaaaatgtcaaagaatttgtggccgtgctttgcctactataattttgatgacaaagttgtattggactcttgtttgcatttatatagcagatgaagaatcaggtacacttccaatttccagtttctttctttcttcttcttctttttttttttttgagatggagtcttgctctgttgtcagcctggagtgcagtgtacgatctcagctcactgcaacctctgcctcctgggttcacgccattctcctgcctcag

SEQ ID NO: 162029 - DNA, 601 bp, Human
taatactttatgttgtaatggcatattacagttttcaaagcatgtttttgtatattttttcacttgatacctatggtcaccctatagaagcagacaaatagttcctatttcattttgcagatgaaagtaaactgaagagtggtggtggtattgggagtgatttacggaatttgttcaaagtcatatgattaataaatggaaagtaaggcctgcaacagttccataatattaaatttattagtactgaatgatgaaatattatattaaacttatttggaattctacatttatagccgtactmatttttttttttttttttttttgagacggagtcttgctctgtcttctaggctggagtgcagtggtgagttctcggctcactgaaatgtccgcctcctgggtttaagcaattctgcttcagcctcccgagtagctgggactataggcacctgccaccatgcccggctaatttttgtattttagtagagatggggttttgccatgttggccaggctggtcttgaactcctgacctcaggtgatctgcccgcctcagcctcccaaagtgctgggattatagccgtgagccaccatacctggcc

SEQ ID NO: 162030 - DNA, 601 bp, Human
taatagagtaaaatgaaataattacacattataataccaatttcagaacaagagttatgggcataagcatcctggaggtgtttttttttttttttttggaggtgttattttaatttctcaattacagagttttaaaaatgaaaatgattttttaaaattttggtaggttgaatgatttaagatgctgatttcagctggaaacaaattgttgccttcatattattttgttgctcctagcagcatgtttatattcattcttatattgatggttcccagtcttgactggtgttagaattcatttgggaagctttttaaaaatacctatgtgggcaaggcgaggttggctcatgcctgtaatcccagcactttgggagacctaggcaggaggatcacttgagcccaagagtttgagactatcctggacaacatagtgagactctgtatttttttaaatatataaataagaaaataaatacctgtgtgtatgtctcatccatagagattctgatttaattgtttaggagtgggatctgagcatcaatatttttttaaagttctctaggtaactgattctaacatacagctgggattgagaactatg

SEQ ID NO: 162031 - DNA, 601 bp, Human
aacaagagttatgggcataagcatcctggaggtgtttttttttttttttttggaggtgttattttaatttctcaattacagagttttaaaaatgaaaatgattttttaaaattttggtaggttgaatgatttaagatgctgatttcagctggaaacaaattgttgccttcatattattttgttgctcctagcagcatgtttatattcattcttatattgatggttcccagtcttgactggtgttagaattcatttgggaagctttttaaaaatacctatgtgggcaaggcgaggttggctyatgcctgtaatcccagcactttgggagacctaggcaggaggatcacttgagcccaagagtttgagactatcctggacaacatagtgagactctgtatttttttaaatatataaataagaaaataaatacctgtgtgtatgtctcatccatagagattctgatttaattgtttaggagtgggatctgagcatcaatatttttttaaagttctctaggtaactgattctaacatacagctgggattgagaactatgtttttggtgcatgttaagtacgatctggctccctacttaatgattt

SEQ ID NO: 162032 - DNA, 601 bp, Human
tagtttctgggaatggtccttaataaaacaaacagacattggcctggtttgctaagtgcctatatcacagcattaagccacactttactttgttaccgttatgtacttaactttcattttaagaggcagaaactttattaagagttgtatttttttagtatcccctgtatcacaacactgcaccttgtgtatagtaggtatctattgtttacctaattgaagccagtttagacagtcactctttagaactagggctagttcagctccttgggaggctgaggcaagagaatcgcttgaacckgggaggtggaggttttggtgagccgagattgcgccactgctctccagcctggacagcagagtgagacgtcatctcaaaaaaataaagaactagggctagtttattcttttcttttctttttttctcatggcattctaagactcccccaattagacagggtctccctctattgctcaggctggagtgcaatggtgtaatcatggttcattgcaagctcaacctcccaggctcaaggaaggcctcagccttccgagaagctgggaccacaggcgcatgccaccatgccctgctaatttttta

SEQ ID NO: 162033 - DNA, 601 bp, Human
ttgtatttttttagtatcccctgtatcacaacactgcaccttgtgtatagtaggtatctattgtttacctaattgaagccagtttagacagtcactctttagaactagggctagttcagctccttgggaggctgaggcaagagaatcgcttgaaccggggaggtggaggttttggtgagccgagattgcgccactgctctccagcctggacagcagagtgagacgtcatctcaaaaaaataaagaactagggctagtttattcttttcttttctttttttctcatggcattctaagactcycccaattagacagggtctccctctattgctcaggctggagtgcaatggtgtaatcatggttcattgcaagctcaacctcccaggctcaaggaaggcctcagccttccgagaagctgggaccacaggcgcatgccaccatgccctgctaattttttatttttttattttttttttgtagtgataaggtctcactgtgttgcccagcagttcaccaaatcctagataacataattttggtgtcaatacttaattatcttccaaaacaatagggattatcaaagtcaacattgatgccttatt

SEQ ID NO: 162034 - DNA, 601 bp, Human
gtgataaggtctcactgtgttgcccagcagttcaccaaatcctagataacataattttggtgtcaatacttaattatcttccaaaacaatagggattatcaaagtcaacattgatgccttattagttgataaacagatttaatatctgtctgctctcacatataactgatttctagttaatatttacatcttaagatgttcctttggcatacactcaacattttccacatcgaattacctactttgctgtaaaccagtggttcttgttgggggtaattttgccttccaggacacattcggyaatgactgtagacagttttggttgttacaactggaagggaaggatgatagtaaactggcgtctagtagaggttagggatgctgctaaacatcctgcagtgcacattgcacagagcagcctctcacaacaaatgtttatctggtccaaaatgtgagtgatggcaaggttgagaaacgctgctgtaaactgatcagttttaaactgcagtattactttttttgttaatagcactactgctcttcatattttgcagggtacagtgtgtgtgcctctgtgtgtgtgtgtgtgtgtgtgtgtgtg

SEQ ID NO: 162035 - DNA, 601 bp, Human
gtcctcaaggccaggttctctctctcatcacatcatcatgagcactgcgtgtgtatgaggattttaaagccttatagtaattgtctgttgatcccattactgtatttaaggaatgatatagatcacaagcattgtaggattcacatgaagaaacaaattccaagaactgggaccataaaggatggaagagatggaacttaagtttgtttcttcttgtagctgagacctcagatgtgcaccactacgcccagctaatttttaaattttttgtaaaattttttgtctttactttgttgcccastttgttggctacctaccatttctccctatctctgccctttaggcaacaacaatactcaacataaatatctgttcttgaactcctgggctcaagcagtcctcccacctcagtctcccagagtgttgggattacagctgtgaggcaccacgcccagtcagtgcactgctttttgcatggagaaagtcttgctgctactttaaaaaggtcagtgtgcttaattgatctacattctgtcacaaacttcttattttatcacaaactgataacaaacagttccccaatcagcactggtcattggac

SEQ ID NO: 162036 - DNA, 601 bp, Human
gtctttactttgttgcccactttgttggctacctaccatttctccctatctctgccctttaggcaacaacaatactcaacataaatatctgttcttgaactcctgggctcaagcagtcctcccacctcagtctcccagagtgttgggattacagctgtgaggcaccacgcccagtcagtgcactgctttttgcatggagaaagtcttgctgctactttaaaaaggtcagtgtgcttaattgatctacattctgtcacaaacttcttattttatcacaaactgataacaaacagttccccartcagcactggtcattggaccatacttggagttacattgctgtagtgtgagactttcatactttttttaaaattgtcacctgtattaagaaatacattttacattttcatccagtgttatatcatatacacatgtacataactgaaacaattttacgaagcagtacctaaccttactatgtgtgacatagtctgatgtttgctatttttttaatgctgatcatgaccttctaatggattttaaaaacactgccctcaagcatttagcacagtgctagagacatagtagttgctcagaaaat

SEQ ID NO: 162037 - DNA, 601 bp, Human
acataaatatctgttcttgaactcctgggctcaagcagtcctcccacctcagtctcccagagtgttgggattacagctgtgaggcaccacgcccagtcagtgcactgctttttgcatggagaaagtcttgctgctactttaaaaaggtcagtgtgcttaattgatctacattctgtcacaaacttcttattttatcacaaactgataacaaacagttccccaatcagcactggtcattggaccatacttggagttacattgctgtagtgtgagactttcatactttttttaaaattgtcayctgtattaagaaatacattttacattttcatccagtgttatatcatatacacatgtacataactgaaacaattttacgaagcagtacctaaccttactatgtgtgacatagtctgatgtttgctatttttttaatgctgatcatgaccttctaatggattttaaaaacactgccctcaagcatttagcacagtgctagagacatagtagttgctcagaaaataccatacattttagcagtgattaaatcttgagagggttgagccttcttaatacttgaggattactttaaaatgttatt

SEQ ID NO: 162038 - DNA, 601 bp, Human
ttaaaaaggtcagtgtgcttaattgatctacattctgtcacaaacttcttattttatcacaaactgataacaaacagttccccaatcagcactggtcattggaccatacttggagttacattgctgtagtgtgagactttcatactttttttaaaattgtcacctgtattaagaaatacattttacattttcatccagtgttatatcatatacacatgtacataactgaaacaattttacgaagcagtacctaaccttactatgtgtgacatagtctgatgtttgctatttttttaatgctgatcatgaccttctaatggattttaaaaacactgccctcaagcatttagcacagtgctagagacatagtagttgctcagaaaataccatacattttagcagtgattaaatcttgagagggttgagccttcttaatacttgaggattactttaaaatgttatttcattggccgggcacgatggctcacgcctgtaatcccaccactttgggaggccgaggcgggcggatcacctgaggtcaggagttcgagaccagcctggccaacatggagaaaccctgtctctactaaaatacaaaaat

SEQ ID NO: 162039 - DNA, 601 bp, Human
ttgggcgacagagtgagactccgtctccaaaaaaaaaaaaagttatttaatcaatacttagttgtttgtggcaccttatacagaacgagtgtagagtggattatgagatttaagacagcgagaagatacttatgttgagtattgttgctgcctaagggcagaaatagagagagatggtgggtgaccaacaaagacaacttttgctttcctttcaatattgccaaagaccttaggagtggctggtgtgaatccctgcttaaaatcaggaccagtttgaatgactgcaaacctcatttttcastttttaccttttagtcttcactttgtggttccagtcatcaaatccctactctttgtcttagaaaggagcagaaggatgtcagagaaagaacattttctctttatttatttatttttttttgagatggagtctctgttgcccaggctgcagtgcagtggcgcgatctcagctcactgcaagctccacctcccaggttcgtgccattctcctgcctcagcctcctgagtagctgggactacaggtgcccgccaccgtgcccggctaattttttgtctttttagtagagacggggtttcaccg

SEQ ID NO: 162040 - DNA, 601 bp, Human
ttttagtcttcactttgtggttccagtcatcaaatccctactctttgtcttagaaaggagcagaaggatgtcagagaaagaacattttctctttatttatttatttttttttgagatggagtctctgttgcccaggctgcagtgcagtggcgcgatctcagctcactgcaagctccacctcccaggttcgtgccattctcctgcctcagcctcctgagtagctgggactacaggtgcccgccaccgtgcccggctaattttttgtctttttagtagagacggggtttcaccgtgttagccrggatggtcttgatctcctgacctcgtgatccgcccgccttggcctcccaaagtgttgggattacaggcgtgagccactgtgcacggctgcattttctctttgttaactcattttcaacacttttgggtttcacttttggagcactgctgtttgactaaggctgaagttctttgtcaggtttacacatcttaagaatttttattttttgttgttagaagcatgttaatttttcttgcatatacttagttatttttttttcacttgcaatccttcttgaagcataaggttttttgttttgtt

SEQ ID NO: 162041 - DNA, 601 bp, Human
tgctcatattatttctttccttccttaaaactttaagtacatttcatatattcttttatatgttataaagcatgatactaaaatgatcacctgtgcacatactacccaatttgagaactagaaccttgctgtacccctgaagctccttatatgtatctccctgattacaactctccctctcccaagaaatataatgttgcgtttaacattttctgctttctttatagttttacctcatttatatctttaagcaatatattgttcaattcaatttgatttttaaactttatatagagtatcrtattacacatattcttggtttttcattcaacattgcgggggatgggcagaagatgatgaggtgagaaggcgggcagggtatgttttctggttaaactatttattcttggagaatcagagaccatatcttatatacccctttaataacctctgtttaacacgaggcctactgttgcaagctaagtctcctgatgatttgcactgacattgaaacattgctgttgtctctataagtatgaggaaacccaggggaaccctgtcatactctttcctcaatggatgcttttagcaagtttgatga

SEQ ID NO: 162042 - DNA, 601 bp, Human
tctttccttccttaaaactttaagtacatttcatatattcttttatatgttataaagcatgatactaaaatgatcacctgtgcacatactacccaatttgagaactagaaccttgctgtacccctgaagctccttatatgtatctccctgattacaactctccctctcccaagaaatataatgttgcgtttaacattttctgctttctttatagttttacctcatttatatctttaagcaatatattgttcaattcaatttgatttttaaactttatatagagtatcgtattacacatatycttggtttttcattcaacattgcgggggatgggcagaagatgatgaggtgagaaggcgggcagggtatgttttctggttaaactatttattcttggagaatcagagaccatatcttatatacccctttaataacctctgtttaacacgaggcctactgttgcaagctaagtctcctgatgatttgcactgacattgaaacattgctgttgtctctataagtatgaggaaacccaggggaaccctgtcatactctttcctcaatggatgcttttagcaagtttgatgaattgttgatgaat

SEQ ID NO: 162043 - DNA, 601 bp, Human
aagagaaatatttctagataaaaattccatctacttatgatctaaacattaatgctattttaacaaaagaaacatgtaaacgctttgattattcttactgctagttcctttgacaggtaagattcccaactcttaaggcaaaatgatacaaaaagtaattcatttggttaatgaaaatttgaaaaaaattattacattcttcactcatattctgcatatcttaaactcctgaaatagatattctaaacaatttaaaattaaccctgttagcaaaggatatggtttaggaatttttttttttaaactgctcacttgttttattgtgaatgaggaaaattagtataattatttgtatttgtttcaggaaagaagcacttgtaaggaaatatagcatccattgtgaaagtggaaaagtaaagataattcatcatgcctgctgtggcttcagttcctaaagaactctacctcagttcttcactaaaagaccttaataagaagacagaagttaaaccagagaaaataagcactaagaggtatgatgtatccttcgctagtttgattgaatcaaatattaatttttagttcgtttccatattaaagt

SEQ ID NO: 162044 - DNA, 601 bp, Human; identical to SEQ ID NO: 32090

SEQ ID NO: 162045 - DNA, 601 bp, Human; identical to SEQ ID NO: 32091

SEQ ID NO: 162046 - DNA, 601 bp, Human; identical to SEQ ID NO: 32092

SEQ ID NO: 162047 - DNA, 601 bp, Human; identical to SEQ ID NO: 32093

SEQ ID NO: 162048 - DNA, 601 bp, Human; identical to SEQ ID NO: 32094

SEQ ID NO: 162049 - DNA, 601 bp, Human; identical to SEQ ID NO: 32095

SEQ ID NO: 162050 - DNA, 601 bp, Human; identical to SEQ ID NO: 32096

SEQ ID NO: 162051 - DNA, 601 bp, Human; identical to SEQ ID NO: 32097

SEQ ID NO: 162052 - DNA, 601 bp, Human; identical to SEQ ID NO: 32098

SEQ ID NO: 162053 - DNA, 601 bp, Human; identical to SEQ ID NO: 32099

SEQ ID NO: 162054 - DNA, 601 bp, Human; identical to SEQ ID NO: 32100

SEQ ID NO: 162055 - DNA, 601 bp, Human; identical to SEQ ID NO: 32101

SEQ ID NO: 162056 - DNA, 601 bp, Human; identical to SEQ ID NO: 32102

SEQ ID NO: 162057 - DNA, 601 bp, Human; identical to SEQ ID NO: 32103

SEQ ID NO: 162058 - DNA, 601 bp, Human; identical to SEQ ID NO: 32104

SEQ ID NO: 162059 - DNA, 601 bp, Human; identical to SEQ ID NO: 32105

SEQ ID NO: 162060 - DNA, 601 bp, Human; identical to SEQ ID NO: 32106

SEQ ID NO: 162061 - DNA, 601 bp, Human; identical to SEQ ID NO: 32107

SEQ ID NO: 162062 - DNA, 601 bp, Human; identical to SEQ ID NO: 32108

SEQ ID NO: 162063 - DNA, 601 bp, Human; identical to SEQ ID NO: 32109

SEQ ID NO: 162064 - DNA, 601 bp, Human
tgagatcgtaccactccactccagcctgggcaacagagcaacactcttgtctcaaaaaaaaagaaaagaatttgaattaaatattctagcctcagttgacttcagatttttctgtgaatttctatggcaatattttctctgcattaattcgttttttagcagacattataaacttaattagagcaatagaaaaatcatttgagctgagctgtgatttattatatctgcattctggtcctatgtcaaaacttttttaaccactctgggactcagttttcttgtttcccaaattatagtcttraaatagacaatttttaagtttcttctttctaatcatgtaatttacattaaaagatttagtatactactttgtttggtaccaagccttttatctgtttctgaggtctcattctttttcctttgctttctccttctttttctcccccagttcccccacccccccccttttttttttttttttttgagacagagtctcattcttgtcgcccaggctggaatgcaatggcgtgatctcggctcactgcaacctctgcctcccaggttcaagcgattctcctgcctcagcttcccaagtagctgg

SEQ ID NO: 162065 - DNA, 601 bp, Human
ttataaacttaattagagcaatagaaaaatcatttgagctgagctgtgatttattatatctgcattctggtcctatgtcaaaacttttttaaccactctgggactcagttttcttgtttcccaaattatagtcttgaaatagacaatttttaagtttcttctttctaatcatgtaatttacattaaaagatttagtatactactttgtttggtaccaagccttttatctgtttctgaggtctcattctttttcctttgctttctccttctttttctcccccagttcccccacccccccccytttttttttttttttttgagacagagtctcattcttgtcgcccaggctggaatgcaatggcgtgatctcggctcactgcaacctctgcctcccaggttcaagcgattctcctgcctcagcttcccaagtagctgggattacaggcgcccgccaccacacccggctaatttttgtatttttagtagagatggggtttcaccatgttggccaggctggtctcgaactcctgacctccagtgatctgcctgcctcagccttccaaagtgctgggattacaggcatgagccaccacacctggct

SEQ ID NO: 162066 - DNA, 601 bp, Human; identical to SEQ ID NO: 32110

SEQ ID NO: 162067 - DNA, 601 bp, Human; identical to SEQ ID NO: 32111

SEQ ID NO: 162068 - DNA, 601 bp, Human; identical to SEQ ID NO: 32112

SEQ ID NO: 162069 - DNA, 601 bp, Human; identical to SEQ ID NO: 32113

SEQ ID NO: 162070 - DNA, 601 bp, Human; identical to SEQ ID NO: 32114

SEQ ID NO: 162071 - DNA, 601 bp, Human; identical to SEQ ID NO: 32115

SEQ ID NO: 162072 - DNA, 601 bp, Human; identical to SEQ ID NO: 32116

SEQ ID NO: 162073 - DNA, 601 bp, Human; identical to SEQ ID NO: 32117

SEQ ID NO: 162074 - DNA, 601 bp, Human; identical to SEQ ID NO: 32118

SEQ ID NO: 162075 - DNA, 601 bp, Human; identical to SEQ ID NO: 32119

SEQ ID NO: 162076 - DNA, 601 bp, Human; identical to SEQ ID NO: 32120

SEQ ID NO: 162077 - DNA, 601 bp, Human; identical to SEQ ID NO: 32121

SEQ ID NO: 162078 - DNA, 601 bp, Human; identical to SEQ ID NO: 32122

SEQ ID NO: 162079 - DNA, 601 bp, Human; identical to SEQ ID NO: 32123

SEQ ID NO: 162080 - DNA, 601 bp, Human; identical to SEQ ID NO: 32124

SEQ ID NO: 162081 - DNA, 601 bp, Human; identical to SEQ ID NO: 32125

SEQ ID NO: 162082 - DNA, 601 bp, Human; identical to SEQ ID NO: 32126

SEQ ID NO: 162083 - DNA, 601 bp, Human; identical to SEQ ID NO: 32127

SEQ ID NO: 162084 - DNA, 601 bp, Human; identical to SEQ ID NO: 32128

SEQ ID NO: 162085 - DNA, 601 bp, Human; identical to SEQ ID NO: 32129

SEQ ID NO: 162086 - DNA, 601 bp, Human; identical to SEQ ID NO: 32130

SEQ ID NO: 162087 - DNA, 601 bp, Human; identical to SEQ ID NO: 32131

SEQ ID NO: 162088 - DNA, 601 bp, Human; identical to SEQ ID NO: 32132

SEQ ID NO: 162089 - DNA, 601 bp, Human; identical to SEQ ID NO: 32133

SEQ ID NO: 162090 - DNA, 601 bp, Human; identical to SEQ ID NO: 32134

SEQ ID NO: 162091 - DNA, 601 bp, Human; identical to SEQ ID NO: 32135

SEQ ID NO: 162092 - DNA, 601 bp, Human; identical to SEQ ID NO: 32136

SEQ ID NO: 162093 - DNA, 601 bp, Human; identical to SEQ ID NO: 32137

SEQ ID NO: 162094 - DNA, 601 bp, Human; identical to SEQ ID NO: 32138

SEQ ID NO: 162095 - DNA, 601 bp, Human; identical to SEQ ID NO: 32139

SEQ ID NO: 162096 - DNA, 601 bp, Human; identical to SEQ ID NO: 32140

SEQ ID NO: 162097 - DNA, 601 bp, Human; identical to SEQ ID NO: 32141

SEQ ID NO: 162098 - DNA, 601 bp, Human; identical to SEQ ID NO: 32142

SEQ ID NO: 162099 - DNA, 601 bp, Human; identical to SEQ ID NO: 32143

SEQ ID NO: 162100 - DNA, 601 bp, Human; identical to SEQ ID NO: 32144

SEQ ID NO: 162101 - DNA, 601 bp, Human; identical to SEQ ID NO: 32145

SEQ ID NO: 162102 - DNA, 601 bp, Human; identical to SEQ ID NO: 32146

SEQ ID NO: 162103 - DNA, 601 bp, Human; identical to SEQ ID NO: 32147

SEQ ID NO: 162104 - DNA, 601 bp, Human; identical to SEQ ID NO: 32148

SEQ ID NO: 162105 - DNA, 601 bp, Human; identical to SEQ ID NO: 32149

SEQ ID NO: 162106 - DNA, 601 bp, Human; identical to SEQ ID NO: 32150

SEQ ID NO: 162107 - DNA, 601 bp, Human; identical to SEQ ID NO: 32151

SEQ ID NO: 162108 - DNA, 601 bp, Human; identical to SEQ ID NO: 32152

SEQ ID NO: 162109 - DNA, 601 bp, Human; identical to SEQ ID NO: 32153

SEQ ID NO: 162110 - DNA, 601 bp, Human; identical to SEQ ID NO: 32154

SEQ ID NO: 162111 - DNA, 601 bp, Human
acacacaaaatatcataattttcaaataattagatcagtaaagtaccctcccaccctgcacaaaaaaggtgaaatatccactatttccttttcagtgtttcctcctagccatatcttttctccttaggtcatcctaacctttacgtggcttcaattacatctatatcctaacatcccatatcactaggccagacttctcttagctatagacctatttatctgtttacctattcgacattttcccttggcagtgtcagaagcacctcaaatttagcatgcccatgattaaactcataatctktgtccacttcacaacctagacctcttagagtactgtttctttaggaaaggcactactatccatccagttttttaaagacagaaatctaggatcaaactatttatcttttccctcacctctcaaattctaatctgccaaaacttactaattttatgtctgtgtatctctcaattgtttttctctgtacttgtccaaactccaatccttgtccaagctccaattatgtctcatgtaaactatagcaaaatctacagttctcccagcaaccactccgcctctccccaactcattcttcatttg

SEQ ID NO: 162112 - DNA, 601 bp, Human
ggatcaaactatttatcttttccctcacctctcaaattctaatctgccaaaacttactaattttatgtctgtgtatctctcaattgtttttctctgtacttgtccaaactccaatccttgtccaagctccaattatgtctcatgtaaactatagcaaaatctacagttctcccagcaaccactccgcctctccccaactcattcttcatttggcagccaatgtggtagtttccttacccgaagtcaggagttcaagaccaacctggccaacatggtgaaaccccatctctactaaaaatayaaaaattagccaggagtggtggtgggcacctgtagtcacagctacttgggaggctgaggcaggagaatcacttgaacccaggagacaagggctgcagtgagccaagaccacgccactgcactccagcctgggcgacagagccagactccatcttaaacaaacaaacaaaacaggaaaaccaaagtccttaatgaagcttgcacagtcctgcatggactgcttcctgactacatttctaggttcatcctgcacacataatctgatagaaaccttgttcttgcccttcatggcacttcatgc

SEQ ID NO: 162113 - DNA, 601 bp, Human
acattagctttcatatattaggttggtgcaaaagtaatcgcggtttttgccattacttttaatggcacaacaatcccatgaaatagataccttgttagactcctttacagtgatccaaggatatagctaaccagagatatcactggggctaaaattctgatctttccaatctttccagaggaaacagggagaattaagtgcattgtaaatttgatccattcaatgtagtatagattggagatgactaataattgattcctggaagatctccatggatgtgctacaatgcttcattgccacyagccctttccctcaggatgggcccttactttagtctgaagttgtattgccaaatgtattcctaggagagccaagggagcatatgagcatgcttctctgcaaagatttacatattgctttgtgcagatctgttgccatattttaaaagtttaaattccgggcacataaactacagtaagatccctgttctctaaggatgagttttgtcaccttaagctgccttttttacataaagacactctaatacaagttcaattagaagtaaatatttattttaggtgagtcataaaatcttcagtac

SEQ ID NO: 162114 - DNA, 601 bp, Human
aggttggtgcaaaagtaatcgcggtttttgccattacttttaatggcacaacaatcccatgaaatagataccttgttagactcctttacagtgatccaaggatatagctaaccagagatatcactggggctaaaattctgatctttccaatctttccagaggaaacagggagaattaagtgcattgtaaatttgatccattcaatgtagtatagattggagatgactaataattgattcctggaagatctccatggatgtgctacaatgcttcattgccaccagccctttccctcaggatrggcccttactttagtctgaagttgtattgccaaatgtattcctaggagagccaagggagcatatgagcatgcttctctgcaaagatttacatattgctttgtgcagatctgttgccatattttaaaagtttaaattccgggcacataaactacagtaagatccctgttctctaaggatgagttttgtcaccttaagctgccttttttacataaagacactctaatacaagttcaattagaagtaaatatttattttaggtgagtcataaaatcttcagtacacactgtctgattctgggt

SEQ ID NO: 162115 - DNA, 601 bp, Human
gatctttccaatctttccagaggaaacagggagaattaagtgcattgtaaatttgatccattcaatgtagtatagattggagatgactaataattgattcctggaagatctccatggatgtgctacaatgcttcattgccaccagccctttccctcaggatgggcccttactttagtctgaagttgtattgccaaatgtattcctaggagagccaagggagcatatgagcatgcttctctgcaaagatttacatattgctttgtgcagatctgttgccatattttaaaagtttaaattccrggcacataaactacagtaagatccctgttctctaaggatgagttttgtcaccttaagctgccttttttacataaagacactctaatacaagttcaattagaagtaaatatttattttaggtgagtcataaaatcttcagtacacactgtctgattctgggtgtgaggtagaagtccctgcccctaccccaggaatttgcctgcaaaggtagtacatgtggggatattaccaaactatctattccctgtatggaactggaatatcaaatcatacaatatatagaagggtacattgaataat

SEQ ID NO: 162116 - DNA, 601 bp, Human
gcctgcaaaggtagtacatgtggggatattaccaaactatctattccctgtatggaactggaatatcaaatcatacaatatatagaagggtacattgaataatatgacatgctatataaatatggcatactatgttaataaaaagtataatatggtttgtattattggtgataacaataaatggagactacttttctgttgcctttagcttttccttcctcttatagtcacctaagaaagtttcagaatgtccattatcatactaagtttttaacatgaagaccaattttatttcaaaccragggtttctgtggaccgagaaccaccataaatacatttcaaacatatctgaatatacaaaagcgaagtacagattataagtataatatgatgcatgaaatagatctatgatcactatggtgtgaagttgtggtcgttctgtctagatgatccagatggtcttcatcaactagacgggactcctttaaccgctgaagacattgtccataaaatcgctgccaggatttatgaagaaaatgacagagccgtgtttgacaagattgtttctaaactacttaatctcggccttgtaagtcatttg

SEQ ID NO: 162117 - DNA, 601 bp, Human
tgtgtatttttgaaactccaggtgatctaatttgaatccacctcagcttggctcttctgccctgacctggccctgacaggctttattaagatgctaattttgtaggatgtcaaaggttatctgactatgacccaaagctgtggaggggcaatgctcagggtgtttctcaaaatatgtggtccatgggtttcaacagatagaactaacagcttgcatggtgggcccgaagatacttcttccaggagtgctgagcaatccctataacagccagcatgtggtgcaggcgtaagtgagggctgtytgaaagatggttcagaagattcctctttaaaaaatacatgtttgactacagtttagtccacattattttttaataacaagactgggaatatagcagttatatatgttttgcctttttatgatagatcacagaaagccaagcacatacactggaagatgaagtagcagaggttttacaaaaattaatctcaaaggaagccaacaattatgaggaggatcccaataagcccacaagctggactgagaatcaggctggaaaaataccagagaaagtggtatgtatgtgtatatatgcatatgc

SEQ ID NO: 162118 - DNA, 601 bp, Human
actgaccataaggggatatcaaattcctcatctgtcctttgattttcctctgtaaagcacccagacccatggctcctcatctcctccagcatcttatctcaaatacaaagactatagaggctgatggttctgttttagagaggagagaaaatagaaattgggtctggatttcttttttttttttactggatagcctaaaaactttcctctgctctccttacttccaatcctcaccagctgccatcttttaaagcagcttttgaagattcacccactcaaaaaaaaagttctagatttatcaaaaaaaaaaacccttatgacttttgctcaagcttaccagtctgagctaaaatggacacagctatttccataattcttcattcccattacatactcctattcacctatctctaaaatgttcatatgcttgacctgtttactcatgttacctgaatgcatcaatgcaaataaaacacaaatgaaatattatttcaacaaatatttattgaatactaactctgtaccaagcactggaaataccatgcctatttaaaaagacataatccctgactcatgaagctcaaagtctagtggaagaggt

SEQ ID NO: 162119 - DNA, 601 bp, Human
tatgaaccaggcagtgtccttgctctgacccagttcaacctcaactcttattgcaactctttttttctcagcttgattgaggtataattggcaaacaaatattgtatatatttaaggtgtacaatttgatgttttggtacatttatacattgtgaaatgattatcacaatgaatctaactagtgtatctatcaccttatagttaacatttttttcttttttttcttttattctttttgtgtgtgtgatgagaacacttaagacctaccctcttagctaatttcaagtacacagtacagtaytgttaactatcaccaccatgctgtacattctccagaatgtattcatcttgcataactgaaatttcataccctttgaccaacacctccccatttttccctccccttagcccttggcaactaccattctactctcttcttcgatgagtttgactatttgagattctacatataagtgagatcatacagtatttgtctttctttgcctgcctttttttattagcatacatgttgtcatacacacacacaaaagtaggaaggaaatccttccatttgtaacaaatctttctttaaaaggctcta

SEQ ID NO: 162120 - DNA, 601 bp, Human
atgttttggtacatttatacattgtgaaatgattatcacaatgaatctaactagtgtatctatcaccttatagttaacatttttttcttttttttcttttattctttttgtgtgtgtgatgagaacacttaagacctaccctcttagctaatttcaagtacacagtacagtattgttaactatcaccaccatgctgtacattctccagaatgtattcatcttgcataactgaaatttcataccctttgaccaacacctccccatttttccctccccttagcccttggcaactaccattctrctctcttcttcgatgagtttgactatttgagattctacatataagtgagatcatacagtatttgtctttctttgcctgcctttttttattagcatacatgttgtcatacacacacacaaaagtaggaaggaaatccttccatttgtaacaaatctttctttaaaaggctctactcactttccttaatggaaacagtgtatgaaacctaattcatcctttttatattattcaagagatctttatgaacagtttcagtttcagcctttatgaacattttaacttcagagttaaaatggagaa

SEQ ID NO: 162121 - DNA, 601 bp, Human
actaccattctactctcttcttcgatgagtttgactatttgagattctacatataagtgagatcatacagtatttgtctttctttgcctgcctttttttattagcatacatgttgtcatacacacacacaaaagtaggaaggaaatccttccatttgtaacaaatctttctttaaaaggctctactcactttccttaatggaaacagtgtatgaaacctaattcatcctttttatattattcaagagatctttatgaacagtttcagtttcagcctttatgaacattttaacttcagagtyaaaatggagaacattagactgaaggaatctgggaacctcaaacacacttgggaaattatttgtttttgtttttgtttttttaaagctaagtatttcatgcatcctgatctctttgctcatatgtgcagtgagttaactgaggattcagtccatgtttattttggttaatctgcaaggaggataataatgtgcaatgtttctgttgttattgttcaaacagatgctctggactgccttcatggctttttctttccctgttcaaggattcagccccagattgaacatttatataaagacttc

SEQ ID NO: 162122 - DNA, 601 bp, Human
agcctttatgaacattttaacttcagagttaaaatggagaacattagactgaaggaatctgggaacctcaaacacacttgggaaattatttgtttttgtttttgtttttttaaagctaagtatttcatgcatcctgatctctttgctcatatgtgcagtgagttaactgaggattcagtccatgtttattttggttaatctgcaaggaggataataatgtgcaatgtttctgttgttattgttcaaacagatgctctggactgccttcatggctttttctttccctgttcaaggattcagycccagattgaacatttatataaagacttctataattgtaatctatttctcccaagaagtgaccttaaaataagctttcatttctggagaacatcctttgtgcttcaattccagacattggccagatggcaccggccactctgctggctctgcagggcttgtacatcttgagggtccattctgagccatcttgccccattggttggcagatgccctactcagaacctctgtcatcctggtgagtcacttctcatcagtgaagagcagcagcgtgatgccaaatacttctacggatgtgtcc

SEQ ID NO: 162123 - DNA, 601 bp, Human
aatgaatacactcatcattgcagaaagttctgttggacaacattggcttgtaggagcaaagcagtgaaaataggctagatactccacaagaggagactaaagtaaattatttatttatttttatgatagactatttaaattttattctaagtgtttgtgtttttaaataattatatctgctccttacatatgcaatgtaaatattgtttatcaagacttacatacatattaatgtatatgtacatgtttatatacatatatgtattatgtgtgtatatgtaacttttacaactagagtttktgttatgtctttaagaatttttctgtataagcacattggcttttgacttctgctgccatggagagccacccttagatcccaaggggctcagggcagcatgggtagaagacgattgaccagcctcctctcctcccatctgagctagtgacaagcagtgatctgcctttctattctggcctcaacagtgtaccatgattacaaatgttgccaggtatggccactatttccaaaaagaaagcaatgcattacacattagaatatattaattatcttcttaaaatagaggtagggcaagaggag

SEQ ID NO: 162124 - DNA, 601 bp, Human
atgaatacactcatcattgcagaaagttctgttggacaacattggcttgtaggagcaaagcagtgaaaataggctagatactccacaagaggagactaaagtaaattatttatttatttttatgatagactatttaaattttattctaagtgtttgtgtttttaaataattatatctgctccttacatatgcaatgtaaatattgtttatcaagacttacatacatattaatgtatatgtacatgtttatatacatatatgtattatgtgtgtatatgtaacttttacaactagagttttwgttatgtctttaagaatttttctgtataagcacattggcttttgacttctgctgccatggagagccacccttagatcccaaggggctcagggcagcatgggtagaagacgattgaccagcctcctctcctcccatctgagctagtgacaagcagtgatctgcctttctattctggcctcaacagtgtaccatgattacaaatgttgccaggtatggccactatttccaaaaagaaagcaatgcattacacattagaatatattaattatcttcttaaaatagaggtagggcaagaggagt

SEQ ID NO: 162125 - DNA, 601 bp, Human
tgcaatgtaaatattgtttatcaagacttacatacatattaatgtatatgtacatgtttatatacatatatgtattatgtgtgtatatgtaacttttacaactagagtttttgttatgtctttaagaatttttctgtataagcacattggcttttgacttctgctgccatggagagccacccttagatcccaaggggctcagggcagcatgggtagaagacgattgaccagcctcctctcctcccatctgagctagtgacaagcagtgatctgcctttctattctggcctcaacagtgtaycatgattacaaatgttgccaggtatggccactatttccaaaaagaaagcaatgcattacacattagaatatattaattatcttcttaaaatagaggtagggcaagaggagtttacttggggagaaaatatacaaagtaataataagatccttacaaactaactgcaaagacatgcttttttgagaatggcagaaaaggctcgtcctaaaatagtgtagtgagatagctatgtggctggtttaatagctgagtacaaagagtgtggtttctaattcatcgtctaccttgaggaagtcacag

SEQ ID NO: 162126 - DNA, 601 bp, Human
gttaggttccctagggaaaaatcaaggtgcagttaccacaaggtgttgaataggtcaaaccccaagtatccactgtaattcccaatcctggaagtgttctagcagtggccacagagatgcagaagcgacttctgcaattagctgagtaggaggctgaacttgaggatctcaaactatatgtctttccatcctgagagtctatgattcttagaaataaaatccaggtcaaaacatcttaccaggagtgttaatattttggagttgctattgtgatatttctggtgagatttaaacatttttygtaaaaatttgatgtcatctctcagggaataaaattaaatttctttccttcctccctccagaaaacttggatgaaatgattgctcttcagaccaaaaacaagctagaaaaaaatgctactgacaatataagcaagcttttcccaggtatgattatttaactatttttttagcctttagaataataacccttttgagtggtaaataatgaactttaataaacattaatttaaaaattacagattttgaaaagtgttaaaatctgaaacgcagccataggattaattagatgtgaccttggc

SEQ ID NO: 162127 - DNA, 601 bp, Human
gtggccaatcacagcacataaatctgacctcaaaaaacattgaaaaataatgtaggtctttactgaagattcctggaggtggctaggaatcttaggtggaaaggaaaaggctacatcacaaaactgagcaatccatcctaaaattctcctttaggtatcttctctccctagataatcacttctccagactactgtccctggtcatctgttcactccccactgcccgcctcccgctctcccctcccaggttttctctctcccctgggatggtctgtgcccctaggtagtgtgctttaccccygctcttggtttcgtcagttccatacctccacctatcaccctactcagcccatcaaaccccagggaactgagctatggaaaggagcctcctttcaaggaggagggtggaacaaaaagagaaaagtttgcaaatggcagattcttttttaaatttgtttagctattaatgacaaccaaaaattgcaaattgttatactttgactctttgtcactatcacagaaattatatacatattcttgatggcatagtatacagccctttaaaatatgttttcaagcagtttttaattacctggaaaca

SEQ ID NO: 162128 - DNA, 601 bp, Human
aactgagctatggaaaggagcctcctttcaaggaggagggtggaacaaaaagagaaaagtttgcaaatggcagattcttttttaaatttgtttagctattaatgacaaccaaaaattgcaaattgttatactttgactctttgtcactatcacagaaattatatacatattcttgatggcatagtatacagccctttaaaatatgttttcaagcagtttttaattacctggaaacatccttccataataatgtaatgacacaagcgaagaacaaaattgtaccacaactgtgaaaaaaaaygcatctctctacataccgcatcacactagcgaatgttttatatcagacactaactgatttctttcttttcttcctatttttctacaataaaaaaacactttattttaaaagtttactgttagactgcttgaggttccaaatattttattggctacagaaatgtattacaattgttttcaaatggttacctactttaaggtttatgatttttaattcaacaaaggattactacatggaaatatggttattttaaagtgagaagggagcaagagtttctctcttttgatagcaagagttcaa

SEQ ID NO: 162129 - DNA, 601 bp, Human
tttattttaaaagtttactgttagactgcttgaggttccaaatattttattggctacagaaatgtattacaattgttttcaaatggttacctactttaaggtttatgatttttaattcaacaaaggattactacatggaaatatggttattttaaagtgagaagggagcaagagtttctctcttttgatagcaagagttcaagtctcttcttcgaatttagggttcctaggggtaaaggagtgtgaagaaaggagcagaaggagagaagtcctgccatagccccagatccttaggtgtgaytgagtaatagactgtctttcaaaaatgcaatgtcaaggagagattgggcagctatagagttattatcatttggaatcaagacccaccaaatgtacttcagaacatgacatatcctggcttgatcacctacactgattaaagtaagacaaagaatatgccctctaatggcaaggtgtggcagaatggaaaaaataccaaatcagaattcagaaagctggggtggggtggggtgggggggatatatctaaagtcaactcatgggatgactttagacatatctctcccctttctgggcctcaa

SEQ ID NO: 162130 - DNA, 601 bp, Human
taaatatatctatgcaatatataacacaatttacatctttttaggattttattttattttattttttgcagtggagtctccttctgttgcccaggctagagtacagtggcacgatctcagctcactgcaacctccacctcctgggttcaagtgattcttctgcctcagcctcccaagtagctgggactacaggcacgcgccaccctgccctctaattttttgtatttttcatagagatggggtttcatcaagttggccaggctggttttgaactcctgacctcaagtgatccccccgcctmggcctcccaaagtgctgggtttacaggtgtgagccaccgtgctcggccatcttcctaggattttagaaactttaccatacccccaaagaaaaagactcaatgaggttataagttctaaattgttatccctttgatttcaggtccgaatgtgggatctagttgtacagttcagtggttcaagtccccttattacaaagttgtgctagttacatcatggaaatttacatctctatgtctcagatagatattatttttctgaaactcaatgtctttaccagaagttgtgaacaaacggtttga

SEQ ID NO: 162131 - DNA, 601 bp, Human
agcaggttcctattcacacttaatagacgcatgcttactgtctgtgtatgaagtagaagagaaacaaactagctacgtatttaataccttgaaactcaagaataccaataaaattacaaactatttcctttttatattactattacctttgctaacactttttccatttgtgtaagttatttcagttgtcgttgttggtgatgatgatgactttatgcctaaattggtgtagcttgggcagtgggagctccctaaatttctctttagtctttttagtacatcatcattgctttctagcaayaacgggatattctatacccactctgaattttcctttcccaagacttgaagtcaattctccttcaaggagttctggttccttttttgtagaaaagacttgtagaattagacacccaaacctgggttatataagttcaaatgagtggtgatagtggcaaaagatgctgcttctatttcagctattgggacttttttgagacagggctgaaaaatataatttttccttaatgtatcaagtttctgttgatttttcctatcttatacatttttatatttttgtgccctccttttctctagcatg

SEQ ID NO: 162132 - DNA, 601 bp, Human
tgattatgactttatgtctctgtgcttcagtgtcttcatctgtaaaatggggatgataataagactgcctcaaaaagttgtcgtgaagaataaatgagacaatgcattttggagcataaagcagtccccagtacatgataagcacacagtacaggtagctcaaccaagagggctgtgcagtagagtagaggtaagagggctcagatggggctcagaatggggtggtcaccacactgagctctgcagctattgcttctgcagaggccctggactttgaaagcctctttttgtaagccatctkgtactttctagagcacctggtttcttggtgctgactccctaagctttagggcctcacctggttaagagagtggctgatttttttgatatagaacaaagcaacattactgtccatgtctgaaggtgaggtcttatcctgcagggaatgcaggtagcggaagctaagcagatcagagtccaaatgccagctgttatttcctgtgtagccttagcctactcacttcgcctctctgagccccagattcctcatctctcagtggatggtaatatccgcttgcagacatcagtacaggtaaagggc

SEQ ID NO: 162133 - DNA, 601 bp, Human
aaccttgcaaatgctgcataagtctaatatttgtggttctgaacatacgtgtggtctttaaaatgagatgtagtgatatttcctgagtgtttgatatagttctcttacctcttccaggaaaaacagaagcctatttggaagccatcagaaaaaatattgaatggttgaagaaacatgacaaaaagggaaataaagaaggtaggaccaagtgtggttgtacattgcaaacttcacccatttgtcaggggctcttgttatataaaaattcccacagtcaaattgactgtgctaaagtctcccygcagagcccaaaaaagactgaagtcacctgtcagatacagaggggaacagaacctccatttctcttattattcaaattagcctttcaagcaaaggcgttttcttttcttttacgttttattaggaaaaatgtcaagcaaacgtagaacgaatagcataatggatccctgtgtctccagcacccatcttcaataattatcaaatgttgccagtcttgttttatctagcccccctttcttggagtattttaaacaaaggcattttctgagcacaaattttgtgcaccctgcagtcacaaaag

SEQ ID NO: 162134 - DNA, 601 bp, Human
ccaggccctgttctaagtgccagagatgtcccgcccaaggaatgcacagcgtcattagagctatggttggccctgctcagtgatgtcatggataggtgtgttactgccaaggaggtgagaagatgggatggatcttcatactaggacagagacagttgagagaagggccacaagtcttctctggaaagttaaggatgaatctgccgagtgaggagagatggaggcagagcgaacactaggtaccaagacataaagggacaaaacagaggggtggttctgggaactggagccattcatgtcyccaggaacagtggatgtttgtggagaagagcagcatatagggttgggaagtgggcagtagccatgccaggaagacatttatgtactcttcagagaaggttggttttagccaagggagcctaaattggggcctaattaggttaagagctgagaaatccatctggcagcagtgtgactacagattgaaaaaataagaccccagaaggcagcagagagataaggaggtaagacagagagatctggagcagaaatatggggctgtaaaccaggggacaacagaggagataaaaaggaagggagg

SEQ ID NO: 162135 - DNA, 601 bp, Human
tgagatacagcacagagggagaaagaggtattttcagcaccctggtagcttaggtcttctaagttgagtgatgatggcaataattatcgatgttcatgcatactttatttggttcaaaatgatttgaatttccaggctgtcagttacattaaaatctacatgaaccatatttcatcgaatctgtcattgattaaaaatgcaccattgttttatgtgccattaaattacaacatgccatcaatgactgcaaagactttaaaattaaaatgttcatcttagaatcactgtagtacactgtgtrccaaaatacatcccaaagccatgataaattgtatggtacatcaatttggagtatttgttactgttttcactgattagcatatgaatcagactcctggtcataatcaacaacatcttgcaattcaatgttcccattccagaaatgaccaacctggtgaagcatagaactctggtgcttgcatatggaaggctctgttagcaaactggcattgggttcgatgctcccttttgtctctgggaaatatgcagtatgccctcttgaagacagaaacagagctctttctccactgctctcatatgc

SEQ ID NO: 162136 - DNA, 601 bp, Human
aatacatcccaaagccatgataaattgtatggtacatcaatttggagtatttgttactgttttcactgattagcatatgaatcagactcctggtcataatcaacaacatcttgcaattcaatgttcccattccagaaatgaccaacctggtgaagcatagaactctggtgcttgcatatggaaggctctgttagcaaactggcattgggttcgatgctcccttttgtctctgggaaatatgcagtatgccctcttgaagacagaaacagagctctttctccactgctctcatatgcgctcrgcttgacttggggtcatcttctcaaagcctgtgggggatctgggtcctagggtcatgcagtggctgcagctgtataagcagggagaattactattagttctgacctttcttaaccattgttgccaccctttgtttggtaagggactgggtgacctgaatccccttcccaaacccaggaaagggaggtccatgtgatgtgatagtgaggataatgagaaaatcttatgtagccttaaaaaaatatgcttttaaaaagcgaatcacagcccttctctcctttgagccttacaaccttaaaac

SEQ ID NO: 162137 - DNA, 601 bp, Human
aacaacatcttgcaattcaatgttcccattccagaaatgaccaacctggtgaagcatagaactctggtgcttgcatatggaaggctctgttagcaaactggcattgggttcgatgctcccttttgtctctgggaaatatgcagtatgccctcttgaagacagaaacagagctctttctccactgctctcatatgcgctcagcttgacttggggtcatcttctcaaagcctgtgggggatctgggtcctagggtcatgcagtggctgcagctgtataagcagggagaattactattagttcygacctttcttaaccattgttgccaccctttgtttggtaagggactgggtgacctgaatccccttcccaaacccaggaaagggaggtccatgtgatgtgatagtgaggataatgagaaaatcttatgtagccttaaaaaaatatgcttttaaaaagcgaatcacagcccttctctcctttgagccttacaaccttaaaacttcttttaaggttagcaagatggctactggcttatgtctcctaacccccagctagggcagagttggcattagaccaaagggcctttcctttgcaccatgct

SEQ ID NO: 162138 - DNA, 601 bp, Human
ttgggttcgatgctcccttttgtctctgggaaatatgcagtatgccctcttgaagacagaaacagagctctttctccactgctctcatatgcgctcagcttgacttggggtcatcttctcaaagcctgtgggggatctgggtcctagggtcatgcagtggctgcagctgtataagcagggagaattactattagttctgacctttcttaaccattgttgccaccctttgtttggtaagggactgggtgacctgaatccccttcccaaacccaggaaagggaggtccatgtgatgtgatagygaggataatgagaaaatcttatgtagccttaaaaaaatatgcttttaaaaagcgaatcacagcccttctctcctttgagccttacaaccttaaaacttcttttaaggttagcaagatggctactggcttatgtctcctaacccccagctagggcagagttggcattagaccaaagggcctttcctttgcaccatgctggttttcccactgcacacagtaatagccgtgtcataaagataacaatttttccttttcaaaagaaagcaaaatatttgcctgtttgtccattcaaatcactgg

SEQ ID NO: 162139 - DNA, 601 bp, Human
tggatggcctcaatctcgtgacctcctgatccgcctgcctcggcctcccaaagtgttgggattacaggtgtgagccaccgcgcccagcaaggcagtggttttcaaactttgatgcacattaaaatcacttagcgggagtctgccttttattccattaaagatgttgacactgcagcctattctgcagaggcagtattaatgaaccaggaataaacaagaagtgccctttgtgccttaggggtcaggaataaaggaatcatcgccttaggtgcggtgcctgcaaaatgtatgttcagcttcrttctctacttcgtgcctgagagaatgggaaaagtgaaaaacaaaaataaaaatgagcatttattgaacatttgctttgtacctgttagatgttttatagtcagtactacaaggctatggaatggtcaatcaatgaccagcattcagaacctgactctaccactacctgagcaagtaacttacccccttttctgtttcttcatctctgaaatgaggatactaatgcttacccatgagtgtggaaaaagcaacaatgtgctttctcctgttctctcactcaacacaacaatcaacacagaag

SEQ ID NO: 162140 - DNA, 601 bp, Human
tgtacctgttagatgttttatagtcagtactacaaggctatggaatggtcaatcaatgaccagcattcagaacctgactctaccactacctgagcaagtaacttacccccttttctgtttcttcatctctgaaatgaggatactaatgcttacccatgagtgtggaaaaagcaacaatgtgctttctcctgttctctcactcaacacaacaatcaacacagaagacttctgtgaccaaatgcgtgggggtttctccccaccaccaagcaagcaatcaattctgcagccgacactagctggktgtccgctgattcaattcaattccaacactatctacttagagtcagcctcagacaccacagggtgagggcgcagtcccaaaagagtgccccttcctttgcaccagttgcatgtccaggcctctggaacagctggctgactggcttcaagtttcggtttccacagcctcctcttagggttcagttaatttgctagagtgggcctggtatggtagctcacacctgtaatcccagcactttgggaggccaaggtgggaggatcacttgaggccaggagtttgagaccagcctggtcaacatag

SEQ ID NO: 162141 - DNA, 601 bp, Human
aatcaacacagaagacttctgtgaccaaatgcgtgggggtttctccccaccaccaagcaagcaatcaattctgcagccgacactagctggttgtccgctgattcaattcaattccaacactatctacttagagtcagcctcagacaccacagggtgagggcgcagtcccaaaagagtgccccttcctttgcaccagttgcatgtccaggcctctggaacagctggctgactggcttcaagtttcggtttccacagcctcctcttagggttcagttaatttgctagagtgggcctggtatgrtagctcacacctgtaatcccagcactttgggaggccaaggtgggaggatcacttgaggccaggagtttgagaccagcctggtcaacatagcgagaccccatctccacaaaaaatttaaaaattagccaggtgggccaggcacagtggttcacacctgtaatcccagcactttgggaggccgaggtgggtggatcatgaggtcaggagttcgagaccatcctggccaatatggtgaacctccatctctactaaaaatacaaaaattagctgggcgtggtggcacgtgcctgtagtcccagc

SEQ ID NO: 162142 - DNA, 601 bp, Human
ctctggaacagctggctgactggcttcaagtttcggtttccacagcctcctcttagggttcagttaatttgctagagtgggcctggtatggtagctcacacctgtaatcccagcactttgggaggccaaggtgggaggatcacttgaggccaggagtttgagaccagcctggtcaacatagcgagaccccatctccacaaaaaatttaaaaattagccaggtgggccaggcacagtggttcacacctgtaatcccagcactttgggaggccgaggtgggtggatcatgaggtcaggagttygagaccatcctggccaatatggtgaacctccatctctactaaaaatacaaaaattagctgggcgtggtggcacgtgcctgtagtcccagctgctcaggaggctgaggcagaagaatggcgtgaacccgggaggtggagcttgcagtgagctgagatcacgccactgcactccagcctgggcaacggtgcaagactccgtctcaaaaaaaaaaaaaaaattagccaggtgtggtggtgtgcgcttgtagtcccaagttactcaggaggctgaagcaggaggatcacttgagcccagaagtc

SEQ ID NO: 162143 - DNA, 601 bp, Human
tctgcagattcttcttggcctctctgtgcaacattccttcctccagggtacagggtaggaccctctatggatcaagggtgttatgacccacaatcagattagagtcctgccttggctgggtgaaaggagggcaggtcagagagaaagattctgcttcctgaggccttcttctgaggcccaaagtgccctaacattatgacaaaaggctgaaacaagggatatgggagttataagccaggaatcatggacgaaaacctatatagatagttagatgatggatggatggatagatagatagatggacagacagacagacagacagacagacagacagacagatgtcatagggtataacctcgtggggttttgtggggggcaattaaggtgatggctgtaaagtgtccagtgctgggatttccctttcaatcctcatggctgtgccctaacagggagcagatgtcctgcttgccagagaggatataagccctgtctaagcctcactcacttagtgattgtagagaggtccttcatggttcgttttcctttctcataagagcttaaggatacccaagtgacccaggctcagattacattcaggctc

SEQ ID NO: 162144 - DNA, 601 bp, Human
tatctgctgaccttctctccactattgtcctatgaccccgccaaatacccctctctgagaaacacccaagaatgatcaataaatactaaaaaaattaaaaaaataaaataaagcaaaataaaaacacacaaaaaaaattaggtgggcgtggtggccggcgccagtagtcccagctactcaggaggctgaggcaggagaatggcatgaacccgggaggcggagcttgcagtgagcagagattgcgccactgcactccagcctgggcgacagagcgagactccgtctcaaaaaaaaaaaaaaagcaatttatacacacacacacaattggggttaggattggtactatctgattcaaaagttaaacagaatttgataggctagtctgagaatattatccctacagggaaacattcaaagcaataaagctactttgaaaggacatgtccaaaagttttcatcatctataacaaaatcattgtcaaatactacttacattctttagaaaaaagtctctttcttttaccctgtccaccttctgcacctcctccaatttcttcattttcttcctcaaactagaagttaaaatgtatatatagaaatg

SEQ ID NO: 162145 - DNA, 601 bp, Human
ctatcgttctgttttggattctgtacttttttttgcctttttaaaaaaaagataattttagatttacagctgagttgcaaaaatagtacagggttcccatatgccctatatccagcttccccttatgttaacatgttatacaaccatagggagtcatcaaagctaagaaattaacatcggtacaggtacagacttcattcagattttacaagtttttccaccaatgtcctttttctgtttcaggttcccatactatttagttgtcatgcctccttagttccctcgaatccgatagttcctygactttttcatctttcaaaaccttgacgctttctttttttatttttattttttgagacggagtctctctctgtcaccaggctggagttcagtggtgtgatctcggctcactgcaacctctgcctcccgggttcaagcgattctcctgcctctgcctctcaagtagctgggactacaggtgcaggccaccacgcccagctaatttttgtatttttagtagagatgggttttcaacatgttggccaggctggtctggatctgctgacctcatgatccgcccatctcagcctcccaaagtgct

SEQ ID NO: 162146 - DNA, 601 bp, Human
gccgactgtatagcatacataaaattcagcaagctgttcacttaagacttgcacaatttattgtacctaagtttttttttttaaaaaagatactcatagaatacttctaaaggaagaaatgagtaaattaagaataattcctctatttagaagaagtaaaaactagtagaagtacaaagagaagaaagtagaccaggcctacagaagaaaagggtgacttggaaaccagcctgagatagacatatccctagggttttacactggcaagagtctttaggtccagaaacaggagtaaaaaaamaaacacaggagccaatagttcctatcgttctgttttggattctgtacttttttttgcctttttaaaaaaaagataattttagatttacagctgagttgcaaaaatagtacagggttcccatatgccctatatccagcttccccttatgttaacatgttatacaaccatagggagtcatcaaagctaagaaattaacatcggtacaggtacagacttcattcagattttacaagtttttccaccaatgtcctttttctgtttcaggttcccatactatttagttgtcatgcctccttagtt

SEQ ID NO: 162147 - DNA, 601 bp, Human
gttatagataatattggtatgaaaacatatttacatcgtatttgttatctccaagtatggattcttgtgtaaaaggtttaagaacagtctgatgaccaactgttcccacgtagcctccagcaaaactcttccttcctcccacctactgaaccctaaggtaaacagtcttttcctaatctctagcatctacttaccagtccctgcccccagcagaacacctttaagtaggaaactctggcaaaggacaggacagacagcaacagcttagccttttttggaggtggtttttgtgtgtgggcayggcagtggggcgttggaaaaacggcagactctttactgatattaccataggggaaaagacatgagagacagttctccaaatactttttttgtttgtttgtttgtttgtttttcttgagacagagtctcgctctgtcgcccaagctggagtgcagtggcaccatcttggctcactgcaagctccatcgcctcctgggttcacaccattctcctgcctcagcctcccgagtagctgggactacaggcacccaccaccacgcccggctaattttttgtatttttagtagagaaggggtttcac

SEQ ID NO: 162148 - DNA, 601 bp, Human
ggggggatagaatatacatgtataacctccatcctcaatgataaatagtaaccaataacttctgcaaacaagcactcaaatggatagcttatttcaaagggatgccataagttctagtcttacctaaagtttaatatttcaaatctattcttcaattaactaagaccagttaggaaagaatcttaccatttcagtgataaactctatgacaagatcttcaagaatatccactgactcagtataaggattctggtcatccccaaagccatacatcatacatcgcactgtaaaagaacaatctcttttgtttacttttacagatttaacaatttgatactttaaaaaaataaagtagaaatgaaccaagttatagataatattggtatgaaaacatatttacatcgtatttgttatctccaagtatggattcttgtgtaaaaggtttaagaacagtctgatgaccaactgttcccacgtagcctccagcaaaactcttccttcctcccacctactgaaccctaaggtaaacagtcttttcctaatctctagcatctacttaccagtccctgcccccagcagaacacctttaagtaggaaactc

SEQ ID NO: 162149 - DNA, 601 bp, Human
aggggggatagaatatacatgtataacctccatcctcaatgataaatagtaaccaataacttctgcaaacaagcactcaaatggatagcttatttcaaagggatgccataagttctagtcttacctaaagtttaatatttcaaatctattcttcaattaactaagaccagttaggaaagaatcttaccatttcagtgataaactctatgacaagatcttcaagaatatccactgactcagtataaggattctggtcatccccaaagccatacatcatacatcgcactgtaaaagaacaatcacttttgtttacttttacagatttaacaatttgatactttaaaaaaataaagtagaaatgaaccaagttatagataatattggtatgaaaacatatttacatcgtatttgttatctccaagtatggattcttgtgtaaaaggtttaagaacagtctgatgaccaactgttcccacgtagcctccagcaaaactcttccttcctcccacctactgaaccctaaggtaaacagtcttttcctaatctctagcatctacttaccagtccctgcccccagcagaacacctttaagtaggaaact

SEQ ID NO: 162150 - DNA, 601 bp, Human
gtgcctgtagtcccaggtatttgggaggctgaggtgggaggaccacttgagtccggaaggtctcagctgcagtgagcaatgatcatgccactgcactccagcctgggcaacagagtgagatcctgtcacacacacagacacacacacacaaaaaattgcgtatctttaaatactggaaaaggaggggaaaaaaaaaacctatgttggataatggtattatggataatatttttattttattcaaggattttataattatgtccttataaaaaatgcaagaggctgggcgcgttggctcacrcttgtaatcccagcactttgggaggccgaggctggcggatcacctgaggttgggagtttgagaccagcctgaccaacatggagaaaccctgtctctactaaaaatacaaaattagctgggtgtggtgatgcatgcctgtaatcccagctcctcggaggctgaggcaggagaatcccttgaatccgggagacggaggttgcagtgagccaagatcgtgccattgcactccagtctgggcaacaagaacgaaactccatctcaaaaaaaaaaaaaacaaaaggaagaaggggggatagaata

SEQ ID NO: 162151 - DNA, 601 bp, Human
tgggaggctgagggggtagattgcttgaacccagcagttcaagaccaacctgggcaacatagtgagaccctgtctctacaaaaaattcaaaaatcagcaaagcatggtggcatgtgcctgtagtcccaggtatttgggaggctgaggtgggaggaccacttgagtccggaaggtctcagctgcagtgagcaatgatcatgccactgcactccagcctgggcaacagagtgagatcctgtcacacacacagacacacacacacaaaaaattgcgtatctttaaatactggaaaaggaggggaaaaaaaaaacctatgttggataatggtattatggataatatttttattttattcaaggattttataattatgtccttataaaaaatgcaagaggctgggcgcgttggctcacgcttgtaatcccagcactttgggaggccgaggctggcggatcacctgaggttgggagtttgagaccagcctgaccaacatggagaaaccctgtctctactaaaaatacaaaattagctgggtgtggtgatgcatgcctgtaatcccagctcctcggaggctgaggcaggagaatcccttgaatccggg

SEQ ID NO: 162152 - DNA, 601 bp, Human
gccagacacagtggctcatgcctgtaatccagcactttgggaggctgagggggtagattgcttgaacccagcagttcaagaccaacctgggcaacatagtgagaccctgtctctacaaaaaattcaaaaatcagcaaagcatggtggcatgtgcctgtagtcccaggtatttgggaggctgaggtgggaggaccacttgagtccggaaggtctcagctgcagtgagcaatgatcatgccactgcactccagcctgggcaacagagtgagatcctgtcacacacacagacacacacacacamaaaattgcgtatctttaaatactggaaaaggaggggaaaaaaaaaacctatgttggataatggtattatggataatatttttattttattcaaggattttataattatgtccttataaaaaatgcaagaggctgggcgcgttggctcacgcttgtaatcccagcactttgggaggccgaggctggcggatcacctgaggttgggagtttgagaccagcctgaccaacatggagaaaccctgtctctactaaaaatacaaaattagctgggtgtggtgatgcatgcctgtaatcccagctc

SEQ ID NO: 162153 - DNA, 601 bp, Human; identical to SEQ ID NO: 28051

SEQ ID NO: 162154 - DNA, 601 bp, Human; identical to SEQ ID NO: 28052

SEQ ID NO: 162155 - DNA, 601 bp, Human; identical to SEQ ID NO: 28053

SEQ ID NO: 162156 - DNA, 601 bp, Human; identical to SEQ ID NO: 28054

SEQ ID NO: 162157 - DNA, 601 bp, Human; identical to SEQ ID NO: 28055

SEQ ID NO: 162158 - DNA, 601 bp, Human; identical to SEQ ID NO: 28056

SEQ ID NO: 162159 - DNA, 601 bp, Human
gtacttagaatagtcaaattttagagacagaaagtagaagggtgactgccaggagctgaggggagtggggaatgggaagataatacttactgcacatagaatttcagttttgctagatgaaaagagttaattagatggatgatggtgatggctgcaaaacaatgtaaatgtacttactaccactgaactgtacactttaaaatggttaaaatgctaaattttacatatatattttaccacaataaaaaattaaaattgatagcatcctagaatttaaggaacacagaatcctagcaaattsccccttcatattgaacatgggaaaactgcccaaataaaagagattatgatgttttaaaaaaggaagcagtgaatgataaggcaggattgtatctaggcagtttcaaatgcaggctgcagtgactgcagacctgaattttaatgttggccctaagtctttgaagcttatatgaccttgtgaaaatgtctgaagctctgtgtcttggttttctggtctgtaaaatggggatgatggttactgccacttaggattgtaaggaccctgtgaactaacatatgctgagcacttattgatatgcct

SEQ ID NO: 162160 - DNA, 601 bp, Human
caaaacaatgtaaatgtacttactaccactgaactgtacactttaaaatggttaaaatgctaaattttacatatatattttaccacaataaaaaattaaaattgatagcatcctagaatttaaggaacacagaatcctagcaaattcccccttcatattgaacatgggaaaactgcccaaataaaagagattatgatgttttaaaaaaggaagcagtgaatgataaggcaggattgtatctaggcagtttcaaatgcaggctgcagtgactgcagacctgaattttaatgttggccctaastctttgaagcttatatgaccttgtgaaaatgtctgaagctctgtgtcttggttttctggtctgtaaaatggggatgatggttactgccacttaggattgtaaggaccctgtgaactaacatatgctgagcacttattgatatgcctggtcaaaggcttgtcagaaaggtaatactgaagagcagagcatagagagtagagggaaaatgtttaagagcaaccctttgcaatgagggaaggagttgggtccagttgcaatgggagttaggttacaaaccacccatacatagttcacttcttg

SEQ ID NO: 162161 - DNA, 601 bp, Human
gttaaaatgctaaattttacatatatattttaccacaataaaaaattaaaattgatagcatcctagaatttaaggaacacagaatcctagcaaattcccccttcatattgaacatgggaaaactgcccaaataaaagagattatgatgttttaaaaaaggaagcagtgaatgataaggcaggattgtatctaggcagtttcaaatgcaggctgcagtgactgcagacctgaattttaatgttggccctaagtctttgaagcttatatgaccttgtgaaaatgtctgaagctctgtgtcttkgttttctggtctgtaaaatggggatgatggttactgccacttaggattgtaaggaccctgtgaactaacatatgctgagcacttattgatatgcctggtcaaaggcttgtcagaaaggtaatactgaagagcagagcatagagagtagagggaaaatgtttaagagcaaccctttgcaatgagggaaggagttgggtccagttgcaatgggagttaggttacaaaccacccatacatagttcacttcttgcaatgaaagagtacaaacattcctctgactgaagagaagcttctgggata

SEQ ID NO: 162162 - DNA, 601 bp, Human
atgataaggcaggattgtatctaggcagtttcaaatgcaggctgcagtgactgcagacctgaattttaatgttggccctaagtctttgaagcttatatgaccttgtgaaaatgtctgaagctctgtgtcttggttttctggtctgtaaaatggggatgatggttactgccacttaggattgtaaggaccctgtgaactaacatatgctgagcacttattgatatgcctggtcaaaggcttgtcagaaaggtaatactgaagagcagagcatagagagtagagggaaaatgtttaagagcawccctttgcaatgagggaaggagttgggtccagttgcaatgggagttaggttacaaaccacccatacatagttcacttcttgcaatgaaagagtacaaacattcctctgactgaagagaagcttctgggatattttagaaaaacttaaattcaaaaatttttggaaataattatgtatctgttaataataacagacatataattaaggttccattcatgtttaatgatggccaacttgagaggccctgtactttaagatggatactaaccttttcattagtgcaactgggcatttgcagtt

SEQ ID NO: 162163 - DNA, 601 bp, Human
cctctgactgaagagaagcttctgggatattttagaaaaacttaaattcaaaaatttttggaaataattatgtatctgttaataataacagacatataattaaggttccattcatgtttaatgatggccaacttgagaggccctgtactttaagatggatactaaccttttcattagtgcaactgggcatttgcagttggaattatcattttacctgggccagggagatcccctggtttcttgtaggatgcaggttatttctttgctgctaattgctcctgcctgtttgtttcatatgatsagacactgaatgtgataaaataccaacactagtagcctgttacagtgaggggacattaaatctataagaatgaatttattagtgtagctctaggcttctggaaatgaacaaatttcttttaaaattcagaagtgcgtctcctgtggttaaaaaaaactgtagactatgacatatttgtttaattactgagggtgaattttctgtttcaattatgaaatataatgtgttaacacagatattaataatggagaattacttgctttatgaagctccagatttaagaaggaaaatggaaaaata

SEQ ID NO: 162164 - DNA, 601 bp, Human
attttacctgggccagggagatcccctggtttcttgtaggatgcaggttatttctttgctgctaattgctcctgcctgtttgtttcatatgatgagacactgaatgtgataaaataccaacactagtagcctgttacagtgaggggacattaaatctataagaatgaatttattagtgtagctctaggcttctggaaatgaacaaatttcttttaaaattcagaagtgcgtctcctgtggttaaaaaaaactgtagactatgacatatttgtttaattactgagggtgaattttctgtttyaattatgaaatataatgtgttaacacagatattaataatggagaattacttgctttatgaagctccagatttaagaaggaaaatggaaaaatacgtctaattgtttgagttaagcaagtagttacttactttaggtctaacttgatgagttgccctagaacattcttataatgtttttttaactgaggatcatgaccttgatccatgtcaacagaggatcaggtggtgaaatcccgaaggtgtctggctatttggcagttttaattatgaggccatctcaaagtcagcagaaattacaaa

SEQ ID NO: 162165 - DNA, 601 bp, Human
gtagcctgttacagtgaggggacattaaatctataagaatgaatttattagtgtagctctaggcttctggaaatgaacaaatttcttttaaaattcagaagtgcgtctcctgtggttaaaaaaaactgtagactatgacatatttgtttaattactgagggtgaattttctgtttcaattatgaaatataatgtgttaacacagatattaataatggagaattacttgctttatgaagctccagatttaagaaggaaaatggaaaaatacgtctaattgtttgagttaagcaagtagttayttactttaggtctaacttgatgagttgccctagaacattcttataatgtttttttaactgaggatcatgaccttgatccatgtcaacagaggatcaggtggtgaaatcccgaaggtgtctggctatttggcagttttaattatgaggccatctcaaagtcagcagaaattacaaaaatacaattttcaacaaagtgagtgaaatactaatggtgaatactaatggtagtaacgccaaagcaggcatcatcacccatgagataggtaaacaggtgaagtgaggtgttctggactggcttct

SEQ ID NO: 162166 - DNA, 601 bp, Human
gtggttaaaaaaaactgtagactatgacatatttgtttaattactgagggtgaattttctgtttcaattatgaaatataatgtgttaacacagatattaataatggagaattacttgctttatgaagctccagatttaagaaggaaaatggaaaaatacgtctaattgtttgagttaagcaagtagttacttactttaggtctaacttgatgagttgccctagaacattcttataatgtttttttaactgaggatcatgaccttgatccatgtcaacagaggatcaggtggtgaaatcccraaggtgtctggctatttggcagttttaattatgaggccatctcaaagtcagcagaaattacaaaaatacaattttcaacaaagtgagtgaaatactaatggtgaatactaatggtagtaacgccaaagcaggcatcatcacccatgagataggtaaacaggtgaagtgaggtgttctggactggcttctgacctgttaaatcatcataatacccttctctcttatttttacattaaaagtgagataatattaatcccaaatgtatatttttaaaagttgctataaaaataaaaatactca

SEQ ID NO: 162167 - DNA, 601 bp, Human
aaactgtagactatgacatatttgtttaattactgagggtgaattttctgtttcaattatgaaatataatgtgttaacacagatattaataatggagaattacttgctttatgaagctccagatttaagaaggaaaatggaaaaatacgtctaattgtttgagttaagcaagtagttacttactttaggtctaacttgatgagttgccctagaacattcttataatgtttttttaactgaggatcatgaccttgatccatgtcaacagaggatcaggtggtgaaatcccgaaggtgtctgrctatttggcagttttaattatgaggccatctcaaagtcagcagaaattacaaaaatacaattttcaacaaagtgagtgaaatactaatggtgaatactaatggtagtaacgccaaagcaggcatcatcacccatgagataggtaaacaggtgaagtgaggtgttctggactggcttctgacctgttaaatcatcataatacccttctctcttatttttacattaaaagtgagataatattaatcccaaatgtatatttttaaaagttgctataaaaataaaaatactcataacttaaaag

SEQ ID NO: 162168 - DNA, 601 bp, Human
gaccagctttgcttttcatctgtgcctccaggaaatgttttctcaggccttggcaaacaaggtacatcttaagattgtatcccatatgtgatcacaattatctgagttatgcggtgcctcactgagacatcctagctaaaattaaggcagttttccccttagtcttcaagtaaactcccacagaaagtgttcacagacacagaaaaacaaattgatcaaatcggcagaattcttagtttacagaggtaaaagatgtgcttttcatggaatcctaggccactggtatttgttaggactgaakggaaagaggtttccctgttcctttgggaaagtgagttaagaaagaaaatgtgacaagaacaatagggactttttcttggtctcatgttatccttcccaaagtggaagagagattcctcctctagatcttcgtatcctgtcacacattgctggctttcaacaaatattgaataaatgagtgaatcacgatattgaatgaatgaagttgctgctatactgagataggagctggggcttcgcttttaggaacactgggaacttcttttttctctgtcctccccaaattcaggggacttaggtg

SEQ ID NO: 162169 - DNA, 601 bp, Human
caaagtggaagagagattcctcctctagatcttcgtatcctgtcacacattgctggctttcaacaaatattgaataaatgagtgaatcacgatattgaatgaatgaagttgctgctatactgagataggagctggggcttcgcttttaggaacactgggaacttcttttttctctgtcctccccaaattcaggggacttaggtgtgtacctatgactagggtaatattatagtctaaacatgtacccgccccccacccccgggttgcccactgcgaagctcatgccctcattccaccacamccagtgagaggacaggggagcggagtactgccactgcctggttgcttggtttccagcatcactgatatcatgttctttgactctttggacagtagtggtgtaagatgccttattatggtattgaactcaaatgcaatatgactgtgctcttcatggctgaaagattcaagtcttatctcaatctctcctcatagttcagagtctagtggagagcaggcatgcaggaaatgtttgcatgcgtggcagaggtataattctgagtacaaaatgctgtcatagtaattatttcttttggtaact

SEQ ID NO: 162170 - DNA, 601 bp, Human
gatgccttattatggtattgaactcaaatgcaatatgactgtgctcttcatggctgaaagattcaagtcttatctcaatctctcctcatagttcagagtctagtggagagcaggcatgcaggaaatgtttgcatgcgtggcagaggtataattctgagtacaaaatgctgtcatagtaattatttcttttggtaactagagataatgtttacttaaaggagatttcatggactgagccttactcttcctttcttgatcctgaatgtttaaaaacagagttatgaaatcaagactgcgtgayaattttaataactagttttaaaaataagtataatgactggctggaatgtggtgtgtgcgtgtatttgtgtatatgcagtgttactaatccagctatgctttaacatttgttgaccttaaaaagggggctgttttcttttccccattttaatttagatacttaccattctgatttaggaatcttacactcaaaattagtttctgttttataaaataaataagcattattgtggcaaatcactgcttgtatgttgattttggatttagacaggacagcagagctcaggaaagaacaaagcaa

SEQ ID NO: 162171 - DNA, 601 bp, Human
ctcttcataatacttgtaatttaatgctgggcacttcagttaacaatatgagcagaattatgccgtggtaattgtagaggtatgtggcaaagcagctgattttaaaattttaatccactctaaatatgcattgcacccttactaaattagcctctgattcttagtggccttttggaaaatgtattcagtatgctaaagtttttagaaaaaacattctgaaattttccttttcattcaagccctgttttttttcttcccccttcccagcacatgacttttattattccaagaattgatactrgaaactgcatttattggaaagatagaacaatggtatcagttaattctggaaaaacagtagatgtcacatcagatgtgtcctgggcagtaaagttatacagtttgtattttttctggttctaaatctgaaggtattattttctttttcagttgaaccctgggtggccccatctaacactttcggatttcagctggcttttatttctattgtatttgaatgaagaatcaggaaattctattgggattacattatcttatggttatgttgagattatgagagacaccacttatgctactacgt

SEQ ID NO: 162172 - DNA, 601 bp, Human
ccctgttttttttcttcccccttcccagcacatgacttttattattccaagaattgatactagaaactgcatttattggaaagatagaacaatggtatcagttaattctggaaaaacagtagatgtcacatcagatgtgtcctgggcagtaaagttatacagtttgtattttttctggttctaaatctgaaggtattattttctttttcagttgaaccctgggtggccccatctaacactttcggatttcagctggcttttatttctattgtatttgaatgaagaatcaggaaattctatygggattacattatcttatggttatgttgagattatgagagacaccacttatgctactacgtacgtttcaaagtggtgcttttaggttttctgttctttgtgagcctctttgtgtgtctttttcatgacttgcatgtgaggcagctgaggaagaaacaatctatacatcgtttctcaatctatacttcctttggcatttataccacgcataaatatactgaaacatgatttttttttaaaaaagtgtggggggcaggagggaggggaagaaatagtaagcatcaatatacacagagcactg

SEQ ID NO: 162173 - DNA, 601 bp, Human
tttcagttgaaccctgggtggccccatctaacactttcggatttcagctggcttttatttctattgtatttgaatgaagaatcaggaaattctattgggattacattatcttatggttatgttgagattatgagagacaccacttatgctactacgtacgtttcaaagtggtgcttttaggttttctgttctttgtgagcctctttgtgtgtctttttcatgacttgcatgtgaggcagctgaggaagaaacaatctatacatcgtttctcaatctatacttcctttggcatttataccaygcataaatatactgaaacatgatttttttttaaaaaagtgtggggggcaggagggaggggaagaaatagtaagcatcaatatacacagagcactgagccagatgctggggaggttaccaaacgaattataggctctgccctggaatagaaggtaacgttatacaaagaagcaaactcacaagttaataagatcaggacaaaaagtgttaaaatggagataagtgaggctagtctgcgctaccaggggaagtcactgtggcctgagtgtttaagcttttggaggaagagagacagacctca

SEQ ID NO: 162174 - DNA, 601 bp, Human; identical to SEQ ID NO: 28057

SEQ ID NO: 162175 - DNA, 601 bp, Human; identical to SEQ ID NO: 28058

SEQ ID NO: 162176 - DNA, 601 bp, Human; identical to SEQ ID NO: 28059

SEQ ID NO: 162177 - DNA, 601 bp, Human; identical to SEQ ID NO: 28060

SEQ ID NO: 162178 - DNA, 601 bp, Human; identical to SEQ ID NO: 28061

SEQ ID NO: 162179 - DNA, 601 bp, Human; identical to SEQ ID NO: 28062

SEQ ID NO: 162180 - DNA, 601 bp, Human; identical to SEQ ID NO: 28063

SEQ ID NO: 162181 - DNA, 601 bp, Human; identical to SEQ ID NO: 28064

SEQ ID NO: 162182 - DNA, 601 bp, Human; identical to SEQ ID NO: 28065

SEQ ID NO: 162183 - DNA, 601 bp, Human; identical to SEQ ID NO: 28066

SEQ ID NO: 162184 - DNA, 601 bp, Human; identical to SEQ ID NO: 28067

SEQ ID NO: 162185 - DNA, 601 bp, Human; identical to SEQ ID NO: 28068

SEQ ID NO: 162186 - DNA, 601 bp, Human; identical to SEQ ID NO: 28069

SEQ ID NO: 162187 - DNA, 601 bp, Human; identical to SEQ ID NO: 28070

SEQ ID NO: 162188 - DNA, 601 bp, Human; identical to SEQ ID NO: 28071

SEQ ID NO: 162189 - DNA, 601 bp, Human; identical to SEQ ID NO: 28072

SEQ ID NO: 162190 - DNA, 601 bp, Human; identical to SEQ ID NO: 28073

SEQ ID NO: 162191 - DNA, 601 bp, Human; identical to SEQ ID NO: 28074

SEQ ID NO: 162192 - DNA, 601 bp, Human; identical to SEQ ID NO: 28075

SEQ ID NO: 162193 - DNA, 601 bp, Human; identical to SEQ ID NO: 28076

SEQ ID NO: 162194 - DNA, 601 bp, Human; identical to SEQ ID NO: 28077

SEQ ID NO: 162195 - DNA, 601 bp, Human; identical to SEQ ID NO: 28078

SEQ ID NO: 162196 - DNA, 601 bp, Human; identical to SEQ ID NO: 28079

SEQ ID NO: 162197 - DNA, 601 bp, Human; identical to SEQ ID NO: 28080

SEQ ID NO: 162198 - DNA, 601 bp, Human; identical to SEQ ID NO: 28081

SEQ ID NO: 162199 - DNA, 601 bp, Human; identical to SEQ ID NO: 28082

SEQ ID NO: 162200 - DNA, 601 bp, Human; identical to SEQ ID NO: 28083

SEQ ID NO: 162201 - DNA, 601 bp, Human; identical to SEQ ID NO: 28084

SEQ ID NO: 162202 - DNA, 601 bp, Human; identical to SEQ ID NO: 28085

SEQ ID NO: 162203 - DNA, 601 bp, Human; identical to SEQ ID NO: 28086

SEQ ID NO: 162204 - DNA, 601 bp, Human; identical to SEQ ID NO: 28087

SEQ ID NO: 162205 - DNA, 601 bp, Human; identical to SEQ ID NO: 28088

SEQ ID NO: 162206 - DNA, 601 bp, Human; identical to SEQ ID NO: 28089

SEQ ID NO: 162207 - DNA, 601 bp, Human; identical to SEQ ID NO: 28090

SEQ ID NO: 162208 - DNA, 601 bp, Human
ggatcgcttgaggtcaggagtttgagatcagcctggccaaaaaggtgaaaccttgtctctactaaaaatacaaaaattagccgggcgtggtggcaggcatctgtaatcccagctactcgggaggctgaggcaaaagaatcgcttgaactcgagaggcggaggttgcagtaagccgagatcaccccactgcattccagcctgggtgacagagaaagactccatctccaaaaacataaataaaataaaataaaagtaattttgagagcttattcccttattcttaattcatataactaaagamgctgctcacgatttacagacttgaaaaataaggggcttcaaattacaactatatttaatactataatattaacaaagatttaattgcttgtttaaaaattcaaaaccacaattcctctagcaagtgtgaactgttaccatttaaagaaaataatagggataatcacattcatcaaatactttttttaacctgatgctatgctagtcaccacaatgaccatctcttgtacttttgttctgccattaaaaaattcttagaccattcattattgaattatagtttaagctggtaaactgaggt

SEQ ID NO: 162209 - DNA, 601 bp, Human
gccaaagtaaaaatgcttattaaactcaatttagattatatctgtcacttcttccttgttaaaagcaattactatggaagaaaataaattacacctaataatgtccactcattacaaagttgggtactatcaaatttttatggcttttacaggtagttgctaacagattgaatgattttaacactctcttataatctgaagaaagcaaatttctgcaaacataatgggactagtaaagatgaaataataaaaaacagtagaggtggtggagaaagcaaatttaaaaaacaaatgaaatgargtacagatggacttcgtttgcagcttatgaaattaacgaagacaacagcaaagacaaaagcctaaagggattaaactgtaagggtggaaaacataagcaaagaaggtgcagcttcaaatacacattagccttactatcacatttgggattaagtaaaaaataagtaaataaataaatacacacaggcctgagacagaacctaattgagctgaagttgagttgtagagaatcatattcaagttcaaagcagattaaacttgctttccactttccatcatcctattcagcaaaatgaaaata

SEQ ID NO: 162210 - DNA, 601 bp, Human
gctggtgactttaagttaaagtcaatgctcatttactgttctgaaaatcctaagacccttaaggactatacaacaagccaggtgtaatggtgcacatctgcagtctcagctactaggaggctgagataggacaatcacttgagcacaagagttcaaggctggctgggcaacatagtgagactcctgtctcttaaaaacgaaaaaaaaaaaaaaaggtttatgctaaatctactctgcctatgctcagcggaacaacaaagcctgaatagcagctaatctgtttacagcatggtttattgattttttttttttttttgagacgtagtcttgctctgttgcttaggctggagtgcagtggcccgatctcagctcactgcaacctccgcctcctgggttcaagcgatcctcctgtctcagcctcacaagtagctgggatttacaggcatatgccaccacgcccagttaatttttgcatttagtagagacggggtttcgttatgttggccaagctggtctcgaactcctgacctcaggtgatccacccacctcggcctcccaaagtgctgggattacaggtgtgagccactgcacccagctagtt

SEQ ID NO: 162211 - DNA, 601 bp, Human
ttgctgatatgaagaaggttttagtgatctggatagaagatcaaaccagccacaacattccaatatgcaaaaacctaatccagaacaagaccctaactctcttcaattctatgaaggccaagagagttgatgggggtgcaaaataaaagtttgaagctaacagaagttggttcatgaggtttaaggaaagaagacatctccaaaacataaaaatgcaaggtaaagcagcaagtgcttttacagaagctatagcaagttatccagaagattgagctacgatcaatgatgaaggtggcttcaytaaacaacacactttcactggagaggaagcagtcttatgttggaagaagatgccatctaggaccttcatagctagaaaggacaagacaatgcctcgcttcaaaggacaggttgcctctcttgttaggggctaatgcagctggtgactttaagttaaagtcaatgctcatttactgttctgaaaatcctaagacccttaaggactatacaacaagccaggtgtaatggtgcacatctgcagtctcagctactaggaggctgagataggacaatcacttgagcacaagagttcaaggctggc

SEQ ID NO: 162212 - DNA, 601 bp, Human
gcctaatccataggcaatataagatttgaggagcaggggagaaaatctcgaacaattatttcacaaaaatactaaccataatatttatttttattttttaatacatatatttttaggctagccaagtgaagcagtggaaataaatatttaaataaatgaatgaatggaaattcatatctgattaagtaaatgcaataatcagtaaaactttgttatattggtcctatttttaaaaatcacagtttcgataatgctcacatcaaaatctgtggctcaggcacattaagatataaagtaatcycttcttattagtaaaaagctaggatttggcatcatggtatagtggagagcacaaagaatttataagttgaacattggctctgctactcaccatgtggcctgaggcaagtcacttattcaccagcctcagattatcactaaaaaggcaataaccacccactatcccacagagtggagaaaggatgaaattaataacacttccataaatggcctcaatctacctctctccctcatctcttatctctttaccacatgcccaatgtgctaactgccctaaacttttatttcccatgtgctatac

SEQ ID NO: 162213 - DNA, 601 bp, Human
tttttagtgccatttgaaagaatattctacatttgtaaatactctatgcgaaataaaaaagcaatccaaaacaaaacggtagaagaagcagttaactttcaattaattttgttaaatccatgaagataatagagcttaagaagaactagtaactactgaaaaaacagagcagcctagttcagaaaacacaaataattacatatatgtttaaagtagaaacagcgtggtgtggcgaaaaataatggctttagagctacacagcccttattttgaattccaaatctgtcacttaaataatctkcctaattttttggcacctcactttcctcatttttaacatggtgataatggttacctgtcctgattgttgtgaggattaaataagccacaaaccagtgcctggtttgaacactggctctgctactcaccatgctcaacaatggtagttggtatttttactgaaatgttgatgacattttctgggtaaaattgtttcctctttcagcctggccaaagcaagaaattctcgattctttaaatttaccagcttataatcaatttgttaacctatgccatatgtctaaattcagcccgaaattta

SEQ ID NO: 162214 - DNA, 601 bp, Human
taagtgtgtgaggataaatggagtcaggtgataataattatttaggtggaaaaatcacattttttgttccataaagtcttaaatgtggcccattattattttcatgttcaagtttctctctcctccagcattttttttttttttttaaagatggagtctcgctctgtcacccaggctaaagggagtggcgcgatctcggctcactgcaacctctgcctcctgggttcaagtgattctcctgcttcaacctcctgagtaactgggactacaggcgcccaccaccgcgcccggctaatttttkgtatctttttttagtagagatggggtttccccatgttagccaggatggtctcgatctcctgacctcgtgatccgcccgcctcggcctaccaaagtgctgggattacaggcgtgagccaccgtgcccagcctcctccagcatttctatttagctaactcaatatattgtttattctaagtggtttttctctttcaggttgcctggcttccccagatgggttgtttatctttgtcacctcatgggggatgagatttagttgttggaggaccacaagcggtagcagtctcaagaaaatggaaa

SEQ ID NO: 162215 - DNA, 601 bp, Human
tatctattcatttgtcagctggaggacatttgggctgttacttctttattagctattatttataatgctgctataaacattcctgtacaagtttttgtgtggaaatacacttaattactgggacatatggtaattctatgtttaactttttaagaaactgtcaaattgttttccaaagtagttgtactattttacattgtcactagtagcagatgagagtttcaatacttcacatcctttccaacacttgatatctgtctttttgtttatagccatcccagtgagtgtgaaaaaactgtayctcattttggttttgatgtgtatttctttaataactaatgatgttgagcatcttttcatgtacatattggtgctttttcctctcctcaccttaattggaaagctgttacttccttttgttcccacagttttgaggttctgccctgacttacttatcacattgtaaatattattgttctctgaactatgcatcctttggttaaaaaccttacttagcatttacataatacattcccaaagagtctgtcattttccattatttctatccctttcatcatgtgatctctgttctaggtcactt

SEQ ID NO: 162216 - DNA, 601 bp, Human
ttgcaactagattccttaacttgcattttcaagcttcacacatgttatagcaggaatcagtactttgtttttattgccaaataatattccattatatggctatatcacattttatctattcatttgtcagctggaggacatttgggctgttacttctttattagctattatttataatgctgctataaacattcctgtacaagtttttgtgtggaaatacacttaattactgggacatatggtaattctatgtttaactttttaagaaactgtcaaattgttttccaaagtagttgtactrttttacattgtcactagtagcagatgagagtttcaatacttcacatcctttccaacacttgatatctgtctttttgtttatagccatcccagtgagtgtgaaaaaactgtacctcattttggttttgatgtgtatttctttaataactaatgatgttgagcatcttttcatgtacatattggtgctttttcctctcctcaccttaattggaaagctgttacttccttttgttcccacagttttgaggttctgccctgacttacttatcacattgtaaatattattgttctctgaactatg

SEQ ID NO: 162217 - DNA, 601 bp, Human
agtgtttcttaatatagtcacactgttgtgtagctgtcaccacaatctaattttacatttttgtctccccactaaaagaaaccctctacccatcagcaggctaatccccatctcactctccccaaccctatccagactaaacgaccattaatctaacttctgtctctataaatttacctattctggacatttcctacgaatggaatcatacagtatgtgtttgggtttttttgcaactagattccttaacttgcattttcaagcttcacacatgttatagcaggaatcagtactttgtttktattgccaaataatattccattatatggctatatcacattttatctattcatttgtcagctggaggacatttgggctgttacttctttattagctattatttataatgctgctataaacattcctgtacaagtttttgtgtggaaatacacttaattactgggacatatggtaattctatgtttaactttttaagaaactgtcaaattgttttccaaagtagttgtactattttacattgtcactagtagcagatgagagtttcaatacttcacatcctttccaacacttgatatctgtc

SEQ ID NO: 162218 - DNA, 601 bp, Human
ttacccagtctgtggtattgttatagcagcatgaaacatactaagacaacaccatataattcactcaaagtgttcagtgtttcttaatatagtcacactgttgtgtagctgtcaccacaatctaattttacatttttgtctccccactaaaagaaaccctctacccatcagcaggctaatccccatctcactctccccaaccctatccagactaaacgaccattaatctaacttctgtctctataaatttacctattctggacatttcctacgaatggaatcatacagtatgtgtttgggkttttttgcaactagattccttaacttgcattttcaagcttcacacatgttatagcaggaatcagtactttgtttttattgccaaataatattccattatatggctatatcacattttatctattcatttgtcagctggaggacatttgggctgttacttctttattagctattatttataatgctgctataaacattcctgtacaagtttttgtgtggaaatacacttaattactgggacatatggtaattctatgtttaactttttaagaaactgtcaaattgttttccaaagtagttg

SEQ ID NO: 162219 - DNA, 601 bp, Human
accttggtcttggactttccagcctccagaaccacgagtcaataaatttcaattcattataaattacccagtctgtggtattgttatagcagcatgaaacatactaagacaacaccatataattcactcaaagtgttcagtgtttcttaatatagtcacactgttgtgtagctgtcaccacaatctaattttacatttttgtctccccactaaaagaaaccctctacccatcagcaggctaatccccatctcactctccccaaccctatccagactaaacgaccattaatctaacttctgyctctataaatttacctattctggacatttcctacgaatggaatcatacagtatgtgtttgggtttttttgcaactagattccttaacttgcattttcaagcttcacacatgttatagcaggaatcagtactttgtttttattgccaaataatattccattatatggctatatcacattttatctattcatttgtcagctggaggacatttgggctgttacttctttattagctattatttataatgctgctataaacattcctgtacaagtttttgtgtggaaatacacttaattactgg

SEQ ID NO: 162220 - DNA, 601 bp, Human
gtggctcatgcctataatcttggcacttccggaggtggaggtgggatgattgcttgggcctaggagttcaagaccagcctgggcaacacagggagatttgtctctacaaaaaaattaaaaattagcctggcgtagtagtggatgtctatagtcccagctacttgggaggctgaggtgagaggattgcttgagcccaggaggctgaggctgcaatgagccataatcatgacactgcacttcagcctgggtgacagacgggagaagggagaccctgtctcaaaaaaaaaaaaaaaaaaaaaargattatgtcattctttggtcttgtggatgatccaaattatttttcatgcactgtggaaacatatttcacattttcattttaaagatggttttggaaaaataaacatgaccataagagactatcttcttaacaagaaggggagaaaattggcctaaacaacaaattaggaactaaggagttaaaaggggaattagggggactaagagactactgtgaacatttccaatattttaagagcctatattgatttcatgttacagtcaaaggttaactgcttaatgtaggctgaacataacattt

SEQ ID NO: 162221 - DNA, 601 bp, Human
actccagcctgggtgacacagtggctcatgcctataatcttggcacttccggaggtggaggtgggatgattgcttgggcctaggagttcaagaccagcctgggcaacacagggagatttgtctctacaaaaaaattaaaaattagcctggcgtagtagtggatgtctatagtcccagctacttgggaggctgaggtgagaggattgcttgagcccaggaggctgaggctgcaatgagccataatcatgacactgcacttcagcctgggtgacagacgggagaagggagaccctgtctcaaaaaaaaaaaaaaaaaaaaaaagattatgtcattctttggtcttgtggatgatccaaattatttttcatgcactgtggaaacatatttcacattttcattttaaagatggttttggaaaaataaacatgaccataagagactatcttcttaacaagaaggggagaaaattggcctaaacaacaaattaggaactaaggagttaaaaggggaattagggggactaagagactactgtgaacatttccaatattttaagagcctatattgatttcatgttacagtcaaaggttaactgcttaat

SEQ ID NO: 162222 - DNA, 601 bp, Human
tagtggagtgtcccaagcaagagaaatgttaagaccactttttgtttgagctcagatttgtataaagaaaatgcaaatgaggtaaactgtgttctgaatacattagattaagttgtgttgaaattcttccaaatatgtggagataaatccactagaagttgaagaactcagcagtgatgaagatagttatacttctaattcacagcctataacttatacaacctatggttgtaattttcttctcagcctataacactgagaagatggtgagagtaataccagacagtagatttaataaagsccaaagtataatataaagagagtttattgggccaaatccacaaactggtcagtcaagaaaagtataaatgatacaagaggactgtacctacacagttaaaaaagaagaaaaaaaacttactaagaaataacaaaggaggatggatcttgaggctgttgcaaatattactgaagaaaattatgtataaagaagattatgggctagccaggtgtggtggctcatgcctgcaatcctgacactttgggaggccgaggcgggtggatcacttgaggtcaggagtttgagaccagcctgtccaac

SEQ ID NO: 162223 - DNA, 601 bp, Human
aacatgcctatggagcagaacacacaacacatgaatcctgaagaaattgtatgtgaatttacttagcaatcgtctctttgatccatctgacttattttaaagaaaagacagccagacaaggctgggcgtggtggctcacgcctgtaatcccagtgctttgggaggccaaggtgggcggatcacctgaggtcaggagttcgagaccagcctgcagatctgccactaatactgggtactcatcaacaatgtccttcaaaatccagtacatatgctaagaataagtattagattaacagaggcycttaagcaaaccagtgctatttagtggagtgtcccaagcaagagaaatgttaagaccactttttgtttgagctcagatttgtataaagaaaatgcaaatgaggtaaactgtgttctgaatacattagattaagttgtgttgaaattcttccaaatatgtggagataaatccactagaagttgaagaactcagcagtgatgaagatagttatacttctaattcacagcctataacttatacaacctatggttgtaattttcttctcagcctataacactgagaagatggtgagagtaatac

SEQ ID NO: 162224 - DNA, 601 bp, Human
tattacagtttaagtacaaatactgtgggactcaagaaggaaagaacaaaaataggccgctcacacctgtaatcccagcactttgggaggccgaggcaggtggatcacaaggtcaggagtttgagaccagcctggccaagatggtgaaaccccgtttctactaaaaatacaaaaattagctaggcatggtggtgggcatctgcaatcctggctactcgggaggcagaggcaggagaactgcttgaacccgggaggcggaggttgcagtgagctgagatggtgcctctgcactccagcctargcgacagagtgagactctgtctcaaaataaataaataaataaataaataaaataaaaataaagcaatggtaagagatgttgtcaaggggataactgagctaaatcttgaaggatgattagttcatgaaaaagtagaaaaatgggtggggggaaatggaggagagacattccagagataaaatagcaggatttaatatacctaacataaaaaagaagaaaagaatcctgtcattcacagagaaagtgggtacacagaagcagtgagcacatgtacttccaacctgattcttcccccttcct

SEQ ID NO: 162225 - DNA, 601 bp, Human
aaaccataaaagcagtgactcaatttaagaaaaaaattaaataaacacaaagatgatccataaaaatagaaagattacaaaggtagtctctaaaagactgaatttagggaaaatttcctactatcatcacataaaaactgcacagcaaccatgtgaagaagaattattcctatattcataaagaaactagctcagagaaagctgaaatgatttgcccaaggtggtgtagccaataaagccaatggaaccatggcaaagccaggcctcagctgtggtcttggatcatctcactagcaggaarcagtgtgagggtccacagggagacgtgcaacattgatcaaggcagtgtgaacttgaaggaggatttttgaaaaccttaaaaatcatggagggctcaaaatcacagaggaggaataaatacagcacatgtctggaaagatttgcttgggaagattgggtcatattaggaaaatcttggaaggcaaatagaggagtctaaaggagatggaaaacaactgaaattctctatgtagaagtctaaaaatgaaagcagtattttaggcaaggaaacatgagtacaaaaatgcaaaaagaaataaat

SEQ ID NO: 162226 - DNA, 601 bp, Human
atcccagcactttgggaggccaaggtaggcggatcacctgaagttgggagttcaagactagcctgaccaacatagagaaaccctatctctactaaaaatacaaaaaattagccaggcatggtggcacatgcgtgtaagcccagctactcgggaggctgaggcaggagaattgcttgaacccaggagaaggaggttgcaatgagctgagatcacgccattgtactccagcctgggtgacaagagcgaaacttcatctcaaaaacaaacaaacacacagtttggaatgttgtgatacaattawttataatagtaattgttaaggactgtctgtactacatttcccagtacaattttattaatgattccaattcaaataaacaatgataatttaattccataagttttaaacatgcctaaagctgtgttggatgctgtggggaacaagagtgagcataagatatttcctgacattaagcagctcataatctagttgaaaagtcaacttcaacttaagaaactaagaaagaatgatggtaataatagtaacttacacatagtaacattttacagtttttaaaatattttcacatatttcttttgg

SEQ ID NO: 162227 - DNA, 601 bp, Human
ggttgaattcttagcactgatatacacattgatttataacgatacagtcatgtgataataatagtttgagtcactattcttgtatcaaaaaatttgatacatttatagtgtggacaaaatacacattaacatacagtttggaggctgggtgcggtggctcacacctgtaatcccagcactttgggaggccaaggtaggcggatcacctgaagttgggagttcaagactagcctgaccaacatagagaaaccctatctctactaaaaatacaaaaaattagccaggcatggtggcacatgcrtgtaagcccagctactcgggaggctgaggcaggagaattgcttgaacccaggagaaggaggttgcaatgagctgagatcacgccattgtactccagcctgggtgacaagagcgaaacttcatctcaaaaacaaacaaacacacagtttggaatgttgtgatacaattatttataatagtaattgttaaggactgtctgtactacatttcccagtacaattttattaatgattccaattcaaataaacaatgataatttaattccataagttttaaacatgcctaaagctgtgttggatgc

SEQ ID NO: 162228 - DNA, 601 bp, Human
ctaaacgttttacctgtattatctcatttacagcaatctcatcctatgctgtaagtactatcatgattgttccattttacaggaaaggcaaagggaacctccaggatgatgctgaagacagagcccactatgacagctgtgcaactatcccagagcgcagacatgaggcagagtgaaaagataacacagaactgggaagcaggtaaagctcaggtgagatactagctctaccacatgttattagtgtaaccttgggaaaatgagtcaatacttcttagctttaatttaccatctatgcaayaggaataatactatatcacagaaaattgagataagccacagaatgatcctcaacagacataataacaattatatgctaaaaagagtcatggcgacaaattagaatttaggtagctgggcatatttcttggaattctaaacattttgtagtacaatagtactgtggaaaatatcaaagtaatgtggttgaattcttagcactgatatacacattgatttataacgatacagtcatgtgataataatagtttgagtcactattcttgtatcaaaaaatttgatacatttatagtgtggacaa

SEQ ID NO: 162229 - DNA, 601 bp, Human
gctctgtcacccaggctggagtgcagtggtgtgatcacggctcactgcaaactccacctccctggttcaagcaattctcctgcctcagcctcctgagtaggtgggatcacaggcactcaccacctgtgatccaaaatgtgatacaaaaatgccaggctaatttttgtattcttagtagagagggggtttcaccatgttggccaggctgatctcgaactcttgaccgcgtgattcacccaccttggcctcccaaagtaatgggattacagttgtgagccaccacacctggccctaaataccttttttttaattttatttttaagatacagggtcttgttctgttgctcatgattgagttcaatgacataatcttaggttactgtaatcttcaactcctgggctcaatcaatcctcccacctcagtctcctgagtagctaggattactggtgtgcaccactataactggctaatttatttggtagagacaaaatatatcacccaggctggtctctaacttgtggcctcaagagatccttttgcttcccctcccaaagtgctaggattacaggcatgagccaccacacccagccttaaataagt

SEQ ID NO: 162230 - DNA, 601 bp, Human
attaatttatttttgagacagagtctcactctgttgcccaggctggagtgcagtggtgcaaactcagatctctgcaacctccacctcctgggttcaagcaattctcctgcctcacctcccgagtagctgagattacaggtgcccactgccacatccagctaatttttgtatttttagtagagacggggttttgccatgttggctaggctggtctcgaaatcccgacctcagatgacctgtctgccttggcctcccaaagtgctgggattacaggcatgagccatcgcgcctagcctatttyatttttttgagacaaagtctcgctctgaggcctaggcaggagtacaatggcacaatctcagttcactgcagcctaaacctcccaggtccaagtaatcccctggcctaagccttcccagtagctgggactacaggcatgtgccgtcacaccttgctaattaaaaaaatgtttttttgtagagacaaggtctccctatgttgcccaggctggccacaaactcctgttctcaagtgatcctcctgtctcagcctccaaagtgttgggattagaggtgtgaaccaccatgcccagccagggctg

SEQ ID NO: 162231 - DNA, 601 bp, Human
cagaggtggaatctagagaagcagtaggccttgctgagctgtggtgtgctctgcccagttcgcggttccctgccactttgtttactccaagtgagcacagaactgcctactcaagcctcaccaatggcagacgccccttgccccaccaagctcccacgtcccaggtcaatctcagactgctgtgctagcagctagcaaggctccgtgggtgtgggacctgctgagccaggcatgggaagggatctcctggtctgatggttgtgaagactgtgggaaaagcgcagtatttgggcaggagtgyaccactcctccaagcacagtcactcacggcttcccttggctaggaaagggaaatcccccgaccccttgtgcttcctgggtgaagcaatgccccaccctgctttggctcaccctccgtgggctgcacccactgtccaaccagtcccaatgagatgaaccaggtacctcagttggaaatgcagaaatcacccatcttctgtgtcaatcttgctgggagctgtagaccagagctgttcctattcagccatcttggaagcgactccttaagatacgtgttttttaaaaaatcttaattgagttc

SEQ ID NO: 162232 - DNA, 601 bp, Human
gttcagatatgccctgcccccagaggtggaatctagagaagcagtaggccttgctgagctgtggtgtgctctgcccagttcgcggttccctgccactttgtttactccaagtgagcacagaactgcctactcaagcctcaccaatggcagacgccccttgccccaccaagctcccacgtcccaggtcaatctcagactgctgtgctagcagctagcaaggctccgtgggtgtgggacctgctgagccaggcatgggaagggatctcctggtctgatggttgtgaagactgtgggaaaagcrcagtatttgggcaggagtgcaccactcctccaagcacagtcactcacggcttcccttggctaggaaagggaaatcccccgaccccttgtgcttcctgggtgaagcaatgccccaccctgctttggctcaccctccgtgggctgcacccactgtccaaccagtcccaatgagatgaaccaggtacctcagttggaaatgcagaaatcacccatcttctgtgtcaatcttgctgggagctgtagaccagagctgttcctattcagccatcttggaagcgactccttaagatacgtgtttttt

SEQ ID NO: 162233 - DNA, 601 bp, Human
tctcagcacttgcttgtctgtaaaggattttatttctccttcacttatgaagcttagtttggctggatatgaaattctgggttgaaaattcttttctttcagaatgttgaatgttggctcccactctcttctggcttgtagggtttctgctgagagatgcactgttagtctgatgggtttccttttgtgggtaacctgacctttctctctggctgcgcttaacatttttcccttcatttcaaccttggtgaatctgacaattaagtgtcttagggttgctctttttgaggagcatctttgyggtgttctctgtatttactgaatttgaatgttggcctgccttgctaggttggggatgttctcctgaataatatcctgaagagtgttttctaacttggtttcattctccctgtcactttcaggtacaccaatcaaacgtagatttggtcttttcacatagtcccatatttcttggaggctctgttcatttcttttcacttttttttctctaatcttgtcttctcactttatttcattaatttgatcttcgatcactgatatcctttcttccgcttgattgaatcggctattgaagcttgtg

SEQ ID NO: 162234 - DNA, 601 bp, Human
tttccctttacacacttctttaaatgtgtcccagagattctggtacgttatgtctttgttctcatcggtttcaaagaacatctttatttctgccttcatttcgttatttacccagtagtcattcaggagcaggttgttcattttccatgtagttgcgtggttttgagtgagtttattaatcctgagttttaatttgattgcactgtggtctgagagacagtttgttgtgatttctgtttcttttacatttgctgaggagtgctttactttcaattacgtggtcaattttagaataagtgckatgtggtgctgagaagaatgtatattccgttgatttggggtggagagttctgtagatatctattaggttcacttggtgcagagctgagttcagttcctggatatccttgttaattttctgtctcgtcgatctaatattgacagtgggctgttaaagtctcccattgttactgtgtgggagtctaagtctctttgtaggtctctaagaacttgctttatgaatctgggtgctcctgtattgggtgcatatacatttaggatagttagctcttcttgttgaattgattcctttaccattatg

SEQ ID NO: 162235 - DNA, 601 bp, Human
tgctagcttttgaatttgtctgctcttgcttctctagttctttcaattgtgatgttagggtgttgattttagatctctcctgctttctcttgcgggcatttagtgctacaagtttccctttacacacttctttaaatgtgtcccagagattctggtacgttatgtctttgttctcatcggtttcaaagaacatctttatttctgccttcatttcgttatttacccagtagtcattcaggagcaggttgttcattttccatgtagttgcgtggttttgagtgagtttattaatcctgagttytaatttgattgcactgtggtctgagagacagtttgttgtgatttctgtttcttttacatttgctgaggagtgctttactttcaattacgtggtcaattttagaataagtgctatgtggtgctgagaagaatgtatattccgttgatttggggtggagagttctgtagatatctattaggttcacttggtgcagagctgagttcagttcctggatatccttgttaattttctgtctcgtcgatctaatattgacagtgggctgttaaagtctcccattgttactgtgtgggagtctaagtc

SEQ ID NO: 162236 - DNA, 601 bp, Human
attcctaaacacataggaaaagatcattcattttgtatcaaataccttgtataattagtgtcctatgatatacactttgggaaacgttgaactaattcctatcaatatactaaggttaaaagataactccctggctgggcacagtgcttcaagtctgtaattctagctactcaggaggctgaagctggaggactacctgaggccaggagcttgaggccagcctgggcaacatagcaagaccccatctcttaaaaaagaaataaaattagctgggtgtggtggtgtgtgcctgtcatctcakctactcaggaggctgaagtgagaggatactagagcccagaagttcaaggttgcaatgagctatgatcactcactcactcactcactcattcattcactcagcactatttccattaagtcagtattttcaaaatttgcctggttacaacagtcatggggtatttgttaaactacaaatttctgggtcacataactaaccctaatgactcaattttatgggaggaggctgagattctgtagttttaccaagtgcctcagatggctactataaaacttcattcgttcaaccattcctgtgttt

SEQ ID NO: 162237 - DNA, 601 bp, Human
aggcaaagtaattaagcaataagatggcaatgtaaaccagtgcatacaaaaagttaattctttatgtttctacactacctcataaaggacaaaaatccttattttaatttttaatgtaataaaaatatagtttaaaaaagatatatagagcctacatatgccaaaaaaaaatagctaaagatcattaagctaaaatgtgtactttagtccacaccatctgctacatagtggcttgtgtagacagttaaccatgaacagaataagctgcgatagtagcaaggaaccacatactctacttcaygtacagtgtatagtccttagggcataagtacacattccttagtatattaatagggatttggtaagaaacggtttggggcagggattgtaagtagacttgtcaaatctatttaatagataagtagattgctctaaagtgtaatttctcatacccttcaaaatgctaatgactgcctagctaatctccaaaagaagaatataatattcagcattcctaaacacataggaaaagatcattcattttgtatcaaataccttgtataattagtgtcctatgatatacactttgggaaacgttgaa

SEQ ID NO: 162238 - DNA, 601 bp, Human
atagcaatgaactagatagacctagaaaaactaacatgagattaatgaggtttaaataaatgagtaagccgggtgcagtggctcacgcctgtaatcctggcgccttgggaggccgaggcgagtggatcacgaggtcaggagattgagaccatcctggccaacatggtgaaaccccatctctactaaaatacaaaaaattagctgggcatggtggcgcatgcctgtagtcccagctacttgggaggatgaggcaggagaatagcttgaattcaggaggcggaggttgcagtgagccaagatsgcgccactgcactccagcctggtgacagagcaagattctgtctcaaaaataaataaataaataagtaaaaaatagtaggcaattttaggcaaagtaattaagcaataagatggcaatgtaaaccagtgcatacaaaaagttaattctttatgtttctacactacctcataaaggacaaaaatccttattttaatttttaatgtaataaaaatatagtttaaaaaagatatatagagcctacatatgccaaaaaaaaatagctaaagatcattaagctaaaatgtgtactttagtccacac

SEQ ID NO: 162239 - DNA, 601 bp, Human
ttcctgactatgtcattggtgagggcacacccaagtttgcctaagactgggagttgtcctaaagattactcaaaatgacatttattttaaaccagattattctctctaataggaactatgtgccaataatgtcactagttttaccccatgatggtcttcataaataaagctactcttaggacaaaatacaatcaggttataatcaaaagccagagatactctataagtcaaaatgatagatcaaataaaaaatagaaacaaactatatacctattaaaaacagatagatgtaatcagaaaratgaactgaaaatatttccttgtaacactaatgatatggtagttttacaaataagcacttgctcaatatatttaacttatcttgggtaaatagtaagaatgaagattttagtttcctgccatgcacctgggagaatggagacagagtgaaatgattgtgggtggtactcacttgcaaaactgcctctgtcaagtttttctgaagagctttattattttccttagtttgccaatagcaatagtctttgagactattttgaacaaaatttcctttgagaatcactttgtttaccatcattgg

SEQ ID NO: 162240 - DNA, 601 bp, Human
tttgcctgtaaaaattacaattgttcagtggatttaacttgaagggcgtttctgggtttgcaatccaaattgtgcagtcatcatgctaacactgctgagatatgtctgagcacccttcaattgttctgtgtctaaactcccccatttaccacttttcctgactatgtcattggtgagggcacacccaagtttgcctaagactgggagttgtcctaaagattactcaaaatgacatttattttaaaccagattattctctctaataggaactatgtgccaataatgtcactagttttacccyatgatggtcttcataaataaagctactcttaggacaaaatacaatcaggttataatcaaaagccagagatactctataagtcaaaatgatagatcaaataaaaaatagaaacaaactatatacctattaaaaacagatagatgtaatcagaaagatgaactgaaaatatttccttgtaacactaatgatatggtagttttacaaataagcacttgctcaatatatttaacttatcttgggtaaatagtaagaatgaagattttagtttcctgccatgcacctgggagaatggagacagag

SEQ ID NO: 162241 - DNA, 601 bp, Human
cactccagccggggtgacagtgagacctcatctctcccccaaccccccactatatatatatattcttgcacataagacaaagtaggaatgttcttgcacataagacaaaataggaataacagttctgtagtcactctctctcttagggaaaattgggccctatcattatggagaaacaagcatgtagctggcatgaaaagaagagtagagaaagcataacagaattttagaactagaagaaccttggtcatcatctaaacctactccagtgactctagaggaaaagctgaggaagtgttaycacatcatttatttttctctttaaatcataccaacacctctccttcaagattctgattcccagccatagtcactaatatgaataccttgtatctctcaggtgtgcaggaacagaaaagttgagaacctcatattttaatgtttatagttctaaaaaactaatgcctgggttaatcagtggctaaagacacatcatactactgcccaaagaaaaaggttatagtcttgatgctttgagaacttatgttcttgcttcccaatattctgtaattctaactttcttgttctaaaacaaggtatg

SEQ ID NO: 162242 - DNA, 601 bp, Human
cccagtgagctatgatgatgccactgcactccagccggggtgacagtgagacctcatctctcccccaaccccccactatatatatatattcttgcacataagacaaagtaggaatgttcttgcacataagacaaaataggaataacagttctgtagtcactctctctcttagggaaaattgggccctatcattatggagaaacaagcatgtagctggcatgaaaagaagagtagagaaagcataacagaattttagaactagaagaaccttggtcatcatctaaacctactccagtgactctagaggaaaagctgaggaagtgttatcacatcatttatttttctctttaaatcataccaacacctctccttcaagattctgattcccagccatagtcactaatatgaataccttgtatctctcaggtgtgcaggaacagaaaagttgagaacctcatattttaatgtttatagttctaaaaaactaatgcctgggttaatcagtggctaaagacacatcatactactgcccaaagaaaaaggttatagtcttgatgctttgagaacttatgttcttgcttcccaatattctgtaattcta

SEQ ID NO: 162243 - DNA, 601 bp, Human
cagattacataaaagtacctttgattttgtctaacaataaatctgagacatttttatatcacattattgttttagacaaaatccatagtccacatatgttttacatatcatttaattaacactttaagcatcccagacagaaagaaacaatcagaatacttaacaaattccagtttctgatgtatattggagtatacactatatattttaattaaggaagtcaggtagaaatctgatttctaccacagaagttttaaatgctatttgaacatttaacaatttattttcaggggatttttttccttaatttgctttgaaaaaggaaaatttgaaatgttcctattctagaatattttccccaaacataccagcaagtgaattcccagtttttactttaaacttatcttacttcccatctaaataaaggatactggggctgggtgcagtggctcctgcctgttatcccagtattttggtgagctgaggcgggaggatcacgaggccaggagtttgaaaccagcctgagcaacatagtgagaccgcatctctatgaaacattttaaaaattaggtaggcatagtggcgtgtgcacctgtagtcc

SEQ ID NO: 162244 - DNA, 601 bp, Human
gatgagaaattctggaaacagatagtggtaatgggtgtacaacactgtaaatgtaattaatgccactgagttgtacacttaaacatggttaaaatggtaacttctgtattgtatatattttgccacaataaaaagtaaattaaaaaaataataatcacacaaatttgaccaagcagtcgtttcataaagtagaaggatgattcaggattgtgatatgaattatatttttaatgacgaaggaacattttaatgacaaaaaatacttatggctatagcagctcaaagtcaagacataaataargcacttattactattagcagatatattctagtagtttgactttaagatacactgactacattggctttcataaatatcaatttctttagtaatctgaaataaaattcgtggcaataagccaagttcctaatgcaagagatattgacaatcatcatttaacagtcaaccacttacttattttaaaggtttgaaaagcactaagagctaaaaacagaaaagactaagctccactttcctcaaagactaaatctcttgagacgctgatgattctggcttccttgaatgtgcctggggtaataa

SEQ ID NO: 162245 - DNA, 601 bp, Human
cagggtatgtttctttttacactttgaaaatttatcagtcctgaggtcttgtgaaattcctgtcaaggccgggtgcagtggctcacacctgtaatcccagcattttgggaggcagaggtgggcggatcacgaggtcaggagatggagaccatcctggccgacatggtgaaaccctgtctgtactaaaaatacaaaaattagctgggtgtggtggcgggcgcctgtagtcccagctacttgggaggctgaggcaggagaatggcatgaacctgggaggcggagcttgcagtgagtggagatmgcaccactgcactccagcctggtgacagagcgagacactgtctcaaaaaaaaaaagagaaattcttgtcaaattatgcacttactttaaagaagtggtacccagaggaagtaaattcatttccataatttgtttcatagataaggaactggaacaccaaattctaaggactgcttaaggacatactgtttatgaagtactttcaataattaaaaaggggatcaaaaggccaagaaaagtaataaaaagggaaaattagctgcaaagtcagatattacaaagctattataatatcttcttt

SEQ ID NO: 162246 - DNA, 601 bp, Human
aagaggtggaaatgaggtggtaagaagaagagatacttttactttctttatatatgccttttgtttgagctgaatgcctcatcagggtatgtttctttttacactttgaaaatttatcagtcctgaggtcttgtgaaattcctgtcaaggccgggtgcagtggctcacacctgtaatcccagcattttgggaggcagaggtgggcggatcacgaggtcaggagatggagaccatcctggccgacatggtgaaaccctgtctgtactaaaaatacaaaaattagctgggtgtggtggcgggygcctgtagtcccagctacttgggaggctgaggcaggagaatggcatgaacctgggaggcggagcttgcagtgagtggagatcgcaccactgcactccagcctggtgacagagcgagacactgtctcaaaaaaaaaaagagaaattcttgtcaaattatgcacttactttaaagaagtggtacccagaggaagtaaattcatttccataatttgtttcatagataaggaactggaacaccaaattctaaggactgcttaaggacatactgtttatgaagtactttcaataattaaaaaggg

SEQ ID NO: 162247 - DNA, 601 bp, Human
gtacatgtgttcctgataatgaactattctcaaacatctctgcctgtcatgtatgtatcagggacagaaacactttcatagtttagaggaaagatgttcttttcatggtctggcaaaatttttcaatgaaagtttaatcgttcctgatccaaatataaaatttttatatacagaagactaattttgagcaatgtatagaaactatccaatataaaagtataaaaaagtggccgggagtggtggctcatgcctgtaatcccagcactttgagaggccacagtgggtgggtcacctgaggtcrgtagttcgagaccagcctgaccaatagggcgaaaccttgactctactaaaaatacaaaaatgagccaggcgctgtggcgtgcgcctgtagtcccagctactcaggaggctgaggccagagaactgcttgaatctgagaggtggaggttgcagtgagccaagatcgtgccaccgcactccagcctgggtgacagatcaagactccatctcaaaaaaaccaaaaaccaaaaaaacaaaaaacctctaacatcacacggtcaggaccttggtgatcagatttgtatatttatgtcaaaccatt

SEQ ID NO: 162248 - DNA, 601 bp, Human
ctcacacctctaatcccagcactttgggaggacgagacaggcggatcacttgaggcttggagtttgagactagactggacaacatggtgaaaccccgtctccactgaaaatacaaaaattagccaggtgtgatggtgggtccctgtaatcccagccacttgggaggctgaggaaggagaatcacttgaacctgggagatggaggttgcagtaagccgagatcatgccactgtactccagcctgggtgacagagcaagattccatctcaaaaaacaaaacaaaacaaaacaaaaaacaaaamaaaaaaaaagagagagagaaaagaggtttaattgactccaagttcagcatggctagggaagcctcaggaaacttataatcatggtggaaggcccctcttcacagggcagcaggagagagaatgagtgcaaggaggggaaatgcgtgatgcttataaaaccatcagatctcatgagactcactcacaatcataagaacatagaggaaaccgcccccatgattgttacctcccacaaaacgtgaggattatgggaattacaagtcaagatgagtggggggagacacagccaaaccatatcag

SEQ ID NO: 162249 - DNA, 601 bp, Human
tgaatatcttggtgggaaaccatgctgctttagagttcagccttcaaaagtttaggtcactgttgtgaccccaagaaataccagatggaatggaacttctagtttctgagtagcaaataatctttactctgcaggaactaagaaccaaatccatattccagggctcttttaggattattcagaatcctaaaatgactcctttgaaggatccccactgagactggcctcagtaatggtttgcattacatcacctgtcagattactattatgtttctttttttctttctttctttttttttttgagacggagtcttgctctgttgcccagtctgcagtgcagtggcacaatctcagcagactgcgacctccgcctccagggttcaagcaattctcctacctcagcctcccgagtagctggaattataggcgcctgccaccatgcctggctaattttttgtatttttagtagacatggggttttgccatgttggccaggctggtcttgaactcctgacctcaggtgatccacccacctcagcctcccaaactgctgggattacaggtgtgagccactgcgcccagacactattatgtttctttt

SEQ ID NO: 162250 - DNA, 601 bp, Human
tttgttttttctctatgactcattctcatcctctatctctcccactctttggattttctggtttgtttttccttaatgacattttcccctctagtttccattctctatttctgttctttcagcaattacccttgaaattttactatatatcttaaattgttaaataagtttaaacaattgcttgacatcctcctgaacaacacgaagactttctaatacttcaattccaattttctcctcctgacttacctaatattggtgtccaacgttcccagtagtctctttttaaaaaaaaaaaaaactccataaataagatattagagttgttttattgagacaacactgatttgagtcgatgtacaagtttactagttcatttattcactactctttcttacatttcagactactagtcttctaggatcattttattctttcttgaggtatattccttagaattcctttaggtttctcaaactcagcactatggaattttggagcaaataattactgtgagggactgtcctgtgcactgtagaatatttaagagcatccctggcctctactcattagatgccagtagcacctccagtagtgactg

SEQ ID NO: 162251 - DNA, 601 bp, Human
aactaatatttattaaattcctaggatgtactggatactgttctgggtcctagagatatagcagtggacatggcagttaaagaccctgcctttactgtgcatatactgaagttacagaagacagaaagtaagtaaaaacaacaacagcaattaaaaaaaaaaaaacaaacaaaaaagacaaaataaaaacaaaaaaacccaaaaagaatttcaagaagtggtaagttcaaggaagaaaatcaaataggtactgggagagactgtgactagggaggggaatgacgacttcatgtaagatcaytggtgtgctgataacagcctctaaagaattaaaacaaatccgacttacagtacttgacaatttctgtggtataaatactcacacatggccattttcaaactactaatgtgaagacaatgaacctggttttgggaagagatttgcattaactggctcttgtgagctggtataagctggctgcagcacactcctggcataggatagtaaggaaaagcctacatttcaggcagagggaacacagcaattttaaaagatcctaaagcagaaccaattcaagtgaattcataaagcagaaaggac

SEQ ID NO: 162252 - DNA, 601 bp, Human
taaacccaggaggcggagcttgcagtgagccgagatcgtgccactgcactccagcctgggcgacagagcgagactccgtctcaaaaaaaagagtatagcttaaaattatcaccacttctgagtaattcatttattcaactaatatttattaaattcctaggatgtactggatactgttctgggtcctagagatatagcagtggacatggcagttaaagaccctgcctttactgtgcatatactgaagttacagaagacagaaagtaagtaaaaacaacaacagcaattaaaaaaaaaaaaacaaacaaaaaagacaaaataaaaacaaaaaaacccaaaaagaatttcaagaagtggtaagttcaaggaagaaaatcaaataggtactgggagagactgtgactagggaggggaatgacgacttcatgtaagatcattggtgtgctgataacagcctctaaagaattaaaacaaatccgacttacagtacttgacaatttctgtggtataaatactcacacatggccattttcaaactactaatgtgaagacaatgaacctggttttgggaagagatttgcattaactggctcttgtgagc

SEQ ID NO: 162253 - DNA, 601 bp, Human
actcagggtataatactgtgttagatgtagtctcctttacacactattgctgctgataatgacagtaaaagctctctgcctccacagctgtctgaccttttataaattatatgaagttttgatttgcatttctctgatgatttcagtgatgagcatttcacaccagtcagaatggcaattattaaaaagtcaaaaataacagatgttggcaaggctgtggagaaaaagaaatgcttatacactgctggtgggaatgtaaattagttcagtcactgtggaaagcaatttggagattcctcaragaacttagaactaccattccacccggcaatcccattactgggtatatacccaaaggaaaataaatcattctaccaaaaagacacatgcacttgtatgttcattacatacaattgaaacccaaccttcaagccaaagacagtttaaagcctagctacaagtcctggataaatccatggactgaactgagaacctctcttcccgtttggcatactttcctctaattgattctccactctttacctattttacatatatctacccttccctaattggttttttacactgtgtgcctttgttt

SEQ ID NO: 162254 - DNA, 601 bp, Human
atatgttatatactttggcagttaaaacagcttaaggactgtatccccacatcagaatttagactgcatcatatgttttctttgtgctatgacgctggtgcccagaacagttccaggcacctctcaagcatttaataaatagctgctgaacacagaatggtgccttaggtatttccttctttcttatatacagggctctttctatgtattccttgttattctgaggcctcaccttggtgggcttctttttcccttcagtgatgttttctgcctcttcatgttcctttgctccttgagtcarattagtgtaattggccatgcggttgaggagggaagacaccttcggtctggtgtccatttcttcctataaagccagtgacatggaagaaatgagctacaaagaacactgaacataagtatcaaaataatcttgctaccagaaaacttcaaattaaatgaaaaaatatttcacaggtaggccgggtgcagtggctcacacctgtaatcccagcactttgggaggccaaggtggctggatcacctgaggctgggagtttgagaccagcctggccaagatggtgaaaccccgtctctactaaaa

SEQ ID NO: 162255 - DNA, 601 bp, Human
ctcacgcctgtaatcccagcacgtcgggaggccaaggtgggccttataaaggttgctggcaataactacactgtctgcaaagccctttatgaatagttcaaaatgtgtataataaaaaaagattatgtacaattatcagggagaaaaaaatctaatatctgaacctaaatgatggttacagctactagttctatgcttaggacataagaaagaggatgaacgggacatagtttgctggtaggcttcctgcctagatgaggaaggaagtctaactgggcttatccgagagggaaaatctcasagagactctatgaaattctgacttaaaattatcacaccaccagatattttcaattactacccaataaggatggctaggcagagagacagacacgtacgggaagtgtggaggagcaaaagaagacttgatggctccagcatagatggccaagatggacacaatgacacaggccaggaaaagtgaggcaaacttgttcacatagcgtacgccgataaataccactaataccataaggaccaagaaagctgtgccgtagacacgcatgttatttagcatggctgctgattccttgagtgcgtc

SEQ ID NO: 162256 - DNA, 601 bp, Human
actagtcaaagggaaaagtgagcctgtgagtcacagatgtgcacaaatccattactacttcaaaaaacatactttaaagtattcgcactagggagttgaaggaggtggtgaatgatgagagagtacttaatgggtacaaagtacattatttgggtaatggataaaagccctgacctaggctgggcgcagtggctcacgcctgtaatcccagcacgtcgggaggccaaggtgggccttataaaggttgctggcaataactacactgtctgcaaagccctttatgaatagttcaaaatgtgtrtaataaaaaaagattatgtacaattatcagggagaaaaaaatctaatatctgaacctaaatgatggttacagctactagttctatgcttaggacataagaaagaggatgaacgggacatagtttgctggtaggcttcctgcctagatgaggaaggaagtctaactgggcttatccgagagggaaaatctcacagagactctatgaaattctgacttaaaattatcacaccaccagatattttcaattactacccaataaggatggctaggcagagagacagacacgtacgggaagtgtgg

SEQ ID NO: 162257 - DNA, 601 bp, Human
taaaaaggaccttcagctgtattacagtccctagataagcagattaaaagtttaagatggaatctacttctgccatcatgcagcatagcatagaagaaatactgaatggggagtcaggaaatcacagttcatcttcttgctctgccattaattaactttgaggtaagtcattaaacctactggaactgtctttttgtcttgaaaaatctttttttctgtaatctggttaaatcaacatagaaccgatgagtttgatcctcagataatccagatgactcttcaagataattctgtaacaagrctacaaataacactgagtgccagctagtccctatgccactagtcaaagggaaaagtgagcctgtgagtcacagatgtgcacaaatccattactacttcaaaaaacatactttaaagtattcgcactagggagttgaaggaggtggtgaatgatgagagagtacttaatgggtacaaagtacattatttgggtaatggataaaagccctgacctaggctgggcgcagtggctcacgcctgtaatcccagcacgtcgggaggccaaggtgggccttataaaggttgctggcaataactacac

SEQ ID NO: 162258 - DNA, 601 bp, Human
gaagccccaaaggtgaacctgagacaaaatggaatttcccaaattgagatataaccagaatgtcacctttagaaattttatgcccctaaaaaggaccttcagctgtattacagtccctagataagcagattaaaagtttaagatggaatctacttctgccatcatgcagcatagcatagaagaaatactgaatggggagtcaggaaatcacagttcatcttcttgctctgccattaattaactttgaggtaagtcattaaacctactggaactgtctttttgtcttgaaaaatctttttttctgtaatctggttaaatcaacatagaaccgatgagtttgatcctcagataatccagatgactcttcaagataattctgtaacaagactacaaataacactgagtgccagctagtccctatgccactagtcaaagggaaaagtgagcctgtgagtcacagatgtgcacaaatccattactacttcaaaaaacatactttaaagtattcgcactagggagttgaaggaggtggtgaatgatgagagagtacttaatgggtacaaagtacattatttgggtaatggataaaagccctgaccta

SEQ ID NO: 162259 - DNA, 601 bp, Human
tgtagtgatttgaataatattgcatcacaatttcttatccattcttctagtgttgactttctattatataaaatattataattaacatctttatgcacatatctacattcacagttcaggtttttttccttaaggcaggttttgttttttttttgagacaggtctcactctgttgccaaggctggagtacagtgacgctatctcagctcattgcagccttgacctctctggctcaggcgatgctcctgcctcatcctcccaagtggctgggaccacaagtgtgtgctaccatgtctgactmatcttttacaaaagtttctgtagagacaggatctcgccttgttgcccaggcttgtcatgaactcctgggctcgtgtgatcttcccctcttggcctcccagtatgctggaattacaggcatgagccattgtgcccagctaagttatggcagattcttaagagggaataactaaccaaagggatcaatatcttaaaacatttcaaaatcactactaaactgctgtccagaaagtttgtactaaattttactcccactggaaatataagaagattcaagtcttgtggcacatgcacactccac

SEQ ID NO: 162260 - DNA, 601 bp, Human
aaataagctaagcttcagttgtaactttccccttcagggtatcaaaatatctgctttttagaaaaatcgcgatctcactgcactataattctgtattcttgaaatgtaagcatttttctatgtcataaaaagctatgaataaaaatttgtagtgatttgaataatattgcatcacaatttcttatccattcttctagtgttgactttctattatataaaatattataattaacatctttatgcacatatctacattcacagttcaggtttttttccttaaggcaggttttgttttttttttgagacaggtctcactctgttgccaaggctggagtacagtgacgctatctcagctcattgcagccttgacctctctggctcaggcgatgctcctgcctcatcctcccaagtggctgggaccacaagtgtgtgctaccatgtctgactaatcttttacaaaagtttctgtagagacaggatctcgccttgttgcccaggcttgtcatgaactcctgggctcgtgtgatcttcccctcttggcctcccagtatgctggaattacaggcatgagccattgtgcccagctaagttatggcagatt

SEQ ID NO: 162261 - DNA, 601 bp, Human
gatataggaaaataggataggaggatgaggattcagataagaattgaaagttgaaacagtatgaaatggctgaccaagaaaaaaattttatcgagaacccagactctcctagttttctagttcaaagatgggttctctccaaacgtgagtaaaaagaataaaagaagcagacttaccaatggtagtagcggaatcggggtctccagttgggtgttcgaagtaatgtttgcaaggcacatgccaagtttacaaagaggtaacacatgagaaaaaacctgaagaataaagagtaagaggaatrattattactggaagatgattctttgaaggttaagtaactgaatacctttgctgtattgaagcctgtttctagacaactaacccttgattaagtaggaagtagggaaacttaaacctctccccacaaaactgttcatccttctctgttctctcagtcaatgacacaaccactctttacccagttgttcttaggataatccaggtttcctcttccttacccttgttccaaattcacttaccaagtcctatggattctatttaaaaatctcttaagctgcttctcttccttttcatctctact

SEQ ID NO: 162262 - DNA, 601 bp, Human
ccatgcccagcccagtatcatccctttcagtgacagactttagagagcacggattggattgatgcagtaatgtctcacctctctgtctcgctctgttttggatagccgcatgtgccgaagcatctgggacctttgttccatcatcaaagtgcgctcgtaagtatatgctgatatatcactgtcatgctgccatagacatcacataaaaggggcaaaaagcacaaaggagaaagaaggatgaaccatacatttttatttccagtcactaaattaaaccagggacagcatcactatattaacytaagcttcacccttactttgtttagtcattgagctacataaatgtttttgtgactgtagataaaattcagaggccctgagagtcttttccataatctaaccaagacatgtgttgccttgaaacacaaaatacaaactccagtctctcttttttatactgttaggttttttttaaaagccatgtgtgattttaagctgaatatatgaataaaaatttcataaaactatattaagcagatgagaatctggcagaaatataagggctgtgtaataaacaagaaagcaaaaccaaaaaataaca

SEQ ID NO: 162263 - DNA, 601 bp, Human
tcagcctgtccagagctgttctggagtcattcaccagctctgaggactaagctctcctgcttggcagcctgtctggccaggcatgtgacaaacccagagagcatggcatgtcttttaacaaacgaggtggtatgtcgctatcaccatggcacttgctgcctctgtcacgcctggcttctaaaaatgcaacagccaggaaggagatagattgattacacctttggggaaccctgtaaactggctgtgaacatgagagaggaatgtggatttggtcctggttggttgggagaggtgatattgytagaagttttaaacaggactgaaaagagaggacaaggaagaaaatgaagtgtataaggcagagaagacactaaagactaaaagtccaaaaggccattagtggagagaagcaggtggctttcacaccagggagtgggacccttttagaggcgtgccactcaggtgtacattcctcagtatgttggggttttgtggagtattgcttgccttggcttggatttgaagtcaatcagccttctcttaatttggcctaaagagttcatcgaacaagagggtcaggtgagagccatttcctagatcg

SEQ ID NO: 162264 - DNA, 601 bp, Human
ttaagttattaagctcatcacccatgtcaactggaatatagatgactgcattttggaatgactgaattaatgacacattgtatttctcctaagaaaaagattttgacattcaagtgaacacataatgatgggctgatatgccatcctcactccaacagtgaaattcagcctgtccagagctgttctggagtcattcaccagctctgaggactaagctctcctgcttggcagcctgtctggccaggcatgtgacaaacccagagagcatggcatgtcttttaacaaacgaggtggtatgtcrctatcaccatggcacttgctgcctctgtcacgcctggcttctaaaaatgcaacagccaggaaggagatagattgattacacctttggggaaccctgtaaactggctgtgaacatgagagaggaatgtggatttggtcctggttggttgggagaggtgatattgttagaagttttaaacaggactgaaaagagaggacaaggaagaaaatgaagtgtataaggcagagaagacactaaagactaaaagtccaaaaggccattagtggagagaagcaggtggctttcacaccagggagtggg

SEQ ID NO: 162265 - DNA, 601 bp, Human
cccctccttagaacttcctggaggcctccccggagctgctaagcacggagcagcgccccctcccgacttcccccgacccagccaacagcacccccctggcatctcacctcccagcttaacccgcacccaggcatcatcagtgccaggggttggccaggcaggtgtgggctctgatcctggctttggtggagggactagccgagctttgggaggaggctcgccttctgcacttggcttgggtcatctgaggacaaaaggaaggagcccctcatccaccttctccctcatttcaatgagggcrtctccttccccccttagagatgttctatgccagctcacagggtgaggcaaggagcatcagaaacctgagtcttcagggccagaaaggccttaagggatgcccctggaggtgtggcaggctgcccattactgggcatgtgtgaggttggcttgagtgcgcaggaggttagaggggagcgtgtgctccaggcaggagtccggacttcctcaggggagtctgcaaggctggggcaagagagaccagtcaggcactggcctgggtgcagaatttcaggggctaccaaaaaacacagtagttgag

SEQ ID NO: 162266 - DNA, 601 bp, Human
aaggcccaagccctctgcacatgaggacacagtggaaaggcagcttccacacatgctgttagcagacagggctactgtgacaagggctgactggtgggtgtggccagtgctggacggccatcagccattctctgctgtcctagaatccccctccctgctaccctctccatacaggcagcttttgggccaaggttttctactcagtccccaatacttatgcagtccaactctgccttgcctctttcaagctgtcgtcagtttcctctacccataattctctgctccccattgaggttgctgwgcctggcccaccaagtaagggctgactgagccctccagtgcctcagagtataggtgctagtgccccagcctcctcctcagcctctgtcagcagagggatgatgctttgtctccagccaagctgacctcagtgaggggctgctgctcatggggtgcctgtctccctgggtactgctggaggccaagactaggggagaggagcgtctccactgggaacactcactctatcacatccaaggtgtcgcttttgagttgtgtgctgaatcccactttaagaacctgcaggagctcaggaaaaatc

SEQ ID NO: 162267 - DNA, 601 bp, Human
atcccactttaagaacctgcaggagctcaggaaaaatcagatggcaggtccttctgtggtgtgatgaaggatgcatccacctgctctggtccttaccaggtacttgcagcatccctgcagaagggcgcattatagccatgcatcagctgctctagggccccttggagaataggatgttttacctagagggtgctaaacttttgcagtggcttttcttagaatgcaagacctcagcatgaggctcagcctgatgggccccacctctgggcagagaaaactgagctctcaaatgccacaataytggcagaggcatgcctgggacttggcatctgggcaccaagtcagtgggtcttctagggcctgtctttgggctgttagttcttaaggaagccagttgattgagaggggaatgggacagggcaaggccatgtctgaagtgggggtgcttggtgcttagcagacctctggccactaccctgagccccacagttcattttgggtcaaaaacatttctcccctgaaggtagcatcctaggtgccaagctgagtgtactcacatgcatcaagtccaggcccttccctggggcagtctaccaggagg

SEQ ID NO: 162268 - DNA, 601 bp, Human
tggaaaatcccagcccagggaaggccaagccttgtgcttgagatcagacccccaggcctggtgtgggagcccaaggcggattctccgagactgacttcattcctcctggccacacacccaggggtctgaggctgggcgctggcagcctgtgagtgtgtgtgggcgtggacgtgtcctcacaacaccaagcacatgtgagcaccacccacctccctccatgggtgggtggtttccaagcgcctgtcctgagcccagtttcttcctcgggtacctgtgccctcttccttcctaccctgggcastgagactgcccaaggcttcctgcagtaccattctctccaactctgaaacatgaaactgaaaagaaactagaggaaacagaggcccagagagggtcacatactttgcctggctctcatagcaaatccttgaagagaggcctggagggtggccagccacttcccaggcccagctgggtctcctgcactgtgtcggctccctcgatgtgaccactcctgctattaccaaccaggccctcctctcctgggatcctcgcctcagctcctgcctccctggagtttcagcttgtctgagctgggggt

SEQ ID NO: 162269 - DNA, 601 bp, Human
tgtgactctctatcctgagttcttaacaaccatgcatttaaaaaaaaaatttatatattattgcttatcttgtacacctcatttattcactcattcatttggtcattcattcattcaacagatatttgagtgctagattctgggcactggttgtgacagggtgagatgggacagtgagtgtgaaagactttggaagcagagtctctccccagtgtggggttagggtgtagcctggtcatggtcattgcagattccagaacgtttgtgtaacaaacactcatatggtgcatactaagtgccrgacactgttcttggagttttgcagttagaatcacttaatccctgtgacaaccctgggattgttatccccattttgcagatgaggaaactgtggccctgagaagttaagcgacttgccctggaggcagaatcacagatcagcatccctccttccttccccgaagttgtctcagattgttccttcagaaagaaaaagagtcttcaggcttagaaagctgtgtcggatcagacaagctgtggaaacggagggttctgggccctcctcctgcctccctgtttctcctttgagagtcatcagtgt

SEQ ID NO: 162270 - DNA, 601 bp, Human
tatcctgagttcttaacaaccatgcatttaaaaaaaaaatttatatattattgcttatcttgtacacctcatttattcactcattcatttggtcattcattcattcaacagatatttgagtgctagattctgggcactggttgtgacagggtgagatgggacagtgagtgtgaaagactttggaagcagagtctctccccagtgtggggttagggtgtagcctggtcatggtcattgcagattccagaacgtttgtgtaacaaacactcatatggtgcatactaagtgccggacactgttgttggagttttgcagttagaatcacttaatccctgtgacaaccctgggattgttatccccattttgcagatgaggaaactgtggccctgagaagttaagcgacttgccctggaggcagaatcacagatcagcatccctccttccttccccgaagttgtctcagattgttccttcagaaagaaaaagagtcttcaggcttagaaagctgtgtcggatcagacaagctgtggaaacggagggttctgggccctcctcctgcctccctgtttctcctttgagagtcatcagtgtctgaacaaac

SEQ ID NO: 162271 - DNA, 601 bp, Human
tcattcaacagatatttgagtgctagattctgggcactggttgtgacagggtgagatgggacagtgagtgtgaaagactttggaagcagagtctctccccagtgtggggttagggtgtagcctggtcatggtcattgcagattccagaacgtttgtgtaacaaacactcatatggtgcatactaagtgccggacactgttcttggagttttgcagttagaatcacttaatccctgtgacaaccctgggattgttatccccattttgcagatgaggaaactgtggccctgagaagttaagcracttgccctggaggcagaatcacagatcagcatccctccttccttccccgaagttgtctcagattgttccttcagaaagaaaaagagtcttcaggcttagaaagctgtgtcggatcagacaagctgtggaaacggagggttctgggccctcctcctgcctccctgtttctcctttgagagtcatcagtgtctgaacaaacaagtggagtcctaagcagcctcattccaggcagacttcctgtctcctctcttatcagccacttgcaaggcaccttctctctcccctgctctcaaactgga

SEQ ID NO: 162272 - DNA, 601 bp, Human
agagtctctccccagtgtggggttagggtgtagcctggtcatggtcattgcagattccagaacgtttgtgtaacaaacactcatatggtgcatactaagtgccggacactgttcttggagttttgcagttagaatcacttaatccctgtgacaaccctgggattgttatccccattttgcagatgaggaaactgtggccctgagaagttaagcgacttgccctggaggcagaatcacagatcagcatccctccttccttccccgaagttgtctcagattgttccttcagaaagaaaaagartcttcaggcttagaaagctgtgtcggatcagacaagctgtggaaacggagggttctgggccctcctcctgcctccctgtttctcctttgagagtcatcagtgtctgaacaaacaagtggagtcctaagcagcctcattccaggcagacttcctgtctcctctcttatcagccacttgcaaggcaccttctctctcccctgctctcaaactggaccatccctgcaagaagagacagctcctgttttcaataataagaataagaatatctgatatttattgaacatacactatgctaagcat

SEQ ID NO: 162273 - DNA, 601 bp, Human
ggccctgagaagttaagcgacttgccctggaggcagaatcacagatcagcatccctccttccttccccgaagttgtctcagattgttccttcagaaagaaaaagagtcttcaggcttagaaagctgtgtcggatcagacaagctgtggaaacggagggttctgggccctcctcctgcctccctgtttctcctttgagagtcatcagtgtctgaacaaacaagtggagtcctaagcagcctcattccaggcagacttcctgtctcctctcttatcagccacttgcaaggcaccttctctctmccctgctctcaaactggaccatccctgcaagaagagacagctcctgttttcaataataagaataagaatatctgatatttattgaacatacactatgctaagcattttatttttctcatttaattcccacaacagccttgtgagataaatagtattatcagctctattttatagatgaggaaactgaggctcggagaaattaaccaactcacccaaggtctcagggttaatgagtggccaagcttagacctaggctgactgtccaatccagtgggccccggcctcactctgttccgtctc

SEQ ID NO: 162274 - DNA, 601 bp, Human
ggatcagacaagctgtggaaacggagggttctgggccctcctcctgcctccctgtttctcctttgagagtcatcagtgtctgaacaaacaagtggagtcctaagcagcctcattccaggcagacttcctgtctcctctcttatcagccacttgcaaggcaccttctctctcccctgctctcaaactggaccatccctgcaagaagagacagctcctgttttcaataataagaataagaatatctgatatttattgaacatacactatgctaagcattttatttttctcatttaattcccayaacagccttgtgagataaatagtattatcagctctattttatagatgaggaaactgaggctcggagaaattaaccaactcacccaaggtctcagggttaatgagtggccaagcttagacctaggctgactgtccaatccagtgggccccggcctcactctgttccgtctcttagggacgggtgttttatattctgtgtcacctgtctctgtgttcactgttcccctgaggtgtaaacacctgaaaaaaaccaaatttgggtttttgcctcaagtttgcgggccccacagagttgctgggg

SEQ ID NO: 162275 - DNA, 601 bp, Human
gttgggatgctggaaagagaggtttagacttgcccctcccctggccctgacctagccgcctcatttccacaggcagctggaccaagggccttctttttgtcgggactcatgatcacagggtgagggttgggtctgggtccctctccctcttgctgatgggcacccagaaaccaggcattgcagtaccacttggaaatggggagaggggtgtcagaatgccaaagcaggaagagacacaggatgggaaagcgaggccccagaggcctttgccatccaaacctcaagagacaacccatccttycccctgcttgtgggccagctggaaccacaggttttccaaacccaacgcaaatctttctgcaaaagaaaggactctgggaatcgattccagaccctgcttgacaatgaagtctgtgctcacacaggcagtgccaccagacgttttatggagtgtgggcattggctcacgcacttgccaaggacatacaggtgctaggccctgagctgggcgtggagaatttcaggggcatcccagaaccctccctggcctcactgacgtctcagcctggcagtgagaaaacagacacctggggtggagagt

SEQ ID NO: 162276 - DNA, 601 bp, Human
gtgcattaggtgtgcagagaggcagcagaggcttggcctctgagcagggagctgacctccgcattggttagcattgtctgcctccccctcagcccagcctgcctcctgggcagctggcgcaatcaagcacacacttacaaatcccttctgtgagtcaagcccttctgctgctgtctctccccattggtggggtggacaggtgagtgctgtaaaagggtgcagggtggtggtggaggggtgttcaggactgacagggtgggctttggagctaaagactgtgtgcctctgcataggtagagctggtgtgtgtgtgtgtgtgtgtgtgtgtgtgtgtgtgtgtgtgtgtgtacgcgcatgcacatgcatagctgggaattccaggacaagggcaccatggagtcagggggtaaaaaaggttggggtgtgctgccagagacctgcctactgatccttaggattaagagttctggaaggctaggtaaggtcaaaccacagacggctttagctgccactctgagacttctaggcttgattctgtgggcaatggggagccattgaagaccctgggcctggcttgatggctgtcctagctctcaggctt

SEQ ID NO: 162277 - DNA, 601 bp, Human
gcattaggtgtgcagagaggcagcagaggcttggcctctgagcagggagctgacctccgcattggttagcattgtctgcctccccctcagcccagcctgcctcctgggcagctggcgcaatcaagcacacacttacaaatcccttctgtgagtcaagcccttctgctgctgtctctccccattggtggggtggacaggtgagtgctgtaaaagggtgcagggtggtggtggaggggtgttcaggactgacagggtgggctttggagctaaagactgtgtgcctctgcataggtagagctgttgtgtgtgtgtgtgtgtgtgtgtgtgtgtgtgtgtgtgtgtgtgtacgcgcatgcacatgcatagctgggaattccaggacaagggcaccatggagtcagggggtaaaaaaggttggggtgtgctgccagagacctgcctactgatccttaggattaagagttctggaaggctaggtaaggtcaaaccacagacggctttagctgccactctgagacttctaggcttgattctgtgggcaatggggagccattgaagaccctgggcctggcttgatggctgtcctagctctcaggcttga

SEQ ID NO: 162278 - DNA, 601 bp, Human
aatggggagccattgaagaccctgggcctggcttgatggctgtcctagctctcaggcttgagctgggttacatcttcattatggggcaaagtggaatctgcagccaccttgcctgcctgctcaccaagcaggtgtggcactgccaggccagtgctgacaagttaatttcctgattatgagataatcatttcctagggaatcgggcagccagctcccgccgtggaggcctctctggctcatctttattcaaggccctgctctgcagagctttctgcttctctgccacctaggggctcctctrgagtctggctgcgctagccaaaacatcccgctcagcacatatttcacaagcaactgaccagttcctcctggactttgtttatcctccagccctgggctcaagagattagggctcttttgcattccactttccatcatttgcccctcatgaggaggaggcttggagaggaaagattccagagacaaggtttactgaacccacaaaaaagaggaagccaagagggaaacaggtgaggtgtggacgagcaatgggaaagcagccacagggctctcagcgccaggcagcctccctccaggaacc

SEQ ID NO: 162279 - DNA, 601 bp, Human
ttgagcccaggagatcaaggctgcagttagccatgttcacgccactgcattcctgcctggacaacagagcaagaccctgtctcaaagaaaaaagaaaaggtggaggtggcgtggggagctggatatgtaccttcaccaggtccaggatcttcctttaaaatgcatactttttgaggtgagggctgatcacacagtctgataataactggacttcacccaacattggccactctgcttggagggcctgttgtaccctacaagccaaaaattgcagaccagcctccttactcctacactgatygtgtccactagcccccaactcaatcaacccttctttatccccttccaacatcacataatcccccagccccaagccctgcagaggggccaagagcccaagcctgcaggcctggctgctgacgaaatgtcccctgggagagctgcccagagaaggagccattgttccttcctggaaaaacataccagctatgggagggggtctgctattccctgggacctcggcaaggatcctgagggtgaggcgggggggcctggcctgaactcctgaggctgctcctttccagcagcttccccgagctgc

SEQ ID NO: 162280 - DNA, 601 bp, Human
cagagcaagaccctgtctcaaagaaaaaagaaaaggtggaggtggcgtggggagctggatatgtaccttcaccaggtccaggatcttcctttaaaatgcatactttttgaggtgagggctgatcacacagtctgataataactggacttcacccaacattggccactctgcttggagggcctgttgtaccctacaagccaaaaattgcagaccagcctccttactcctacactgattgtgtccactagcccccaactcaatcaacccttctttatccccttccaacatcacataatccccyagccccaagccctgcagaggggccaagagcccaagcctgcaggcctggctgctgacgaaatgtcccctgggagagctgcccagagaaggagccattgttccttcctggaaaaacataccagctatgggagggggtctgctattccctgggacctcggcaaggatcctgagggtgaggcgggggggcctggcctgaactcctgaggctgctcctttccagcagcttccccgagctgctgcctcttgtgtcacccccatggccatgagggtgtgacagaggtggagctcagagagggagtca

SEQ ID NO: 162281 - DNA, 601 bp, Human; identical to SEQ ID NO: 32689

SEQ ID NO: 162282 - DNA, 601 bp, Human; identical to SEQ ID NO: 32690

SEQ ID NO: 162283 - DNA, 601 bp, Human; identical to SEQ ID NO: 32691

SEQ ID NO: 162284 - DNA, 601 bp, Human; identical to SEQ ID NO: 32692

SEQ ID NO: 162285 - DNA, 601 bp, Human; identical to SEQ ID NO: 32693

SEQ ID NO: 162286 - DNA, 601 bp, Human; identical to SEQ ID NO: 32694

SEQ ID NO: 162287 - DNA, 601 bp, Human; identical to SEQ ID NO: 32695

SEQ ID NO: 162288 - DNA, 601 bp, Human; identical to SEQ ID NO: 32696

SEQ ID NO: 162289 - DNA, 601 bp, Human; identical to SEQ ID NO: 32697

SEQ ID NO: 162290 - DNA, 601 bp, Human; identical to SEQ ID NO: 32698

SEQ ID NO: 162291 - DNA, 601 bp, Human
cacgtgcgggcccagcgggcatggagtgcgcttgaggctgggcgctccggctccaagagccttcgtgtagaaaagctcttccgcagtgcttgggcaccctgacccgtgcctcgtctctctcagggacacttactcggacctctttcggtgtaattgccttgaattcccccggtcgtggaggaaggcgcccgagctcggctccacctcccaggtcttgtaacttaaaaatagccgcgtgactcaggcaagtcccagcccgtgaaacagcagtgatgggctcgcctcattgcagggcgcctgscacacatctcttttgcttgtgatagaatatttgagctggttaaacatgttatgtacacttattgagtgacgtgcagcattttggagatattacatacgctacgttttgatggattgacgtttttatttgttgtaggaggataagatcaatgccctcattaaagcagccggtgtaaatgttgagcctttttggcctggcttgtttgcaaaggtaaggtgatggtggcaaagtgattgtggtaaggcctgctgatttacgagggcagttgtacatgctaaagtacccccagcggtgccataa

SEQ ID NO: 162292 - DNA, 601 bp, Human
cgtgcgggcccagcgggcatggagtgcgcttgaggctgggcgctccggctccaagagccttcgtgtagaaaagctcttccgcagtgcttgggcaccctgacccgtgcctcgtctctctcagggacacttactcggacctctttcggtgtaattgccttgaattcccccggtcgtggaggaaggcgcccgagctcggctccacctcccaggtcttgtaacttaaaaatagccgcgtgactcaggcaagtcccagcccgtgaaacagcagtgatgggctcgcctcattgcagggcgcctgccrcacatctcttttgcttgtgatagaatatttgagctggttaaacatgttatgtacacttattgagtgacgtgcagcattttggagatattacatacgctacgttttgatggattgacgtttttatttgttgtaggaggataagatcaatgccctcattaaagcagccggtgtaaatgttgagcctttttggcctggcttgtttgcaaaggtaaggtgatggtggcaaagtgattgtggtaaggcctgctgatttacgagggcagttgtacatgctaaagtacccccagcggtgccataacg

SEQ ID NO: 162293 - DNA, 601 bp, Human
tgactagacgtgaaatgttatagtattctttctgtatgtgtaataccttgagacctttggccttgtcttgttataaatatacagtattctttacaagaaaaaaattgtttaatttaattatatgagcactgttcctttggagtgagaggaatgcttgggaaagcaatgtagcagaatcaccgaactgttttcaatgtacaacctttacttgattctaataaatcatcatactatgccagaaagtgtgagtatgattgtaagtgtgtgtgtgtgtgtgtgtgtgtgtatgtatgtatgtatrtgtgtactggggaggggtgcacacagacaggcacaggtaggttgaaaacatttctcagatgatctccacattatcccccatcaaattgtcttccagaatcaccatttcagaaagccaggtgtttgcaaatttttttaaagttgaaaggagggaagaattcttttttcaaaaccaagttgactatataggatagctgctgacaaagaatagtctacctgactaaatggttataattacatattatataatatattagtaccgtaggtcactactccaaaactttctcattttgttccacca

SEQ ID NO: 162294 - DNA, 601 bp, Human
gactaaaataaataactttttgacttgtgtacagaaaaaaatgccagcttttaaaaaacatggtatgtataaactaaatgtcaaataaggttatccttcaaatatttttattcaaaattctatttttaagtgattgctacttagtccctccagcaaactagcaaggagacgacttagcaagttatttaaactcttcagcttctgtttcttcatgtttattaaggtgagtttaactagagtatctctattctttgttttggctttgagagcctaggattgttttatttaaaaaaaaaaaaaagaaagaaagtctaaagggagtttttccacatggttttgtgtgtgtgtgtgtgtggttttttgtttgtttgtttgttttgagatggagtctcgttctgtcaccaggctggagtgcagtggtgcggtctcggctcactgcgacctccgcctcccgggatccagcgattctcctgcctcagtctcctgagtagctgggattacaggcacatgccacaacacctagctcattttttgcatttttagtacagacagtgtttcaccctgttggccaggctggtcttgaacttctgacctcaagtga

SEQ ID NO: 162295 - DNA, 601 bp, Human
tttaaaattaagtgactaaaataaataactttttgacttgtgtacagaaaaaaatgccagcttttaaaaaacatggtatgtataaactaaatgtcaaataaggttatccttcaaatatttttattcaaaattctatttttaagtgattgctacttagtccctccagcaaactagcaaggagacgacttagcaagttatttaaactcttcagcttctgtttcttcatgtttattaaggtgagtttaactagagtatctctattctttgttttggctttgagagcctaggattgttttatttwaaaaaaaaaaaaagaaagaaagtctaaagggagtttttccacatggttttgtgtgtgtgtgtgtgtggttttttgtttgtttgtttgttttgagatggagtctcgttctgtcaccaggctggagtgcagtggtgcggtctcggctcactgcgacctccgcctcccgggatccagcgattctcctgcctcagtctcctgagtagctgggattacaggcacatgccacaacacctagctcattttttgcatttttagtacagacagtgtttcaccctgttggccaggctggtcttgaacttc

SEQ ID NO: 162296 - DNA, 601 bp, Human
tgttatcaccagatacctgttttagcccctgttaaaataaaacttgttcctatgaagattagaaacccactgtaactagaaaatgttattaaatccttaaagtttacttgctacagaaggcagcatttctggcaaactcttagcatggagtttagtcaatgaagtccttcaaaaacattgttataataaattgccataaactcaaactttttatttgagaaacataaaacataatatcttggtttaagttagggactttatgctatattctggatctacttatttatttaaatgactacaygccattttctaaactgttgcagtttaaaatgaaatctattttctaatgtaaaaataattttaaaaaatagcagaaattgctaactgcctattttttctctgtaaaatccagccatggcagtggtgctttaaagagtcaatgattcattgtaccccagaaatgggttctgtgagggatggagacataaatacagttttctactctaatgtttttttcaagaccccccccaatttaatttaaattcaaatctcaacaccaagagctccagccaattttaattttcatgattgtcatcaatta

SEQ ID NO: 162297 - DNA, 601 bp, Human
atgcacagctatggttactgaatgcaagggagcattctaaggatatatagggttgattcgttacaacagaattccagcaatctgaaagagagtctgttcataaagtgtaaacaggtcaaacttttgatcaaaccagtataaccgatttctgctactcactgcaccaattaaactacactgtcacattagtcaacttgactcattgttttagcatcacagagacagagcctgggtatagaaaataaaggtagcagaattagcagacccatttatactgcttacctaaaatccacgcccccccatacttcctcattaacagacatccgccctctccctgtaagcctcagtggggtaaacctgcaggtcttaactgactgtgatgatcacattcccgggctagggactgagcaagaaacacaattctagccagtgagaagtgaaaggttttctaggggccttcaggaaagagcttctctgctcttaggaagccaatggaagaggtattcatttcctcctcaagaagtggttatatctagatgtgatgctcaaaatgctattacaaccaccttgaggatgaagtcaccaattggcaaggccaagt

SEQ ID NO: 162298 - DNA, 601 bp, Human
tcaacagcctttaacctgatctcttttgtccagtaatagtccctcaatcacccccgtagagccaccttccatgcacatacattataacatgcacagctatggttactgaatgcaagggagcattctaaggatatatagggttgattcgttacaacagaattccagcaatctgaaagagagtctgttcataaagtgtaaacaggtcaaacttttgatcaaaccagtataaccgatttctgctactcactgcaccaattaaactacactgtcacattagtcaacttgactcattgttttagcrtcacagagacagagcctgggtatagaaaataaaggtagcagaattagcagacccatttatactgcttacctaaaatccacgcccccccatacttcctcattaacagacatccgccctctccctgtaagcctcagtggggtaaacctgcaggtcttaactgactgtgatgatcacattcccgggctagggactgagcaagaaacacaattctagccagtgagaagtgaaaggttttctaggggccttcaggaaagagcttctctgctcttaggaagccaatggaagaggtattcatttcct

SEQ ID NO: 162299 - DNA, 601 bp, Human
gctgttgaacagtctcccacttcttcaaggttctcaaaaagtgctactttcccccctctaaccaagacgtgatccaaatgcaaaagggtggtttggacagtaatatagcagcccatgaatcaacagcctttaacctgatctcttttgtccagtaatagtccctcaatcacccccgtagagccaccttccatgcacatacattataacatgcacagctatggttactgaatgcaagggagcattctaaggatatatagggttgattcgttacaacagaattccagcaatctgaaagagagtstgttcataaagtgtaaacaggtcaaacttttgatcaaaccagtataaccgatttctgctactcactgcaccaattaaactacactgtcacattagtcaacttgactcattgttttagcatcacagagacagagcctgggtatagaaaataaaggtagcagaattagcagacccatttatactgcttacctaaaatccacgcccccccatacttcctcattaacagacatccgccctctccctgtaagcctcagtggggtaaacctgcaggtcttaactgactgtgatgatcacattcccg

SEQ ID NO: 162300 - DNA, 601 bp, Human
tttcagtttactggccaccactgagatacaggcagctgttgaacagtctcccacttcttcaaggttctcaaaaagtgctactttcccccctctaaccaagacgtgatccaaatgcaaaagggtggtttggacagtaatatagcagcccatgaatcaacagcctttaacctgatctcttttgtccagtaatagtccctcaatcacccccgtagagccaccttccatgcacatacattataacatgcacagctatggttactgaatgcaagggagcattctaaggatatatagggttgattcrttacaacagaattccagcaatctgaaagagagtctgttcataaagtgtaaacaggtcaaacttttgatcaaaccagtataaccgatttctgctactcactgcaccaattaaactacactgtcacattagtcaacttgactcattgttttagcatcacagagacagagcctgggtatagaaaataaaggtagcagaattagcagacccatttatactgcttacctaaaatccacgcccccccatacttcctcattaacagacatccgccctctccctgtaagcctcagtggggtaaacctg

SEQ ID NO: 162301 - DNA, 601 bp, Human
aaacaaaaacaaacaaaaattacattccacaacattcagtgctgtgcatcaatggccaaaattcagtttgattcctaatgaatacataatcacatatagattatgtatgtatgctttaatataacaaaccaatttatacaaaatacacaaattcgttggggtcatttttaagggaaattttcagtgaccttctaatttaaaaatctaacatcaaaagtctataaactcatacctttagatgcaaaataataacaattttagttccaaattaaagctttgttttctgccccagggaagacawactaccacatccatacaattagatcaagtgatcaggacctgtaagctccatgggctgagtgacgagctggcatctccaaatacacaaaaacacggaaatgaatttgcctaggctgatttgccttaagaagctcaatttatctcatgctatggatttgcactcaaccattctactttcctgttttaaaaacagcattttagtgaacaattgtgagtgctcaccaccctacatagccctactggcattttgccaatatatgcatttaacattagaaccccttgtcactggttgatttttatt

SEQ ID NO: 162302 - DNA, 601 bp, Human
ccagtgaggtttataagtttcttaaaagttgtgcagttttggggtcccatactttttaggtcaaaatcattctcatggcttcagcccctatcaaaatgctgaaggctcccaatctgtatatctagcctagcactgtctcctgccatccaggcccattgtatgtctagcctagcactgtctcctgccatccaggcccaataaccttctgcccactgggatgctcacagccactcagagcctgctcttgccttccttatctcagggaagccagacccctgggagttatccttgccagcagccmctccctctcacttacagccaggccgtcccaaagcctttggatcctgcctcatcagggtctcttggactcatctactctgccctccccaactagggaggaggcctagcccaggcctagacccctgcagtggcttcctgtcatgtctccctccatcctgccagtcctttgccatgcttcccattgcaggggagtaatgtttctaaaacacacatctgattgtgtagcctcatgctcaaaagaatatgtcagtggttccccgaacttctcaggatcaagaagtttagtctccttgacagggat

SEQ ID NO: 162303 - DNA, 601 bp, Human; identical to SEQ ID NO: 31249

SEQ ID NO: 162304 - DNA, 601 bp, Human; identical to SEQ ID NO: 31250

SEQ ID NO: 162305 - DNA, 601 bp, Human; identical to SEQ ID NO: 31251

SEQ ID NO: 162306 - DNA, 601 bp, Human; identical to SEQ ID NO: 31252

SEQ ID NO: 162307 - DNA, 601 bp, Human; identical to SEQ ID NO: 31253

SEQ ID NO: 162308 - DNA, 601 bp, Human; identical to SEQ ID NO: 31254

SEQ ID NO: 162309 - DNA, 601 bp, Human; identical to SEQ ID NO: 31255

SEQ ID NO: 162310 - DNA, 601 bp, Human; identical to SEQ ID NO: 31256

SEQ ID NO: 162311 - DNA, 601 bp, Human; identical to SEQ ID NO: 31257

SEQ ID NO: 162312 - DNA, 601 bp, Human; identical to SEQ ID NO: 31258

SEQ ID NO: 162313 - DNA, 601 bp, Human; identical to SEQ ID NO: 31259

SEQ ID NO: 162314 - DNA, 601 bp, Human; identical to SEQ ID NO: 31260

SEQ ID NO: 162315 - DNA, 601 bp, Human; identical to SEQ ID NO: 31261

SEQ ID NO: 162316 - DNA, 601 bp, Human; identical to SEQ ID NO: 31262

SEQ ID NO: 162317 - DNA, 601 bp, Human; identical to SEQ ID NO: 31263

SEQ ID NO: 162318 - DNA, 601 bp, Human
aagtgacacatagaacttttctaagagaagacagacaagttgacaggcatgccttgtactcagctgtgttcatgtggtggtctgtggaaagaaaagaagactcatttggaaatgaagctgtccctttccaagcagtctctggtgcttttcttctctcaaaatggatccgataaatatttgaatagagcagattgtagaatgtcgtgctgtcaccagaaagctgctgttttgggttctgcattgagccaaatatgtagaggacctaccaagcccactgagggactaggttttcatgtctctrgtcatacctagaatgttctgagccgtctgagggccttcatgccggcagcagctagcaaagccagaaagcaagtctaacaggatctaagatgaccatcaggagaaggagtttgagactgtgtatgcaacccccaatagacccccttttactctgatctggagaatgtatctggcttcatattttcaagtcacatgtctctcagacccctggattcagaacccaaggccacaaatcataggcatgaagcactttcttaagactgacctaacgctggattatttcccgtccaatgcctgcatg

SEQ ID NO: 162319 - DNA, 601 bp, Human
ggttttcatgtctctggtcatacctagaatgttctgagccgtctgagggccttcatgccggcagcagctagcaaagccagaaagcaagtctaacaggatctaagatgaccatcaggagaaggagtttgagactgtgtatgcaacccccaatagacccccttttactctgatctggagaatgtatctggcttcatattttcaagtcacatgtctctcagacccctggattcagaacccaaggccacaaatcataggcatgaagcactttcttaagactgacctaacgctggattatttcccrtccaatgcctgcatgctgcttgaattgctccacccacacctccatgaccaagggcgccagagtgctgcaactggggcgtgggccgctctctgcttttcctgtctgactctgacaagtcctccctcactgaatgtagaatcgttgccaagtttctgagaagtgtcgattccctgttaacatggatatcagttctgcctcacatttcccacttgaggttgaggcgtactggagacaacacctcagaccatctgaaccccatcagtggacgaaaatggggctgttaatatactctaaaagcca

SEQ ID NO: 162320 - DNA, 601 bp, Human
tcttaagactgacctaacgctggattatttcccgtccaatgcctgcatgctgcttgaattgctccacccacacctccatgaccaagggcgccagagtgctgcaactggggcgtgggccgctctctgcttttcctgtctgactctgacaagtcctccctcactgaatgtagaatcgttgccaagtttctgagaagtgtcgattccctgttaacatggatatcagttctgcctcacatttcccacttgaggttgaggcgtactggagacaacacctcagaccatctgaaccccatcagtggaygaaaatggggctgttaatatactctaaaagccatactaaaaatgctctgagggaactggctaagaatagtgggcctggtgattgtctatcacgcaaggctttgttttgtactgttcagaaatctgtcacctttctgcctgcccttgtttcctgaatgaaatgcttctggggttatttatgaaaggagtgatcctggggcaggcaggaggcagtgggcttcatggctccttgaagttattactgatcttgaccttctctttggctacctttagacaaagaatacgccaatcaatacttggg

SEQ ID NO: 162321 - DNA, 601 bp, Human
cttaagactgacctaacgctggattatttcccgtccaatgcctgcatgctgcttgaattgctccacccacacctccatgaccaagggcgccagagtgctgcaactggggcgtgggccgctctctgcttttcctgtctgactctgacaagtcctccctcactgaatgtagaatcgttgccaagtttctgagaagtgtcgattccctgttaacatggatatcagttctgcctcacatttcccacttgaggttgaggcgtactggagacaacacctcagaccatctgaaccccatcagtggacraaaatggggctgttaatatactctaaaagccatactaaaaatgctctgagggaactggctaagaatagtgggcctggtgattgtctatcacgcaaggctttgttttgtactgttcagaaatctgtcacctttctgcctgcccttgtttcctgaatgaaatgcttctggggttatttatgaaaggagtgatcctggggcaggcaggaggcagtgggcttcatggctccttgaagttattactgatcttgaccttctctttggctacctttagacaaagaatacgccaatcaatacttgggg

SEQ ID NO: 162322 - DNA, 601 bp, Human; identical to SEQ ID NO: 25588

SEQ ID NO: 162323 - DNA, 601 bp, Human; identical to SEQ ID NO: 25589

SEQ ID NO: 162324 - DNA, 601 bp, Human; identical to SEQ ID NO: 25590

SEQ ID NO: 162325 - DNA, 601 bp, Human
cttaatgtatgttaacattgccctagctagacatatggccccgtgttctcagactttagcctacatcagcatcacctggactgcttgtgaaaacagattgctgggccgaatcctagagtttctgattcagtagctctgtgcaggacaatgagaacttccatccccggtgatgctgctgctgctgatccaaggaggacactttgagaaccactggggtagcctatgcctggcacagagaaaggcctcaatgcctatcagttgccttatcccatggttttctctttatggtccttttttttttaggggagggggtgacaggttaaaatacagaaaagtgaagataataatatattagatgtcccgagaatccaccatccagaattaacaaataatagcattttgttgtgtttgttttgagattttaaaaaattaatttactaaaagtaacagaaaaaattgaagtctccccaccttgtatcactctcagtcctgtttctctccctccccaggggcaaccgctgtcatgagttacagtccttccaggatgtgcctctgaaaatggattgcatataaatgtacgcataaacaacacgtaggattg

SEQ ID NO: 162326 - DNA, 601 bp, Human
aatgtcctgatgcttttacttttttttttttttttttttttgccccgtcttatggtgctcagacacttttacttcctactacataaagtatggcacgccaggcatgcagccattcactcactgtgcatgacactcctactgtgtgccaggagacactgggctaagcactgaggaacgcaggtgtgagcaccagcctttcctgtgctgcagtgatgggagcattctgtctctgcatgtttgcatatggtggctctgagccacagacggctgttgagcacagatggagtcatagctgagatgygctctaacagtaaaatccacactgagatgtgaaggcttagtacaaaaaaaaatgtaaagtatctcattcataatttttatatttattatatgttaataattttgatatattgggtaaaataaatacatcttaaaattaattcacttgtttctttttactttaagaaacctggatgtaaaaatttttttaaaaatgaaaaataggccaggcgcagtggctcacacctgaaatcccagtactttgggaggccaaggaggacggatcacctgaggttgggagttcaagaccagcctgaccaac

SEQ ID NO: 162327 - DNA, 601 bp, Human
accagcctttcctgtgctgcagtgatgggagcattctgtctctgcatgtttgcatatggtggctctgagccacagacggctgttgagcacagatggagtcatagctgagatgtgctctaacagtaaaatccacactgagatgtgaaggcttagtacaaaaaaaaatgtaaagtatctcattcataatttttatatttattatatgttaataattttgatatattgggtaaaataaatacatcttaaaattaattcacttgtttctttttactttaagaaacctggatgtaaaaattttttwaaaaatgaaaaataggccaggcgcagtggctcacacctgaaatcccagtactttgggaggccaaggaggacggatcacctgaggttgggagttcaagaccagcctgaccaacgtggtgaaaccctgtctctactaaaaaatacaaaaattagccaggcgtagtggcacatgcctgtaatcccagctactcaggaggctgagacaggagaatcacttgaaccctggaggcagaggttgcggtgagtggagatggcaccaccgtactccagcctgggcaacaagagcaaaactccatctcaa

SEQ ID NO: 162328 - DNA, 601 bp, Human
agcagtggctcatacctgtaatcccatcactttgggaggccaaggtggatggatcacctgagttcaggagttcgagaccagcctggccaacatggtaaaaccccgtctctactaaaaatacaaaaattagctaggtgtagtggtgggtgcctgtaatcccagctgcttgggaggctgaggcaaaataattgcttgaacccgagaagcagaggtttcagtgagcccagatcacaccactgcactccagcctgggtgacagagcaagactcagtctcaaaaaaaaaaaaaaaaaaaaaaaggsggggaatgataaaggtgacaactccatagagctgttgggtggatagcaagatagatgttaacttcctccccagttgataacagaggaaccaaaggcccaaagaggaaggcaacttgctcaaagtcacactgcaggtttgtggcagagccaaggcaggctgaggtcaggtctggggcttttttccaactgctcctcaccccagtgaaggtgggaatggattccactgctgctgcttgaacttttccacccaaatatctcaatattcaggaagaatgaagaaaatgtcccaggatataatcc

SEQ ID NO: 162329 - DNA, 601 bp, Human
tggacgaggctgggtcatgtagggcctgggggtcatagtaagtctggcatttatttaagagcagtgttaagattaaagtgggcggtgtatgtgtgtgacataacctgagtagtgttttaaagctatttttatttgtttgggttttttgtttgtttgtttgtttgagacagagtctcgctctgtcacccaggctggagtgcagtggctcaatcttggctcactgcaagctccgtctcctgggttcacaccattctcctgcctcagcctccccagtagctgggactacaggcgcccacaactrcgcctggctaattttttgtatttttagtagagacggggtttcaccgtgttagccaggatggtctcgatctcctgaccttgtgatccgcccacctcggccccccaaagtgctgagattacaggcgtgagccacttagagctatttttaaatccttgcaacagcacttcaaaggcaaagcttaccatttccactttacagatgaggaagctgaggaagccacggctcagagacgttaagccacttgccctagtgtgcacagctgggaagtggtgaacccgcctttcaacccacagttgtctg

SEQ ID NO: 162330 - DNA, 601 bp, Human
caggctggagtgcagaggtgcaatcataactcctgggctcaagtgatcctcccaccccagccccccgagtggctgggaccacaggcccatgccaccacactcagctaattttatttatttatttacatatttatttttagagacagggttgccctctgcctacccaggctggagtgcagtggcgtgatcatagttcactgtagcctcaaactctcaggctccaggatcctcccgacttagtctccccagtagctggcactacaggcatgcactaccacacccagctaatttctaaaaaaawtttttttttttttgagacagagtctcactctgtttcccaggctggagtgcagtggcacaatctcggctcaatgcaagctccacctaccaggttcacgccattctcctgcctcagcctcccaagtagctgggactacaggtgcctgccaccatgcctggccaatttttttgtatttttagtagagacggtgtttcaccgtgttagccaggatggtctcaatctcctgaccttgtgatccgcccgcctcagcctcccaccatgctggaattacaggcgtgagcaactgcgcccagcttctaa

SEQ ID NO: 162331 - DNA, 601 bp, Human
gcagctgggttccaagacagagctggaccaggggccaagccttcatgagcaggctctcattaagcctctgcctgcatcaggcttgctaatggcccattggccaagtcacatagccatgcccagaatcagtgtgggaggggactgaccaaggacacaaatcccagggaccccctcaatgtaacagtctggccacagagtaggtaattatcatcccattttacagaataggaaattgaagcatagagcagaagtaaagtacagatgtggaaactgagccccagtgtggttaagtggcttgcayaagttactgtgctaattatgggggatatagcagtgaacaaaatgaaaatgttcctgtcctaatagagttcacaatccaggtgggaagatgagtattaaataaccaaatctcttagagaccatgacccaagtggtcctggctgagtcaaaagagcacagtatctaacaaagtaaataatgttcacaaatcgcaaaaacactgctgaaaacctaattttctttctcatgttccccacgccccttgcagctcctctcacccccagcctaagcagttttttcacttctgtcctctctcatgctc

SEQ ID NO: 162332 - DNA, 601 bp, Human
ggaggactgcttgagcccagaagctcaagaccagcctgggcaacacaggaagacctagtctctacaaaaatttaagaaattagccaggcatggtggcacatgcctgtatgcctgtagttgtggctactcaggaggttagggtgagaggatcacttgagtctaggaagctgaagctgcagtaagccatgatcatgccactgcacccagcctggtggacagagcaagatcttgtcaaaagaaaagaaaagaaaagaaaagaaagaaagaaagaaagaaagaaagaaagaaagaaagaaagaaagaaggaaagaaagaaagagagagaaagagaaagaaagaaagaaagaaagaaagaaagaaagaaagaaagaaagaaagaaagaaaagaaagaaagaggcacaagccaatgctaaatgcaccaaaatgggtaactctcacaggtataatatcaaaatgaaagaaattagaccaaaaaaaaagagtagatgccacttggtttcgtttttgtgaaattctaaaagagacaaaacatgtaattggacattcatggcagcattcttcctaatagccaaaaaatggaaacaacactctttaatgtcc

SEQ ID NO: 162333 - DNA, 601 bp, Human
actgcttgagcccagaagctcaagaccagcctgggcaacacaggaagacctagtctctacaaaaatttaagaaattagccaggcatggtggcacatgcctgtatgcctgtagttgtggctactcaggaggttagggtgagaggatcacttgagtctaggaagctgaagctgcagtaagccatgatcatgccactgcacccagcctggtggacagagcaagatcttgtcaaaagaaaagaaaagaaaagaaaagaaagaaagaaagaaagaaagaaagaaagaaagaaagaaagaaagaaggaaagaaagaaagagagagaaagagaaagaaagaaagaaagaaagaaagaaagaaagaaagaaagaaagaaagaaagaaaagaaagaaagaggcacaagccaatgctaaatgcaccaaaatgggtaactctcacaggtataatatcaaaatgaaagaaattagaccaaaaaaaaagagtagatgccacttggtttcgtttttgtgaaattctaaaagagacaaaacatgtaattggacattcatggcagcattcttcctaatagccaaaaaatggaaacaacactctttaatgtccatcaa

SEQ ID NO: 162334 - DNA, 601 bp, Human
aattagccaggcatggtggcacatgcctgtatgcctgtagttgtggctactcaggaggttagggtgagaggatcacttgagtctaggaagctgaagctgcagtaagccatgatcatgccactgcacccagcctggtggacagagcaagatcttgtcaaaagaaaagaaaagaaaagaaaagaaagaaagaaagaaagaaagaaagaaagaaagaaagaaagaaagaaggaaagaaagaaagagagagaaagagaaagaaagaaagaaagaaagaaagaaagaaagaaagaaagaaagaaagaaagaaaagaaagaaagaggcacaagccaatgctaaatgcaccaaaatgggtaactctcacaggtataatatcaaaatgaaagaaattagaccaaaaaaaaagagtagatgccacttggtttcgtttttgtgaaattctaaaagagacaaaacatgtaattggacattcatggcagcattcttcctaatagccaaaaaatggaaacaacactctttaatgtccatcaattgatgaacagacgaacaaaatgtgatatatccatacaatggaatattatttggccataaaatggaatgaag

SEQ ID NO: 162335 - DNA, 601 bp, Human
aggcatggtggcacatgcctgtatgcctgtagttgtggctactcaggaggttagggtgagaggatcacttgagtctaggaagctgaagctgcagtaagccatgatcatgccactgcacccagcctggtggacagagcaagatcttgtcaaaagaaaagaaaagaaaagaaaagaaagaaagaaagaaagaaagaaagaaagaaagaaagaaagaaagaaggaaagaaagaaagagagagaaagagaaagaaagaaagaaagaaagaaagaaagaaagaaagaaagaaagaaagaaagaaaagaaagaaagaggcacaagccaatgctaaatgcaccaaaatgggtaactctcacaggtataatatcaaaatgaaagaaattagaccaaaaaaaaagagtagatgccacttggtttcgtttttgtgaaattctaaaagagacaaaacatgtaattggacattcatggcagcattcttcctaatagccaaaaaatggaaacaacactctttaatgtccatcaattgatgaacagacgaacaaaatgtgatatatccatacaatggaatattatttggccataaaatggaatgaagtactacgc

SEQ ID NO: 162336 - DNA, 601 bp, Human
tcctggacttacgtgatcctcctgcctcaggctctgaaagtgctaggattacaggcatgagccactatgcacaggctgcagtcaccttaagtaagggggtattaactggaaggacgcagaaaggagcgttctgaaatgctgaaaatgttctacagcccaatctgatggtgattacaagggtatatatatatatataaagctgcagcaaaatggatattaaagatttgtgcatattatttcatgtacgttataactcgattaaaaaaaatttagaccgggcacagtggctcatgactataawcctagcactttgggaggccaaaatgggcagattgcttgagcccaggagttcaagaccagcctgggcaatatagcaagaccccatctctacaaaaaatttaaaaataagtcaggcgtggtggtgtgagcctgtggtccctgctactcaggaggctgaggcgggagaatcgcttgagcccaggaggttgaggctgcagtgagccaagatcatgtcactgcactccagcctgtgtaacagagcaagactttgtctcaaaaaagtaaataaatagggccgggcacgttggctcatgcctgtaat

SEQ ID NO: 162337 - DNA, 601 bp, Human
cctccatcccctgggttcaagtgattctcctgtctcagcctgtagctggaactacaggcacctgccaccatgcccagctaattttgtatttttagtagagatggagttggccaggctggtctcgaattcctgacctcaggtgatcctcctccttggtctcccaaagtgctgggattacaggcacaagccaccatacctggccaaaaaaatttttttaattagcttggcataatggggcacacctgtaaccccaggggcttgagaggctgaggcaggaggatagcttgaggtcaggagttcraggcttcagtgaactatgattgtgccactgcgctccagcctgggcactctgtctctaaaagaaaaaaaaaatgaaaaggctaactaaacccatgtcagactaggtgggaggaagggcgggtaaagggagagacacatagtgactggtgggaacctcatgggctgagagccagaatcctcccttttcccatcgcccaggatgagaggactgaggcatcagctgcaacctggactcaaggccccctgaagtccttctgtccccaaagacctgtgacctctgggattccactcttcggagttg

SEQ ID NO: 162338 - DNA, 601 bp, Human
catacctggccaaaaaaatttttttaattagcttggcataatggggcacacctgtaaccccaggggcttgagaggctgaggcaggaggatagcttgaggtcaggagttcgaggcttcagtgaactatgattgtgccactgcgctccagcctgggcactctgtctctaaaagaaaaaaaaaatgaaaaggctaactaaacccatgtcagactaggtgggaggaagggcgggtaaagggagagacacatagtgactggtgggaacctcatgggctgagagccagaatcctcccttttcccatygcccaggatgagaggactgaggcatcagctgcaacctggactcaaggccccctgaagtccttctgtccccaaagacctgtgacctctgggattccactcttcggagttgcagttaactggggtatcagctgaatcaacgaggaggattctagagtgaacttccacaccataccccaggcccctaagcccactcctccttgtttagccatctgtcctcaggatggatgtcccttgcttccacagggaggccacgtatcagggaaattgcaggtctgcaggggcagatgttggcagctcttg

SEQ ID NO: 162339 - DNA, 601 bp, Human
actccccagccttccccgactctgctctgttcaaccctgcaggggccaagttccccatcaagtggacagctcctgaagccatcaactttggctccttcaccatcaagtcagacgtctggtcctttggtatcctgctgatggagatcgtcacctacggccggatcccttacccaggtagggaaggggcatcagctcagggctgctaccagggcccagtctggcaatgggctcatctcaacaacatgtccattcaaactgagttcttgatcctcacccccaaccttccctcacctttcctgtyttagttaaaggcacctccatccatctaatgtcttaagcctgaaatctgggggcttccttggcccttccttctctctcactcctatgactttttttttttttttttttttttttgagacggagtctccctctgtcacccaggctggagtgcagtgacgtgatctcggctcactgcaacctccgcctcccaggttcaagcgattctcctgcctcagcctcctgagtaactgggattacaagcatccaccaccatgcctggctaatttttgtatttttagtagagacggggtttcaccatgtt

SEQ ID NO: 162340 - DNA, 601 bp, Human
gggattacagacacacaccaccatgcccagctaattctttaaattttttgagagacaaggtattgctatgttgccgggctggtgatttccatttttaagcgatgctttcagcatggagagtgaatgggagggaaagggaacagggtggcagccagtgaggaggccacagcagtggcccaggcagaggtgatgatggtctggacagggtggtggcattcgtgactggcatacgttgatgaactggtgctacgtttcaaaaggagaaaagatctgacttgctgacttaggaggtgagagagagagaataaaggatgattaccctggctttgcaccacagggtgggtaatggtctagggatagaaattggagagctctgttttagctctgctaaatttgagttgacttaaatatagagacatccaagtaaaggaagcacttgagttcatgagtttggagtttgagactaataatataaaattggggatcacagacattgaatggctattcttatgaatagctaatagaaacttgaactgaacaaaaaaatggtcccacccataggttaacattgaatctggccacctgaatgttttgtcttgag

SEQ ID NO: 162341 - DNA, 601 bp, Human
ctccagcctaggcaacaagagcgagactccgtctcaaaaaaaaaaaaaaaaagaaaaaattaataagcagctcactctgggcaaaaccctgatgcccacttgaaacctgccatgtctgagttttaccagtgccagaatctgaggctaccaacacgcctctgggaacctgctactgccaactatccttcccatagctacctgaacaaagccagttatcagtccagagtgagcaccttcacaggcatggtttgcttggcccaacagcatctctggctttctgggccagcatgtctaggtcacyttattactccctggacaacttgataggatgaaaagtgttggctttagaattatgccaaccttggtgtaaattctcattcagacacttaactggctgagggacacctggggtcagtcacttaggcacaaagaccttcatgtgtaaactgggaataaactcaccttccttggaaggttactgtagaatatatgaaacagcatgccgtttccatgaaggaaggtaccatgcgtggcttatggccagcacctagtacactgctagcttcacagtagatgctcaagaaacactggttgcataagt

SEQ ID NO: 162342 - DNA, 601 bp, Human
gagagggttttaacaatgaaaaaattggccggggccaggcacggtggttcatgcctgtaatcccagcattttgggaggctgaggcaggcggatcacctgaggttgggagtttgaaaccagcttgaccaacatggagaaaccccatctctactaaaaatacaaaattagccaggtgtggtggcgcatgcctgtaatcccagctacttgggaggctgaggcaggagaatcacttgaacccgggaggcagaggctgcagtgagctgagatcgcgccactgcactccagcctaggcaacaagagygagactccgtctcaaaaaaaaaaaaaaaaagaaaaaattaataagcagctcactctgggcaaaaccctgatgcccacttgaaacctgccatgtctgagttttaccagtgccagaatctgaggctaccaacacgcctctgggaacctgctactgccaactatccttcccatagctacctgaacaaagccagttatcagtccagagtgagcaccttcacaggcatggtttgcttggcccaacagcatctctggctttctgggccagcatgtctaggtcactttattactccctggacaactt

SEQ ID NO: 162343 - DNA, 601 bp, Human
ggcaaggcccacctgggtcccttcccacattcccattggaaagcaccagaaacacttgtgtcccttcggggaaggtcatgtatacaacattccaggaaagtatcacagggactttgtttctcaaggagaaactctagggggaagagtcagttctctgagggaagctgcccattcattaaagggtttccaccctacaattatggcaggagaagggcttttgtgctagatcctttactcgagtcaagctatggcagctggctatcattattccattttacaggcgggagagacagatggacargacagccgaacaggttcagcatttcatcaggtgactccaggcaggcagtaatctggctaagggtctacactttcagtccttgaagcatcactccaccactaagtagagatacctggggcaggccaccttctccccacacgcacaccactgtcatctattggcagggcctgagagggttttaacaatgaaaaaattggccggggccaggcacggtggttcatgcctgtaatcccagcattttgggaggctgaggcaggcggatcacctgaggttgggagtttgaaaccagcttgaccaaca

SEQ ID NO: 162344 - DNA, 601 bp, Human
ccaagttatgttttctcccccaacacagttcattgctcccaacaattacgtttctatcaggctaagggatttcttcagggacagcaatcccaaagtggcaaggcccacctgggtcccttcccacattcccattggaaagcaccagaaacacttgtgtcccttcggggaaggtcatgtatacaacattccaggaaagtatcacagggactttgtttctcaaggagaaactctagggggaagagtcagttctctgagggaagctgcccattcattaaagggtttccaccctacaattatggcaggagaagggcttttgtgctagatcctttactcgagtcaagctatggcagctggctatcattattccattttacaggcgggagagacagatggacaagacagccgaacaggttcagcatttcatcaggtgactccaggcaggcagtaatctggctaagggtctacactttcagtccttgaagcatcactccaccactaagtagagatacctggggcaggccaccttctccccacacgcacaccactgtcatctattggcagggcctgagagggttttaacaatgaaaaaattggccggggc

SEQ ID NO: 162345 - DNA, 601 bp, Human
tgagtccattccctctgctttaaacaccctttgctgtagggtacctacatcatccacctccttacctcatttagcgcttggctcaaataaatttaggtaatacttttgttgggactcaggacataccatcccaaaatatgactgtaggaaaacaatatgccaccccaaaaatatacttctttggcatattttgaactggttattctgagaaactgcagacataagagtagctctgaaaagctgtccttttgtaaaagaaattcacatctaaaaaggaaatctacactagtaaaggtatctrtattaggaagagggctgctccagacaaattttattaccagagagactttttatttttattttttgagacagggtcttgctctgtcacccaggttggagtgcagtggcttgatctcggctcactgcaacctccacctcccaggctcaagtgatcctcccacctcagtacaccccctcaacagtatctgggaccacagacacacgccaccaccaattctttccctcaccctgccataacttgggttgctgccactcaagcccctaacagaagtcccaagccccatattcttttctgtagctc

SEQ ID NO: 162346 - DNA, 601 bp, Human
atataccatgtgcaagcctggtcttattctccagtccccgtctcactacacctccacctctaggtccaagccactattctttttcacctggcaattgcaccagcctcttcactgggctccctgttgccacccttaagaatacagaccaggcctggcacggtggctcacgcctgtaattccagcactttaggaggctgaggcgggcggatcacgaggtcaggagatcgagaccatcctgactaacatggtgaaaccccgtctactaaaaataccaaaaattagccgggtgtggtggcgggcrcctgcagtcccagctacttgggaggctgaggcaggagaatggcgtgaacccaggaggtgcagcttgcagtgagcagagatcgtgccactgcactccagtctgggagacagagaaagactctgtctcaaaaaaaaaaaaaaaaggaatacagaccattccaccaaagccaaatcctcatcatggtctgtaatgctgtatgcgatctggcccccacctacttctccatcctcctcctcaaccattccctccccaccttctacccttttcccctttgctgtttcttctccagccacattgacc

SEQ ID NO: 162347 - DNA, 601 bp, Human
gcaggaggtacctgattgccacctgagctttgcagagaaggagctgtggggcagggaaggattggcctctcctagaagatatttcttgctccaccagggcagcaagaaagttaggcccctttgggcctacctagggtacccttcctggcattgtcactgcaggtggcaggagacaggtgatgtttaccctgctgaggccagagttgccaaaaggcttcaatcaatcctttgaatctgcacctggccctgagtcccaaaataacaaccagggcagcttacctgatctgcaggttgcaggtgmctctggcttttctctccctgcagctctgcctgctgagccctggctggcaagagattctttttcttaggggttactgagacctaactgcatcccacaggtgctctgggcctctccccattaggcccacctctaccatcaaccatccctctgtccagaggcctctgtcatcagccacctggtttcttccctgaccaactttattgctgacacagaccatctttggctctagccagtctgcctcctcatgatctctcaaatgcttcatacatactccaccctccagttctgtctgggtggttc

SEQ ID NO: 162348 - DNA, 601 bp, Human
aataccaggagcagctgctgcctgagagagtggggggcctccagagcccccagaagagtcttcctaacctctttccatcaggttttaacatcacactgagatggggaggtaaggaaagaatggttaggtgtgctcaatctatccttagggcaacaagggtctggccctctttgttgaccctcaagggaagaagtttgtgacttcccatttgtcactcaccaaccctctagagagaaacagaagggggcaagggcatgggagtattttctccctggggttggggggcacacacaagggaagmagcagcagccttactggctctttcctcccctgggcaagaagcctgtacatgtgatacagtgtatgtcattcacatggaacccccttggggaaatgccaaggtaccttttggacccaagaagcctcagagaggagagactggcaaagccctgaactgcaagctaagctgacaatttctaagcattgtaactaggtcatcaggttcctggagaagccagctgtggctgggggatggggaggaaaattttgcagcctaccaagatccctacttccctttaggccccaccctccctgaaatctg

SEQ ID NO: 162349 - DNA, 601 bp, Human
cagagcacctcgtttagtctttctcccaacaaccctctgaaatgagtattacttccactttatagatcttcaggtttacagagggaagtaacttgtccaaattcatgaagccagttaagtgataagatattgcttctactcaaaaaatgcttgttgactgaatgaatgaatgaatgacacagctatggctgtgactttagtcaaggagtagcaacaagaccaaatatttatagttctcaaagtgctttttcatctatcatctctttgggcctccctgctagcccatgagggaggcaaggcrggtgttatctttcttcaacatatgaggcaacaggcagagcttgggcaagaggcttgaggccacagagcaaacaaggagtgagtggggccatcctggaaaaactccagagttcccacaatgccatgtttaatcattcaaacccatgtcaagcacctactgtgtgccaggcatgctcctacccactttaaatacttaactcattaagtcttccactcagtcaacaaacaaggaggaccctgggaagataaaacaaaatatgccccattgccaaacgcctagtcaacaacactggccaaacct

SEQ ID NO: 162350 - DNA, 601 bp, Human
ctcagtaagctcagagcacctcgtttagtctttctcccaacaaccctctgaaatgagtattacttccactttatagatcttcaggtttacagagggaagtaacttgtccaaattcatgaagccagttaagtgataagatattgcttctactcaaaaaatgcttgttgactgaatgaatgaatgaatgacacagctatggctgtgactttagtcaaggagtagcaacaagaccaaatatttatagttctcaaagtgctttttcatctatcatctctttgggcctccctgctagcccatgagsgaggcaaggcgggtgttatctttcttcaacatatgaggcaacaggcagagcttgggcaagaggcttgaggccacagagcaaacaaggagtgagtggggccatcctggaaaaactccagagttcccacaatgccatgtttaatcattcaaacccatgtcaagcacctactgtgtgccaggcatgctcctacccactttaaatacttaactcattaagtcttccactcagtcaacaaacaaggaggaccctgggaagataaaacaaaatatgccccattgccaaacgcctagtcaacaacac

SEQ ID NO: 162351 - DNA, 601 bp, Human
aaggtcaaggaaagtctctcagaggaggtgaccagcaagctgaaccaaatgtaggcctcagaaaggaaatactaggggcagaacatttcaggcagagaaaagagcaactacaaaggcccttgggcaggaagaagttatgccaggatccagaagcagcaaggaacccatgcggcttgagtggagtaagggagagacagaatgatggaggggcagccaggaccagatcacacaggcctcagaggttggtaagaagtctgggttttgctgggtgcagtggatcacacctgtaatcccagcactytgggaggctgaggtgggcagatcacgaggtcaggagttcgagaccagcctggacatcatggtgaaaccccatctctactaaaaatacaaaaattagctgggcgtgatggcaggtgcctttatttttttatttttattttttgagatggagttttgctcttgttgcccagggtggagtgcaatggtgcgatcttggctcaacacaacctccgcctcccaggttcaagtgattctcctgcctcagcctcctgagtagctgagattacaggcatgtgccaccaagcctggctaattttgtatt

SEQ ID NO: 162352 - DNA, 601 bp, Human
cactgaatacagtgcttggcacttaatgagcattcaaaagtaggatgaaagaacactattaattctcattagcttctcttctctgggcctcagttttttcatgtcttaggttttgttcatttgtttaataatttattcaaaaagtattcactgaatgtttactacctgcaaagaacagctgcagacactggagatacaatgatgaacaaaccaaacgccctataatcatggggcttatattctaatagaagagacagacaaaaacaagtacacaaacaaaaagaaaattccaggtagaggytgttgctatgacaaaactacaagaagactggagagggatttagaaatagcatggctactttaaactgaaggtcaaggaaagtctctcagaggaggtgaccagcaagctgaaccaaatgtaggcctcagaaaggaaatactaggggcagaacatttcaggcagagaaaagagcaactacaaaggcccttgggcaggaagaagttatgccaggatccagaagcagcaaggaacccatgcggcttgagtggagtaagggagagacagaatgatggaggggcagccaggaccagatcacacagg

SEQ ID NO: 162353 - DNA, 601 bp, Human
tacattatccttttggttgtatgaattttcctaagttgcttccaactctttgtaaaacagagcaaggttccaataaaaaataagattggtccagttttcttttaagtggtacagtggtatatataaaaaatgatgttccaaacaactcattataacaattaagaataagtggcaaaaataatgcatgtaaatcactgaatacagtgcttggcacttaatgagcattcaaaagtaggatgaaagaacactattaattctcattagcttctcttctctgggcctcagttttttcatgtcttargttttgttcatttgtttaataatttattcaaaaagtattcactgaatgtttactacctgcaaagaacagctgcagacactggagatacaatgatgaacaaaccaaacgccctataatcatggggcttatattctaatagaagagacagacaaaaacaagtacacaaacaaaaagaaaattccaggtagaggctgttgctatgacaaaactacaagaagactggagagggatttagaaatagcatggctactttaaactgaaggtcaaggaaagtctctcagaggaggtgaccagcaagct

SEQ ID NO: 162354 - DNA, 601 bp, Human
gcaaaaagaggagatcgtgttgcctcaatccaggagcccagctgatgaggcaggaagggagccagcaaatcctagactattaggtgcagtctgggacaatcccaaggtcatctatgtaattagattttttttttttggagacggagtcttgctctgtcgccaggccggagtgcagtggtgtgatctcagctcactgcaacctccgcctcctgggttcaagcgattctcctgcctcagcctcctgagtagctgggattacaggcacgcgccaccacacctggctaattttttgtattttagyagagacagggtttcaccatgttggccaagacggtcttgatctcctgacctcatgatctgcccaccttgccctcccaaagtgctgggattacaggcgtgagccaccacgcccggcctgtagttagatttttaaaaaaccatcattttaaatgaatctgggcaatatttagttataaagaatggcataaaaactgctcagttcaaaggacttttgtaacatacatttgtgtgaactaattttacttttggctcgtcttcttacccatattttcctttcacccgactcccttagctacattat

SEQ ID NO: 162355 - DNA, 601 bp, Human
atgttggccaggctagtcttaaacttctgacctcaagtgatctgcctgcctcggcctcccaaagtgctgggatgacaggcgtgaaccatcgtgcccagcctggtgatcctttaaaaatgtatgtcggactgtcatttcttggttcaaaaccctccaatgactcttttttctgagacaggattttgctctgtcgcccaggttggagttctgtgagatgtgttcatagctcactgcagccatgaactcccaggctcaagtgatcctcccaccttagcctcctgagtagccaagattattggcrtgtgccaccatgcctgacaaattttttgtagagatggaggtctcactgtactgctcaggctgatgttgaattcctgggctcaagtgatcctcccacctcagactcccaaagttttgggattacaggcatgagctactggacccagtcgattttccttctttttttttttggagacggtctcgctttgtcacctaggctggggtatagtggtgtgaacatggctcactgcaaccttgacctcctggactcaagtgtttctcccatctcagcctcccgagtagctgggaatacaggtgcgaa

SEQ ID NO: 162356 - DNA, 601 bp, Human
tttcacagccctgatgacctttggtaccccatggcagcggtcaacgtccttccctattatgaaatgtcctgggtgcatagcatcaccactgtgtcatctacttgtgcctgcacccatgcaaacacacagggacacaaagctggaaaagggctggttttgagaaggagtaagcctgggcagttgaaacccaggttcggtgtactctagggcacttacttctaggtgactgtccttgccactgctggcgtaccaaggtctcccagtcatatgcccatgcactgtatacattttggcatttatyctcatgaataaagtgtcattagaggccagacactgctggctaacgcctgtaatcgcagcactttgggacgtcaaggtgggaggactgcttgagcccaggagttagagaccagtctggacaacacagtgagaccttgtctctactaaaaatttaaaaataagctagtcggccgggtgtggtggctcacacctgtaatcctagcactttgggaagccgaggcgggtggatcatctgaggtcaggagttcgagacgagcctggccaacgtggtcaaactctgtctctaccaaaaatacaaaaa

SEQ ID NO: 162357 - DNA, 601 bp, Human
tgctagaattaaaggcgagagccaccatgcctagccctgacatgttaatttacttaaaatctgtcacccaccttggaatgtccactgggtgagaatagggactttggttcgttcagactgtatgtccaacctttagctcagtccctgatatatgacaggaatgcaataaatacttgttaatgaacaaatgaatgaatgaccaatatccctcaggaaatgactcagactcaaaggggagtaaggctgcctgagtgtccttggctttcacagccctgatgacctttggtaccccatggcagcrgtcaacgtccttccctattatgaaatgtcctgggtgcatagcatcaccactgtgtcatctacttgtgcctgcacccatgcaaacacacagggacacaaagctggaaaagggctggttttgagaaggagtaagcctgggcagttgaaacccaggttcggtgtactctagggcacttacttctaggtgactgtccttgccactgctggcgtaccaaggtctcccagtcatatgcccatgcactgtatacattttggcatttattctcatgaataaagtgtcattagaggccagacactgctg

SEQ ID NO: 162358 - DNA, 601 bp, Human
acagccccacttgtaatctgagaaatgcaaattaaaaccgcaagataccatctcacacccaccagctccataaaaatttaagtctgaccatatcaagtattaacaaagaggtaaagtaatggaaaacccatatgctgttggtggctgtgtaaattcacacaaacacaggaaaacaatctgccattaccttctgatcaagcaattccacttctgtgtaaaccctacaacaatgattctcagtgaggtcccaggaccaagagtggcagcatcagctgagaagttgttagaagtgcaaattctragggccccaaccctgacatacacaatcaaacactttgggggtggagcccagcaatctgaggtttaacaaaccttccaggtgattctgatgggcagctaaagtttgggaaccactgcctgggagaaactcttgaacatgtgcatgtgcaggagacacaaacagttttcataacagcattgtctgaaacagcaaaaacaaggggacaacccaaataaccactgacagcagaatggatacacagcttgagacatgatcatataaatggatacgaaaatgaacaaattatgctatgcaagtaac

SEQ ID NO: 162359 - DNA, 601 bp, Human
aggtggtgggcacctgtagtcccagctacttgggaggctgaggcagaagaactgcttaaacccaggaggtggaggttgcagtgagccaagatcgtgccactgcattccagcctgggtgacagagcaagactctgtctccaaaaaaaaaaaaaaaagaaagaaaagaaaaagaaaagaaaagaaaagaaagaaaaagaaaaagaaatgtgctgaaccaaactctccacttgggtggaagggtgttaagaaaaaagattctcctgtaaactggtacccactgctgtgggcccaggctaactawccctattaaaatcccaagtacacatacccttggccccagtaattccacttttagggattcatcccccccagatatactgtattcatatatgggccaaatgacaaatatacagggctattcattgagtgtcactattataactgcaaaagactggaaaaaaatgtgtctaccaatgggaactggttaaagtatagaatagtgccctgtgtagaatactatgcagcattaaaaagactgagaaagcttttatgtactgacacagaaagatcttaagagatacaactttgatatttgcatcct

SEQ ID NO: 162360 - DNA, 601 bp, Human
aagtcttctctaaaacagtgtgaagtagataatccagacttaccttccagaaagggcctcaagcaataagaaaaaataaaaaaaggcagagagagccaagggaagcccatggagaccatagttaagtgagggcttttgagtccaatatattggacttgtattctgtctttattagcattcaaccttaggactataatttaacttactttacactcagttttctaatctggacaatgaggacaataacatgtttcccaagaaggattattgtgaagattaaaaatactacactggccgagtstggtggctcacacctgtaatcccagaactttgggaggtccaggagggaggatcatatgaagtcaggagtttgagaccaacctggtcaagacaacaagacctccatctctacaaaaacaaaacaaaacaaaacaaactacactgtaccttacagcatcttgcacatggcaggcactcaataaatagcagcaactatactgtcattagtaaattaagcacagatgggtcatccctaaaggaccctctgatggccaatagatgcacactgagaaccagtgacttgaggctctctatagcaagt

SEQ ID NO: 162361 - DNA, 601 bp, Human
gagaaagacagccaggcgtggtggctcacgcctgtaatcccagcactttgggaagccgaggtgggtggatcacgaagtcaggagatcaagaccatcctggctaacacggtgaaaccccgtctactaaaaatacaaaaaattagccaggcgtggtggcgggtgtctgtagtcccacctactcgggaggcttaggcaggagaatggcgtgaacccaggaggcggagcttgcagtgagctgagatcgtgccactgcactccagcctgagtgacagagcaagactccatctcaaaaaaaaaaaaagaattgagaaagagagaaaaagaagattctatttggaaaaatgttccccaaactaaacagctgttcttattgtaaaccactggtattttcagtgaggctctagttccgcacagaaaaaaggcaatttgaaagttccacatggtcaggttcaagaaacgtgagcttactcctgctttgtggtggctctatttggctatggtcctgtcaattaagcaccacgggcctcacttttctcatctgaaaagtgtggaggatggatcagatgatctctaaggctttctctccagttccaaagcacta

SEQ ID NO: 162362 - DNA, 601 bp, Human
agcgctggggataaagcagtgactaaatagaatgaaaattcgtacctgtatgagtttataatcaaatgggaagagacaggcaataaacatgtcagacggtgatgcattaagaaagaataaatgtgagaaagggggtacagagaaacatggaagaaggtaagattagaatccatggtcagggacaacttcttaaggaggtgaatttgatcagagacctgaatgaaatgaggaaacaggcactgcaaagatctgagaaaaggctgtgggaacaagtgcaaaggcccagaggcaggaacacgcytgaggtgctccaggaacaggaaaaatgccagtgtggctgaagtccagtgaatgtgaggagactggtggtgatgagatctggaggtagccaagggcccgattgtgtggggcctggtaggccatttaaagacttgggcttgtcctgggaaagcactgtagggttttgagcaggggaaggacatgacctgaccttggtgttaaatagcgtccgtctggctgctgggtggagatctccaggggtctggtgagataatcaggaaaatatgacagtggcttagccacaatggtgccagggaagttg

SEQ ID NO: 162363 - DNA, 601 bp, Human
agtctggctgagtgttggacagagaggagggaagagaagaaaggccagttcccactctcttcatccctttcctcactgcctggcaaaactagaaagaggccccaatatagcaggtgattatgcaaggtgtccagtattctccagacactttctctcaggataaggaaaggggacaggaagcttatgggaaagttctagaaaaggcatcttttgcactgtgctgaggcaacaggcaggaatggggtagcaatctccaaaaactaggacttctttctgaggtctttgaccccaagtgctccayagtccaaagcagcttctccttcctcctctccacccaaagctatggcgactcccttgtctgatgcagatcagtgctggatgctgtggggaagagagtactgggctgacagtcagtggatgtggattttgtttcccagttccatcgctgatttgcaggtgagtcctttcccctgcctgagactctgggaaagtatgggcctttccccaactgtcaaatgaagtgggaatcatctcaaagggctccgtctagggctacagcataaggagaatgaaagtaactcatgcagacagatgagtgact

SEQ ID NO: 162364 - DNA, 601 bp, Human
aatttttttgtatttttagtagagactggatttcaccatgttggtcaggctggtctcaaactcctgacctcaaatgatccacccacctcggccccccaaagtgctgagattacaggcgtcagccactgcatctggcccaaaatgtccttatttcaaaagaataccatgaggattcaaattaatacatgtaaaggtcttagaattgtgcatggcacatagttaactttgagtaaatgtctggtttattgttcttactagtagaccatggctcagcttgtgtctcggagccttctctatggcytacaagggcctgcagggttttctcagcttcacctagggccaggctgcttcattcctcacatgccatgttctgttcagactcaggacctttgcccacactggtgcttctaccaagctctgtcccacttatctctgaggtcttaatccacaggtcactttctcaaggagcctagctgctcacttcttcccccatctgaccatgggctctgtcccctaggccttgcccagtgctgggtccagagaaggtgctgaagagtctggctgagtgttggacagagaggagggaagagaagaaaggcca

SEQ ID NO: 162365 - DNA, 601 bp, Human
ggctgtgagtcacctgcagagtcaccttatgctcctggcctcagtttccctgagggagaggctgataaatgtgtgctgaatagacaaacatggccttgctagaagatcgctgggagatggtaggaagggggtagggcaaacggagaggccttatcactcttttggcagggagttgcaggcggagactcggaagaagtgaggtttgtggttggaatccacttcctctggttttcccaggggagctgttggctcccgagatgtgagaagaacatggcctttctcctctcccccacggaaacayaggcctggaggtgggcaacttggagaagcagctcagtggaggcagggcaaagagaggggtggcaagactgtgttggggtcaacacctcagtccagccggcccaggtatgggtgggtgccacagcaagccttttggcttctgagcctcagtttctcctgccttgacctccctagcagtagtggtgagatcagggggtgtcatagagggctcaagccatctgggctatagggaatatttggtggtatcctcacaacaaacttcatgtttatcttcctccaactctgacctgttcaattcagc

SEQ ID NO: 162366 - DNA, 601 bp, Human
aggtaggtggagaagaggaagaggctactagcagccaggaaaagtgccagggacaccagaactgtaccttgttctgtccttctcacatccctgcattggcaggctgtgagtcacctgcagagtcaccttatgctcctggcctcagtttccctgagggagaggctgataaatgtgtgctgaatagacaaacatggccttgctagaagatcgctgggagatggtaggaagggggtagggcaaacggagaggccttatcactcttttggcagggagttgcaggcggagactcggaagaagtgakgtttgtggttggaatccacttcctctggttttcccaggggagctgttggctcccgagatgtgagaagaacatggcctttctcctctcccccacggaaacataggcctggaggtgggcaacttggagaagcagctcagtggaggcagggcaaagagaggggtggcaagactgtgttggggtcaacacctcagtccagccggcccaggtatgggtgggtgccacagcaagccttttggcttctgagcctcagtttctcctgccttgacctccctagcagtagtggtgagatcagggggtgtc

SEQ ID NO: 162367 - DNA, 601 bp, Human
tccaatcttgccatcttagaccctgctatctctacccacagaaaacctgacttccttagtgacttcagcagcagcgcacacttcctgagcacatactctgtaaggtactcttcttggtttttttgtagattagttcattagttgtctctacactctgtcagtgggtactaccattaacccatatagctgatggatatgtggcccacagatgatctgtgaattgctcaaggccatgtagtgagctggtgacctaactgggatgcctacaccagcaatctggttcagtgcctttactcctaaygttgatgcagtactctgctcagtttctaaaggacaatcatgggccaggtccatgtacttctgtggctgaggaaggccttcattctaagtccaggtaacctgaggctcagagatactgagacctagctaaagtggataagtggcagctagctgtgatggctcacacctgtaatcccagcatctttgagagttcaaggtgggcagactgtttgagctcaggagttcgagaccagccagggcaatatggtgggacccccatctctataagaaaaatcttagaaatttagctgagtgtgttggc

SEQ ID NO: 162368 - DNA, 601 bp, Human
cacaggaggaccctgtctctacaaaaaaattaaaaaaaaaaaaaaaattagctgggtgtggtggtatgcatctatggtctcagcaactcaggatgctgaggaggatctttgagcctgggaggtcagggctgcattgaatcatgtttggggccactgtactccagcctgggcaacagagtgagaccctgtctcaaaaaaacaaaagataaaagcaaagaaacaaaaaactattattatgacagctgaccattaccaaacatttcagtgtttcacctgtgctgggcactgagctataaagcastctatgcacactaggccatatttcccaattacatgtacaatcatcatattcacttgagagattattttttgtcctgtctcccccacttgactgtgtgtggctctgtcacctgtatctctagaacctggtgtgctatacttggaacacagcagatgccattctaaataaatctattttagaagaacaaatgaatgctttcatttgatcctcataacatttatcaatagccccattttacatatgtgaaaatggaggctccagaatttacccaagatccctatctaggaagtggcaagagta

SEQ ID NO: 162369 - DNA, 601 bp, Human
tgggattacaggcacccgccaccacacctggctaattttttgtaattttagtagaggtggggttccactatgttggccaggctggtctggaactcctgacctcaggtgatccaccttccttggcctcccaaagtgctaggattaaagacatgagccaccgcacccagcccttacttgttaacagtaataaaatactttaggagctgaggcaggaggattgcttgagcccaggagtctgagaccagcctgggcaacacaggaggaccctgtctctacaaaaaaattaaaaaaaaaaaaaaaattagctgggtgtggtggtatgcatctatggtctcagcaactcaggatgctgaggaggatctttgagcctgggaggtcagggctgcattgaatcatgtttggggccactgtactccagcctgggcaacagagtgagaccctgtctcaaaaaaacaaaagataaaagcaaagaaacaaaaaactattattatgacagctgaccattaccaaacatttcagtgtttcacctgtgctgggcactgagctataaagcagtctatgcacactaggccatatttcccaattacatgtacaatcatca

SEQ ID NO: 162370 - DNA, 601 bp, Human
atacttcaagaggcttcaacagtcctggccacccacttggaatggccccacactacatactcctgagtgcttcaggccctggtgcctttgccaacactgtcctttaactggtcactccatatcttcctcagttaaccaacccctactaagcctataggactccattttggagtcccctcttccctgctcatccctccccaacctctgggatgaatgtctcctttctgttcccagactccttggacttctgtttataccaggggtatgcactgaggctggcattggagactcagccgtgagsaaggcttccatggagcttatgttctagtccattctcaatggtggtaagatcacctccaatggcgtgaagtgaagcattcttagacattacagtgatttgtggctctccacagggccacagcacataaggagatatagagtatatagtatatatagtatataggtattgccctcccatgaaatttgaatacctcagctatactatactatatataccatatatatacacacaatatgtagtatatatagtactgtatatactatatatatactttacatatactatatattatatattata

SEQ ID NO: 162371 - DNA, 601 bp, Human
gcacgagccaccatatctggcctttttttttttttttttggagacagagttttacccttgttgcccaggctggagtacaatggcgcgatctcagctcactgcaacctccgcctcccaggttcaagcgattctcctgcctcagcctcccaagtagctgggattacaggcgcgtgccaccacacctggctaattttgtatttttagtagagacggggtttctccacgttgggtcaggctggtttcaaactcctgacctcaggtgatctgctcacctcggcctcccaaagtgctgggattacargcatgagccaccatgcccagccaccattttttttttcttgtttttaaaagatgtgcccagactgactttgaactcctggactcaagcaatcttcctgcctcagcctcctgattacaggaactacactacacagaatgaccaccatgccagcttttcttctcagtgctttattttttaatttttaaatttttgtgacagtgtctcactctgttactcaggttagactgtagtggcgcaatcatggctcactgcagccttgacctcctgggctcagatgatcctcctgccccagcctcctga

SEQ ID NO: 162372 - DNA, 601 bp, Human
ctctggagggagcctctggtgggcaggttggtgacaagaagagcagggcagaggagagagggtaacaatgatgcaggactgacaggcctccatcacggggtctgtgaggccttgtcccggacatcctccactgcagggggtgtgactctgggcccaggaggttgtgatcaacagccctctgccctgaatctaagtcagaagggaagcacatgacagggggaaggaggagctgtgggctaaattacccagcccagggtgcagcagcctgtggggcagggagaaggacgcttagaacataacktttatgagtaagcgtagtacccaatttgtcctttaatcctcccaacaattctgcaatgcaggctgtctctccccatttacaggccaagaagctgtgcctctgagggtccagggactggatcaaggtcacccagctgtgtcagtggtggagccagaatctaaaactggcatctggcacctagaaatatgtaagaaagaagtaagttccaggctgggtgcggtggctcatgcctataatcccagcactttgggaggctgaggtgggtggattgcctgaggtcaggagttcgagaccagcctg

SEQ ID NO: 162373 - DNA, 601 bp, Human
gctgcattgttcccatagagttccacaaaagtatcctgcagggagagagaaggaaggtgcagttttagtcctcagagagtgatgtaggtgggtggggaaaggggccatctgcatgctatggccttggtgatgtgaaaaactgtagccatctgtgcccactctgggccaggtaaagggctaagggtggtcctctttcttgaccctccattggtgataatcaaaccatgttactgctgagaaacaggtagagaggaggaaagtgccctgtctgaggtaagtcaagaagtagcacttactccakaatccaaggtgggaacgagatgggcagggtcagggaactgatggaagccaggtggctggagcagagtgcaggagaggagggcatgggggagatgatggtgcaggggtgagcaagagccagaccatacgtggcctggaagccgcaaggagcctagagttgagtctgagggtagtgtggagtgtggagccactaggcctcagattttctactgctgcaccagagggagggataaggaagcccagggctaaatccccagggtcatttgaggccaattcaggggtagaatgggtcctgggactt

SEQ ID NO: 162374 - DNA, 601 bp, Human
gtggcttatgtctgtaatcccagcactttgggaggctgaggcaggcggatcacctgaggtcaagagtttgaaaccggctggccaacatggcaaaaccccatctctactaaaaatacaaaaattagctgggtgtggtggtgcgcatctgtaatctcagctacttgggagactgaggcaggagaatcccttgaacccgggaggcagaggctgcaagtgagccaagatctcatcactgcactccagccagcaagactctgtctcaaaacaaacaaaacaaaattctcagatgctcaagccctgrtataaaatgatgtgtagtatttgcatatagcttatgtacatactcccacatactttaaattatctctagattacttataatacttaatacaatgtaaatgctatgtaaatagttgttatactgtattgtttagggaataatgacaagaaaaaaagtctaggctgggtacagtggctcaggcctgtaatcccaccactttgggagacttaaataggaggattgcttgaggccaggagttcgcgaccagcctgggcaacatagtggcaccgtgtctctacaaaaaaaataaaacataaaaaa

SEQ ID NO: 162375 - DNA, 601 bp, Human
ttgggaggctgaggcaggcggatcacctgaggtcaagagtttgaaaccggctggccaacatggcaaaaccccatctctactaaaaatacaaaaattagctgggtgtggtggtgcgcatctgtaatctcagctacttgggagactgaggcaggagaatcccttgaacccgggaggcagaggctgcaagtgagccaagatctcatcactgcactccagccagcaagactctgtctcaaaacaaacaaaacaaaattctcagatgctcaagccctggtataaaatgatgtgtagtatttgcatrtagcttatgtacatactcccacatactttaaattatctctagattacttataatacttaatacaatgtaaatgctatgtaaatagttgttatactgtattgtttagggaataatgacaagaaaaaaagtctaggctgggtacagtggctcaggcctgtaatcccaccactttgggagacttaaataggaggattgcttgaggccaggagttcgcgaccagcctgggcaacatagtggcaccgtgtctctacaaaaaaaataaaacataaaaaaatttaaccgggcgtggtggcacctact

SEQ ID NO: 162376 - DNA, 601 bp, Human
tctcagctacttgggagactgaggcaggagaatcccttgaacccgggaggcagaggctgcaagtgagccaagatctcatcactgcactccagccagcaagactctgtctcaaaacaaacaaaacaaaattctcagatgctcaagccctggtataaaatgatgtgtagtatttgcatatagcttatgtacatactcccacatactttaaattatctctagattacttataatacttaatacaatgtaaatgctatgtaaatagttgttatactgtattgtttagggaataatgacaagaaaraaagtctaggctgggtacagtggctcaggcctgtaatcccaccactttgggagacttaaataggaggattgcttgaggccaggagttcgcgaccagcctgggcaacatagtggcaccgtgtctctacaaaaaaaataaaacataaaaaaatttaaccgggcgtggtggcacctacttgtagtcccagctacttggggggccaaggtgaagggtcacttaagccaaggagtttgaggttacggtgagctgagggcaccactgcactccaacctgggtggcagaaagagaccctgtctcaaa

SEQ ID NO: 162377 - DNA, 601 bp, Human
ggactacaggcacacaccaccatgcccagctacttaggaggggttgaggagggaggatcctttgggcccaggagttcgagtctagcctgagcaacaggctagattctttaaaaaacagagatgaaaaagaaagaaaaaaaggatgtgaagggttaaatttgaacactttccaggtagttttcagcatcatgctttggtggaatcatggttttgaggctaagtggggttgctgcatgttacattcctgcctcttccttcccccagctttagtcgtcttcattacattcatgcctgggaagcsttcccagtgacctgagttaggcattaagatcatgggaatccaagattttcccatgtcttctagcatatttgttcacaagaaaaggaaaatttcctccttgcagcaaggggtttttaaccactgtcagtaccatggaatctttcactaaaaatcctttgaatagaaatgtggtcaaggagaggaaaggtatcagcagtgataataccttacaatagtgtatttcatagcacttgaagtagcttcttatttgattatggtaagaaggtaggcagagaattagtgacttgcctattgtcatat

SEQ ID NO: 162378 - DNA, 601 bp, Human
attggccactgagtgtggcctttaggctatttatcagattactttcagctattttattaactagattaggcttgagtaggagctgactttaaaccttcacaggtttccacaagatagagtgcaaaacttcgtacgcaggagtagggaggggcctatttaacttgttcccttatccttgcttctgttcctatgctgcatgttgtgactcttacgtgtatttcaaagttgtcgtctttatactcagaaatagtattttttgagaatatttctaagaaaagacaacttatatttgacaaaactrtgttgaactcttactatgtataatgcactgtgttaagcaccttgatggttggatggatggatggatggatgaggtatacacaagtgagtaaaatctatctttgtttttaggaacttcgagtctactgggagagacatttacatagttaatataaaattggatgataagtgttacagtggagatataaacaaagcacaattggctttggagaggcaacaattttgtatgataggtggaaattgggaaagagttcatagagatttgacctggactttgaatgatggataagattttggttgg

SEQ ID NO: 162379 - DNA, 601 bp, Human
gctgcatgttgtgactcttacgtgtatttcaaagttgtcgtctttatactcagaaatagtattttttgagaatatttctaagaaaagacaacttatatttgacaaaactgtgttgaactcttactatgtataatgcactgtgttaagcaccttgatggttggatggatggatggatggatgaggtatacacaagtgagtaaaatctatctttgtttttaggaacttcgagtctactgggagagacatttacatagttaatataaaattggatgataagtgttacagtggagatataaacamagcacaattggctttggagaggcaacaattttgtatgataggtggaaattgggaaagagttcatagagatttgacctggactttgaatgatggataagattttggttggtaggcataaaaattagtggtgtattttagaaattgggttattcagggcagagagagaataaattgggctagaggaggctagaaatgagaaaatggtaaattgagggaaaataatgacatggtgaatgtaaaacacctagcacagtgtagatacttatcaaactttgcctcttttaaaaaacatttagaaaa

SEQ ID NO: 162380 - DNA, 601 bp, Human; identical to SEQ ID NO: 36429

SEQ ID NO: 162381 - DNA, 601 bp, Human; identical to SEQ ID NO: 36430

SEQ ID NO: 162382 - DNA, 601 bp, Human; identical to SEQ ID NO: 36431

SEQ ID NO: 162383 - DNA, 601 bp, Human; identical to SEQ ID NO: 36432

SEQ ID NO: 162384 - DNA, 601 bp, Human; identical to SEQ ID NO: 36433

SEQ ID NO: 162385 - DNA, 601 bp, Human; identical to SEQ ID NO: 36434

SEQ ID NO: 162386 - DNA, 601 bp, Human; identical to SEQ ID NO: 36435

SEQ ID NO: 162387 - DNA, 601 bp, Human; identical to SEQ ID NO: 36436

SEQ ID NO: 162388 - DNA, 601 bp, Human; identical to SEQ ID NO: 36437

SEQ ID NO: 162389 - DNA, 601 bp, Human; identical to SEQ ID NO: 36438

SEQ ID NO: 162390 - DNA, 601 bp, Human; identical to SEQ ID NO: 36439

SEQ ID NO: 162391 - DNA, 601 bp, Human; identical to SEQ ID NO: 36440

SEQ ID NO: 162392 - DNA, 601 bp, Human; identical to SEQ ID NO: 36441

SEQ ID NO: 162393 - DNA, 601 bp, Human; identical to SEQ ID NO: 36442

SEQ ID NO: 162394 - DNA, 601 bp, Human; identical to SEQ ID NO: 36443

SEQ ID NO: 162395 - DNA, 601 bp, Human; identical to SEQ ID NO: 36444

SEQ ID NO: 162396 - DNA, 601 bp, Human; identical to SEQ ID NO: 36445

SEQ ID NO: 162397 - DNA, 601 bp, Human; identical to SEQ ID NO: 36446

SEQ ID NO: 162398 - DNA, 601 bp, Human; identical to SEQ ID NO: 36447

SEQ ID NO: 162399 - DNA, 601 bp, Human; identical to SEQ ID NO: 36448

SEQ ID NO: 162400 - DNA, 601 bp, Human; identical to SEQ ID NO: 36449

SEQ ID NO: 162401 - DNA, 601 bp, Human; identical to SEQ ID NO: 36450

SEQ ID NO: 162402 - DNA, 601 bp, Human; identical to SEQ ID NO: 36451

SEQ ID NO: 162403 - DNA, 601 bp, Human
gccagggtggttgaggatggcctctacgatgcgcacgtagcccttgctgatggcgagcagcagggcgtcgccaatgcgcgccaggttctccttcttgagcagcagctcggtcacctccaggtgctcgttgcccacagccagctgcagcgcgttctggcccatgtagtccacgcagttgacgttcagcgtcttggactcctccagcatcttgcgcaccactgggatgttgccgtactcggcggcgtcgaggaagcgctcctcctcggcggtgaggctggtgccgcggtcattgaacatgaasgccgggcccctgacagcctggcgccggcccttctcccgcatcactgtcatgcgtctcagggatgggcttccctccatggacctaatcagtagcaacgataaaacaactgtagaatattagggcacattccttcctttcacatgtcagggccctttctggaatacacactacccactgcaaacctctggctgcaggggtcggctcagttgctagcgataccgttgctaactactcgcctgaaagtgacacctgtgatctaaccctggctgctagatcccagaaggaagccggcagcccttc

SEQ ID NO: 162404 - DNA, 601 bp, Human
acaccataacactaaactaaaaagattaacttagcatctagaaaataattcaaggaattgatgtctacaatcgtctttttagatgggaaatgggagacaagaagctgccaaaaacagtctaaataatattgatcggaactatgaaatacccagatttagtagctagaaccaatcaaaacgcataggaggaggtagcaactgattaaaaaataaaatgatctgtcattaatatataatttttatacaaataaataatactgcttgattgaaaataatatccagaaaaaaagttcacttattaaaaaaaatctcttaaagcaaatcactttgctgtcctcatatttctagattgaactgacatctacggctcaccactctgaatatacatttgtggaattcagggagaggcattttgtcatatcagtgaagtgactttaatagtattttttattggtcttttgacttttgattctaaagggatacacaaatgcttgggccaatgaacagtgcatccaaaactaacactatcgtggagatggaataggagcttgctctgtccagtccaccacacacctagtattgcaggacatccagacacggt

SEQ ID NO: 162405 - DNA, 601 bp, Human
tgcacatccaaaatatttctttaataacctgtcaccgagctatcctccattaatttatctaaatctgtatcctagaatatttgacctcttagggtattgaccttcacatgttttaaacaccatacctactgtattcctcaaagaaatgtgaaaactgcagagtggctgagaatcttctctgaagcatctaaataatggcaatttcgggggtgagatactagatattataggccattgataagataaaataaatataggtgtcttaaaaggaaaaaaaatcacctctttttcactaggaaamaatttttttttttaatttcaaggctaatactttgagctcaaagtccccatgggaagaatatagcgaacaccatggaatagggcaaattaggttacctgcttgtctcagaaatgagcttcacttttgctgccctttcagagctcagagtctcagggtcagtgctatgaaagcactattttctctgtctgtctaaagccctgacagacggacatgaacatgggataagaggggagaaaggtgaaagaaaggcagataagaaaggaataacaaggacaggtaaaaatgagaaagaaaaggcac

SEQ ID NO: 162406 - DNA, 601 bp, Human
cttacaaatttgtttgagttcttgggatattaagaagatcaatcttttgtgagatacaatcgaaaaaacatttttcctagtatgcccttcacttttttgtttataatctttctgatgtcatacagaggttttaaattatatgtggccagattatttgcatttttgcttggagatttcttcgcttttatatgagaaagtcctttccaacataaacattaaattcacggtcatgtatctcctattctggtgttttatatattcattttctggattaactgtccttgagttctgtaaggcctgygttgaactcatgccttgatttctaggaaagaccagatctctgggaatcctgagcccagttagaagacaatagactcagaaccagagctgggagtaggtcttgggcagagggtagaaaaaagacttcctggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctac

SEQ ID NO: 162407 - DNA, 601 bp, Human
gcattcagggtaaactacaggtggagcatataatgtcattaaatcagattaccacttaggaaatcaacaatgtagtttttagaccaacagtttctgtaggaaacaaaattcccatgaagttaagagacaggtgggcatgtgtctatatggaattgatggacaaatttcccttttgtgagtgtctggtagctatcgtttgaatgtgtctcctccaacattcaggtgctgtcaatgtggtagagttaacaggtggggccttcaagaggtgattaggccatgagggctgctcccttgttaatgktattaagacgcctataaaaaagacttcatgcagcattcagctagcttgctcttctactcttctgccatgtgaggacgtagtgttcctcccctctagaggatgcagccctcaccagactaccaaacctgctggtgccttgatcttggacttcccagcctccagaactatgagacaagaaagttttgttcttataagtctctccatctcaggcattctattgtaacaacacaaacggactaaggcactagtcgttcttaggttttaaactcttgaggacagaaatattaatgttatagcata

SEQ ID NO: 162408 - DNA, 601 bp, Human
tctttatcaaagcccacctacaaggaaatgcacaggtttccactgactggtgcatagtttcccatcaacaattttaattaaaaaagaaagtctcatctcccaggacaggcgatgtaggttcaatttcccccaaatccctgcctttgcccccagagtgcacccagtgtaaagtccactgatggctgcactggcagctgcctccgcatcaccatacatgcgtacttaacgacccacagacagaggtggtgagaataaatttatgaatactagatttgaaataattaactgagttattatgttragattctaagcctcaatgtgatgggtattagaaagctaggcttttgggaggtaattagatcatgagggaggagccttcatgaatgagactggagccctgataggaagaggcaggagagctcgctctttccaccatgtgaggatacaatgagaagtcagcagtctgcaacccagaggagagccctcatcagatcttcactatgctggcatcctcattttggatttccagcctccagaactgtaagaaataattttttttttttgagatggagtttctcttttgttgcccaggctggagtgc

SEQ ID NO: 162409 - DNA, 601 bp, Human
ctccaggcaattcctagagttattaatatttggctctttatcaaagcccacctacaaggaaatgcacaggtttccactgactggtgcatagtttcccatcaacaattttaattaaaaaagaaagtctcatctcccaggacaggcgatgtaggttcaatttcccccaaatccctgcctttgcccccagagtgcacccagtgtaaagtccactgatggctgcactggcagctgcctccgcatcaccatacatgcgtacttaacgacccacagacagaggtggtgagaataaatttatgaataytagatttgaaataattaactgagttattatgttaagattctaagcctcaatgtgatgggtattagaaagctaggcttttgggaggtaattagatcatgagggaggagccttcatgaatgagactggagccctgataggaagaggcaggagagctcgctctttccaccatgtgaggatacaatgagaagtcagcagtctgcaacccagaggagagccctcatcagatcttcactatgctggcatcctcattttggatttccagcctccagaactgtaagaaataattttttttttttgaga

SEQ ID NO: 162410 - DNA, 601 bp, Human
tgggatagtcagtaactgtgatattgggcagcgtggtgatgccttcgaacctgtctgaggcattgaacacaagcagacccaggaagatgatgaaagaagctgcatgtgctacaaacttcataaaagggcttcgcagaattttccccagctgtaacaaaccaaagaggaaaagtttgcttcagaaaatctggctttcacttgtggagattacaatataggattaaaaaaaatagatgaaaggagaacactcaaaattctgcttctgtttccaaaaagctctatattatgaaaaatattcttytttaggggaatgcttcctccaaaaataatttaataagtattcaaaattcattgtttctaaatgtccaatttgtcttagggtagactgcattcacagatgcacttctggaaatcacagggcctatactggttcttgctcttatttttacacaaaagaatatgcaaagtctggattttagggtctggaaaaagaaatttcaactttgtattgtgtaattcttcattgctttgtaattgtaattgagatgttatgaggatcttatagactcatataagaccttaaaaaccctttgaagattaa

SEQ ID NO: 162411 - DNA, 601 bp, Human
gttttcaccctgaagatctgtttgggatagtcagtaactgtgatattgggcagcgtggtgatgccttcgaacctgtctgaggcattgaacacaagcagacccaggaagatgatgaaagaagctgcatgtgctacaaacttcataaaagggcttcgcagaattttccccagctgtaacaaaccaaagaggaaaagtttgcttcagaaaatctggctttcacttgtggagattacaatataggattaaaaaaaatagatgaaaggagaacactcaaaattctgcttctgtttccaaaaagctytatattatgaaaaatattcttctttaggggaatgcttcctccaaaaataatttaataagtattcaaaattcattgtttctaaatgtccaatttgtcttagggtagactgcattcacagatgcacttctggaaatcacagggcctatactggttcttgctcttatttttacacaaaagaatatgcaaagtctggattttagggtctggaaaaagaaatttcaactttgtattgtgtaattcttcattgctttgtaattgtaattgagatgttatgaggatcttatagactcatataagacc

SEQ ID NO: 162412 - DNA, 601 bp, Human
ttaaaataaaagacttaccaagaacccagaccataattagcatttcagtccatgtaaactgggtggttttcaccctgaagatctgtttgggatagtcagtaactgtgatattgggcagcgtggtgatgccttcgaacctgtctgaggcattgaacacaagcagacccaggaagatgatgaaagaagctgcatgtgctacaaacttcataaaagggcttcgcagaattttccccagctgtaacaaaccaaagaggaaaagtttgcttcagaaaatctggctttcacttgtggagattacaayataggattaaaaaaaatagatgaaaggagaacactcaaaattctgcttctgtttccaaaaagctctatattatgaaaaatattcttctttaggggaatgcttcctccaaaaataatttaataagtattcaaaattcattgtttctaaatgtccaatttgtcttagggtagactgcattcacagatgcacttctggaaatcacagggcctatactggttcttgctcttatttttacacaaaagaatatgcaaagtctggattttagggtctggaaaaagaaatttcaactttgtattgtgt

SEQ ID NO: 162413 - DNA, 601 bp, Human
atgtcatgctaaaaagtgagcaatatcgtttgaaaaagatgaaacccttaagtgagaggtcctaggacattctgaagaaactgaaagcagaaaatgccattctgggacaagaggacaaaatagtacaacttaacaacttaacaaattgtccaacttaacaaattgtcctgactacataaagggaaaatactgtagaatttttaaaaaatgtaatggcttaaaagaaaatgtataaaataattacttgacctaggctgaggccacaggagtgaatgggaggaagaactaacctactaactcmgaaaatgagaagacaccaagactcacattggataaaacaaatacaaaaatgacttcggattaatcagaaataaacaacctggttccaatctccatttcttagcagagaacacaataaattcttttcctcacattacttcaaattcttattttaacacagctattcaaaatgggttattgtaagacgaaataggttggtgcaaaagtaattgcagtttttgccattttaaaaatagtaaaaaccacagttatttttgtacccaacctaataacaaacattctgaaaatgaaaactctccta

SEQ ID NO: 162414 - DNA, 601 bp, Human
atcctctctttagagatgcagaaaccagacttagaaagattaaaaattgatcaaaacaatacatataggagatagggaagcctgaatccatcccttccagacaacagtcatcaaatatacataaataaatttcaataaataggttatgaaatggtcaagatacctaaaatacaatctaaaattaattctttaattacaaatggtgatcatttgctcatttgaacaagtctccttggtatataaaagtctttgcttgctgagaataacagaggtgcttaattacatcttatattttggagcrgaagtccagccttcaataacattaacatgctccttgtactcatcacaatgtgccctaattacacctataaaaaagtattcttcacaaccagatcacagttaaactctgtgcctgagttcccttacctgtaagatgaagattagacaacactttctaaagtattttccagatttcagattttacaactatatccaaatttgctaactgtggctcctcaatttggcctcaagggaagggaggctaacattacttaccattggtttgtacggggcaaggaaggcatcaatgttctttcacacc

SEQ ID NO: 162415 - DNA, 601 bp, Human
taagaataaagtatgaacatgccaatcataaaggcaaaaaacaccataataaagaggaccatgaacttgaatatgtcctttacagtccttccaagagagatctgcagggggccaaagctctcatttgcagggaggatgtacgcaatccgagagaagctgagcacaacagctatggcataaaggccttcagatataatctgagggtcagaagggagccatttatctctagctagaaaaaagagagaaagagattaaaaatggagctttctattcattgccaactacgcaaagcaaatacctkaaataggatctatcttgtaggtaggtggttaccatctcagttgaaactaatctagatttaattaactgtccagggactattttcatcttaaaccagaaacgtaaattctatattactttagatggagggtacactattataaagatactaagctgactccacattcagcagaaacagaataaaatacaaaacatggagaggttaaaacacttcgttagacacagactgtatccaggatgacaaaacaactgacttgactgatttgtcccttcagtcattagatttactgaccagttattt

SEQ ID NO: 162416 - DNA, 601 bp, Human
aattgcttttcggcatttctgtgtttaccatatgtccccaaatgtcacataagcccctgagtgcctgaacttgttttacatctccttccattctctgtgctgcccacggtgatggagataaccaccctaactgataggagaaatgaagggaaggggtccttatgaggaggaagctggctctctcagttcacacagcctagaaggccattaggaccaaaacttctactttgagaacactatattatgagtttctaaaacatacatagagatttggtggagttaacaaactgcaaagcactaraaagatactgaaaactgaactgaaggacataagaaaacatatatacaacagtgaagagaggtaccaaacccagcccaatccaaaaccaagaatcaagtgatttctagaatactcaaaattttgactggataaagaataccattagtgtttgccaaacatctggtcattctaccaggtagaattgtgggctggctaattgaagagagagtaatttccttagggccaatacttcttctagccactaatttcaaaacttctgaaatataccctgagagaaggcggagcagcagtaaattcatg

SEQ ID NO: 162417 - DNA, 601 bp, Human
caagttaaaggcttttttgtttgtttttaatctggcagtttatatgatgttctgatcaaaagcagggcctcgactcagtgacttcttgaaacatcatgaaaatatttagtattagtctgtgaaagactgtggactagacagttacttttaacatcttctaagttcacacataaaaattattgaacaaacatcagaagacaagaaaaaaaagacagaacatttattttaaggtcttggtaagttttcgatacctaccctggactttgagttacccattcccatttctatatccttctgaagycttctccttctgcatttgggaaagttaacaattcgcatgatgaaataaacaaatgattttggactaggaactagactgaaaggtggaggtaatgtttttccatcatcaaaataggataaccaaagttttgaacgagcaaacttccattctacatcactgtcatcctgtgtcacaaaaatagaaaaaaaaactaattttaaatgctaaatattctagtgactgttgctaataggttttttacaatgaatctaagttacgtttttgaaataggtaacttatacacatttatctacatatatt

SEQ ID NO: 162418 - DNA, 601 bp, Human
ttatttagtcaaataaaaagtttctacaaaaaaggagaatatggtggtggtgaactatacataaaccaagaaggctagaagtttaaactatttaacttcagaataacagtcgagaagcatggaacatacaaaaacaaagtgttttctaacagtgacttttctggttacttttaacaagttaaaggcttttttgtttgtttttaatctggcagtttatatgatgttctgatcaaaagcagggcctcgactcagtgacttcttgaaacatcatgaaaatatttagtattagtctgtgaaagactgtggactagacagttacttttaacatcttctaagttcacacataaaaattattgaacaaacatcagaagacaagaaaaaaaagacagaacatttattttaaggtcttggtaagttttcgatacctaccctggactttgagttacccattcccatttctatatccttctgaagtcttctccttctgcatttgggaaagttaacaattcgcatgatgaaataaacaaatgattttggactaggaactagactgaaaggtggaggtaatgtttttccatcatcaaaataggataaccaaagt

SEQ ID NO: 162419 - DNA, 601 bp, Human
ctataccattctatctctgaaagttagttcatgataacaaagtatgatcatgaaaattatcttctttgttaaactatgactcaactgagataactcaagggtttcttgcttatttataaaatgagtatttatggttatttgaggatgctcttgggcctgtatctattttatgacactaatggaaaaaagattatttagtcaaataaaaagtttctacaaaaaaggagaatatggtggtggtgaactatacataaaccaagaaggctagaagtttaaactatttaacttcagaataacagtygagaagcatggaacatacaaaaacaaagtgttttctaacagtgacttttctggttacttttaacaagttaaaggcttttttgtttgtttttaatctggcagtttatatgatgttctgatcaaaagcagggcctcgactcagtgacttcttgaaacatcatgaaaatatttagtattagtctgtgaaagactgtggactagacagttacttttaacatcttctaagttcacacataaaaattattgaacaaacatcagaagacaagaaaaaaaagacagaacatttattttaaggtcttgg

SEQ ID NO: 162420 - DNA, 601 bp, Human
gttaacaatgatatattaatattatatagtttcatatagctagaaggaggatactgaatgttaccaacacaaagaaatgatagatgtctgagatgatggatatgctaattaccctgatctgattcctacatatgtatcaaaacatcactatgtagacaatgagtaagtataattatttatcaattaaaaataaagttagacaaaaccaataaaacaaaaataaacaaatatgtaaaatttacaaaaattttcttaaaaaaaagactttgacaatcagtgggctgagccattttgtggtttmctgcttctaaaaaaattggataaaaaatagaacaatacgcagtaacggacatcaccaatatattataaattccttgatcgtcacttttgtgaacttatacacattagaaagtcaaagacttgatgatcgaaatgatcaacgagatgaaaaacaaagggctataacttcccctgagttggagaatagtgttcaaatgtcacatccagtatcaaaatgcaaaagatattttaaagtagcactcatgaaacagtatagccaaacaatccatttaaaaaatggatcacctgaaagaaaaaccta

SEQ ID NO: 162421 - DNA, 601 bp, Human
caaaggaaaaaacaacagtgaaaagacagcctacaaaattggagaaaatatttgcaaattgctcatccaataggggattaatatccagaatatacagggaactcaatcatctcaacagcaaaaaaaaaaaaaaaaaaaaaaaaaattccaattaaaaatgggcaaataatctgaacagacatttctcaaaagaatacatacaaatggtcaatgatatatgaaaaaatgctcgacatcactaaccaaaccacaatgaggttatcatctcactccagttagaatgtctactatcaaaaagacaaaaaaaaaaatgctggcaagaatgcagagaaagggaactctaatatgttgttgatgggaatgtaaactagtacaaccattatgtagaacagtatggaggattttccaagaactacaaatagagctaccatatgatccagcaaccccactacgggaatttatctaaaggaaaagaaatcattatatcaaagagacaactgcacccacatgttttattgcagcactattcacaatattcaaaatatgaaatcaacctaggtgtctaacagcagatgaatgtataaaaaatgtagtatatata

SEQ ID NO: 162422 - DNA, 601 bp, Human
atcccaggaatgcaaggatgtttcaacatacaaaaatcaataaacatcatacatcacatcaacagaatgaaggataaaaactgtatgattatctcaacagatgataaaagcttttcataaaattcaatattcctttatgataaaaaatcttaataaattaggtatagaaagaaagaatctcaatgtaataaaggcatacaacaaacccacagctaacatcttactgaactgggaaaagctgaaaggttttttagaagtgtaacaagacaaggatgctcactatcaccactcttattcaacwtagtattggatgctctggccagaacaattaggcaagagaaagaaagaagggtatccaaattggaaaggaggaagtcaaattgtccctgtttgcagacaacatgatcgtatacattgaaaaacctatagactctaccaaaaaacttttagaactgataaacaaattcagtaaagtagcagaatacaaaattaacatacaaaaatcagttgcatttctatacacgaacaacaaactacttgaaaaagaaaataaaaaaggcaatgccatttacaatactcaggtataaattaaccaaggaga

SEQ ID NO: 162423 - DNA, 601 bp, Human
acacccaactgtataataatctggaaagacaacatatttggattcccatcctacaggttaaatgaaaatatattctatatgaatcaaatattttcagagtccaaagaagtgaaagaactaaagaaatatgagttaaaaatattaaataatctcctatgggggaaaaatctttccaagtaggacacaaaacctgacgccataaacaatttgtaacgttgactatacaaaaataaaaaaagttgtgaatgggaaaaaatactttaaatattaaaaagacacacaataacctggtaaaaaacawtcttaagtcataacacaaaggctaatattgttaaaatatgaagaattcctcttcattgataacaaaaagcccttcaagtaaagcaaatatatatggagacataaggatatataacattaaacataaaaaggaaggtaaaactcattcatgataaagaaatgcaaagcagcacattttaacctatctggtgaagataaaaacctttggtaacacactgtttgtaaattagggaggaaataggtgctctcatatatttattgtaagaatgtaagttagtacaagctccatcagtttgataat

SEQ ID NO: 162424 - DNA, 601 bp, Human
aggtactgaacctaaagggattatgaaaattattcttcttcccccaacaaacacagttctaataatttaacaagcaggagctgggagaggaagggggaaaatggtgtaaataaaacacggatattgattttcttcatagtttagagctgaaggatcaaaagataaaacttgaaacatatcaatcaattaacagagatctaagtatgtttaaaaatattaagataaacaccaagacatatagtataatccacttcagcagacactgccacttctcttccacagctttttagtttggcacatrgccacttgaaattaggactttattttccaggctccattgcagataggtggtttgtgcaactttacagaaatttcttataggaaggaactttcttctctatcactttctaactgtattttggaatgtagaaataataggcagagctccaggagctttcttggaacatgagataatgttagactgaaagccattcatgatgcagtaatacgatggaaaaagcctgggtccctgacattgttaggtaccacattaggaacatgagagagaaataaatttctattttcttttagccatttaaag

SEQ ID NO: 162425 - DNA, 601 bp, Human
ctccccctcccagattagcaggaggaaaaacaatcattaccactggggacagaaagtcagcaccaaggtggttctgcacaagcaaaccttactaaaataacctgtatcttctatcagtttctcccacatatttaccttccaacaatttactacctttagcaacccaaacactttttcctttgtcatatcccttctccacaaacttcttgtcccttgttaagttggtatataagccccaaatgccaactactcctttgagccactcatcactgagtttttctacaggtatgtgcactgcatkcataaataatccttttttcccctcctgtttatcagtcagttgtcagtttaattcatagcccccaggtactgaacctaaagggattatgaaaattattcttcttcccccaacaaacacagttctaataatttaacaagcaggagctgggagaggaagggggaaaatggtgtaaataaaacacggatattgattttcttcatagtttagagctgaaggatcaaaagataaaacttgaaacatatcaatcaattaacagagatctaagtatgtttaaaaatattaagataaacaccaagacat

SEQ ID NO: 162426 - DNA, 601 bp, Human
tcttccacatcaacattccatttcaggaggctctggagcaacatctacacatacagtaaaaataaattataacctaagtatattacaggtagtcaatataaatatatagaaatagaaactaatttagaacataaaataactcagagaacatagttctcataaactcttcttgaaggaactaccaaaagacaaagttaagctaagaaagagataaacagaaaattatggcaaaaaagactggtggtgaatactgactatgtttaactgtgggactaaaactaaaccaaatgtaggctatagwcctgacaaggtagtgaagtggatcagaatatgtcaccccaaaatatgccattttggcataaggattattttgagctaaaggcaattaaaaagtagcaaacacagaaagagttctctgccctaacccatctgcctaaaaacaggacatacatttccctttgtgaagatcttcttcctctccccctcccagattagcaggaggaaaaacaatcattaccactggggacagaaagtcagcaccaaggtggttctgcacaagcaaaccttactaaaataacctgtatcttctatcagtttctcc

SEQ ID NO: 162427 - DNA, 601 bp, Human
aaaatacaaaattatgtgtatcagttgaaagcagcttgaaaggcagtaatacaaattggtggaaaagaaatgactatttaacaagtagtgctgagacaagttgagcctctgcacaaggcaagaaggtacctgagattagacagaaatcagtttcgccacacatgacactacctggtaatagtccatccctttgttcatgttggaaagatagttcatgagaattctaaaatgatctgcagctcagagaaggagacaaagattggccatccccattctattaggaagcttgtctagtaaaccsaagacagtattgtgtaataggcaacaaagactcttgaggtctctctccccctatcgcaatagttcctgaataaaatctgtttttaccactttagctgctgtctggctctggttttctttaacacagttgagactgtgagttgcaagaacaaatcatgtagttttgagttgtgactccatcattcacaagctctggaaccttggtatcttaatctgtgtaatggaaatgctagacagtgtcttgtaaaagagacaatacatgtaaattacatagtaggtgctcaaataatataactattat

SEQ ID NO: 162428 - DNA, 601 bp, Human
ggatggatcttaaactggactgattcattcattcagcaaatatttattgagagccaattctgtggcaggtactgtaccaggtgctaggaatacaacagtgaacacagtccccagtccagtgaaacttcatattgatatggaaccattcacaataatgggtgaacatatcagggatctggttaaatttaggggacagtgaagacagattcctataaaatgaaaatacaaaattatgtgtatcagttgaaagcagcttgaaaggcagtaatacaaattggtggaaaagaaatgactatttaamaagtagtgctgagacaagttgagcctctgcacaaggcaagaaggtacctgagattagacagaaatcagtttcgccacacatgacactacctggtaatagtccatccctttgttcatgttggaaagatagttcatgagaattctaaaatgatctgcagctcagagaaggagacaaagattggccatccccattctattaggaagcttgtctagtaaaccgaagacagtattgtgtaataggcaacaaagactcttgaggtctctctccccctatcgcaatagttcctgaataaaatctgtt

SEQ ID NO: 162429 - DNA, 601 bp, Human
cctacttcaccttctactatcctttcttccttgtccccgactcatggggagactacaacctatgtgttgtattaaatatttaatctgccaattcaggaaacacaagttactcaaactcttcagattttagtttcctcattaattaaatgaggagattatatgacacattttcttagtaagaactttgttcaaaactccaaattctcattgattttccccttttgtgcaagggcttgggaaatgcttcttgttttttatgccgttttagccatacagttcttcccactttgttcctccctcyccaccccccatggagattacggtacaactcatcagacttctgctttctaaactacaacctcattccaatcctttctcctgagacagattgattaggtcaccatgattagatttttgctagttatcgattataaattcacaggtttctcttctacatacatacactattggattgatttacatttaaaatgcattccttgtattaatcaagtaatggcttcaaagcctatgaacaattttattaagtttagtcctttcctcttttatcagtgtagatagatttagtggcatctcattggtg

SEQ ID NO: 162430 - DNA, 601 bp, Human
cccgggtccgcggttgttggacgggcgctgccttttccgggttgatattctcctggtcctcttggagcgccgtctgctgcaatgctagcagcgccgagcccgcctcgcgggtcgcaggccccggcgcagagttgcccaacatcactgctcccgggagtggacggcgggatcagcctgcggcgccaagcagcgtgcactctgcccagccgaccactcgcaccgacccggccaaagaatagtcgtagccgccggtcgcagcccaggccagcctaccagcccgcccgctcgctcacccagctcragaccacgcagggccgaggaggttgcgaaaggcgcaggcaggcactgcccagcgtggcgagccaaagacgcccagagatgcagcgagcagcccgctggagcggcggctgttcttgcagttcaagtatcccgcgactattgaaatggaccaatgaaagcgctcgcggccttgacgtcattcaaggcgacagggtcgcaggcgagtgaagggtaaaccaaaggaaactgagcaggggcggggcaggagggagaaacaaactggctggggcgggagaaaacgcctgcgcggggcggggagagg

SEQ ID NO: 162431 - DNA, 601 bp, Human
gtcttaggaaaacatgtttcatgttttcatttttaaatttagtttttctttcttttttttttttttttttgagacaagagtcttgctctgtcgcccaggccagagtgcagtggtgcaatcttagctcgctgcaacttccacctcctgggttcaagcgattctcttgcctcagcctccctagtagctgagattacaggcatgcatcaccatgcccagctaatttttgtatttttagtagagacagggtttcgccatgatggccaggctggtctcaaactcctgacctcaagtgatccgcccrcctcggcctcccaaagtgctgggattacaggcgcgagccaccgcacccagcctttacttcttaataaaagagacactgcttatatgccagaaagtaatattggaaggaaaatgttttaaaatttgtaacctagtgtactatatcatgttcaaggaatccagttgggggaaaattagtgttctagattagaacagtttcatcctcctccactgccctaagccccagcacattgccatccctaaagtagtcactgactctgcctggtgtatgttaaaaggtcaccattaaaaaaatcaattt

SEQ ID NO: 162432 - DNA, 601 bp, Human
tttgataacggctctgtagcaactctagaaaaaatatctcacagcctcatctttaaacatatcaatcattttagtgttttgttccatcctcatcctgtattttccctcctttattaacttttaaaaaacaactcttctgactacccatccccaagatgtcatccttagacctctgcttctagtgctttcctgatatagattatcttttgccagcagtaggctttcttccatactgcagcattaatctccctctgaatactaaatctcttcaccactgctgtacaaaggaactaggttcctktacaaaggaattagggcttacccctaattattaccaaagaatcaccattcaacaaaatgaaagttaactcaccattgctaaactttcaactttgcagtttgcaggctgctgatgcagaaagtattgggtaagaaactgatttactgttggagcagctaagtcaaaagtaaggactttcaaaactagatgctccattctcagaacttgtttcttggtgtaggtatcatctgtaatgtacacaaactctgctacttctggggggtatatttcttcaaactttctacaatgaaaaaagtttta

SEQ ID NO: 162433 - DNA, 601 bp, Human
ctaggcaaccctcagttttgtaggacaattattatttaatctggcacaggcatttcagtcacaagataggtgtgtgaagaccgtaatacatacccagctttgtcccgtgactgtgtagagtgctaaatgaaaggcagctccagcaataactgatggcaaatacttgaggtatgggtcagcatctatcaaacttaattctcccaaaaactggaataaaaaatactttatgatcacaagagcgtttagaattcaaatgtcaaacctctgccttctaacctaattttttcctgcctttgataayggctctgtagcaactctagaaaaaatatctcacagcctcatctttaaacatatcaatcattttagtgttttgttccatcctcatcctgtattttccctcctttattaacttttaaaaaacaactcttctgactacccatccccaagatgtcatccttagacctctgcttctagtgctttcctgatatagattatcttttgccagcagtaggctttcttccatactgcagcattaatctccctctgaatactaaatctcttcaccactgctgtacaaaggaactaggttcctttacaaagg

SEQ ID NO: 162434 - DNA, 601 bp, Human
accgactaaaacaaaagtccaccttaaagaagaaaaattcatttatatcagcaatacctaaccacggctatttttggttctttgcaatcagcacttttcatgatttgtatttaccttctaaatagattcaaacccaaaatatcagtccaactagaaatgggatctctctccaggggaggtttactttttcattaaaattttattgatacataatatttgtatatttttatggggtacatgtaatattttgttacatgcatagaatgtaatgatcacatgaaggtatttagggtatttattwcctcgagtatttatcatttctatgcattgagaacatttcaagtcctctcttctagctattttaaaatacacaatacatttttgttaactatagtcaccctagtctactgttgaacattagaacttattctttccatctaaccatatgcttgtacacattaaccaacctctctccgtttcccccgccaatgccaataaactctcctgaaaatcataaaaacaactagctatctcattaacactgacgactctacatgactattcaaacatacatatttatccatctatacacatgccagat

SEQ ID NO: 162435 - DNA, 601 bp, Human
aggagttcgagaccagcctggccaacatggcaaaaccccattactactaaaaatataaacaattagccgggtgtggtggcgggtgcctgtaatcctagctacttgggagactgaggcaggagaatcacttgaacctgggagacagaggttgcggtgagctgagatctcaccactgcactccagtctgagcaacagagagagaccctgtctcaaaaagaaaaaagaaaaaaaaattaactgcatacagcaataattgtaaagctgtattgatgatggcacacaatgtagaaagatgtcattygtatagcaataatggcacaaaaatatgggagaaaacagagccacataagagcaaagttttacacagtattaaaattaagttgctattaatcaaaattagattgtgaaaaattaagataattgtaatccccaagggaatttttaaaaaagaactcaaaaacatataacaaaaaagggaattaaaatgatgcactagaaaatagaaaaagaaacaacagtatctatcaacagacaaatggataaacaaaatggtgtatcaatacaatagaatattatgtagctataataagtaatgaagtcc

SEQ ID NO: 162436 - DNA, 601 bp, Human
caggagttcgagaccagcctggccaacatggcaaaaccccattactactaaaaatataaacaattagccgggtgtggtggcgggtgcctgtaatcctagctacttgggagactgaggcaggagaatcacttgaacctgggagacagaggttgcggtgagctgagatctcaccactgcactccagtctgagcaacagagagagaccctgtctcaaaaagaaaaaagaaaaaaaaattaactgcatacagcaataattgtaaagctgtattgatgatggcacacaatgtagaaagatgtcatycgtatagcaataatggcacaaaaatatgggagaaaacagagccacataagagcaaagttttacacagtattaaaattaagttgctattaatcaaaattagattgtgaaaaattaagataattgtaatccccaagggaatttttaaaaaagaactcaaaaacatataacaaaaaagggaattaaaatgatgcactagaaaatagaaaaagaaacaacagtatctatcaacagacaaatggataaacaaaatggtgtatcaatacaatagaatattatgtagctataataagtaatgaagtc

SEQ ID NO: 162437 - DNA, 601 bp, Human
tgagagtaagagaccataaacagccactgtcattcagctacaagggaaataatgaggcaacttagccaggcatctagcgaagtgaagccccagtaagcattactatatttggggaactcatatttaaagtaattaatagctcttcaactcttagtggccaactgacttgagaacgggcaaaaaaaaggccattaaaaaggaaagccaaagcttcatatccttggataagtctattactttttaaggctcaatgtccttctcctgaaataaggacacaacactgacccgaatctttgcccarggtgattgtgaggatcagatacaaagtatgtgaaaaccacagtgcactaaattatttttaaactcatttttaatctaagcttttctactatcaaaactacagccaattaccctttcataatcccaaaacagtaatgtttaagtagcagatctttttaaatcagtgttttaaagatttagatgttaagaatttaatattacagccttccctaatagattctctagggttacactaacatgaccaaacagggaaaatatacatttgaaagctgttatgcagtcaagtggcagaattcgaaat

SEQ ID NO: 162438 - DNA, 601 bp, Human
tgtttactgagcattagcacaggcctgatactctgcatggaatttcacaacagttctttgccctcatggggcaactggggtaataagacctacagaggacagactaaactgtgtaccatttcatgaaaagccatgccctttctttcctccaggttgttacacatgctgttcccacatcactgaatacttaaccacaaccttccttcaagacttgcttcatggttacctcattatctttctggtctccagagtggctctgtgctctgttaatgccttataaggtgttataggtccatgcccrgtgtcatgctatgagcacagactcaggatccagtgtacctagggatgaatcctggctctgccatttactagctgtgtgaccctgatgaagttatttgactgcctcaatttccccatctgtaaatggtgataatgatactacttactttatacagtcaaggtaaggattaaaatgaattaatccagtgattctgcaggtaaagactgtgagccaccagccttagcataacctaagaatttgttgacatgcaagtctcaggtcccactccagctctactgaatcaggaatgctggaaatggg

SEQ ID NO: 162439 - DNA, 601 bp, Human
tagttcacattctttttttttttttttttagaggcagagcctcgctcttttgctcaggctggagtgcaatggtgtgatcttggctcactgcaacctctgcctcctgggttcaagcaattctcctgcctcagcctcccaagtagctgggattacaggcacccaccatcatacccaggtaatttttatatttttgtagagacggggtttcaccatgttggccaggctggtctcgaactcctgagctcaggtgatccacccacctcaacctcccaaagtgctgggattacaggcatgagccacmatgcccagctttagatcatattcacatttttctctattttcctcaactctgaatcaagaacaaaggcttattatgaccaccaactatcctctgtgaataaagtatggacagacatttcaacgcaaccatatttagtcacagagtgaagcccttgtctgctcacttgtggttggtgctccctcactaccaatgccaaggtcccttcccagcctatatcataggtgatgtaattaactgggtgagaaaaaaaatcttcctctctttagcatggattttccaatgagaagtcattgagcatat

SEQ ID NO: 162440 - DNA, 601 bp, Human
ctctttcattccagaactcttgagcatcttcctcagcaataaccagcagccttcagcagggagaacatcatcttaaatttgctgcccatttctttgcacagtacacaaaatatgtacattcagttgtcattcttagttcacattctttttttttttttttttagaggcagagcctcgctcttttgctcaggctggagtgcaatggtgtgatcttggctcactgcaacctctgcctcctgggttcaagcaattctcctgcctcagcctcccaagtagctgggattacaggcacccaccatcrtacccaggtaatttttatatttttgtagagacggggtttcaccatgttggccaggctggtctcgaactcctgagctcaggtgatccacccacctcaacctcccaaagtgctgggattacaggcatgagccaccatgcccagctttagatcatattcacatttttctctattttcctcaactctgaatcaagaacaaaggcttattatgaccaccaactatcctctgtgaataaagtatggacagacatttcaacgcaaccatatttagtcacagagtgaagcccttgtctgctcacttgt

SEQ ID NO: 162441 - DNA, 601 bp, Human
ttcccattttaaccatagaaagagtgctattgttccttttctccacatggtggtgctaatgtagcaccaccatggagccgtattgccaaagacgaaaaaattcagcactgctcatcgttattaccagtctgtaagtggccacttaaaggccatttggagtacatgcagaccattaattataatgcatttccaaaaatagattaatcacaaattttaaaataaaaaatttaagtaaacagattcaaatcaatgagaggggcataagcatttgcagtttttcaccaagatcttgcttgtggcrtaggtcagcatcctgatttcttttccattatttattctcacaaaactaaaagatcctaaatctcagttagaggttgccaggaataacagcaagtatgtttggtggttctgtcaaatggctgtagatatttggctcacatgtagatctagaaattatgaacaaacgtctcactaaagtgagaagtgagtttcacactacttttcacagtctgttggatgctaattgaacaacatttccaggaaatggctggtgtgctgactgtttgaacctgggatattgcagcaaatgaaatccagatcc

SEQ ID NO: 162442 - DNA, 601 bp, Human
gtacaaacaataaatgtttcttatttccaacacagaattgggttaggtgataaaagcttatttgtaatgatgttatttaaaactcagaacacagccaggcaccgtggctcacacctgtaatcccagcactttgagaggccaaggcagggtcggagttgaggtcaggagttcaagatcagcctggccaacatggtgaaaccctgtctctactaaaaacacaaaaattagctgggcatggtggcacgtgcctgtagtcccagctactagggaggctgagacgggagatctcttgaacacaggrggcagaggttgcagtgagccgaggcggtgctactgcactccagcctgagcaacagagggagactctgtctcagaaaagaaaaacaaaaactcagaatacatcatcccaaaaaagcaatgtcactagcaacatggtaaacattaaattctcaatctgtgtgttgtgtgaaaaaaaaagaataaaaaataaaaataaatttgcaaactaacccatgaacattggtttaatccacaatgtagctgatctataaaatctacaatactgctctaattctggtacctgggaccacgcctccctaca

SEQ ID NO: 162443 - DNA, 601 bp, Human
cctccgctgcttcatctgtaataccaaataacatcagtatcttcttgtaatgattaaatgagttaatatttaaagcacttagatcagaacctgacacatgtacaaacaataaatgtttcttatttccaacacagaattgggttaggtgataaaagcttatttgtaatgatgttatttaaaactcagaacacagccaggcaccgtggctcacacctgtaatcccagcactttgagaggccaaggcagggtcggagttgaggtcaggagttcaagatcagcctggccaacatggtgaaacccygtctctactaaaaacacaaaaattagctgggcatggtggcacgtgcctgtagtcccagctactagggaggctgagacgggagatctcttgaacacaggaggcagaggttgcagtgagccgaggcggtgctactgcactccagcctgagcaacagagggagactctgtctcagaaaagaaaaacaaaaactcagaatacatcatcccaaaaaagcaatgtcactagcaacatggtaaacattaaattctcaatctgtgtgttgtgtgaaaaaaaaagaataaaaaataaaaataaatttgc

SEQ ID NO: 162444 - DNA, 601 bp, Human
gggcggatcacgaagtcgggagatcgagaccatcctggctaacatggtgaaaccccgtctctactaaaaatacaaaaaattagccaggcatggtggtggacgcctgtagtcccagctactcgggaggctgaggcaggaggatggcatgaacccaggaggtggagcttgctgtgagccaagatcacgccactgcactccagcctgggcgacagagcgagactccgtctcaaaacaacaacaacaacaacaaaaactggttgagaaactatcacctcatttgagtgtttatccacccacctgwgagttctgcaaggcagagttgctcccctaactccaccatgctcatattctatcatccttttatttcctgactctaaaatatcttaatcagaaaaaagtttgttgggaaaaatgacatggtcttcgcagtttttaaacctcctgcttgcctcttagttactgtcaatcttttttcctccatctatcaccttgcacacaaaatgaagataatgcatctctgtccctcactagtcacatgtaatatttgattaacaacttgaagaggcaatcctttgtgactggagtcaatatgtgtttattt

SEQ ID NO: 162445 - DNA, 601 bp, Human
ttagaggatatatgtgtagggacataaggctatttttccagtatgattcctcagtaatgctgtcttattatttgataacttcctccaggaggtgataaggccttgcaactgaatctctgcaattctctgttttagcacagctattaaaaactggttgaggccgggcgcgatggctcatgcctgtaatcccagcactttgggaggccaaggcgggcggatcacgaagtcgggagatcgagaccatcctggctaacatggtgaaaccccgtctctactaaaaatacaaaaaattagccaggcrtggtggtggacgcctgtagtcccagctactcgggaggctgaggcaggaggatggcatgaacccaggaggtggagcttgctgtgagccaagatcacgccactgcactccagcctgggcgacagagcgagactccgtctcaaaacaacaacaacaacaacaaaaactggttgagaaactatcacctcatttgagtgtttatccacccacctgtgagttctgcaaggcagagttgctcccctaactccaccatgctcatattctatcatccttttatttcctgactctaaaatatcttaatca

SEQ ID NO: 162446 - DNA, 601 bp, Human
tccaaaaccacccacacctccactggtccatggaaagattgtcttccatgaaaccagttcccagtgccaaaaaggttggggaccactgatttagaggatatatgtgtagggacataaggctatttttccagtatgattcctcagtaatgctgtcttattatttgataacttcctccaggaggtgataaggccttgcaactgaatctctgcaattctctgttttagcacagctattaaaaactggttgaggccgggcgcgatggctcatgcctgtaatcccagcactttgggaggccaaggygggcggatcacgaagtcgggagatcgagaccatcctggctaacatggtgaaaccccgtctctactaaaaatacaaaaaattagccaggcatggtggtggacgcctgtagtcccagctactcgggaggctgaggcaggaggatggcatgaacccaggaggtggagcttgctgtgagccaagatcacgccactgcactccagcctgggcgacagagcgagactccgtctcaaaacaacaacaacaacaacaaaaactggttgagaaactatcacctcatttgagtgtttatccacccacctg

SEQ ID NO: 162447 - DNA, 601 bp, Human
tcggcctcccaaagtgctgggattacaggcatgagccaccgcacccagcccatcaaatcttaagtatacatttgttttgttatccaaagacctgtggtacaggtgtaatttttaaataactcacaaagcattgcttcaaaactgtatagctgtttttcacataatcttgagaaatcagacttcttgtcgaagtcatcctttatacatttgagatggtctttgcaacaggattaatcaagtgacaaattcaccttgcttttcaataaagccatgaaagtcgtgataacattgtatttccttmaactgttgacttcattgccaccacttgtgaggaatctaaccaaaatgttcttagatatcaaaacaacaaagcaaagttattttattatctcagggagtcctgcaattgaattcagtaaagtatttcttaaatttattagaactttaaagtcctccacgattactgttcttgaagaatgtttttgtttttctgtattctcatagcatgttaacaactacatcagttactctgattacaatttaccttactcttttattctttcttggctagtaacagcttctatatgagagcttggtaaag

SEQ ID NO: 162448 - DNA, 601 bp, Human
tggcatgaatcacaagtaggaatttattgtaatgcataatgaacacagaactagagagtttccagtgttaattcggttgccaaacggtagaaacaaagagcctagattcatatcatccttctgttctgccatcctccacatgtcagctttctccacaatctgactcccttcatgaccccagaagttaaaacattccaggcatcacatctcaacacaccgaagttccaaggaagaaaggactcttcctctgtgtgcctccctcaggagagaggaaatctttcccacaagtccctggaagactttccctcgtgtctcattggtcaaaactgtatcacatgccaatgcctaaaccaaactctggcaagaggaatggtacaccaccatcactggcttaaaccaatcagtcttcctgggctggtggctggcacctgcctctcttaagtagcatgtcctctagaagcagagtagatagctaaagaaaattgagattctataaataaaggcatgaatattgtctaggcaaccaacaacatctgctataggaagtagatatagtgtggttccctctgaggaggtaggaaggagaatggaatcagcaagg

SEQ ID NO: 162449 - DNA, 601 bp, Human
tccagcctgggcaatagagttagactgtctcaaaaaaaatcaattttcattttttaaaggaccatatatatattttggcaatacatactgatttactgtaaaaaatttataaaaagatataagtaggggattctggaagacagagacagaattaaatcttttttcgtttaagtttttggagggttttttgttttgagacagagtctctatcacccaggctggagtgcagtggcacgatctcagttcccaggcgacttcccaggcatcgatcctcctacctcagctttccaagtagctgggwccacaggcgcacaccaccacacctggctaattattgtatttttttgtagagacagggttttaccatgttgcccaggctggtttcgaactcctgagctcaagctacccacccgccttggcctccaaagtgctgggactacaggtgtgagctgctgcacccagcctagttttaagaatttaaaacttgattattggtatgaaagccgtttaaattcctctaagtgaaaagtaaaacttgaaaacttttagaagaacatacaacagtcttatctttttgacattggaataagaaaggatttct

SEQ ID NO: 162450 - DNA, 601 bp, Human
ccttcatttcaaggatagaaatatgtaaaattttaccaaccatggataagtttgttatgggagtagtggaaggacagtggaaaaaaaaataggttttttcatgatacttttatttttccttttttaaaaataaatttagggggtacaagtacagtttagatacatgaatatattgtgtagtcgtaaagtctgggcttctagtgtaaccatcacgcaaatatacttgtatttttctaattacagttctaccaaacatttgccaccacaaaatacaagtatttttattctttatttaaattakggtgagtgatatttcttcctatatagccattaagatctctggaagttttgatctactttattcaaaccactttaataaataagacttttcacctaaatgaaatacctttgaattttataaacaacttccatgaaacatatattaaaaccacctttaatttggtatgaagacactttggcaatgcagcggaataaatgatcttggcaagacccagcaagtacagtaaatgctcatgagctctatgaaaaatataggctacagaatacttcatttttcttttattgaactacagtacaaatg

SEQ ID NO: 162451 - DNA, 601 bp, Human
tgaactacagagaataaagaagccatgtcccagttattcaggaggctgaggagggaggatcacttgaacctgggaggtcgaggctgcagtaagccatgatagcaccactgcactcagcctgggggacaaagcaagaccctgtctcaaaaaaacaaacaaacaaaaaaggcaccaatgaagaacttcctaagcttcattaactgaagggaggaaggcagtcctgtcttacccagacagggacaacttgagtcttttaagaaaaagataaactgaagcaaataaagaagagaatgactaacaygctcaccaaaaaagtatggcaaaagagaaatagctaaggagctggggatgttcagtctggaggagaaacaaccgaataagctgtgattatgtgaaggctatgcctgcaaacaagataagcattctatctattctctaaggtgctggggagcataagaacaaaataaagcaggagacaatatttcttaatataagaacttcttaacagaattgttcagtggtggagtggattgcctcgtaaaacaagaatactcaagtatcaactggataatctggccaagatattcattctgttaaacga

SEQ ID NO: 162452 - DNA, 601 bp, Human
tgttttacactctctgtcatttctcccaccaacagtatcctctctcagccctctcccgagcagtctcattcactgcttttttccttctgacctatacaagctgacagtgcctccgcttcatcttacatcctgacacagggtttggtaactcatttcaggtctttatttcctcaaaaacagactgaaaaaactcctccagggcagactccctatccttaagatctcacccagtccactgtaaggtacctatttcaaagtttcaaacacagcaaaaacttggcaaacaccagttactgcaccraagcccagtcatcagaagatttcaacttctaccaatttggggtgacatccgcctaactaatcttgcctccaaaaagccaattccaaaagcacatgttgcaagggagttgggagtgacacagtaagtaacagaagcctagggaaagtacttgagggattcggtggaactgaatctcgcatgaactacagagaataaagaagccatgtcccagttattcaggaggctgaggagggaggatcacttgaacctgggaggtcgaggctgcagtaagccatgatagcaccactgcactcagcctgg

SEQ ID NO: 162453 - DNA, 601 bp, Human
gcaccaccacgcccggctaattttgttcatttttttgtagagatgaggtctcactatgttgcccaggctagtctcaaactcctggactcaagcaatccttctgcctcggcctcccaaagtgatgggattacagggataagctatcatacctagccttttcttttttttttttttaagcaggtcaatttgaagaaaaatattaggtagttattagcacaggagatacgtaacatggtaaaaaccatgaaggacgtgtgcaaatgactaaagtttgggaaacactgttttacactctctgtcrtttctcccaccaacagtatcctctctcagccctctcccgagcagtctcattcactgcttttttccttctgacctatacaagctgacagtgcctccgcttcatcttacatcctgacacagggtttggtaactcatttcaggtctttatttcctcaaaaacagactgaaaaaactcctccagggcagactccctatccttaagatctcacccagtccactgtaaggtacctatttcaaagtttcaaacacagcaaaaacttggcaaacaccagttactgcaccgaagcccagtcatcagaag

SEQ ID NO: 162454 - DNA, 601 bp, Human
tttttttttttgagacagggtcttgctctgtcgcttaggctggagtgcagttggcatgatctcagctcactgcagccttgaccaccgagggtcagcaatcctcccacctcagcttccccagtagctgggactacaggcatgcaccaccacgcccggctaattttgttcatttttttgtagagatgaggtctcactatgttgcccaggctagtctcaaactcctggactcaagcaatccttctgcctcggcctcccaaagtgatgggattacagggataagctatcatacctagccttttcttttttttttttttaagcaggtcaatttgaagaaaaatattaggtagttattagcacaggagatacgtaacatggtaaaaaccatgaaggacgtgtgcaaatgactaaagtttgggaaacactgttttacactctctgtcatttctcccaccaacagtatcctctctcagccctctcccgagcagtctcattcactgcttttttccttctgacctatacaagctgacagtgcctccgcttcatcttacatcctgacacagggtttggtaactcatttcaggtctttatttcctcaaaaaca

SEQ ID NO: 162455 - DNA, 601 bp, Human
gcagaagctcctatattctctacctctgcctctcatgctacattcaaaaagccatctatctactctcctttggagaggccaggcagtcttggacattccaaaagcagcctattggcacagtgcagtggtttgcaatcttggccgattttgcccctcagagcaatgtctggagacatttcttcgccgtcacataacagggaagtggccactggcattaatgggcagaggcccggggtgctgttaaacaccctacagtacacaggacagcctcactataaaattatccagtctgaaacgtcamgaatgcacctgttgagaaactcttgtaaagctgacagaacacgggctttgaaatcgagaccacctggagttaaaactaggcaaatcccttcacccttctgaacccacttccccatctataacagggatccggtttttcccgggtatagaggatgtgctgaaaatttcttcccttgtagacatgattgccagtgacctgggagccttccgatgccagagggcaaagaagccactggggcacagacagggaagccaggccagcactcactcacctgagagggtgacagtgacagtagtcatg

SEQ ID NO: 162456 - DNA, 601 bp, Human
agccgaccttggagcagcaacagagggaggcgcggcaggcctccacgccttctgatggcacagccgcagggcctgctgatgcttcgacaggggcattagaaaagctccaaggagtctggctgagcaaccggaaggacggacatgccaatttctgagactggacagagaagtgtgtccattagaccctcagtagcaggtggaaatgactttgtaaagatctgaatataagagccctgttttttgaggggtaatcttcagcagaaaactaaaagcgccttacctgactgactttcaggcataygcagaagctcctatattctctacctctgcctctcatgctacattcaaaaagccatctatctactctcctttggagaggccaggcagtcttggacattccaaaagcagcctattggcacagtgcagtggtttgcaatcttggccgattttgcccctcagagcaatgtctggagacatttcttcgccgtcacataacagggaagtggccactggcattaatgggcagaggcccggggtgctgttaaacaccctacagtacacaggacagcctcactataaaattatccagtctgaaacgtca

SEQ ID NO: 162457 - DNA, 601 bp, Human
tgtggcttagctggagagaaaggagtgagcagcaggaggtaaggccgggtgaagtgagggcccaggctgcgcagggctctgcaccccacacgagggacctgccgtggggagccgctggacgattctgagcaggggcctggcaggatctcattcctatttttgaaggacgatcctggcagcggggtagagactagggtacgagggtgaaagtggccatggtgatgggttagaaggccactgtgaaaatctaggcagtgaagagtgctgagccgaccttggagcagcaacagagggaggcgcrgcaggcctccacgccttctgatggcacagccgcagggcctgctgatgcttcgacaggggcattagaaaagctccaaggagtctggctgagcaaccggaaggacggacatgccaatttctgagactggacagagaagtgtgtccattagaccctcagtagcaggtggaaatgactttgtaaagatctgaatataagagccctgttttttgaggggtaatcttcagcagaaaactaaaagcgccttacctgactgactttcaggcatacgcagaagctcctatattctctacctctgcctct

SEQ ID NO: 162458 - DNA, 601 bp, Human
gtggcatctgaaaagatgtaagcgtgagccaggcagtctgtggggtcagaggattcccagcacagtgaacaccaggtgcaaagtccccgaggggggtgggcacggtcaccagcaaggggcccagtgtggcttagctggagagaaaggagtgagcagcaggaggtaaggccgggtgaagtgagggcccaggctgcgcagggctctgcaccccacacgagggacctgccgtggggagccgctggacgattctgagcaggggcctggcaggatctcattcctatttttgaaggacgatcctggmagcggggtagagactagggtacgagggtgaaagtggccatggtgatgggttagaaggccactgtgaaaatctaggcagtgaagagtgctgagccgaccttggagcagcaacagagggaggcgcggcaggcctccacgccttctgatggcacagccgcagggcctgctgatgcttcgacaggggcattagaaaagctccaaggagtctggctgagcaaccggaaggacggacatgccaatttctgagactggacagagaagtgtgtccattagaccctcagtagcaggtggaaatgacttt

SEQ ID NO: 162459 - DNA, 601 bp, Human
attaattggatcatgtgactactgccataagcatctaaaactagcactgggtggggctatttgaggctccagagtctccccaaagtgtactctgatattcaacctaaggtaatgaagacagtgctcagtaatccatttattcattaaatgagtaattcttgtgagccgagaagaaaaacaaagtggacaatgtgggaggggagctcttgtgccaaggttgtttaaggaagacctgcaagtggcatctgaaaagatgtaagcgtgagccaggcagtctgtggggtcagaggattcccagcayagtgaacaccaggtgcaaagtccccgaggggggtgggcacggtcaccagcaaggggcccagtgtggcttagctggagagaaaggagtgagcagcaggaggtaaggccgggtgaagtgagggcccaggctgcgcagggctctgcaccccacacgagggacctgccgtggggagccgctggacgattctgagcaggggcctggcaggatctcattcctatttttgaaggacgatcctggcagcggggtagagactagggtacgagggtgaaagtggccatggtgatgggttagaaggccact

SEQ ID NO: 162460 - DNA, 601 bp, Human
ctccctggtctggcattaatccatttttccctattaatcctacagattctatccatgacatccacaacagagctacccagtacactgctttttaaaaagtgatcaccaaaagggctcattaatttccaacatctgtaactgtgagatcctatccttttctggtcaattaattggatcatgtgactactgccataagcatctaaaactagcactgggtggggctatttgaggctccagagtctccccaaagtgtactctgatattcaacctaaggtaatgaagacagtgctcagtaatccayttattcattaaatgagtaattcttgtgagccgagaagaaaaacaaagtggacaatgtgggaggggagctcttgtgccaaggttgtttaaggaagacctgcaagtggcatctgaaaagatgtaagcgtgagccaggcagtctgtggggtcagaggattcccagcacagtgaacaccaggtgcaaagtccccgaggggggtgggcacggtcaccagcaaggggcccagtgtggcttagctggagagaaaggagtgagcagcaggaggtaaggccgggtgaagtgagggcccaggctgcgcag

SEQ ID NO: 162461 - DNA, 601 bp, Human
tccttggcttccttgtgactccctctctgtcagccccagtgccctgcagcttcatccagctgggctcagccccagatggacccctggacagcagtgtggtattctgcctccaggagtcagattctgaactgagaaaacggttccctcactgactccccagctaaggcccacccagtgaatgctaatttggcagcttctgtttgtaatgctctccaactccctggagaagtggaaagcaccagaacctcccaggtcggactcaccaatgtcggagctggcagctaccagcacactgcctccrccgtcaataaaggcactgatggtctccacgttgatgttgcctccaaaatctgaaagcaggcaccagacacagtgacccagaggtctcctctccctgctcctctgacactggcagggaggggacatgaagggcagagcagccacgatcactcacagagcagcaccctctgggggccacaatgagggagaggcttcccacaccacatcccagaacgggcaaggccccatcctcgcagcgtgaagactcaaaattatggctcagaattagaaacttctggaggtttggaggaaacagtcaaac

SEQ ID NO: 162462 - DNA, 601 bp, Human
gcttttggctaagcagagctttgccatatgcccctgaaacctggaaggtgacaggcctgattacctggccaaggtctgagatgtcatagttgtgatggtcaatgacagccgttttctcctcgtcaaactcaatcccgcactcactgcccagctctcgaagagggtcacctgcacagaccgaagagacacctagctgagcccttacaggggggccttgggccaagtgtccttggcttccttgtgactccctctctgtcagccccagtgccctgcagcttcatccagctgggctcagccccaratggacccctggacagcagtgtggtattctgcctccaggagtcagattctgaactgagaaaacggttccctcactgactccccagctaaggcccacccagtgaatgctaatttggcagcttctgtttgtaatgctctccaactccctggagaagtggaaagcaccagaacctcccaggtcggactcaccaatgtcggagctggcagctaccagcacactgcctccgccgtcaataaaggcactgatggtctccacgttgatgttgcctccaaaatctgaaagcaggcaccagacacagtg

SEQ ID NO: 162463 - DNA, 601 bp, Human
ttttgccttgatttcccaaaaaaattaagtgaccccttcttcccccaggtttctgctgtcctctccctgctcactcactcacccaacacctcgaaagaggatgggatttagagatgatttcccaacgatggttggggccttcagcaggttctcagtgtcagccacgatgagcgtatgctgcaaagagtagatggaaaggtgggtggtcaggaaaaggttccccaagccagggagaacctcctcacaccctcttggcttttggctaagcagagctttgccatatgcccctgaaacctggaargtgacaggcctgattacctggccaaggtctgagatgtcatagttgtgatggtcaatgacagccgttttctcctcgtcaaactcaatcccgcactcactgcccagctctcgaagagggtcacctgcacagaccgaagagacacctagctgagcccttacaggggggccttgggccaagtgtccttggcttccttgtgactccctctctgtcagccccagtgccctgcagcttcatccagctgggctcagccccagatggacccctggacagcagtgtggtattctgcctccaggagtcaga

SEQ ID NO: 162464 - DNA, 601 bp, Human
gacctcgctctgccacctgggctggagtgcagtggcacaaccttggctcactgcaacctccgcctcctgggttcaagcaattctcttgcatcagcctcccaagtagctgggactacaggcacacaccaccatacctgtctaatttttgtatttttagcagagacggggtttcaccatgttggccaggctggtctcaaacgcctgacctcgggtgatctgcccacctcagcctcccaaagtgctgggattacaggtgtgagccactgcgctcggccaacttttttttttttttttttttttktttttttttaaagagaggagttctgtgttgcccaggctgctctcaaactcctggcctcaagcgatcctcctgcctaggccttcccaaagcgctgggattacaggttgagccactatactcggccttaatataacaaattaatcccatctacgtacccttaaagaattacaattttgccttgatttcccaaaaaaattaagtgaccccttcttcccccaggtttctgctgtcctctccctgctcactcactcacccaacacctcgaaagaggatgggatttagagatgatttcccaacgat

SEQ ID NO: 162465 - DNA, 601 bp, Human
ttcagacagacctcgctctgccacctgggctggagtgcagtggcacaaccttggctcactgcaacctccgcctcctgggttcaagcaattctcttgcatcagcctcccaagtagctgggactacaggcacacaccaccatacctgtctaatttttgtatttttagcagagacggggtttcaccatgttggccaggctggtctcaaacgcctgacctcgggtgatctgcccacctcagcctcccaaagtgctgggattacaggtgtgagccactgcgctcggccaacttttttttttttttktttttttttttttttttaaagagaggagttctgtgttgcccaggctgctctcaaactcctggcctcaagcgatcctcctgcctaggccttcccaaagcgctgggattacaggttgagccactatactcggccttaatataacaaattaatcccatctacgtacccttaaagaattacaattttgccttgatttcccaaaaaaattaagtgaccccttcttcccccaggtttctgctgtcctctccctgctcactcactcacccaacacctcgaaagaggatgggatttagagatgatttc

SEQ ID NO: 162466 - DNA, 601 bp, Human
agcagcccagcactggccccaggaactgagcccaaggacatgggatccccgagagccagttcttcccaggaatgaatccttttttcttaattgccaaccacttagctcttgtcttgatataacaatggagtctgacttgtttttgtttttgtttttcagacagacctcgctctgccacctgggctggagtgcagtggcacaaccttggctcactgcaacctccgcctcctgggttcaagcaattctcttgcatcagcctcccaagtagctgggactacaggcacacaccaccatacctgtytaatttttgtatttttagcagagacggggtttcaccatgttggccaggctggtctcaaacgcctgacctcgggtgatctgcccacctcagcctcccaaagtgctgggattacaggtgtgagccactgcgctcggccaacttttttttttttttttttttttttttttttttaaagagaggagttctgtgttgcccaggctgctctcaaactcctggcctcaagcgatcctcctgcctaggccttcccaaagcgctgggattacaggttgagccactatactcggccttaatataacaaat

SEQ ID NO: 162467 - DNA, 601 bp, Human
taagaggtggaagagcccgtcaggatgtccagcaccaaagggttatcaggatcggccaccatcctgcagcaggacgagagcagcccagcactggccccaggaactgagcccaaggacatgggatccccgagagccagttcttcccaggaatgaatccttttttcttaattgccaaccacttagctcttgtcttgatataacaatggagtctgacttgtttttgtttttgtttttcagacagacctcgctctgccacctgggctggagtgcagtggcacaaccttggctcactgcaacctcygcctcctgggttcaagcaattctcttgcatcagcctcccaagtagctgggactacaggcacacaccaccatacctgtctaatttttgtatttttagcagagacggggtttcaccatgttggccaggctggtctcaaacgcctgacctcgggtgatctgcccacctcagcctcccaaagtgctgggattacaggtgtgagccactgcgctcggccaacttttttttttttttttttttttttttttttttaaagagaggagttctgtgttgcccaggctgctctcaaactcctggcctcaa

SEQ ID NO: 162468 - DNA, 601 bp, Human
tggggctgtctcgcccacccgatgatgggacacaggccccacacggaggacaccctcctccttgaacacccagcgggagagggccacagctagttcatagttgcctgtctgggaatacctgcaggagggaaacaggagcagcttgggcaccagagccacctttccagtggtgcctgatgggcaggaccactcatgtccaccatgacagtaccctagcgaagttctgcctgtaggccttgggcacctagggactcatggttaaagggaacgcaggaaacaaacgaaaagatatggctggttkcttgtcatctgcacaacaaatacacaaatttctaaaaggaacggtggaggttagggatctctagataagtcactactaccttaaaaaattggaagtgccaataccagcaatatagcaataaagccctgaaataatctgacagcacctgaaacactcagcctctgacacttttagctaaaagcctccttcttccccttctgagtcctccccatatacacacactgcaccacccggatccccggcccctaagcctcctggcagctacctctgggagccgggcgccgccttctgcactgctga

SEQ ID NO: 162469 - DNA, 601 bp, Human
tcctccccattggttgttttgttgctgctcccttgcaaaggaaagaaatgacacttttgtgctgacatctggatcaaatatttttctagtaaaatgtgtttgcaaaagcaaaatttatgcccccttaaatataatataaatttaatgcctgtacgaagggaacccgtttgtcgttgaggaatatctacacccagtattagagctcaggttaatcctgttagtcactgtttgcttgtatagaacagagtgaagtacacagagtgaagtatttaacttcactgacaactcaccagtgaatttytgatttactttctgccagaatttattatagacaagtaattttattgaaagactcgatgccacaaatcataagaaagctctccagagatgtgtaatgcctccaaatcctgtccatctatcagttttcctgaatatcctagtaaaaatgctaactttattccaaaaatatgaacgaggcagtgtttttttttccagctgttctaaagagaaaggtaggggtgtgtgtgtgtgtgtgtgtgtgtgtgtgtgtgtgtgtatgtgacagagaaggaagggagaaaggggtagggagataaatata

SEQ ID NO: 162470 - DNA, 601 bp, Human
taatgcctccaaatcctgtccatctatcagttttcctgaatatcctagtaaaaatgctaactttattccaaaaatatgaacgaggcagtgtttttttttccagctgttctaaagagaaaggtaggggtgtgtgtgtgtgtgtgtgtgtgtgtgtgtgtgtgtgtatgtgacagagaaggaagggagaaaggggtagggagataaatatatttgttttgagaaggcccaatttaggaaaaacagattcttggaggaattaaagaataacatatttgctgaacgtgaaagtgataatataggyttaattcattctttcacatggttagttcatggctcactcaaaagacgccaggcactgtattagacaccaaccataaggtcacaaaatacagtaggaaaaaggaaaaaagccctgcctcttgggcttagaattcaattgaactattaaccaggaaagaaatcagccaaaaagattatgtcttaacaagaaaaacaaaaaggaaagtataatttgatcattacaactgttttctgaggtaggtgtcatctctattttacagaaaacagtcctgcatttgaacccagatctgcctgattgatt

SEQ ID NO: 162471 - DNA, 601 bp, Human
gaaggcccaatttaggaaaaacagattcttggaggaattaaagaataacatatttgctgaacgtgaaagtgataatataggtttaattcattctttcacatggttagttcatggctcactcaaaagacgccaggcactgtattagacaccaaccataaggtcacaaaatacagtaggaaaaaggaaaaaagccctgcctcttgggcttagaattcaattgaactattaaccaggaaagaaatcagccaaaaagattatgtcttaacaagaaaaacaaaaaggaaagtataatttgatcatyacaactgttttctgaggtaggtgtcatctctattttacagaaaacagtcctgcatttgaacccagatctgcctgattgattggactgtaaaaggttaacgactctcacctagttcatttcaaatgtggagcttagactaggttatctctaaaggtccttcaggctcacacctgtaatcccagcactttgggaggccgaggccagtggatcacctgaggtcaggagaccagcctggccaacatggcgaaactctgtctctactaaaaatacaaaaaatagccgggcgtggtggtgtacgcc

SEQ ID NO: 162472 - DNA, 601 bp, Human
ctgcctcttgggcttagaattcaattgaactattaaccaggaaagaaatcagccaaaaagattatgtcttaacaagaaaaacaaaaaggaaagtataatttgatcattacaactgttttctgaggtaggtgtcatctctattttacagaaaacagtcctgcatttgaacccagatctgcctgattgattggactgtaaaaggttaacgactctcacctagttcatttcaaatgtggagcttagactaggttatctctaaaggtccttcaggctcacacctgtaatcccagcactttgggargccgaggccagtggatcacctgaggtcaggagaccagcctggccaacatggcgaaactctgtctctactaaaaatacaaaaaatagccgggcgtggtggtgtacgcctgtaatcccagctgctggggaggctgaggcaggagaaatgcttgaacctgggaggtggaggttgcagtgagcagagtttgtgccattgcactgcagcctggatgacagggtgagactccgtctcaaaaatagcaacaacaaaataaaggtcctttcagattataacttttcctgactctgaatattagttgag

SEQ ID NO: 162473 - DNA, 601 bp, Human
gagtctttgggaccacgagacaagtatatgtgaaaaagccaacagtgcaaagtggtatatgactgtgtgtctaagttgagtggtatgggtattttttggctgttctgaggaacaagttcaatgtagactgaaactatgggaacatttgagagagacagtgggctgcctacattgtgttttccacaggaggatgaatgtgcctaatagcttgggagaaactaggattttctttgcctggtgtagcactggtgttttctttacccacgaataaagtagatggagatagtcctggaagacagtrgacagggcggctgtcagaatagaggaaaccagcatggagtgtaatgagttaaataaggcttatttaactgtcaggttaaataaggcttgtattttacctgtcaggttggtggcccagaagattttgacattcccagattattgatcttttggctttgctgtccagtttagatggtttttgctaaagtagctttgaccatcaaagatatagacatgtatacgtgcatttcctatgcttgttttttttatgtagaatgtttatttttctggataaaggaaacattgttggccacccagtagg

SEQ ID NO: 162474 - DNA, 601 bp, Human
gagtttgagcatcatgattctgtttggaaatatttggcccatgggactttgacagttgtctcactgtttacagcatttatagggtagtccgaacactgattaagatgatccataagggcttttaagtgacaaaaaaattgttttagttttttttaattaatttttttttgagatggagtcttgctctgtcacccagactggagtgcagtggcactatctcggctcactgcaacctctgcctcccagatacaagcagttcttctgcctcagcctccccagtagctgggattataggcatccmcctccacacccagctaatttttgtattttcagtagagatgggatttcgccaggctggtctcaaactcctgacctcaggtgatccacccacctcagcctcccaaagtcctgggattacaggcatgagccaccacgcctggccttaaattgttttagttttagctttaaagccatctcatatatggcccccaatgtattccatttacagctccgttttatgtttactgtttcatagtcaactcaagcaggattgttttttgtacacgctagtgtgttagtctgatgtgtaagcttttcttga

SEQ ID NO: 162475 - DNA, 601 bp, Human
ataaatttttgggggacataaatcttccttgtggggaaatctttactatttatcttaaatagtttagtgactgcttaagcagtattctttggggactcttggtttttaactgaaggcagacctgcatgcagggcctttggctgctgtgctcctgggctgggtgctgtgtcttgagcccctgtgcaatgcctggctcagagtaggagctcaacagatgcctgttgactgaataataaacaggtatcgcaggagcttttgttatgtgccatgtgtggaatgcaaggaaggaaaggcccactcyctgcccttaaggagtttctaatctgtttgtgaagacaagctgtcagtcattttataggagctatgatatatgattagttgccaaatgaaagtttagagtgagaacaggggatgcaggggtacgagatgccagggaagactccgcaaatgaattttacactttgcttttagaagagctggtgtactgctggcagcaacagcaaaatcttaagggagggctggttttaaaggaagaacaaagatttgtgttgagtttagatgtcctcatgaaaaaaactgcttcccagcaccccagtttcat

SEQ ID NO: 162476 - DNA, 601 bp, Human
gagaactgttaaggagttttctcttttcagatgatcttaagatacttatagcttggcagagtccttgtgtcatttggttgggaaaaaacaagggtctagagcagtcagtggtccttaaacttcagtgtgcataacaatcactgggtaacttctaaagtgaagattcttgggccctaccctccttctaatgtttttattaagtctgggtagaggtccagaaaactgcagtttctaacttgaacccctgctgattctgaagtagatggtccttaggttattcttggagaaatcctgagttggkcatagagggaaaaagagacaagaaataaaattcaatagaagtaaatacttataaagaaagcaagaaccaaaactgagagagtaactttaacctctcttctgtgagatgaagggagtgagtatgctgtgctgcttaaaaagataagcgtttagttttttctggcagtgaatgagatcaaactgtcctccaaagacgacatattgagaggattacagaagtgaaaaggaatttttagaaaggttagaatatgagaaagtacctaactgtcgccgagaaactcaaaagacatgattaaatcaa

SEQ ID NO: 162477 - DNA, 601 bp, Human
ccctgagtccaaggccagctggtttcagcatgcagagataagactagaacacagcttcctgatgcccagaccagagctgttctcattaccatttctatatccacctccatctttagtgggttgctgtgatttccagcattcaaacccttgcacatttccagagccttttagctgtctcgtggagcagttcatcccaattgctgcctttttaatttttattttcaattgtgtttaaaacaaaacaacaacaacaacaacaacacataacataaacttgaccatcttaatcatttttaagtgyacggcacagtaggttaagtattcagattgttgtgccagcccaatctctcctgcttcaccgttcaatctcagtaacattggaaacaacagaagggtctttatgcaaatacctgtcaggaaggcgtgcgcctcacctgtgtttgctccttcacagtagtaggaagttaattatgtgggatttgctcacctgatccacacagctgatcctactgtagtgcacatttggaaatcccacacccctttcttcccctgaggaaaaaattctttcctcatcctagattcagtgctctgtttaatcttg

SEQ ID NO: 162478 - DNA, 601 bp, Human
agctgttctcattaccatttctatatccacctccatctttagtgggttgctgtgatttccagcattcaaacccttgcacatttccagagccttttagctgtctcgtggagcagttcatcccaattgctgcctttttaatttttattttcaattgtgtttaaaacaaaacaacaacaacaacaacaacacataacataaacttgaccatcttaatcatttttaagtgtacggcacagtaggttaagtattcagattgttgtgccagcccaatctctcctgcttcaccgttcaatctcagtarcattggaaacaacagaagggtctttatgcaaatacctgtcaggaaggcgtgcgcctcacctgtgtttgctccttcacagtagtaggaagttaattatgtgggatttgctcacctgatccacacagctgatcctactgtagtgcacatttggaaatcccacacccctttcttcccctgaggaaaaaattctttcctcatcctagattcagtgctctgtttaatcttgagcatatgagaatgagtcaccatgggtaagagtgtaatctcatttatacctttcttccaaccctcctttaattt

SEQ ID NO: 162479 - DNA, 601 bp, Human
ttagtgggttgctgtgatttccagcattcaaacccttgcacatttccagagccttttagctgtctcgtggagcagttcatcccaattgctgcctttttaatttttattttcaattgtgtttaaaacaaaacaacaacaacaacaacaacacataacataaacttgaccatcttaatcatttttaagtgtacggcacagtaggttaagtattcagattgttgtgccagcccaatctctcctgcttcaccgttcaatctcagtaacattggaaacaacagaagggtctttatgcaaatacctktcaggaaggcgtgcgcctcacctgtgtttgctccttcacagtagtaggaagttaattatgtgggatttgctcacctgatccacacagctgatcctactgtagtgcacatttggaaatcccacacccctttcttcccctgaggaaaaaattctttcctcatcctagattcagtgctctgtttaatcttgagcatatgagaatgagtcaccatgggtaagagtgtaatctcatttatacctttcttccaaccctcctttaattttttaagtttatgatactggatcctgctttcctacataa

SEQ ID NO: 162480 - DNA, 601 bp, Human
caccgttcaatctcagtaacattggaaacaacagaagggtctttatgcaaatacctgtcaggaaggcgtgcgcctcacctgtgtttgctccttcacagtagtaggaagttaattatgtgggatttgctcacctgatccacacagctgatcctactgtagtgcacatttggaaatcccacacccctttcttcccctgaggaaaaaattctttcctcatcctagattcagtgctctgtttaatcttgagcatatgagaatgagtcaccatgggtaagagtgtaatctcatttatacctttctkccaaccctcctttaattttttaagtttatgatactggatcctgctttcctacataagggctggtgatttggagactaattttgggagtgcgaggtgttgagattttttttgggaaccagtgctttctgttctgctgaacatgaagctgcatggcctaagttctgaaattcaggctatgtatggaatgtctgtgtggatgaagaaacaagccaatgcctttttttgggtcggggccggggggagactgggagaaagatgaatgaaaatgttaagatagtctgattttgtgggggaaatatt

SEQ ID NO: 162481 - DNA, 601 bp, Human
aagcagttagttgctttgtgattttattttacccacaaaagaaatacttgatattgtgctgaagatgttgttgaataggtatattaactcagataaaataactgagttctacttttgattccagttatccctatctatgcaatgtgtaaatgctatttccatttcttcatttgtggaatgaaaaacatttcactggaaaattgtttttaaaaaagtacttgtaaagtacattggaatctttaggatactttgaacatggtgcttaaagaatgtaaatggttaatgcttgctttcatacccaatagaggaatatgggagtgggagtcacttgaatatcaaaatgaaactctgtatccatttttaaatacagtatgcatttgagcaaagcccttctccctaactgcttattttaaattggcagttgctcagccaacagtcagtaatctcagttagcaagtgtttggcacgcctgttttaacctgcacaggttcagttcacacaaagaaagggagggttgggttatgtgatgcaaacaccacgttagcctcattaacatattttgaataactgtatttgaatatttgccagctaagctaggcca

SEQ ID NO: 162482 - DNA, 601 bp, Human
ttgccagtggcaaagggtgtttgttaacccctaaagtgatggtgatggtttctccctattgtgttatactgtgcatttgctccaatttcagggttccttggttcaaaggaacgctggggaaccctaactttgaagatctcaatttgacagcaacctgcctttttccatgagtcactgttagttcaaaatacccaaaaagagattctcatttctgtaggttgggcaagttgcagcctgcttgattttttagtgtctttggtttataatgattttagagagtagaagaggaaatggctgtttrttgtatgttgcataaaactatatggccttgtgcaaatgatctaactttatatgaatcctggattgaagacagatgtttcttttgtataagtagattcaccactctgtgtcctactctgaaataatgagggggagaataatcccatatatatcacatcaattttaaaaaaccggaattcaagaactgggaaatttttcagtttacattctcctgattctgattttgtttcttacgttatttttctattttaaatttgcttttattatttgagataaaaaatactttgtttccattctaagt

SEQ ID NO: 162483 - DNA, 601 bp, Human
atctttaaaggacaaaatggaaaataaaattaggtttggggtaaggaatcctacttggacactacaaaaatagaaggaaaaaaaggtgaatgaataattggcaaaacaaactctttttcctgtaagttcccttttcccaaattcttgccatcatgctaaaaaaagttgtctcgtgggttgatttttctcagaatcctgatgcttgttgttaataagaatttttttcatgtgccaaagttttgtttttcgtgtgacttctgcggcaattttggtcttactgaaaatatttttttaagtaccrtggtaaaagttactggtaataagccaaaaggagaatttaaggtgaacttctatacaatttacttttattgactaggggaaatcaaatgcattgcccaaggtaattgaagtcagattattgtaggagaaatatcaattctaattaaaaacaaagtgtgagtgcttatttccagtttcaaaacttacattttttaatttctacctcatcctttccccaacaagacatatttttgctatcaggctaacataaagtgctgctactgactgagccagcctaatggaatggcatcactgtttctgt

SEQ ID NO: 162484 - DNA, 601 bp, Human
gtttggggtaaggaatcctacttggacactacaaaaatagaaggaaaaaaaggtgaatgaataattggcaaaacaaactctttttcctgtaagttcccttttcccaaattcttgccatcatgctaaaaaaagttgtctcgtgggttgatttttctcagaatcctgatgcttgttgttaataagaatttttttcatgtgccaaagttttgtttttcgtgtgacttctgcggcaattttggtcttactgaaaatatttttttaagtaccatggtaaaagttactggtaataagccaaaaggaraatttaaggtgaacttctatacaatttacttttattgactaggggaaatcaaatgcattgcccaaggtaattgaagtcagattattgtaggagaaatatcaattctaattaaaaacaaagtgtgagtgcttatttccagtttcaaaacttacattttttaatttctacctcatcctttccccaacaagacatatttttgctatcaggctaacataaagtgctgctactgactgagccagcctaatggaatggcatcactgtttctgttggcatagttaagcagggggttaaaaattcaag

SEQ ID NO: 162485 - DNA, 601 bp, Human
tatttccagtttcaaaacttacattttttaatttctacctcatcctttccccaacaagacatatttttgctatcaggctaacataaagtgctgctactgactgagccagcctaatggaatggcatcactgtttctgttggcatagttaagcagggggttaaaaattcaagtttttgggaaggagtttttttttttggagggatttcttttgcaatacgcaaccttcagacattccagaaagtaactgtggatgcattttagggtatagccagtgtcctttgcatctttcagtctgataggyaaaatcatattttagattactattaaaacagcatgctgatttattcatcttgtccttccttttaagaaatatatttcagaaatgctagtaacatcttgctcagcagctcactctgacaccctgacttactcttactggggagatctcactgttttgtttgctctgcagatcttatagtggcctttgaccaaaggcaatgaaatgttacctgacttgcagtatcagtcaggattctcagttacaagcaatagacatctctgactaatttaatcataaaaggagtttattaagaatattagg

SEQ ID NO: 162486 - DNA, 601 bp, Human
cccaacaagacatatttttgctatcaggctaacataaagtgctgctactgactgagccagcctaatggaatggcatcactgtttctgttggcatagttaagcagggggttaaaaattcaagtttttgggaaggagtttttttttttggagggatttcttttgcaatacgcaaccttcagacattccagaaagtaactgtggatgcattttagggtatagccagtgtcctttgcatctttcagtctgataggcaaaatcatattttagattactattaaaacagcatgctgatttattcatsttgtccttccttttaagaaatatatttcagaaatgctagtaacatcttgctcagcagctcactctgacaccctgacttactcttactggggagatctcactgttttgtttgctctgcagatcttatagtggcctttgaccaaaggcaatgaaatgttacctgacttgcagtatcagtcaggattctcagttacaagcaatagacatctctgactaatttaatcataaaaggagtttattaagaatattaggtagccacagtttctctggaaaagctgagaactcaccttggcagcttatc

SEQ ID NO: 162487 - DNA, 601 bp, Human
caccaccgctgcctttgggaactgcatcactgcccctacctctggcccaggtttctgtacggttcttactatttgtaactgcttgagattctaaatctgggatggattatttggtggagccagtgtacctagtaatgtgactgcagtctgattgcaggggtggttgaaaaagcagttacttggagttttcagcttttgaagtgttgtgtgtggttttttttttgttttttgttttttttaagaaacatgatcttgttatgttgctcaggctggtcttgaactcctgggctcaagcaatccycccaccttggcctcccaaggtgctgggattacaggtgtgagccaccacccctggcctgtagtgttaattgttaatgattttccaaacataggaaggaaagttcagatgctgggtaacctaaaagaatcacataagtccaccctacatggcatactggaggtggaggtggaaggatagaaaaataaggacaacagctaccttcctacattacttaagatgctaataatagttatgagaaaaatgttataacagaacccatagtttctcagtattttcgtaatagcagcatccatatgttac

SEQ ID NO: 162488 - DNA, 601 bp, Human
acacagtgcatatggcagtgctgaaattcaaacccgcatgtatctgcttcaacacctctcttcctgctatcataccagcattcctcctcatagaaattttgtgaaaaagcacagataacctccttgatttaaactagaaatttttgagagtcctgcattgtttctcttaataatccactacttatcatttatcatgagttgtgagatcctgctaggttcaggagagtgactgggaccagagctacagactcaggagtcataagaccttaagagctcctgggtgctgtgggcattggtgagrtggtcctgggaagaacttgcagagtaagagaagtagtactataggacctaatgaaacatgagctggaggtgggttagaaagagacagagtggtttttatttggtagaaggaaaacctgaataggaacctgttaggggagcccaagagcatagttgaagaaggaaagtgtggttgggagccaggaaccaaaataggataaggtggaaaataagccattggagtggatggccaagcgggaagttatgctcgcctctgtagtttgaaatcaaatttgcagaatctttaccttctctgtgagta

SEQ ID NO: 162489 - DNA, 601 bp, Human
tgtctgttattttgtatctgcccacattgatgttaatctgtcactttccttcctacgtgcatgggcttgtgaaatctcctgaccatttatgctatttgtttgtctttttgcaaatcaaaagagcctaatgtcaccttaaagcatcatggtaattaaacttaagaaaggatgagtgattacagtttatttaattcctccctctttagagaacttctagagtacacaggcatagacatacaaatttagtttcaagtaagaatgagagtatacctgagtagtttacataaaattatggggaaarctggatatgtgttggagcagacaatgtttgtggggctaggtgtccagagtcaagtctgtctcggatgggccttcagcagaacggctttttcctgacataggtgcagcctcatcctatgcgtgctcatcacaagagcatgtttctcctttgttctgggggatgggaatttccttcctttgattcctttctcttcactcctacagccccagtgtttgcttgttcactccccgcgtcccacatcaatgccagtcaactctggcctgcactagttggcatcgagatctgtgaaaaggagtagaa

SEQ ID NO: 162490 - DNA, 601 bp, Human
ttttcctgacataggtgcagcctcatcctatgcgtgctcatcacaagagcatgtttctcctttgttctgggggatgggaatttccttcctttgattcctttctcttcactcctacagccccagtgtttgcttgttcactccccgcgtcccacatcaatgccagtcaactctggcctgcactagttggcatcgagatctgtgaaaaggagtagaagcaggggagacaaaaattaaagctctccctgcatctacttttttttttttttttttttttttttggagacggagtctcactctgtcrcccaggctggagtgcagtggcgctatctcgggtcactgcaagctccgcctcccgggttcatgccattctcctgcctcagcctcccgagtagctgggactacaggcgcccgccaccacgcctggctaattttttgtatttttagtagagacggggtttcaccgtgttagccaagatggtctcgatctcctgaccttgtgatccgcccgcctctgcctcccaaagtgctgagattacaggcgtgagccatcgcgcccggccctgcatctactttttagttattggttcctcatcctctctac

SEQ ID NO: 162491 - DNA, 601 bp, Human
agatgcaggtagaggaagaaggagggggaaatgatacctaacattactaatattcttttctcttcatcatacccctactctccattcaccctcatccccattctcttttctaatccttcagtatctttcttccctattagactgtaagatccagaaggataaaagccatgtcaatgttggtctctaatgtgccccatcaatgtctagtacaagacttgacatatagaagacaccaagatgtgcttgcttggtgaatgagtgaggcatgaaagggggattgggggagtacactgtttttctytatacccctcttgacaactttaccctgttctgatttttcacctgtgtatcccccaatctctgatcttgaaggggcctgcctcctggccagcagcaagaacatggttcccacaatggatgctgaacacattttcccatagagcatttttctacatggtggttagtgtctgttggaactatactgtatacttaagggagctttcgtggctggccatagtacccataatgtacaacattgtttttatgggaaaatgcattgagttcaaatgaatctacttacatgcagacttttggattaaaa

SEQ ID NO: 162492 - DNA, 601 bp, Human
gtagctgggactacaggtgcccaccaccatgcctggctaattttttgtattttagtagagatggagtttcaccgtgttgcccaggctggtctcaaactcctgacctcagtcagtccatccgcctcagcctcccaaagtgctaggattccaggcgtgagccactgctgctcggccagggtccttaagttcaaatcatggagcagtccacagagcactcttctcaggtgcagagtggaaaggactttgatcgtggactagtatttttagtcacatccacaggcctttgaaagggaaaaaatayattattgataggtcctgttttttgaggaaaaaaaaaaaacaagcattcctaactacctggcaaataatttcttctattctaatgataattaatttatgtggtcaaagatcagagaaagggagccataggcaggacagcagcccagtattggtaccacactcttagggatctcttaatttttgttttcttcataacaattgtcagttttcttacactgtgctgtatttggagtggatgatgctggtggtgattgtctaaaacttagatatttaaacagtttgaaaacttgttggagtagga

SEQ ID NO: 162493 - DNA, 601 bp, Human
gagcagtccacagagcactcttctcaggtgcagagtggaaaggactttgatcgtggactagtatttttagtcacatccacaggcctttgaaagggaaaaaatatattattgataggtcctgttttttgaggaaaaaaaaaaaacaagcattcctaactacctggcaaataatttcttctattctaatgataattaatttatgtggtcaaagatcagagaaagggagccataggcaggacagcagcccagtattggtaccacactcttagggatctcttaatttttgttttcttcataacarttgtcagttttcttacactgtgctgtatttggagtggatgatgctggtggtgattgtctaaaacttagatatttaaacagtttgaaaacttgttggagtaggaattataaaagctttatagttttcattatcttctccattcccactcttccaagttactacaaatatgcctaatttttataaatatatgcaatttaaaatgttttaattgtaatatacaagtagttcttggcagtagattccttcggagatttttcttcatattttatagagttcttcagattttttcctctttgctta

SEQ ID NO: 162494 - DNA, 601 bp, Human
aatagaagatgaaaaaagttttgtggtgtttgctgttttataaactcatatttggagaaggaacacaatatatatatgatttcctcataactgctgttggtgccccagatttgatattgttgcatgataacctgacattgcttcctgcttctgaaggaatgattggatttgaagccaacatgcttgctaaaccgggaagctgctattacagaaggcacaggaagtcaagctgcctatgcagttgtgctgagacatgagactcatacgttgtgacccgtgcctattgtatgtctccccatcwttataactgcttttgaaaactggcttcaaataagcaaaaggcctagtgttatttccatagcagcactaaaattaatgaataagagttacagagttggctgaatataaaggagatatgtctaacaattacagttctccaaaacctagtgtgctccctctttgtccttgtaagtggtcaaacaaaaatggcataagcactcacttaggtgttgcattggtcagggacctggtgggaggcggatggcacacacaagttggataatttggggaacatttcataaaaagacagtaaaaatgtagg

SEQ ID NO: 162495 - DNA, 601 bp, Human
tgttttagtcttgaagtccttgcccatgcctatgttctgaatggtattgcgtaggttttcttctagggtttttatggttttaggtctaacatttaagtctttaatccatcttgaattaatttttgtataaggtgtgaggaagggatccagtttcagctttctacatgtggctagccagttttcctaacaccatttattaaatagggtatcctttcccgatttcttgtttttgtcaggtttgtcaaagatcacatggttgtagatttgtggtattatttctgagggctctgtacagaactcrtttttatgaagaatcattgactttcaaaaatacttgaggttacccagttcaagcatccaaaaatacagacttcctgttcattcagcatctagtttaatgtattcaattatggagagcaaaattttacattatgaaacatcttggctgggcacggtggctagtgcctgtaatcctggcacttttggagccccaggtgggtggatcacttgaggtcaggagttcaagaccagcctggccaacatggtgaaaccccatctcagtttaaaaaaaaaaaatgtatcttgttccattgttgaacaa

SEQ ID NO: 162496 - DNA, 601 bp, Human
ctagtgcctgtaatcctggcacttttggagccccaggtgggtggatcacttgaggtcaggagttcaagaccagcctggccaacatggtgaaaccccatctcagtttaaaaaaaaaaaatgtatcttgttccattgttgaacaactgtagaaggttattcttgcattgaaatgttccttcctgtaccttctgttgcttgctagttcttccgtttgctattctcttgccttctgtcttttggtccctttatgacatttttggtgtttgtttaacaggcattcacttattcaacatctatttaytgaatgcttgctgtaggccaggacttgttcttggtgctgggtattcagctgtgaacaagacaaagcttctgccttacatgaaacttacattgtagtaggtagagacagacattaagcaaatacataatatggtctctgtaggtgataactactgagattaacagcagttaaccatggtcacaagagaaaactgtggcttaaattgggtctgaagtcattctgagtcaactgtgtaatgcagtggccaaaaagcctaaattcatcttagactatttgaatcaaatggccatgttagagagg

SEQ ID NO: 162497 - DNA, 601 bp, Human
tgggtctgaagtcattctgagtcaactgtgtaatgcagtggccaaaaagcctaaattcatcttagactatttgaatcaaatggccatgttagagaggtcatgtttgctttcttattgtcaagctgagcctggtgtatagcatttactttttgaagagatattggcaagtggaaacttgttcaggggtatccccatgatagccttgtaaacagctgaagaaagccatcatatttgcatggagtgttccctaggccaaacctttctggttttgccaacagtttctcaaatggtatgatgtctrtactctttaactgtcctggtcttcctccagataattaatttcctcttaaaatgatgctcccagaattcaactcatctttccagatgtggtttcaacttaggtaatgcttattagactatttcttcccttgatctggttatttaattttagtaacgcatctgaggattgaatttcctttaaaaacacacacacacacacacacacacacacacacacatctgtgttacttgactctcagtgttgagctaggctgtaaagccaggtctccagcacttctgttcgtacaatttatgtacataa

SEQ ID NO: 162498 - DNA, 601 bp, Human
gtgtttaatataattgtttaattaaaaaagaataatagcaccagacctttccttcagattatagcagctcaataattaatcctgttttagtatgacatttcaaataactgtgaacagccttaatatgtcatccattttacatttctgcattttatccaaacattttgaaaaatgaagatacagtcttcatttcatgatggcatttctatctggtactaggcttaacaaaaaacatactagaagccaggcttggtggctcacgcctataaccctagcactttgggaggccaaggtaggcagrtcacttgagctcaggagtttgagaccagcctgggcaacatggcaaaaatgcaaatccacaaaaaatccaaaaattagccggccatggtggcatgcgcctgtagtcccagctgcttgggagactgaggcacaagaattgcttgtgccaggaaggcagaggttgcagtgagccgagattgcaccattgcactccagcctgggtgatgggagtgaaaccctctctctctctctctctctctctctctctctctgtaaataaataaatatatatatatatatatttttacctttctaacattgc

SEQ ID NO: 162499 - DNA, 601 bp, Human
actttcaagaggagttgcttctcttgcttagtacaaagtgtccatggatcagaatgtgattaaacaagtcaagtcaggtgacttgtcactgagggtttgtattggttgcaagtaccagaaatgtgcctgtgccgattggggaatcaggatattagtcaaaggaaaggaaaacctgttcaacaatttttcttgcttttcatgtgctgcagagaaaaggctaaatcccatctggtgcacactattgtgggaatcttatactttagattcataaacacagtatgttcagattttctagatttgrcatttgcttgaatgtgttcggtgtgtattttatactgagtgtcaaatttcttgccttttgacgatagctgacttttagttgactaaaaaagtagtagtcatagttaggtttactatctgtggctatcacagggttcacatgggcatcattgtccaaccaaagttgcttctgaagtgctgccatacagtcttggctctcatgaacacttgtcctagtttttaccgttgtcctggaagaattactttcacgagtgtctgggtttggaggaaaaattgtatggctcctatggatacgtctcaa

SEQ ID NO: 162500 - DNA, 601 bp, Human
cactttgcaaaccccattgcttcttgccgtatctgagcacttgccacctggtggtaaggagaccattccatctccttcactagatggtagcacctggaagtcagggatcattgctgacttatcttgcctcccaacattgatcatgcagtaggtgtggatgagaaagagggagataagggaagaaagggggctgtgaataaacgctgttgctttctgcttcctttttaggagttaaaagtctcttcagctacctgtttaggagtatgaaagcaaatctaggaaatggcctctgcagttttcygaatatgacaaatcatttagtttcctaagcttgttactctacagtgggacttctcaacctctgcactgttgatattgtggcctggatgattgtttgttgtgtggcctgccctgtgcattatagggtgtttagttagcagcagcatccttggtctctgcccactagatgccagtagtgcaccccatccccagctgtgacaacaaaaatgtctgcaggcattgccaagtgtgccctggaggcaaaatagccgccccctaattgagattgagaaccgctgctgcataggagctcctgtctggg

SEQ ID NO: 162501 - DNA, 601 bp, Human
aacctgaaaaatagccatcatgatactagagaaatagctgagatattaatatttcctctgtagattgttttgttttataagggcattttgtgtcttactaagaaatctcacataaaagtaagaacaccaaattaaatattagctcttgtggttattttaagactcatctcaataaccaagagaatttggttctcacactttgtaccttttgattgtaaacagctttaaacaggtttatgttgtacttcatcaaaaattatagaggatctgcagactgagacgcattgggactgaaattagkcaattcagagtttctcatgcatgtaagctgcttttattttgatccctatcattcttagtctgtcttttcaaatattctactggaaggactgttgtgagttgagggcaaaggagaaaatggcagggtctcgagccaccaggcctcataatacctgctctttgaggtagagtaaaagctaactgatgaatgttttccagaataatatttagatttagtctggtggtttttttttttttcttgttttgtttgctttggtttaagctcaatacagtcacatctgaatttacacaacaaaaatgt

SEQ ID NO: 162502 - DNA, 601 bp, Human
accaaattaaatattagctcttgtggttattttaagactcatctcaataaccaagagaatttggttctcacactttgtaccttttgattgtaaacagctttaaacaggtttatgttgtacttcatcaaaaattatagaggatctgcagactgagacgcattgggactgaaattaggcaattcagagtttctcatgcatgtaagctgcttttattttgatccctatcattcttagtctgtcttttcaaatattctactggaaggactgttgtgagttgagggcaaaggagaaaatggcaggrtctcgagccaccaggcctcataatacctgctctttgaggtagagtaaaagctaactgatgaatgttttccagaataatatttagatttagtctggtggtttttttttttttcttgttttgtttgctttggtttaagctcaatacagtcacatctgaatttacacaacaaaaatgtttccgaaaagttgtggatgaatccatttttaataagccaagtactataaaaagcatcagaagaacttgttaactgaacttatcctaatgttctgatcacctgtttcttttaatagacatagtggt

SEQ ID NO: 162503 - DNA, 601 bp, Human
aaacagctttaaacaggtttatgttgtacttcatcaaaaattatagaggatctgcagactgagacgcattgggactgaaattaggcaattcagagtttctcatgcatgtaagctgcttttattttgatccctatcattcttagtctgtcttttcaaatattctactggaaggactgttgtgagttgagggcaaaggagaaaatggcagggtctcgagccaccaggcctcataatacctgctctttgaggtagagtaaaagctaactgatgaatgttttccagaataatatttagatttagyctggtggtttttttttttttcttgttttgtttgctttggtttaagctcaatacagtcacatctgaatttacacaacaaaaatgtttccgaaaagttgtggatgaatccatttttaataagccaagtactataaaaagcatcagaagaacttgttaactgaacttatcctaatgttctgatcacctgtttcttttaatagacatagtggttgcaacaatgctttgattagttcctttttggaagctggcttttgttggggggagggtttttgtttcttgtatcttaaacttgacaccttga

SEQ ID NO: 162504 - DNA, 601 bp, Human
ttgtttgctttggtttaagctcaatacagtcacatctgaatttacacaacaaaaatgtttccgaaaagttgtggatgaatccatttttaataagccaagtactataaaaagcatcagaagaacttgttaactgaacttatcctaatgttctgatcacctgtttcttttaatagacatagtggttgcaacaatgctttgattagttcctttttggaagctggcttttgttggggggagggtttttgtttcttgtatcttaaacttgacaccttgattctcattgaaaaaactttcaaccatstatggttggtgatttgttgaaatttataactgaaaatctgccactctgcttttagtatttgaaatgccttggcagggagacgtttttctcagaacagatcttttggaggacctcaggaagttaattattctggcaagaagttctttttgaacttttttggatcattatgatattatgctaatttatctaaaaaatggattctaagttgaataactgtatagtcctggcagataagagcatgtcagatgtcttggcacagtttggggacagaggggactttcccacttctttatgtaatcc

SEQ ID NO: 162505 - DNA, 601 bp, Human
cagtggtgattatttttagccacgttcatgtgttttaaacaatcccttttaggtctgttgaatgtagcttggaacagaacgtcccatagaaatgatagtatagtacacgtggtggcaaagtttccatattagccctcaaagattatttaactcatcatatactcacacgctttgccgtacaaggggcaatgatgtatagcgtataaaaacactgtttaataatactcaacctacagcaactttcaatactaagaatgaaataaaattgaaaaattgtaaaaatgcataaggataaattttrtttctctgaaaaggttgcttttgaggaaaagtagttttaaagagacttggtggtgtggtagaagaactcccagcagacctgaagatgtagcagatgtatagcagtttgggcatcttggacaagtaaatcatactcgcaagcctcagtttcttttaatgtcatggggatagttgtgtggatcagagcagaatttgtgtgaaggtgatttgcaaactgtaaagtcctatgcaaatatacaatatatgttctggttcttttcttaattatgaaaatcttgtatcctggcctttttcttgacac

SEQ ID NO: 162506 - DNA, 601 bp, Human
catagaaatgatagtatagtacacgtggtggcaaagtttccatattagccctcaaagattatttaactcatcatatactcacacgctttgccgtacaaggggcaatgatgtatagcgtataaaaacactgtttaataatactcaacctacagcaactttcaatactaagaatgaaataaaattgaaaaattgtaaaaatgcataaggataaattttgtttctctgaaaaggttgcttttgaggaaaagtagttttaaagagacttggtggtgtggtagaagaactcccagcagacctgaaratgtagcagatgtatagcagtttgggcatcttggacaagtaaatcatactcgcaagcctcagtttcttttaatgtcatggggatagttgtgtggatcagagcagaatttgtgtgaaggtgatttgcaaactgtaaagtcctatgcaaatatacaatatatgttctggttcttttcttaattatgaaaatcttgtatcctggcctttttcttgacactcatatattagtaacaaaaatctttatgcttagcaacaattagtaaggtcctatttcgctcacaaatacaataaatgcatgtta

SEQ ID NO: 162507 - DNA, 601 bp, Human
tacagcaactttcaatactaagaatgaaataaaattgaaaaattgtaaaaatgcataaggataaattttgtttctctgaaaaggttgcttttgaggaaaagtagttttaaagagacttggtggtgtggtagaagaactcccagcagacctgaagatgtagcagatgtatagcagtttgggcatcttggacaagtaaatcatactcgcaagcctcagtttcttttaatgtcatggggatagttgtgtggatcagagcagaatttgtgtgaaggtgatttgcaaactgtaaagtcctatgcaratatacaatatatgttctggttcttttcttaattatgaaaatcttgtatcctggcctttttcttgacactcatatattagtaacaaaaatctttatgcttagcaacaattagtaaggtcctatttcgctcacaaatacaataaatgcatgttattttgacctacatggatgatagaaacatttgcttttttgtgacagcctattggaacttccaaagtgttctctctctctctctctctctctctctctctctctctctctcgtttttctagtctctaaacctctcttgttttttctttg

SEQ ID NO: 162508 - DNA, 601 bp, Human
ggggactcagtggccattgcagaccaaagcctcattcattgaggtggggtaggggttgctggggactacaattcagagttatatatgtaacagagttatgcatataattcagcaaacaaagaggcaagttgaaaagggtttattaaagtattaatgtttgtgtcaaatgtataaaattcaggaaacaggcagagcaataacatttaatgttggaagaggacttagagatacaaaaaatagagtttattcattctggagcagagaaatcttaagccggataggttaactgatttgcaagtgyctcctgccttccaatcctgcatccttaaggatatccttaagatgatacatctgggttttgcgatgctctgttctccaggtacggttagcagtgattttgcataactatgtgctgagaccctaggatctaacaaactataaaggttagaaatgaaatatgaggtagcctactatatcagccacctctgattcccttctcccaccacagggagaattagattgaccggctgatcgattgcttgattgagacaggatcttgctctgtcacccaagctagcctgcagtgatctccactcactgc

SEQ ID NO: 162509 - DNA, 601 bp, Human
tgcttgattgagacaggatcttgctctgtcacccaagctagcctgcagtgatctccactcactgcagcctcgacctcctgggctcaagtgatcttcccacctcagtctcctgagtagctggcactacatgtgcacaccacagtgcccggctaattttttgtatgttttgtagagacaggattttgccatgttgcccaggctggccttgaactcctgggctcaagctatcctgccttggcctctcaaagtgctgggatgacagatgtgagccactgtgcctggccagtaatatgtattaagyaaggtaatttgtaggagcttagagagaaccagcaatatgacacagtttctgctcttttggggcttacaatacagtattatatcatcagagggggtccattctgaaccataccttgaattaggcattagcatactagattctaattttgtttcttccattgaatttctaacgtggaccctggttaagtctaagagatcatttaaatcgtgggcctcagtttttttattcataaaatgagaatattgacatgggcctcagtttttttattcataaaatgagaatattgaatcttgaaaccct

SEQ ID NO: 162510 - DNA, 601 bp, Human
tgttgcccaggctggccttgaactcctgggctcaagctatcctgccttggcctctcaaagtgctgggatgacagatgtgagccactgtgcctggccagtaatatgtattaagtaaggtaatttgtaggagcttagagagaaccagcaatatgacacagtttctgctcttttggggcttacaatacagtattatatcatcagagggggtccattctgaaccataccttgaattaggcattagcatactagattctaattttgtttcttccattgaatttctaacgtggaccctggttaagtmtaagagatcatttaaatcgtgggcctcagtttttttattcataaaatgagaatattgacatgggcctcagtttttttattcataaaatgagaatattgaatcttgaaaccctgttatttttacattctgtgtacaaaagtctcatggtactatctttaattttacttatcagattttgaatctctagtgctctttttatttcaagatattcttagccaagctataaaatcaaactaatttatatgctgttatgaggcaacttagcaattcatataaccacaggctagagaaagtttggac

SEQ ID NO: 162511 - DNA, 601 bp, Human
cataccttgaattaggcattagcatactagattctaattttgtttcttccattgaatttctaacgtggaccctggttaagtctaagagatcatttaaatcgtgggcctcagtttttttattcataaaatgagaatattgacatgggcctcagtttttttattcataaaatgagaatattgaatcttgaaaccctgttatttttacattctgtgtacaaaagtctcatggtactatctttaattttacttatcagattttgaatctctagtgctctttttatttcaagatattcttagccargctataaaatcaaactaatttatatgctgttatgaggcaacttagcaattcatataaccacaggctagagaaagtttggacatatataatggttcatttcttcaattttaaggcagaactacatcccaagcttatgtaaaataatttgaattattatatattcccatagttctgcctcaaataaaatataactgtttttgaaaattcaaagacttagaaagtaaattagaggattgtttattataaaagaactttggaccctacaaaggaatttaaccacagttttcttttctttgttaa

SEQ ID NO: 162512 - DNA, 601 bp, Human
gatgaagtcttgctacattgcccaggctagtttcaaacttctgggctcaagcaatccatctacctcaccttcccaaaatgctaggtttacaggcatgagccactgcgcctggcccaattttatacaatattttaaataattttgtatatgaaacaaattttgattgtgttttgactgcaacctgtcaaatgaggtcaggtatgtgaattctcatttgtagtgttgtgtcagtgcccagaaagtgtcagattttagaagattttggattttcagattagtaatacacaacatgtagttgctrcagagatcatatggcctgcaaaacctaaagtatttattatcttgccctttacagaagatttttttgttgatgtctactgtagacaatggggaaatgaacatgggaggagcaactggtagtctctgccacagtaaagagaatgataagaagggtgaatcactgcctttgaaatgtagagttagaactttgtacttaggcatactagtggcccatggggcagtgagttggtatgcaggtgattggttttttgttgttgttgtttgtttgtttgtttgagacagagtttcgctctttttgccc

SEQ ID NO: 162513 - DNA, 601 bp, Human
cacaacctctgcctcctgggttcaagcaattctcctgcctcagcctcccaagtagctgggattacaggcatgcgccaccacgcccggctaattttgtatttttaatagagacaggatttctccatgttggtcaggctggtctcaaactcccaacctcaggtgatccacctgccttggactcccaaagcactgggataacaggcgtgagccaccatgcctggcaagtgattgttgaagaagcaatgttcagggacagatttgaggagccaggcatgaagtagcctggtggaggtaaagggawgaaggcacagaaggctgcttactgacgtgagcttccatctttaaagtggagcatcctaactcctggacttttccctcttcctgcagctcactgctctgtcttgcattcgattcttgcttatcagcagtgccacccctgtaggtcagactctttcctcccattgacttcttacgggtctccctgcctggacattcaccctcctccacagtcacctcctctaagtgtggctcttatattagtcccatctcaagaacttccaaggagtccctgttacctactcagtaaagccaagcctctaag

SEQ ID NO: 162514 - DNA, 601 bp, Human
cttggactcccaaagcactgggataacaggcgtgagccaccatgcctggcaagtgattgttgaagaagcaatgttcagggacagatttgaggagccaggcatgaagtagcctggtggaggtaaagggatgaaggcacagaaggctgcttactgacgtgagcttccatctttaaagtggagcatcctaactcctggacttttccctcttcctgcagctcactgctctgtcttgcattcgattcttgcttatcagcagtgccacccctgtaggtcagactctttcctcccattgacttcttaygggtctccctgcctggacattcaccctcctccacagtcacctcctctaagtgtggctcttatattagtcccatctcaagaacttccaaggagtccctgttacctactcagtaaagccaagcctctaaggtcctcccgctccttgatcctgatcttgatcctatcctgtcttccttcacagtcttacacacaccctagattccagcccaacagaaacaccttgtgcctgcgctgtactttgccaccaccacgtatttgctgttgtctccttgcttctgtccaaagggtttggggatttggg

SEQ ID NO: 162515 - DNA, 601 bp, Human
agggatgaaggcacagaaggctgcttactgacgtgagcttccatctttaaagtggagcatcctaactcctggacttttccctcttcctgcagctcactgctctgtcttgcattcgattcttgcttatcagcagtgccacccctgtaggtcagactctttcctcccattgacttcttacgggtctccctgcctggacattcaccctcctccacagtcacctcctctaagtgtggctcttatattagtcccatctcaagaacttccaaggagtccctgttacctactcagtaaagccaagccyctaaggtcctcccgctccttgatcctgatcttgatcctatcctgtcttccttcacagtcttacacacaccctagattccagcccaacagaaacaccttgtgcctgcgctgtactttgccaccaccacgtatttgctgttgtctccttgcttctgtccaaagggtttggggatttgggactatggcttagcacatggtagaacattcatggctgggcagagggggtttctgactttgttttggcatctctctacatctgtatttccctctccagcccctacccccttcccttacaacctaa

SEQ ID NO: 162516 - DNA, 601 bp, Human
tcagtttcatctagtaggtgcctagtggctattttgttgatcagtgttgcaatgatggtgtctacaaacagtgctacctacaatttagtgtgtttcactaaaaatgtaacttaacacctggaggaatttaagtgcaaatgcaaatagaggtttttttgtgtgtgcgagacagagtctcgctctgtcgcccaggctggagagcagtagagcgatctcggctcactgcaacctccacctcccaggttcaaggaattctcctgcctcagcttcccgagtagctggcattacagacgtgcgtcamcacgcccagctaatttttgtatttttggtagagatggggcttcaccatgttggccaggctggtctcgaactcccgacctcaggtgatccgcccacctccacctcccaaagttctgggattataggcatgagtcactgcgcccggcctagagttctaataattgtgttgaaaataaatgccacttaagatcttaaaaacaccaatttttaggtagtttttagcagaaaagaaaaaaaaatctatttaactgttttcttcagacctgaagcagtatttaaatacattcatatttagaagttt

SEQ ID NO: 162517 - DNA, 601 bp, Human
ttatttttataggaatgatttagcttatggagtaccaatctcatccttttccttcctctgtctttttaaccaagcatagaatgaggagaccaatgtatataatcaaatacttgcgtatgctggaaaagaatttatgtcattcactcatctccttttaattaaaacctagtgagattggtggcaatgttgggaagcagatggatgagcatgaatttcaaatgtgtatttagaaaaattgaaaggattggtaggaaagatattaagtaggcagtgtggtcgggagttgaacctgtgagttcamcagcaggcgcttgtagcataaaatatagtagtgcttccagacccctctgacctagggatgtctaagagataaggagggaaagtgcaggggtctcttttcttgtggtttatgcattttgaagttattaaagcataagacaatttgttctggaatttttactcaagataaaaactatgaccattgtgtgaacattactgcttcacctccctctcctaactctacttttgtttactattccatatccagtgtctagcagtgtactcatcaaacagtaagtgctcagtacatatttgttgaatg

SEQ ID NO: 162518 - DNA, 601 bp, Human
ccttttccttcctctgtctttttaaccaagcatagaatgaggagaccaatgtatataatcaaatacttgcgtatgctggaaaagaatttatgtcattcactcatctccttttaattaaaacctagtgagattggtggcaatgttgggaagcagatggatgagcatgaatttcaaatgtgtatttagaaaaattgaaaggattggtaggaaagatattaagtaggcagtgtggtcgggagttgaacctgtgagttcaacagcaggcgcttgtagcataaaatatagtagtgcttccagaccyctctgacctagggatgtctaagagataaggagggaaagtgcaggggtctcttttcttgtggtttatgcattttgaagttattaaagcataagacaatttgttctggaatttttactcaagataaaaactatgaccattgtgtgaacattactgcttcacctccctctcctaactctacttttgtttactattccatatccagtgtctagcagtgtactcatcaaacagtaagtgctcagtacatatttgttgaatgactaaataagtggattctggcacttaattataagagctttttgg

SEQ ID NO: 162519 - DNA, 601 bp, Human
agatgaaaagattcttaagcaaaatgattttttaaagatgtaaagacaaaagaagcttatcttccagtccccttcctcacttgactctgccagcccccttcaatacatgcctcactggcacctctcctggatttagctttaaaagtttgggaggagtgaaggtgtgtgtcctcatattactaaaagaagaaccctagtgttgtgtaacagtgtttcacaggctctttcataataaacataatattagacacagccaaagtaagttcattttgaattaataatccagtatttcatagtgctsgttcgaggtacagatctaggccttgtgtgcaacagaatagaattttagaagtagagtaaaaagtttcatccactaagctgtttctcattggcctgcagtctgatttctttcaaagttttggagtttaacacaaatttaggtgttcagctaataataagattaagggtgtttgtgggcaaaccaaatataatttatatcccttaattttgagctcataatgtttctgctctgggtttataagagataccaccgaagaaaaatctcaattagagtgagataatttgtaaagtaataagtagg

SEQ ID NO: 162520 - DNA, 601 bp, Human
gcagaaataaatttttatcatcaagtaatattaactgaatatacattatatgtaacttgtgttccctcagaaaactgatcacatgtatacaaaagcatcatattttgtatctttatttttaggtcaagcaattctgtaccccttagccacttagtttcatcatcatcatcaaacattttttgggttcctaaatatgtttcttcatgtttaatacttctttattctgcttgttctttcaagtagggaaaggacaaacttaattatttacaaaatgtagacgatggttaaaaaacaggaaaaraatttaatgaagtgtaattcattctctctttttccttcttttgtactcaggttgtttattctgttgatggatattggactggagtgatgagtgttctaggatgggtatttgatgatgccaggggactcaagtaatggctttgcatgaagattacacagtaaagctgcacattgattacctcatcttattagctgatggagatgtttgagaggacaagattgcagggctttcaagcctgtacagctaccaggatttgatcctaagagcttgatcattgtcattgcccatagggactgtgtt

SEQ ID NO: 162521 - DNA, 601 bp, Human
taatttttagcatttatagaattctaaaattaatcctgtttgtttttgtcttcctccactaaaatttaagtttgctgaggtagacagttttgtttctggaaccactatccctccagcggctagaacagtggaacatgttcaataaatattcaataaatatttttgaataagtgaatgaatgaacaggttaaatgtaatctttattttttaatgaactatcctttccagagacatacaaattgccagttgatggcattttttatttctttttgtaaaaagagtattttaaaatttgaatgarttctatctaacagataacacagttgagtacattaaaagggaccttgaacacaaaatccatgttttcgtggattagtatttttgcagcttaaatggtgaacgataggattgttagatgcaaataactctggaaattaaagacctttagttgtaactctccctaaaatgtttgtgagagcttgtaaaatgttgttcactttattctattataaaagggcattataataaatatgaagttttgaaaccatgttcttttaaatgaggtgaattatagaactctgttattagccattatgctgtg

SEQ ID NO: 162522 - DNA, 601 bp, Human
catgttcaataaatattcaataaatatttttgaataagtgaatgaatgaacaggttaaatgtaatctttattttttaatgaactatcctttccagagacatacaaattgccagttgatggcattttttatttctttttgtaaaaagagtattttaaaatttgaatgagttctatctaacagataacacagttgagtacattaaaagggaccttgaacacaaaatccatgttttcgtggattagtatttttgcagcttaaatggtgaacgataggattgttagatgcaaataactctggaarttaaagacctttagttgtaactctccctaaaatgtttgtgagagcttgtaaaatgttgttcactttattctattataaaagggcattataataaatatgaagttttgaaaccatgttcttttaaatgaggtgaattatagaactctgttattagccattatgctgtgccccttcttttaaagcatatccctccacataccctttctaaggacttgggggtaacaaaatgaggagtaagtgaagaaagaagaaggcacagcttgtcgagattgatggaccgccccccgcccccgggagagc

SEQ ID NO: 162523 - DNA, 601 bp, Human
tagatgcaaataactctggaaattaaagacctttagttgtaactctccctaaaatgtttgtgagagcttgtaaaatgttgttcactttattctattataaaagggcattataataaatatgaagttttgaaaccatgttcttttaaatgaggtgaattatagaactctgttattagccattatgctgtgccccttcttttaaagcatatccctccacataccctttctaaggacttgggggtaacaaaatgaggagtaagtgaagaaagaagaaggcacagcttgtcgagattgatggacygccccccgcccccgggagagcagcgtaggaaattgcaggatgaaatttgtgtgccagtcttgtcagcacccattcctgttgaaggagagggcatatggatgaggtggggaggattccagcagaggggacccaggaaaggggagggggtggggacaacaggaagtgtaatgggaggcttggggaaagttgaagatctgataaaggtagttggtgaggtgaagaaaggagaatccactaaaacttgaccctaggagcattctccgccgaatggcatggggtagtgaccctgactctggacaa

SEQ ID NO: 162524 - DNA, 601 bp, Human
ggaaggtaggtagaacttgggttggggtgatcgtgttgcctgataaactgttctgtacagtttgataatctcttgcagggagatggaatattttaatgtaaatatttgcatttagcacctactatttcatctaatgtgacaggagcttggtggaccagtagtgacttgagcaagatctctgccgtcaagtagcttatagtctgattggaaagacaagatgctaccaaaactagcaaaaaacaaacaaaaaaatgattacacattgtgattaatgctataagtttaatttcagagcacacaraaaggttaatcctgcttgtataaacttaattctttaataatgatactgcaggcatttttacaatatagttaattatttgggagtgggaacaattcttttgagtagcccattttgctctatttaactataaatacactacatgctacaaatcagatgtacagatgaaacagctgctgcttcgttgttttgttcctgttactcattttaatgaataatttgaacagactccaaaacattaaattatatgtataaacatactttaaggattatatcataatgttagtgtatttaaaacttagt

SEQ ID NO: 162525 - DNA, 601 bp, Human
ttattttagtacctttattcatttcagaatattttttgtatggatctctcatttgatttttacacagtttttagaagcagaatttctgctgttgcagggggaagttttatatgttcaagtacttaaatatgagagaaaatctagaattgcctctacaaatcattttgtttgtaataatcatgagttacacattctgtttgctctagaaatcaagaaacagaatagtggatcatttaaggccagaaactatatccactacttgtatctcccttttgggatggttttctgatgtttttttcartgtgtgtcatttgtataaccctggccggctgtcttgaaaatatatgtcactaatcatggtagggggtaggtgggtgagggggtcatctgattggttgtttacataaattagttgtagtgtctgttatcttcatatttaaataactgtatatgttagtataaaactccagtataaaatgggcagctggccaggtgctatggctcacatctgtaatcccagcactttgggaagctgaggcaggaggatcgtttgagctcaggagttcgagaccaacctaggcaacatgaggaaacctcatct

SEQ ID NO: 162526 - DNA, 601 bp, Human
gcatttcagttaggacttcacctttccctccgtaattctagcatggtaagcaagacttggaaaaagtcacaataggtggaaaattaaggaattaaaaatttaaacctgcctcagaaggttgtatggctcctgaaaccaaagatacattcatccttattttaaaaactagctacttaaaagtatgtatgatatgaataaagattagatgagaatatggagaaatagattttttgatgctggcgagattatgtataattttcgccttcacttttcagttgacgttgttgctagttatttattwaaaataaatttgttaaagtaaatgcccatatagcttacatgatttttttctggagaacactttccttggatattgggcaaccttcagaaataatagactccaccacagtactttaagaggcacagacatttaaaatttatgatatacaagtataagctaagtttatgtttgcagggtttttttttctctttaacagctgctagaattttaagatttcttagaattaaagacgagataaaatttaaaccaatgctatccaaaaattaatatctaagaataacttcgcataaattatagaga

SEQ ID NO: 162527 - DNA, 601 bp, Human
tatctaatctatctatatgggtgattgtattactatacatagtgtacttgttttcttttttcttttttttttgtttttaagcttttatgaactggtaacaattttgcttggagctcaagatgagttgggtcctgccagatggcactgttatttctctggcagaagtagctagttattttctcttttccttcaacacttctctccttgtcctcaagcattaaatcatgcatatacaatacaaatccttacagccgctgttattttcagtccattgtatctatttcctgttgaccgaaggttrtgaggcttgggtagtgtagagggagatgaaaagttgacagaaaaaagaaagctgggctcattttaggggcaaaacaccataaaatgggcaagatggcacttggatttattgaaaacaaaaagaaataaataggcaatcgtctttcttgtatggtgagatcattatctgcatggtgcatgcatgaagaatcgttttcctccaagaatcgtgttttatgaaagggtgacacccgtagccctcatggggaaagaggaagatgtcattattggcacttgggctgagccttccacgtttgcatca

SEQ ID NO: 162528 - DNA, 601 bp, Human
aatcgttttcctccaagaatcgtgttttatgaaagggtgacacccgtagccctcatggggaaagaggaagatgtcattattggcacttgggctgagccttccacgtttgcatcagagatcttgatttcattatctgtgccataatttttatcttgcattcaaccttgtacttagtccttctctttagatgaagttattcattcttgcttattggacttaatgtagtttatagtcagtagctccagaaggcataatttatctctttggaaggatgtctttctaaagaaacttttcattgccmtatatcttgttctggaagctttagactgagatttatgttaagaagaaaatgatatttaagcgttattttggctttttacatataaatctaattatggaaatttgaaatttgatttgtaacacttcagtgctttccctttagttcttaatgtgaaagtgttgtttttaaacagtgatccaaatcttaatatagcagtgttttattttgttgtaaattgtgaatgtttcataagaaactaagaaaagaaaatgggaatgttttgttttgctggaaattcaaaacagtagttctaacccagaa

SEQ ID NO: 162529 - DNA, 601 bp, Human
gtagtcacatgttggctaatggatcctgtgatggtcagcacagccatttccattatcacagaaagttctgttggacagcactgctccaaaactgcaattagaatttgcctctgtgcaggaaaattttatgtctttaatttgagagataacatgaattttctactgcataaacaatatttattttttcatggtcttgttctttatttaaacaagacgttattaaacatcaaatggacattgacattatacttcatagcatatgccattttgttcttattctctgtgatgacgttacattctrccctctgagagactgggaagtcattacacacacacatacacacaaatgtatggatatatatagagagagagagactatgtaactatgtatatatacataaaaatgctaacataatattcaatgactgaaatgtgtgggccttctcatagtaggcactgtgaagttgtaggttcctaatattaacatattggcacggtttcagtcccagggttcataattgacttattccctgattaagttagtttcactttttgttcactgagccttgtgggctggagatttgagagtttatggctgaat

SEQ ID NO: 162530 - DNA, 601 bp, Human
aaagttctgttggacagcactgctccaaaactgcaattagaatttgcctctgtgcaggaaaattttatgtctttaatttgagagataacatgaattttctactgcataaacaatatttattttttcatggtcttgttctttatttaaacaagacgttattaaacatcaaatggacattgacattatacttcatagcatatgccattttgttcttattctctgtgatgacgttacattctaccctctgagagactgggaagtcattacacacacacatacacacaaatgtatggatatatakagagagagagagactatgtaactatgtatatatacataaaaatgctaacataatattcaatgactgaaatgtgtgggccttctcatagtaggcactgtgaagttgtaggttcctaatattaacatattggcacggtttcagtcccagggttcataattgacttattccctgattaagttagtttcactttttgttcactgagccttgtgggctggagatttgagagtttatggctgaattcttacaacaataagaaaacccactattggtttgttgtatcatccattatacctgaaggcc

SEQ ID NO: 162531 - DNA, 601 bp, Human
ccaaaactgcaattagaatttgcctctgtgcaggaaaattttatgtctttaatttgagagataacatgaattttctactgcataaacaatatttattttttcatggtcttgttctttatttaaacaagacgttattaaacatcaaatggacattgacattatacttcatagcatatgccattttgttcttattctctgtgatgacgttacattctaccctctgagagactgggaagtcattacacacacacatacacacaaatgtatggatatatatagagagagagagactatgtaactrtgtatatatacataaaaatgctaacataatattcaatgactgaaatgtgtgggccttctcatagtaggcactgtgaagttgtaggttcctaatattaacatattggcacggtttcagtcccagggttcataattgacttattccctgattaagttagtttcactttttgttcactgagccttgtgggctggagatttgagagtttatggctgaattcttacaacaataagaaaacccactattggtttgttgtatcatccattatacctgaaggccaagttagtgaagaacagagacagc

SEQ ID NO: 162532 - DNA, 601 bp, Human
ggaattttggcaagcatcacaccaggcatgtgagctgtcatttataccacagagaactcacaaaacagggtgtacagcagttacaatgtttttctttaaagctgaagccatttgctagttaggttaattaggcaaaatttgtgaatttgttagtaacgttacagccatataggcaaaatttgtgaatttgttagtaatattacagccattaatggcttggggttaatccaggttaaaaaatgtttccttcccaccaaatagtgggactcccatctgtactttcttgccagtatgtacatasccatactctagggtgtgtgataagcctgccttaagacctagcttcagtgtgacagttctacaggtgagcatatccaatttgctaaatacaggaaatgtttaaaagaatagttcttttaaaatgatgtttaaaaacatctctcttatgtctgtagagttttaaaaacaaattaatttgtttacacacctctatgcttgcctgaccaattcttgaatgggctgggcagatcgcagttatatcactatccctgcaatgcataaatagtatgagaacttctgtatttttaatccttgcctcaaa

SEQ ID NO: 162533 - DNA, 601 bp, Human
acaagtatttccaatgtggttggaaggcagaggggcaagaagtgacgctggagagatttaggggtggagatggggcgggagttgattggagggtcctgtgtaccctgccagagtttgggttttatcctgtaggcacagggggcagtcactgagcatagggaattggcttcagaatttggtacttttaagttaccccaaaatccagacttaactgttgacttcttgttaacaaattatttgttcaactcaaaattggagtgactattgcatataagaaatggctacaaaataagtttttacrtagtccttctcaactatgcagacatcttgcaaatttcagcttcttcattacctgctcgtaatggaagtctagtcgttaaaatgattttttgtgtgaatttcttttaaaattactttgagtatttggttttgaaggtttctagaaagcctgtcctttttgtctgctcctgctctgcaggattggcaaggcagtgtacggctttctctggagctaccaaggcagcaaggataaaaataggacaaactttaagaatctcagatattttcagataacaaagactgatttatgtgggcccgtttt

SEQ ID NO: 162534 - DNA, 601 bp, Human
gtttaaccatataacactgttgatattttactatttttcacctattaaaaaatagcacatttggccgggcgcggtggctcatgcctgcaatcccagcactctgggaggccgaggcgggtggatcacgaggtcaggagatcaagaccatcctggctaacacagtgaaaccctgtctctactaaaaatacaaaaaaaaattagccgggcttggtggcaggcacctgtggtcccagctactccagaggctgaggcaggagaatggtgtgaacccgagaggtggagcttacagtgagccgagatygcgccactgcactccagccttggcgacagagcgagactccgtctcaaaaaaaaagcacttttatgtagctcaacccaattctttaggtgctatttaaaaatatattttaaaactatattagattatggccgggcacagtggctcacacctataatccctgcactttgggagactgaggcagatgggtcacttgaggtaaggagttcttcaagaccagcctggccaacatggtgaaattccatctctactaaaaatacaaaaattatccaggcatggtggcacacgcctgtagttccagct

SEQ ID NO: 162535 - DNA, 601 bp, Human
atccaaaaagctaaatcatagatgttcttccacctctcttacttttttttacaatgctcctaaatatatttacaaaggaaatgagatgttctcatagaggatgtgcattcttcagtcaaggaatatgagtctaattttttgaagcctattcaagggtgggtagggttgagaacccaaaataagaatttttaattctcaagtgtctgagattaactttgcaagttttaaggcacagcgtcttgtctatttggccaccttaggatgattcttatcatttgggagcctgacaaacacccactcygctctgggaaggaaagcttggtatgcttttagaaaattgattgattagttcaccaaattatttgagtttgctgacactctactaggctgtgggaattcattcagcaaatatatattaggtgattagttaaggagacaaaaggtaaacatcacagactgagcatctaatgggagaggagtcattaagagaaatatccaaaataattcattgtaataattgatgagtgcaagtttatatatacatatgtatatataaattatgcattaaaatatatatacagtgcatatatatatgtgtaaa

SEQ ID NO: 162536 - DNA, 601 bp, Human
gatgattcttatcatttgggagcctgacaaacacccactccgctctgggaaggaaagcttggtatgcttttagaaaattgattgattagttcaccaaattatttgagtttgctgacactctactaggctgtgggaattcattcagcaaatatatattaggtgattagttaaggagacaaaaggtaaacatcacagactgagcatctaatgggagaggagtcattaagagaaatatccaaaataattcattgtaataattgatgagtgcaagtttatatatacatatgtatatataaattaygcattaaaatatatatacagtgcatatatatatgtgtaaaagtataattctatggaagtttatgaatatagttcttgtgctcatagagcttacagtcagtctagtaggagggacaaataatccaggaattatactactgattcataagcgctctgctaaagaagaactagataagcatagttagcagcagcagtgatctttccagtgcagaactcccaattccttacaaaatagatgagaggtatatttaggttgagtgtaactcttgacttgtgaacttttcatctttacaatatccat

SEQ ID NO: 162537 - DNA, 601 bp, Human
tgggagcctgacaaacacccactccgctctgggaaggaaagcttggtatgcttttagaaaattgattgattagttcaccaaattatttgagtttgctgacactctactaggctgtgggaattcattcagcaaatatatattaggtgattagttaaggagacaaaaggtaaacatcacagactgagcatctaatgggagaggagtcattaagagaaatatccaaaataattcattgtaataattgatgagtgcaagtttatatatacatatgtatatataaattatgcattaaaatatatayacagtgcatatatatatgtgtaaaagtataattctatggaagtttatgaatatagttcttgtgctcatagagcttacagtcagtctagtaggagggacaaataatccaggaattatactactgattcataagcgctctgctaaagaagaactagataagcatagttagcagcagcagtgatctttccagtgcagaactcccaattccttacaaaatagatgagaggtatatttaggttgagtgtaactcttgacttgtgaacttttcatctttacaatatccatggttgggaaagggttg

SEQ ID NO: 162538 - DNA, 601 bp, Human
atctaatgggagaggagtcattaagagaaatatccaaaataattcattgtaataattgatgagtgcaagtttatatatacatatgtatatataaattatgcattaaaatatatatacagtgcatatatatatgtgtaaaagtataattctatggaagtttatgaatatagttcttgtgctcatagagcttacagtcagtctagtaggagggacaaataatccaggaattatactactgattcataagcgctctgctaaagaagaactagataagcatagttagcagcagcagtgatctttycagtgcagaactcccaattccttacaaaatagatgagaggtatatttaggttgagtgtaactcttgacttgtgaacttttcatctttacaatatccatggttgggaaagggttgtaagaaaattcacagtatgattaatcagatttcttatatatagtctgtgagttggctaccaagtacagctgtgttaatcacaagtcatttttatgtgttcattaatagataaaacaagtatctaaggactttaatctgccaatacgttctacattgaggtcatgagctatatctaaatgcaactgc

SEQ ID NO: 162539 - DNA, 601 bp, Human
tttattactgtggattagtttggcctattcttgaacttaggaaccattgaaaccattattttttccagtattaagcctgtgagattcatccatgttgtagcatgtaacaagagttcttcattccttgtagcatttcattgtgtgaatatatcacaaattgtggatctattctagtgttgattgatgtttgggttgttttcaatttttagttaacacaaagctgtagtgaacatttctttatatgtcttttgatgaacataaacacttagttcttttgtgtatacacccatgagtataatarctgtgttacagtacagacgtatatttagctttaataggtttaacagctttagttttccaaagttagtgtaccagttgcctacctaccagcagcgtgtgagagtttactttacattctcatcaatgtttgatgttgtcagtctttaattttagctattctattgggtgttagtggtatcttgtggtgttaatttgcattttcctgagaaccaattcaaccagagagtttttagtttttttttctttttctttttttcttttcttttcttttctttttttttttttttgcatatttccaagc

SEQ ID NO: 162540 - DNA, 601 bp, Human
catttcattgtgtgaatatatcacaaattgtggatctattctagtgttgattgatgtttgggttgttttcaatttttagttaacacaaagctgtagtgaacatttctttatatgtcttttgatgaacataaacacttagttcttttgtgtatacacccatgagtataataactgtgttacagtacagacgtatatttagctttaataggtttaacagctttagttttccaaagttagtgtaccagttgcctacctaccagcagcgtgtgagagtttactttacattctcatcaatgtttgwtgttgtcagtctttaattttagctattctattgggtgttagtggtatcttgtggtgttaatttgcattttcctgagaaccaattcaaccagagagtttttagtttttttttctttttctttttttcttttcttttcttttctttttttttttttttgcatatttccaagccactgctcctgagatcttgatttattgagtctcctgcggtggggccctgtcacctagatttctaaaattccccacaagtgattcttaggccttcaaacctctggataagaattatggcatttgtcagcat

SEQ ID NO: 162541 - DNA, 601 bp, Human
tgtgtatacacccatgagtataataactgtgttacagtacagacgtatatttagctttaataggtttaacagctttagttttccaaagttagtgtaccagttgcctacctaccagcagcgtgtgagagtttactttacattctcatcaatgtttgatgttgtcagtctttaattttagctattctattgggtgttagtggtatcttgtggtgttaatttgcattttcctgagaaccaattcaaccagagagtttttagtttttttttctttttctttttttcttttcttttcttttctttytttttttttttgcatatttccaagccactgctcctgagatcttgatttattgagtctcctgcggtggggccctgtcacctagatttctaaaattccccacaagtgattcttaggccttcaaacctctggataagaattatggcatttgtcagcattgcctaaaggtttaatttaaagtctccaagaatatttcacaatctactaaagagggagtcatgacaaataaaaagtttttctacttgaaacagattaaacagatcatgctatgtttaagggtcttcagtagttgagtgaataaat

SEQ ID NO: 162542 - DNA, 601 bp, Human
tctctatggtaaattaacaagccaaatgacatgcattactgatgcagaactttgctctgtagttcagctaaactgggctcttgtcacaagaccaggaaggattaggaacacagacacattgaagggtgaggggaacagaatttattgggccaaagaggaaaagaagaaaaaagtactctcaggaaagtgagagggggtcctcctaataggctccccacctcacagactgaattccaggccatcacccaggatctgaaaaggccaggctcctccctatatctatcactccccactctaaagragtgcatctaactgcctttataataaggataaggatgaagaccaatcttaactttttcttgctgacaagggtccctgttttgggaaaacagcagtcagatccccctcagaggcttatctaagggttcctggcaaaaggggccatcatttgaggctccggttgcatgactgtttggagtttgatggcctgaaggcgagaatagacaaaccgggttattaaaaacatgtatgaaaacagaacggggttgcgggtaaatacagctaaaaaatcccaaggtcttttatcggtttgcacagggag

SEQ ID NO: 162543 - DNA, 601 bp, Human
ttccaggccatcacccaggatctgaaaaggccaggctcctccctatatctatcactccccactctaaagaagtgcatctaactgcctttataataaggataaggatgaagaccaatcttaactttttcttgctgacaagggtccctgttttgggaaaacagcagtcagatccccctcagaggcttatctaagggttcctggcaaaaggggccatcatttgaggctccggttgcatgactgtttggagtttgatggcctgaaggcgagaatagacaaaccgggttattaaaaacatgtatgraaacagaacggggttgcgggtaaatacagctaaaaaatcccaaggtcttttatcggtttgcacagggagagggaggccaaagcctgactggtaaaaaaaaaaaacaacaacaacaacaaaaccttttaccctttttccggcatgtcaggcttctgtgttcccttcccccaagcacaatcctaagtcaaccagtttaaggtttgggaaattaacttttcccagtttggaggctacatcagaggggcgtgtcccatagtacagagacaaaattacctatcagcaaagggaggacagaggagg

SEQ ID NO: 162544 - DNA, 601 bp, Human
ggatgaagaccaatcttaactttttcttgctgacaagggtccctgttttgggaaaacagcagtcagatccccctcagaggcttatctaagggttcctggcaaaaggggccatcatttgaggctccggttgcatgactgtttggagtttgatggcctgaaggcgagaatagacaaaccgggttattaaaaacatgtatgaaaacagaacggggttgcgggtaaatacagctaaaaaatcccaaggtcttttatcggtttgcacagggagagggaggccaaagcctgactggtaaaaaaaaamaacaacaacaacaacaaaaccttttaccctttttccggcatgtcaggcttctgtgttcccttcccccaagcacaatcctaagtcaaccagtttaaggtttgggaaattaacttttcccagtttggaggctacatcagaggggcgtgtcccatagtacagagacaaaattacctatcagcaaagggaggacagaggaggaaaaagaagattttttttcaaaggagtcctacggattcagaatgcatttgaaaggggtacagactaaaggtgaatggctactcatctagaaagaggggagca

SEQ ID NO: 162545 - DNA, 601 bp, Human
agaattgcaggatatttgcttagaactagaatattgatccagatttatccatccccttagcttcttctgagctgcagccagagattgctggttggttcacaggaataagcagggtaagtttaaaatgtaggcaagaacttaaaaacaactaatgggtctagaatataatgacaaatgtatgagaagttttgaaacatttctctctctctccagtcctcatttttgttaaaaacaaatcactcataagtaggaattgaacaatgagaacacttgaacacaggaaaggagacatcactcaccrgggcctgttgtggggtggggggaggggggagggatagcattaggagatatacctaatgtaaatgatgagttaatggtgcagcacaccaacatggcacatgtatacatatgtagtaaacctgcacgttgtgcacatgtaccctagaacttaaagtataataaataaaaataaataaaaaaaatcatgataggatggagttgtttgcaaaatagactttagtcttatacttggcccattatttgcataaagtgcagcaagaatttttatttatttatttatttttgagatggagtcttactc

SEQ ID NO: 162546 - DNA, 601 bp, Human
gccagagattgctggttggttcacaggaataagcagggtaagtttaaaatgtaggcaagaacttaaaaacaactaatgggtctagaatataatgacaaatgtatgagaagttttgaaacatttctctctctctccagtcctcatttttgttaaaaacaaatcactcataagtaggaattgaacaatgagaacacttgaacacaggaaaggagacatcactcaccagggcctgttgtggggtggggggaggggggagggatagcattaggagatatacctaatgtaaatgatgagttaatggtgcagcacaccaacatggcacatgtatacatatgtagtaaacctgcacgttgtgcacatgtaccctagaacttaaagtataataaataaaaataaataaaaaaaatcatgataggatggagttgtttgcaaaatagactttagtcttatacttggcccattatttgcataaagtgcagcaagaatttttatttatttatttatttttgagatggagtcttactctattgcccaggtgagagtgcagtggcacaatctcggctcactacaacctccgcctcctggattcaagtgattctcc

SEQ ID NO: 162547 - DNA, 601 bp, Human
actacaggcacgtgccaccacacctggctaatttttgtatttttagtagagatggggtttcaaccatgttggccaggttggtcttgaactcctgaccacaagtgatctgccctcctcagcctcccaaagtgctgggattacaggtgtgagccactgtgcccagcctgaataattaatttaacataggccttttagatcgactttgttccacaaggagtctcagataggactttctaaagccaagtccatccatgagtttgtaccctcaaatacttgtgagttgggtaaacgcctctcttcytgagatcccaagaacatgtgggtcctgggcctgttggaaagtggcattctctactcaccacaggttaggaaccctgtacggggactgtgtagatgagctatgaggccaattttcccaaggggctgaataaagattcagctctgcaagtagagcttgactccttaaagggaagcatacctttctagtcaaagccttggtgaaacaaccagtttctccaattgcatcctgttgcaaaagaaaatggattcttactgcattgatgcaaacaaccatattgctataagttaagaatactcacaa

SEQ ID NO: 162548 - DNA, 601 bp, Human
tttgaaaatattgatcttatagaagtctggtcccatgaatagattgaaagaggcagacagtagaggaaattccactaaggagagttcagtcatgtagatctcagcagggatggggacctgaacttgggatggtggcaatgggaatagagcaagggaataagtacgcggctaagaagaagggctcggtgcctgcgtgactggaaatcaaagagaaggaatcaagctgattgagttttaagcctggagaatctggataaagtcatttctttcaatgcaagccaggaaaagcagtcaacttaaraagtaaatggatttctatttgaggcccacaagcaaggtaatactggagtaaccaagtagaaatattagtttgagaatatgggacttggaatttggtaagatgatggaagttgtcagcattcagagaagaaaatgaagttctgaaaaaggaggatgatctctaatagcgtgtatggtaaaaggttagaggactgaactctgttggccattcccagggagagagacgggaggaaggagccagtaagtgaaacaaggaaataatcagcaagggagaagggttttaagatctttttaagatgga

SEQ ID NO: 162549 - DNA, 601 bp, Human
aaaatcgatttttctgaatatttgttcttttaagcgtagttaaatatactatgctacaaaatacagtccatttttttccagctctacagctacctggaagggtatattgcattcatgctctgctggaagggaaaaagagttggagtttctcacccctgaagaagtatggccttagtaatgccttcctgcctcaggaagtgtgcccttctctctcccactttctataatcctgggtggataggccctctgttgggacagaagggcaggaaatggaccagccacaaagcctctccgagtcatrccctttcctgtatttgtgtgccattatggccgcttctaagtcacatctgttgggctctatttccttccttcctatataagcagtttttatgttgtgtctaacaggtgatattctgttccagtcaagccattatgctgtttgatttttacttgtgtttaaagagctgaatcttctttccccttatcactacccacttcactcattgctagtgagtatactttcctatactgtctcctagagtctgtatccaaaagttacagaccttgagaggagaagaaaaaaatgagtctgggtgattct

SEQ ID NO: 162550 - DNA, 601 bp, Human
ccttgagaggagaagaaaaaaatgagtctgggtgattctctgagattctcaaagtcctacaaatagaaagctaaagtttttaatgcacatatcctaaacagtatgtgctaaaatttctgtattttgtggtagagttttcctcagctatctccaagattttaatgtatctgtgattattacttaaatcagtacttatttcaccattcaataacagtatctaactcctttcttgaagtgactgtataacctggttatcagttagtgagatgtaagttatgcccaaggtggtgcaaacgatgasaaaatagaggtgtttctcttcatctttagataacctatcttatcccagacttagacattcactcacactcaaaattagatattggtattggttagcatatgagtgagtgtctgcattttctagtggtttaatatgccaattcaagacacagttctatgagcatcctttttaaaattctgtgtgtgtgcatgtgtgtatgcatatgtataatgagagaaagataataggtcatcccaatgaccctgagagctggcaaagatgggaataaatgttgatagtttgttctttattttagatgct

SEQ ID NO: 162551 - DNA, 601 bp, Human
gaagaaactggactgccgtagccccatctaatgggagtaactaacctacactgctacaatcctttgttgacttgtgaaatgatgcacccatgcaggcaaatcttctggtatatcaggaaaagccagagatttcagattttatatgtattatctctcaatttttaaagttctatcaactaatttaattattaagaaaacattgcaggccaacccaaacacttctgcaagctagataatggccttcagctgctatttagtaacctcttctccagagtatataatatcaaatcagacttaagaktattaatgtatttgacataattatttaagaacagtgagactgtataatctttccattctgttcatataacaacttcttaaaaattactttgcctttgctggggtaatacatgcttctagtctgtcatttttttttccatgctggccttcataagtaacattaagttctaaggtaacatagtttgttaagaagtctgtaaaagaaactgttcagccaaattgggtaatgcctacccaggttttttaaattggggtttaagttgttaaaacacagacaatttgatttgttgcaccatgctgt

SEQ ID NO: 162552 - DNA, 601 bp, Human
tctgcaacagtctgaacattagttactatactgacttttttttgttaagccagtgcaaggttttgtatggtgtttttatacaccactttggttaaagtaccttcaagcttagatccttaatattgtgtggggagcatacagaagactaatcctgagagtttccctgggtgactcttttggcacagtgatggatttgctctaaacattttttcaagagatcttttaaagtttctgaatgtgattaaaaattaacatgcactttttaaaatttttattcttttgtatttcaatttttattttwgttttaggggggtgcatgtgcaggtttgttacctgtgtatattgtgcgatgctgagatttagggtatgaatgatcctgtcactcaggaactgaacatagcacccaatcgttagtttttcaaccctttccacctgcctccttcccctctctggtagtacccagtgtctgttgttgccatctttatgtccatgtttagctctcacttgtaagtgagaacatgtgatatttggttttctgttcctgcgtttatttccttaggataatggcctccacctgcatctgtgttgctgcaaaggaaat

SEQ ID NO: 162553 - DNA, 601 bp, Human
tttacattcccaccagcagtatataagcattcccttttcttcacagcctcaccagcatctgttgttttttgactttttagtaatagctgttttgactagtgtgagatgatatctcattgtagttttgatttgcatttctctgatgattagtgatggagtattttttcatacatttgttggccacttgtatgtctcatttctagaagtatcagttcatgtcttttacccattttttaatggggttacttgttttttgcttgttgatttgagtttcttgtggattctggatattacctctttstcagatgcatagtttgtgcatattttctcccattctgtaggttgactgtttactctgttgatagtttcttttgctgtgcaaaacctgtttagtttaattaggtcccacttctcaatttccggtttgttgcaattgcttttgaagacttggtcataatgcctagtttcttgagggttattatcaggaggagacattggattttatcgaaagctttttccaggtctattgagatgatcatatgttttttgtttttaattgtttacatggtgaatcacatttattgatttgtttttttgtttg

SEQ ID NO: 162554 - DNA, 601 bp, Human
attaggtcccacttctcaatttccggtttgttgcaattgcttttgaagacttggtcataatgcctagtttcttgagggttattatcaggaggagacattggattttatcgaaagctttttccaggtctattgagatgatcatatgttttttgtttttaattgtttacatggtgaatcacatttattgatttgtttttttgtttgtttgtttttaattatactttaagttttagggtacatgtgcacaatgtgcaggttagttacatatgtatacatgtgccatgctggtgtgctgcacccrttaactcgtcatttaacattaggtatatctcctaatgctatccttctaccttccccccaccccacaacagtccccagagtgtgatgttccccttcctgtgtccatctgttctcattgttcaattcccatctatgagtgagaacatgcagtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatca

SEQ ID NO: 162555 - DNA, 601 bp, Human
catgactgccttgactgtatttgagatgaccgacttgaaatacccttagaatttagttcttccctttttccatttaaatgacaagcaaaaatggctgggcacagtggctcagcctgtaatcccagcatctggggagaccgaggtgggcagatcacctgaggtcaggagtttgagaccagcctgaccaacatggtgaaacctgtctctagtaaaaatacaaaaaaattagccaggcgtggtggcgcatgcctgtaatcccagctacttgggaggctaagacaggagaattgcttgaacctargatttggaggttgcagtgagctgagatcatgctactgcactccagcctgggcaacagagcaagactgcatctcaaaaaaaaaaaacaaaaaatgtgtgagattgatcaggttaaacaccactagctttaagagaaaggcagttcattaacattcatacaacacagatttaagcacctatcagttacaggatataaattctccaaacaaggaaaaggttgctcccctgaagaagctcaccgtccaggacccctgaagaagctcaccgtctaggaggggatgtggagaagtaaacacattat

SEQ ID NO: 162556 - DNA, 601 bp, Human
caaaaatggctgggcacagtggctcagcctgtaatcccagcatctggggagaccgaggtgggcagatcacctgaggtcaggagtttgagaccagcctgaccaacatggtgaaacctgtctctagtaaaaatacaaaaaaattagccaggcgtggtggcgcatgcctgtaatcccagctacttgggaggctaagacaggagaattgcttgaacctaggatttggaggttgcagtgagctgagatcatgctactgcactccagcctgggcaacagagcaagactgcatctcaaaaaaaaaaaacaaaaaatgtgtgagattgatcaggttaaacaccactagctttaagagaaaggcagttcattaacattcatacaacacagatttaagcacctatcagttacaggatataaattctccaaacaaggaaaaggttgctcccctgaagaagctcaccgtccaggacccctgaagaagctcaccgtctaggaggggatgtggagaagtaaacacattatcataattaccgtggaaggggctgtggttgaagtaaactcttggcactattagggaagctcccctgaggaaagtctgagagtgtga

SEQ ID NO: 162557 - DNA, 601 bp, Human
aaaatgtgtgagattgatcaggttaaacaccactagctttaagagaaaggcagttcattaacattcatacaacacagatttaagcacctatcagttacaggatataaattctccaaacaaggaaaaggttgctcccctgaagaagctcaccgtccaggacccctgaagaagctcaccgtctaggaggggatgtggagaagtaaacacattatcataattaccgtggaaggggctgtggttgaagtaaactcttggcactattagggaagctcccctgaggaaagtctgagagtgtgagtgkcaattaaatgatggtaggggagggcagcctggcaaaggatcttctcgttagaataaacaacatgcccaggtcctttaaaaagaggggagatgagacaggcccagagtcgtggggaggtaggtgggcgggcaaaaaggagggaggaaagtaccaaaggagggacgaatgccagatgccttgcaggttcctggtcctgaaggagttataatttatgataatgagtttggactttattctgagtgtaccattaaagaattttatgcaggcacataaactttaagatttatatatttaaatctt

SEQ ID NO: 162558 - DNA, 601 bp, Human
cactaaattatgctgcactctttgttcaaaccaagtctagcaaaagccaagttgtaactaactgccttggacttaaacattcaggctcacatgagttctctatttattctcagaatttaagagtcaccaaaattggtttatttttgcctttgctttagtattcttatgtcttattatctattttcacacttttcttcagcaatcagtaaaacattggcctattatatacaggcagtaaaggaggagaaaaggctaagacaggcctccttacaccttggactttttttctcgtttctttcckcttaagtaatatagggctattctttgggcatgattttcatttctgtctggaacattaatgtcaaattgagtttggaagcatagagaaatccagctaacaaaatgcctaagtaacatagtacaatttagtgcaacatttccacattttagcttctgccctaaaattaaccttaagctttgcacagagtagaaaatacacgtaaattttataaatgtatttttaaaaatttcaatatgattatatcatatttttctaatacgaaaaccaaggaataccctagaaaaggagtacccttttagt

SEQ ID NO: 162559 - DNA, 601 bp, Human
atcattctcctagctagagaagactaaagcaagataggagctgagtttctctctcttttttttttaatctattatgattagtttttcttcccaaacaggtttgttcttgccttgtttcttttcctctaggaataggttttaaaagaccctccatgtaatttttcataggccgtgatcattctggattatagtcatcacaccagcattcacacaggctcgggtaactttctcattgaccttgactccctgctccttccgtttcagtccttcccattttaaaagctctttttgttgtcatatwgggaaatcattagcattttgagaccaaatgcagatgcttaaaggggatggactacataactctgaaaatttgtacctaaagatccaggatacggtgtcattactaagggctttggaggtggaaaatggcattggtttagaggagaaacaatcagtttcagcttcagaaggataattggagataacctgtcaggcagttggaaggtggaactagagaaaaagtgagaaaccataactcggtaagatttagcagtcatgtgaccttgattatttaaccacaaacttagataagatactgggg

SEQ ID NO: 162560 - DNA, 601 bp, Human
atctattatgattagtttttcttcccaaacaggtttgttcttgccttgtttcttttcctctaggaataggttttaaaagaccctccatgtaatttttcataggccgtgatcattctggattatagtcatcacaccagcattcacacaggctcgggtaactttctcattgaccttgactccctgctccttccgtttcagtccttcccattttaaaagctctttttgttgtcatatagggaaatcattagcattttgagaccaaatgcagatgcttaaaggggatggactacataactctgaraatttgtacctaaagatccaggatacggtgtcattactaagggctttggaggtggaaaatggcattggtttagaggagaaacaatcagtttcagcttcagaaggataattggagataacctgtcaggcagttggaaggtggaactagagaaaaagtgagaaaccataactcggtaagatttagcagtcatgtgaccttgattatttaaccacaaacttagataagatactggggtagcaaagctgagaaatgcaaagagtgaccactgggagataactatggtgaaaaaaatcaggaggg

SEQ ID NO: 162561 - DNA, 601 bp, Human
tcgtagccgggcgcggtggcttacgcctgtaatcccagcactttgggaggccaaggcgggtggatcacaaggtcaggagatcgagaccatcctggctaacacggtgaaaccccacctctactaaaaatacaaaaaattagccaggcgtggtggcgggcacctgtagtcccagctacttgggaggctgaggcaggagaatggcatgagcctgggaggcagagcttgcggtgagccaagattgtgccattgcactctagcctgggcgactgagagagactccgtctcaaaaaaaaaaaaaaaagttgtcatcttcctttgctttagaaaagggtcctgcgggtatgggccctggattagggaattttaggggtagggagtggatcttgcccaaaattttagtatttaccttttaaactcaggctgcctcatttctgaataaactcaatgtattgtgtaacttagaaaattggttaggaaattttattttttataacttctacagaattatattttaagaaacttagatttcgataggtaaggtgctagatatcagcacttaaccagcaaattctgattctgccacctaatagatgtaaactca

SEQ ID NO: 162562 - DNA, 601 bp, Human
ttatttaaatgtatatagggaattgagaggaatttatgaagttacaaacctatgttgaacatatgttcatgtttcgtgtgtgtgtgtgtgtgtatatagtttttaaaaaaatagaaattcttaagtcttccattttatatctgtaactttctacttatcaccaagtcactggcagtggtttttttgttttacacaaaatattttgctgtccaaaatacacttttataatacaattataaatattagttatgtgtttgtacacaaaaattacatcattataaatgtgtacaatgaatgattrtaaacataagggaatatttctgaaagaatgcagactgtctctcatttttatttggggaataattttagatatttttgtcaaggcttatgtttgtgatgataatttctgtaattagctcttccaggtttcccatgtccccccgaccagattcagtgcatagcacaacttcaagcagtgactcacacgacagtgaagagaattatgttcccatgaacccaaacctgtccagtgaagacccagtatgtaaagttttaacttttccctttctgagcagcccttttcagtcattcaagctagaac

SEQ ID NO: 162563 - DNA, 601 bp, Human
gtggccctatattatttaaaacagccctatttagaggtataaaatataaagcccaattctgtcaatgaattggtttttcatccttaatagactttaggcagaaccagctttcttaaaactatatattgtcaggaaacataattcagtgatatgaaaaacttgattttgtgcttaaattaattaactttaaaatattaccaaatttagccaggcacagtggcatgtgcctgtagtcccagctactcaggaggctgaagcaggaggatctcttgagcctagttcacacctagcctgggcaacrtagcgagacctcatctataaaaatttttaaatatcaaatttataaagtattcaaaaataatataatcaatatatcaataatgttttcactgatttttcaaggcagggcaatttttagacacttttgcttttgtattcactatttttcaatttgagtggagttctattattattatttaagttaattagttttcctcagtatagtaagttgactctagtaaaactctaaatcctaaattctcggtcagagtagatattgtcacctattttcaactttgggtagttgagtgaactgttttct

SEQ ID NO: 162564 - DNA, 601 bp, Human
actctagtaaaactctaaatcctaaattctcggtcagagtagatattgtcacctattttcaactttgggtagttgagtgaactgttttcttatcgtaaagtaattagagtattttctgaggtactaaagagtgtgtctttttgcccaaaatagtaaatagccataaaaattttggaaagtcccatataataggaaagtttaaaaatgtgatttgtcatgggtgttagatgaagggaaaagatgaaaaagaagagcattacaatcagaaatcaaaggaaatcaaaatacaatttttttttttacacctaatgacagtaagccagaaaggtgcttttacttgccaccaatagaggtgtctaaataaacacaatgtggtgaatttctttttttttttatttggagacagattctctttctgtcacctaggctggaatgcagtagcgcgatctcaactcactgcagcctccacctcctgggtttcaaatgattctcctgactcagcctctcgagtagctgggattacaggtttgcgccaccacacacgactaatttttgtgtttttggtagagacagggtttcatcatgttgcgcaggatggtct

SEQ ID NO: 162565 - DNA, 601 bp, Human
ttccagagttgtcttcactctgctctctttaaaatcttagcactatttttgtccaaaattttaattctttttaaacccagaagttagtagtattattgctcttattatataaactatgcttatttacgtttttctgcatgtttagcagcttctttatcatttcttgtatttcaggccttccttaggtagtaattttccttctctcttaaatacgttctttagaatgtatgcctttcaggaaggaaaagatcaggctaaggaaattaggtggtaaaaaatccagatgattgaaacaaaatasacttagccaatggagtcaaacaaattttagtgtgaaagcctttagataaaacgtagaaagtttttttaaaatttaacttgaaagcaaggaatataaagatcctgtaaagcataattgagtacagacataattttaataatgttcaagttgggctatcatagctaagtatctcctgatgtctcaatcttagtgtgaaccaagtttaacttttgaaactacgtttagcttgctctaagctaggctttaatcagttttttaaatattacttattttctttctatcctaaaaggttgtttaact

SEQ ID NO: 162566 - DNA, 601 bp, Human
tcaaggctgtggcgtcacgcctctaagcggatacggcagaagttttggggccagacacaagacttccaagtttgaatgggcagcgcaaaacccagacaagttttccggtagtgccgccaacccctgtcaggcacagaagacacagcgagaaccgtgagccgttacgaaagcctaaaacactgagctcgcgtcctgccaagcagcaggcgcacaaacctacacctccgagcgctccctggaggtcccgcccactcttctctcccgagccggctagagatctggaagagggcgggccaagggygaggagggcagtatgcgcatgcgcgctcaggacccagtcagtgagccaataaggaatctcgcgagtgttgaaagtcggtggcgtaggtcgtcgtcctggatgctggcgagatagatgttatcttccagaggaagaggaggaggcggcgaagcgttttcccagcctcagtctctctttcgttttccttttcccttcccccaaccctccgcccttctctaaatcagccggccttccttgacctcagtgacccgtctggccccgcccaccctcgtcgacgtgattcccgccgtgaggtaagcg

SEQ ID NO: 162567 - DNA, 601 bp, Human
agtgagccaataaggaatctcgcgagtgttgaaagtcggtggcgtaggtcgtcgtcctggatgctggcgagatagatgttatcttccagaggaagaggaggaggcggcgaagcgttttcccagcctcagtctctctttcgttttccttttcccttcccccaaccctccgcccttctctaaatcagccggccttccttgacctcagtgacccgtctggccccgcccaccctcgtcgacgtgattcccgccgtgaggtaagcgccggtggaacctagagccccgcggaagagcagaacgtttrggagtgtgcagctcctgggcccggctcaggcccgtcgcggaggcgcggcgcaggggagcgctcgggtgggagtctcgctcctccaccagtttattgcgacgtagcatccaggcctaggcctccccgtccatccccgccggactcgggcctctggcagcagcgggtgacgcagacggaacatcatgtcgtccgcggccgagcctccgccacccccgcctcccgagagcgcgccttccaagcccgcagcctcgatcgccagcggcgggagcaacagcagcaacaaaggcggccccgaaggcg

SEQ ID NO: 162568 - DNA, 601 bp, Human
agcattcatgaattttttttttttttttttttggtgacaaagctgattttcccagaaatagccttcctatgtattcagttactttttttctttttgcttgatactaataggtcaatggagcacttgttttttagttatccttttggcagtgtggaactcttctgtgttcatcctcatctctattgactagattgattaaatagtcacctgtataccaataatgtgatgtcaagatgcctgaagcacattttatttttgtaggttgcatttcatggcattttggaattttgtaaactggacwgggtaggtggctttgtcacttacatatgtagaccagagatttatgatgaacatagggtcacacaagtgccaagggtcttaacaatgaagttagacttgacttaaggtcattttaccttctattccagtaccgtaccagatctcctccccacaactttttggtcacagatagttttattatagcatatattgcctagcatagatttgtgcatcattaatgaagattacttctgccaattttttttaatggatgaatagaactttgcagtgtagaagttgttttttgttgcttgtgacatat

SEQ ID NO: 162569 - DNA, 601 bp, Human
tttatatatatgggttaaatacgttgttatccccatagtatctaatatcattttatcagtttttctgttagcttagatgacagctgtttaagtttctaggaagtttggggtgagaatgtattatttaagatgtgttttggtcagaaattggtctataatggtatgtttactattttcgaagaccaattctatttaattatttctttctaccaggaaatatttgatgatgcgtcacctggaaagcaaaaggaaatccaagaaccagatcctacctatgaagaaaaaatggtatgttctaggyttgtgaatagagtctataaggaaaactttttatcaggtgattaaatgtactaaacatctatcttagtccattttgtgttacaacaataccacagactgggtaatttataaagaaacgaaatttatttcttagagttctggaggctggcaagtccaaggtcaaggccagcatttgttgagggccttcttgcagtgtcattatatggaggaaggccaagagaagagagcaagacaggactgaactttcttttataacaagctcactggtgataacctcctcctgagatactgacagtaatct

SEQ ID NO: 162570 - DNA, 601 bp, Human
ttgcagtgtcattatatggaggaaggccaagagaagagagcaagacaggactgaactttcttttataacaagctcactggtgataacctcctcctgagatactgacagtaatcttttcctaatcacctcttattaggccctacctcccaacactgttgcgttggggattaaattacaacatgggagatttggagggggacacagtcaaaccatagcaatgtctgtttaatttttgtaattatggcacagatatccatttgaaatatgtgtaatatggaatactataacttccatatcttaygtgtctatgtaagccaaatggaagtattatatgaattaacataatatgatgtcattatctagttatgttaacaacacctttaaaaatttaaccttggaagcgaggtgaagaccagaatagttactcagtgtatgtttattctgcacttgactagcattgtactctgctagttaccaaaaaaagaaatatgctccttgttcacagcatttttatattatagatggggtctttacaaaaagaacatgacattatattggagtcattcaagtcccagttcacgttccgtatcttctaagaaac

SEQ ID NO: 162571 - DNA, 601 bp, Human
acccagaacagtatctggcacatagcagatcttacatattttttaaaacatacttttttcttgtcctttgactttctcttccaaatcagtaaatatttttgaatgtcttaaatagcttcaaaatcttaaaattatggtatgtattttatgtgcatgtataatatgcacaatacatataacactatgtaaattataaatgatatatctttaggtttgatttgttatatattttacatatgtatatatgtaactgtcaccttttttgctatcaaacttagagaaaaaatagatttgccgctckgtttttttaaagtgaatactactttgaatacagtctacatattttaatactgctttaaccctttatagtttagattctgacacactctgctggtgaatctaattgccaattctgaggcttagttttagtttcttgatttgtgcttgacattgttgaccattcctcaaaaatcttgacttgccttgaaagacattttttcccgtgataatatcctctttgcttttttattcctttgtccttccttattaaaatttgaacatttcttcctagacagtttgattcttactggtttttacctgg

SEQ ID NO: 162572 - DNA, 601 bp, Human
aatcagttcttgctcccacctccttgccacttctgatctgctttctatcactagttagcatttcatttaagtggaatcatacagcatgtagtcttttgtgtttggcttctttcactttgcatagtgcttttgaaactcatccatgttgcatttatctgtagttctctttttttttttgctgagttcattgtatggaggcatgctgaaactttgatttctgaagttttaattgatactctgataaaatgtatcttaaatttttttttttcagcaaactgaccgggcaaatagattcgagtayttattaaagcagacagaactttttgcacatttcattcaacctgctgctcagaagactccaacttcacctttgaagatgaaaccagggcgcccacgaataaaaaaagatgagaagcagaacttattatccgttggcgagtgagtaatagtttaaacttcatagttcaaccaaacttattttcgatagtcttcagtggaagcataaaatcactatgataaataacttaaaattattttagtgccattatttatttggccctgtttggcttggcatgatttagccataaatgtataagtatat

SEQ ID NO: 162573 - DNA, 601 bp, Human
tgcttttgaaactcatccatgttgcatttatctgtagttctctttttttttttgctgagttcattgtatggaggcatgctgaaactttgatttctgaagttttaattgatactctgataaaatgtatcttaaatttttttttttcagcaaactgaccgggcaaatagattcgagtatttattaaagcagacagaactttttgcacatttcattcaacctgctgctcagaagactccaacttcacctttgaagatgaaaccagggcgcccacgaataaaaaaagatgagaagcagaacttaytatccgttggcgagtgagtaatagtttaaacttcatagttcaaccaaacttattttcgatagtcttcagtggaagcataaaatcactatgataaataacttaaaattattttagtgccattatttatttggccctgtttggcttggcatgatttagccataaatgtataagtatataaaaatacgcataatggttagagcacagtggctcttgcctgtaatcgcagcattttgggacgccaaggtgggaggattgcttgagtccgggagtatgagagcagcctgggcaacgtagggagat

SEQ ID NO: 162574 - DNA, 601 bp, Human
aaaaaaaaaaaaaaaaaaaaagaataaaactgcataacgccttattttttgtagcattatatagtttatgaattgtaacaatcatgttgagtatggaatttagatgtcacgtcattcctcagagaggaaacaaatgcagaggttaagtggcttgtttaacatcacattgaagaatgatccagacttgaatttgaatctgacttgggtgtgctctaggctcctccatcacatacagatgttgacagtattttatctaaagtgtggtgtgtgggatattgtgatgacttacatcacggcagcytgtttaaaatttttattgcatacttagttgtttttatataaattgaagtgtcacgttgtatgccgtcctttggtggtggttgaaaataattcttacatgttgaatttggaaattctctagaattttcattctggttggataaataagatgtttaattagtaatagtagatttagggcagtcttggctccctgaaatggctttgtgtaattcccaaagtgaaaactgtgattagtaattaaaatacaaaagattgtttaaaagaagaagtatcaacaaggttaaattcactacacagtttg

SEQ ID NO: 162575 - DNA, 601 bp, Human
taataccttttatttggggtattccactcattcattatatcttatttctcatccattgtgaccaaagcactattttaatacttacgaaactttgaagggacaattttgcccttcagctgtatttaaaatatttcagacttcagaagtttgcattagtgtcatggcatgaaactggaaactactgtactgaatattgttatgggatagtcagtatgatgtctcgaaaagaaacacttcttttattcttttctattttattattatcctaatttatcttttttataagataaaaaagattctrttggaaatagtaataataaattgttaggcttaatgtattaaatagtgttattagggaaaaaagtcctagttaacagatttctttactcctcaaaccatcttaaatgggaagctaatttacctaaagtaatgagggtcatagtattgtctttgggtatcaggaatacatttttttaaatctttttttgtttgtttgtttttattgagacagagtcttgctctgtggcccaggctggagtgcgtgcagtggtgtgatctcggttcactgcaagttgtgcctctggggttcaagcgattcttg

SEQ ID NO: 162576 - DNA, 601 bp, Human
atgcagagaagtacaaggaataacagactaggatgtactgattatgattagaagcatatataacaaacaagaaggcccttgaatttctgaggaatgcttctatcttggaaggccgcttatccttttagcaagcatgtggttttggtagaaatgaagttacaaattagattcagcggtctcaacagaggcataacgtgcctttttctaaataagatgaaaatatttgttgaaagtgtcagaattggggagtaagtattaatagttttactgaaccaagccctttagagattaattggcagtrttaaaactttagaaaatcagtttttaagggggtagtatatctgattctcttaggatgtagaatttagatgtgtatttaaaaatttttttgatgaatccgtggtcactgcttaaatttctgagtccttatgctgcagcttttgctcgaagttacaattttaaacatgtggtttctggaacttttttttccttggcaaaaagatttttaaaaaggtacactttaaaattcaaataatgagattttctgactacatagttcttgaaatttgactatcatatttgagtttattgggttctggtt

SEQ ID NO: 162577 - DNA, 601 bp, Human
aaatcaggttattttattttcatcttaacagttaccgacaccgtagaacagagcaagaggaggatgaagagctattaacagaaagctccaaagcaaccaatgtttgcactcgatttgaagactctccatcgtgtatgttaaacacacttgatttttttaaaaaattgccctttgagatctcctttggttaatgttttggatttgtgttggctactatttgtgaagcaaatttttagtagtcttagatgtttattggttatgaaataaacttcagattttgatggagatgagagcatattayaggatagtagtgctgtatttcaaagttatataaaatgtcattgtgtttgttattgccctgaagtatatgtaaatctaaggatcgttttgctttatatttgtcccacataagaaaactaatttattttaaaaaaggtacttcatgaacacatttgcttacttctgatgtttttatattaatttaattttttgtgaaatgtatttgtttattggttagctttttatcctcaagtgtttttcaaaaggagatggagggctacactgtgtacatattaaaaaagaaaaatcaggtgaccgttat

SEQ ID NO: 162578 - DNA, 601 bp, Human
tctaaacctgcctcctaagaatttcccgatctagtggaattgcagaaagacattttaagtgtctattgaatttttcactggttaactttgtcagttttttaaaacttaatggttctgacatttaaatgattaatgacgttactttagtcttaggaaagctggttctaaacgtttgcataatatagctagctactctactcctttttagtattcccacctctttttatatactagattacttgtcatcagtaaatgtaatgcgtagtttatttctacgtgatgtaatttttttctcttgttmcacaggctgcttttgtcagagacgttttattaccgggagaatgggatgtatgtgtaacatcttatgaaatgcttattaaagagaagtctgtgttcaaaaaatttaattggagatacttagtaatagatgaagctcacaggatcaaaaatgaaaaatctaaggtaatttgatacttagatgtgaaaagccttcatgtaagaatttgattaaagtacagatttttttttcttttaactttaagttatgagatacatgtgcagaacgtgcaggtttgttaacataggtatgcatgtgccatgg

SEQ ID NO: 162579 - DNA, 601 bp, Human
gacattgcagatgtcccctggggaacaaaattgtgcccctccatgacctaacctttttaacattctttggcatctgttttacttcttcatatattgagctttaatttgatagattgctgaccccactgtcagttttctgtaaacattgtggtaattctaatctatttttgcttatcatttttgctacacctagaatcctttttcctggtctctttactaatacctagtccaagactcagcgacatcacctccactgaaccagccaggctgaggctggcctaggtgcccttctgtgtattcyatctttaacaatctgagcatcctaatattataggactttgcagaggatattgagatgattcacaagtgttttccatactggattgtaagcacaaaggcaggaagcacagatttatttgtctttgtatacctggcacaatgcctagttagagtggatatttgaacagggaaaaaaatttaagttcatgattgttcaaatatttcattataaagtactttaaaattcttaaatattgagagttttgttaaatatttgaaggtagtaatttcctagctacctttgtttcaattcagatggcat

SEQ ID NO: 162580 - DNA, 601 bp, Human
gtctttgtatacctggcacaatgcctagttagagtggatatttgaacagggaaaaaaatttaagttcatgattgttcaaatatttcattataaagtactttaaaattcttaaatattgagagttttgttaaatatttgaaggtagtaatttcctagctacctttgtttcaattcagatggcattcatgcatctaagcactctctttgtatttacttagaccaagggattgtggagtgtatatgtaatcttgggggtagaaaaggaggcagaagaacatgattttttttcatgcattttttyccccttattcctctgctcttggctttcctttagtaaatacgtaggtacatctaggtaaagcaaatgaacaacccattcagcagtatcaaccagatttggtaactctgttttgttcacagggtattttgaaaatgcttatgaagtcagggagaagaggtcttgtagctacctctctactttctcctgctctttactttgaagtttctacagtagcacctgtggtcttataatgaaaggagggtttagaagtcggtatggatgcgcttaggaatgagataactcttatttgatgtattagtt

SEQ ID NO: 162581 - DNA, 601 bp, Human
tattaacaaccccagaatttatgggttgactggatggtttctttgtggattacacttggggttatccagttacatttatttagctggacaatgctagaagagaaccggtggggctaaaggtcttcacttacacatctggcagttgctgccgcctgttgactagggctgaactagcttttctacgtggtgatgttagagaggtgttgctggtatttttcccactaatgtctaatttggtttgtgatatagtcactatttttaaaaaccagtgtaaatagaacagaggtacaaaaaagggtayctttagttgtgtagttaattttaaaacttactgttctatgaaaatgagtgaactactactacatataacatggaaatgtctcattgtttaataaaagaaaccagatataaatgggtgcatattgagtgagtccatgtatataaagttaaaaatgataggcaaaattaatttatggtgtctaaaaataagaatattgcttacccttgggaaggaaaagaggggatagtgattggaagggacacaaaaatgatttctagagtgttctatttgggtaataacatgggtacttttacagtactt

SEQ ID NO: 162582 - DNA, 601 bp, Human
accagtgtaaatagaacagaggtacaaaaaagggtatctttagttgtgtagttaattttaaaacttactgttctatgaaaatgagtgaactactactacatataacatggaaatgtctcattgtttaataaaagaaaccagatataaatgggtgcatattgagtgagtccatgtatataaagttaaaaatgataggcaaaattaatttatggtgtctaaaaataagaatattgcttacccttgggaaggaaaagaggggatagtgattggaagggacacaaaaatgatttctagagtgttstatttgggtaataacatgggtacttttacagtacttgaataaaatttctagaactgtacactcatgatttattgaagtgtgtacttttatattctttccctaagttagtacattaagtttaaagactaaccataaggagatcttaatgagacccttgtccattctttttttttttttttttgagatggagtctagctctgtcgcccaggatggagtgcagtggcgccatcttggctcactgcaagctccgcctcccgggttcacgccattctcctgtctcagcctcccaagtagctggga

SEQ ID NO: 162583 - DNA, 601 bp, Human
ctgtacactcatgatttattgaagtgtgtacttttatattctttccctaagttagtacattaagtttaaagactaaccataaggagatcttaatgagacccttgtccattctttttttttttttttttgagatggagtctagctctgtcgcccaggatggagtgcagtggcgccatcttggctcactgcaagctccgcctcccgggttcacgccattctcctgtctcagcctcccaagtagctgggactacaggtacctgccacctcgcctggctaattttttgtatttttaatagagacrgggtttcaccatgttagccaggatggtctcgatttcctgaccttgtgatctgcctgcctcggcctcccgacccttgcccattcttaggcactgttagacagtctgcatgcaagtaactagttttagacctgaaaggcagcaaattgttgaaaacattttaaaaatttactattgtttttagtattttatggtagtataacaagtatatactcaaacatatacaggcacatctcattaccctttgcagtgcttcacagatactgcatttttaagaaacatttattttgcgaaacaaataga

SEQ ID NO: 162584 - DNA, 601 bp, Human
cctgcctcggcctcccgacccttgcccattcttaggcactgttagacagtctgcatgcaagtaactagttttagacctgaaaggcagcaaattgttgaaaacattttaaaaatttactattgtttttagtattttatggtagtataacaagtatatactcaaacatatacaggcacatctcattaccctttgcagtgcttcacagatactgcatttttaagaaacatttattttgcgaaacaaatagatggtttgtggcaaccctgtgtcaaggaagtctatcaataaacaccgttttccyaacggcatgtgtttactctgtttttaaagcagtaatgtattgctttaaataatgtatcacatttttaaagcaataatgtacttttaaaataaggtgtgtacgttgttttttttttagacataatgctattgcacacttaatagtgtaaatgtaactcttagatgcactgggaaatgtgacttgctttattgaggtagtctggaactgagcctacaatatctctgaggtatgcctttattgaataagtaatggtcttgtattactacccttcaggaacccagtagtaataaattatataca

SEQ ID NO: 162585 - DNA, 515 bp, Human
atatctcttaaagatacgaaatatcactgctatagtattaagtgtgcagattcaagtttgtgtttctctctatattttaataagaatgacatttggaccagtaggtgaatctcctctatgatactatcaaaagcatgttgtaagagttgtcagtgaatgggtttactttttccttttcatacctttttgtagagatagatttttaaaaaatgctktccttgaaagcaaagtaattaaaggagttaaattggtggggaggagtggcaggaacgtggtgggaatactcagatattaatgaaaggtatattaaactctgcagggaaaatggagactattaagtagtctcatgtcccagcactttttggaaggctgaggtgggcagatcacgtaaggtcaagagtttgagaccagcctggccaacatggtgaaaccctgtctctatcaaaaatacaaaaaaagttagctgggcatggtggcatgcacctgtagtcccagttatttggaaggctgaggca

SEQ ID NO: 162586 - DNA, 601 bp, Human
gacatttggaccagtaggtgaatctcctctatgatactatcaaaagcatgttgtaagagttgtcagtgaatgggtttactttttccttttcatacctttttgtagagatagatttttaaaaaatgctttccttgaaagcaaagtaattaaaggagttaaattggtggggaggagtggcaggaacgtggtgggaatactcagatattaatgaaaggtatattaaactctgcagggaaaatggagactattaagtagtctcatgtcccagcactttttggaaggctgaggtgggcagatcacstaaggtcaagagtttgagaccagcctggccaacatggtgaaaccctgtctctatcaaaaatacaaaaaaagttagctgggcatggtggcatgcacctgtagtcccagttatttggaaggctgaggcagaagaatcacttgaacctgggaggcagaggttgcagtgaactgagatggcgctgctgcactccagcctgggtgtcagagcaagactccatctcaaaaaaaaaaaaaaaaaaaattcttatgcatttgaggtgcaggaacgtgtgacaacagcagattgtcagcctctgcttct

SEQ ID NO: 162587 - DNA, 601 bp, Human
tctagaatggatcttcagaaccaggctgagaccaggattattaggtgtgtgttggaggtttggggagtcatatgcattgaagagttgttgtgaagtagtggaaagttatttttaaatgtatatggggtaacaagataatgattatcttaccctttgggatggcaaagccttccagaccagaggcaaatatgcttttctgtacaaatgttacccttttttatttgtgccatggtgagaaaaaagtgggaaatgactgacttggataataatgtgtagatttttttcccccttgtaaccaagyaggtagctttggaattaaggataattgattagtcttagttttggttacccttaaatttttctacttttgaagccactgataatagattgttatattccccaacaggttcacgagtactaatcttcagtcaaatgacaagggtattggacattttggaagattattgcatgtggagaaattatgagtactgcaggttggatggtcagacaccccatgatgagagacaagtgagtaaaatttggggagggagataaaaaagaatcagataaattttttgacaaccattttgttttatccata

SEQ ID NO: 162588 - DNA, 601 bp, Human
gtgcttagtagatggcgttagttaggacaggctaattctacaaatatcagtgacttaacccaatagaattttatttttctctaatctaatggttcagtgagagtatattgaggtgatcttccatctaaataagggtatttccatctcagggatctgccatatcttaggaccctggagtcctctgctatactgcatcctattggcagaagggggaaacgatagagttggggatttcccaggaaattctttatgggtcagaccttgaaagagcctccttgtctctccacccccttgatcaaasaattagacagaactcaaatcatgtagcataactgactgcaagggaattggtaaattatagtatagttatatcacaggaccaaagagaattgggtttgatgagcaactagcctgtcttccactttagttatttaaaagaacacctgtgtgagagtacctggtcagatcaggaagattatttttagattgagagaattgatactgcagattggcctgacccatgatattggtgaccacaaacccaactttaatctctgtcattagtcactttctttttttttttttttgagatggagtttcg

SEQ ID NO: 162589 - DNA, 601 bp, Human
agagcctccttgtctctccacccccttgatcaaagaattagacagaactcaaatcatgtagcataactgactgcaagggaattggtaaattatagtatagttatatcacaggaccaaagagaattgggtttgatgagcaactagcctgtcttccactttagttatttaaaagaacacctgtgtgagagtacctggtcagatcaggaagattatttttagattgagagaattgatactgcagattggcctgacccatgatattggtgaccacaaacccaactttaatctctgtcattagtcmctttctttttttttttttttgagatggagtttcgctcttactgctcaggctggggtgcaatggtgcagtcttggctcactgtgacctttgcctcccaggttgaagtgattctcctgcctcagcctcccgagtagctgggattacaggtgtgcgccaccacgcctgactaattttgtatttttagtagagatggggtttcaccatgttggtcaggctggtctcgaactcctcaccttcaggtgatccacccaccttggcctctgaaagtgctgggattacaggagtgagctactacaccca

SEQ ID NO: 162590 - DNA, 601 bp, Human
gatttacagatgcccgccaccacacctggctaatttttttgtatttttagtagagacagggtttcactttgttggccaggctggtctcgaactcctgacctcaggcgatccacccacctcagcctcccaaagtgctggattacaggtatgagccaccacgcctgtccaaaacactttttttaaagataaaaaagaccttaattgattcataattaatttagaaatcttgaggtttttttacttcatatttactgtggcaatttttggagcaaaccttcaggctaatagctttcttgtgccrtttgtagacatgttagtcaaacagcaagccttaagtgcatacctttgtgttactgttttttatttgagggacataattaaaaacgagagtacacaagcactttacatctgaaggttccggaaccttcctgcccaacttggaagtagtttgtataagcataagaacattttggtagcaatggtagcatccaatccaaggaaacataccttgtggatatctcctcacttacaaagtcatggatgtttggctgtatatcctattatgggtcccaaaccatgatacaagtatttaaagaagttg

SEQ ID NO: 162591 - DNA, 601 bp, Human
attttcatcattatgtaaaatttaatgccagtttttcagttggtaagctctgaaatatttttaaagtttttgtaatgaagtttgtggtatatgtttacagtgaaatatattcttgtatgggatgaatagtaatttgggatggtaacctgattcattttattttaaacagcagaattggctggtaataaagggaaaaatttcttaacttcataagtaatacttggtaatatagagataaattgaaaaatacccagagattagaagaaaaaaataattctacccagtgtttttcttgttaatrtttaggtctatatcttcagaattttttgtaggctaattatgtgtctacatttttctcctagtttagatttataccaaacattctgtagcatttctccctcatttaacagttgttcctttaagcaagaaatactgaatgcttactctgttgactagacactgtctcgtgttaattatatacataatattgagcaaagtatcatagtctccaccctcatagagcttatagcccaggattttgtgaatatctttacatttacaaacatccttcttgatgatgatttgttactgtgtataataa

SEQ ID NO: 162592 - DNA, 601 bp, Human
gaagctgaatcccttaatgatgaagagttagaggaaaaagagaagcttctaacacaggtatagcctttaatcagtacaaactttagtaacagtttgttgtaaaggactgtgttaggttatgttggggcataaaaataaatacaagtttctgcttttaaagatggaataattggagacaataaagtatgggcatgtggataaatgctccatctgattgtcactagttgaggtagttgagaagactacagattttattactctggctcggtagagtgggtatcttttttatcaccttactttraatgttcccgtctttcctatgaattttccacattgctacccagtcaccattttcaactataaatcttggcttggttattttttaaacatcctttggtgttcatcaaggtctttcagaatctggcctttgacttacctttaaagcttcattttccttccatttttctacttgctcatatttttgccctttatgttattcactctttctggccaactgctagtaatccttcaaagctcagtgaaactgtcaccttttcatacagtattccttactctcagccactcatatttaattgcttgg

SEQ ID NO: 162593 - DNA, 601 bp, Human
aagcatcaagaaagcacttgacacaaaggtaatttgcttgttaataagttaggtagttaataaaataactcctagctgtgagtatgagagagtgactttttataaaggaaaagaagtaagggtttacaatttaaaatttcttcagagtagcattcaaacatggtattgtcagcagaatttacctatacactagactgatagatctgagtcaaagacactaagattagctttttactaagtagaatcaggaagtcttagtctgtatttctctttataataataaagactataaaggtctttygggacaaagattatataaagcaattgaagtgctctagatagaaaattctgatttgaaatgcaacattttagctaattatactaaagctgagtttgaaatacagattatataggatttgtattttatataatataaaatctgactttcatagattggacggtacaaagcaccttttcatcagctgagaatatcatatggtactaacaaaggaaaaaactatactgaagaagaagatcgttttctgatttgtatgcttcacaaacttggatttgacaaagaaaatgtttatgatgaattgcg

SEQ ID NO: 162594 - DNA, 601 bp, Human
aataaagaataattttatagtgattgtaacaagacagtgccatgttaatttaactagtacagtaccgtaatttaaaactgtgttacttcttaacatgttccatgttaagatgcacaaaaaatgataatgtattcttctatctctatatactatttctaagtcttgtgtggtgtattctatacagtagtattttaaaattattttactgtagttgtgtgtgtagtagtatcacttactataagaaaaaaataattttgctctataagaaagggggctgctacccagcagccgtccgtgcagrtggacttctgtttctttcagggttaactgctacttctatgttatactttaaatcttttctggaggctgtatgtccagtttgccagagagagatgaggtagaactcatcgtagacttccatggctggttttccaaaattgggaaaggtgccatgtgattgattgactaccataattctagtgatactttgaagggaaagattatacacacctgttaaagttcttgttgtttttgaccctcacatatgtgcactattaatctttttaagttttggatataagtagcacagtagttctcagac

SEQ ID NO: 162595 - DNA, 601 bp, Human
aaacttgtggatggaaagtgcgtgtaccatgtttgtttataatttaggagctccagaggagatgtaataccttaattactttgattgaaagagaaaacatggaactagaagaaaaggagaaggcagagaaaaagaaacgaggaccaaagccttcagtaagtattcatgaatatgtaaatatgtggattatgtaaatttcccctttctaagtatttaacactgcttggctgtcattgatgtgttagtccctgttgtgcacccctccattgcctttactttttttttttttttttttttcctkaagggagaacccaagctcataatttgagattcttccactttcaaatttaggtagtggtataatttttaatttttagttgttatgagtaagtatgtatttataggttacatgagatactttgatacaggcatgcaataagtaataaggacatcagggtaaatggggtatttatcacctccagcatttatccctgttacaaacagtttaactcttagttattttaaaatgtataattaaattatttattgcggtagtcactgtgttgggctatcaaatactgggtcttagtctctctttgta

SEQ ID NO: 162596 - DNA, 601 bp, Human
gagatgtaataccttaattactttgattgaaagagaaaacatggaactagaagaaaaggagaaggcagagaaaaagaaacgaggaccaaagccttcagtaagtattcatgaatatgtaaatatgtggattatgtaaatttcccctttctaagtatttaacactgcttggctgtcattgatgtgttagtccctgttgtgcacccctccattgcctttactttttttttttttttttttttccttaagggagaacccaagctcataatttgagattcttccactttcaaatttaggtagtggyataatttttaatttttagttgttatgagtaagtatgtatttataggttacatgagatactttgatacaggcatgcaataagtaataaggacatcagggtaaatggggtatttatcacctccagcatttatccctgttacaaacagtttaactcttagttattttaaaatgtataattaaattatttattgcggtagtcactgtgttgggctatcaaatactgggtcttagtctctctttgtatttatttgtatccattagccagccccactttcccccacccccactgcctttctcagcc

SEQ ID NO: 162597 - DNA, 601 bp, Human
gtggtattatgacttttactgttagtctctaagctttgattatttcagtgatgttttagcaatgtgaaggcaaacacttaaagggaaaaaatgttatttaataatagttaatttaataaaaaatggttaatttataaagtcatgaataaatgagtatctctggataatatttggtacttatgtaactgccttttaaaaactcaagtgtttcttactattttgggaagcttgcatttatttgatattgatctactactgttaattgtgcattagttttataacgtcattattaacattaacrttttttattctgtaagtaaaataagtaggtaagattatttggaggctttatagtttgctttgaaagatttatatagcctgggggaaaagtctcatacctattactttgtagtagttgttattactaaagtgttataatgtgtctgcaactatatttcatgtttatattagtcttgtgaaaagtaatccttctgtctgtttgtagacacagaaacgtaaaatggatggcgcacctgatggtcgaggaagaaaaaagaagctgaaactatgaatatgtttttgtttcataatcactaacttt

SEQ ID NO: 162598 - DNA, 601 bp, Human
cagtaaagaaagggtctgaacagtggataacatgttgagaggttaattattaatgggcagtcttccctaacaaagtatctaataggcattgtggtctctttggcttcagaaattaccaagaaagcctggaccccgggtgaaacggagaaatggacacaagtcccctgtgtttctccattctgttggttttatgcatctttatccaatcaagtgcccttggacaaagcctgaaaccaggtaagagcctgacttttctccagagatgggcatgaacttttctttttaaaacgtgtgtcacaargaatccaggggtttctgactgtatgggacagagcttgcttcagagcgtgccaggtggttctatacacgacctcacaggttcacagggacacgtagccgtttgtaaacagaaatgaaattttagaaaatcatcctcggattaaaagtcttctaagagtgcctgcagctagcagtgaagtctcttgcgtatctgatatggaaacagtcatgctaaaagttattcagcggcaaatgatatgaaagcgattcagatcttcctgagagttaatgtggcatctaatttgcaaccggggagccaggc

SEQ ID NO: 162599 - DNA, 601 bp, Human
atgggacagagcttgcttcagagcgtgccaggtggttctatacacgacctcacaggttcacagggacacgtagccgtttgtaaacagaaatgaaattttagaaaatcatcctcggattaaaagtcttctaagagtgcctgcagctagcagtgaagtctcttgcgtatctgatatggaaacagtcatgctaaaagttattcagcggcaaatgatatgaaagcgattcagatcttcctgagagttaatgtggcatctaatttgcaaccggggagccaggcttgcaatgaaatgctctgtcggrttggggttgtctaattgcctgcctctctcagaagagaggggaatttatgagagttctatttccagtcaggtctaaagtagagatatcattgcacaatttctagactttgttttgctgccaaaattttagtctgaggctgaagaatccaacagccgtcctgcctgttttgtttgtaaattcacaaactagattgatggcgaaagacagatcaaatgccttatcaggaaggtagtagagtggagcccagcttccaggctaagcagtggaccaataaatgacggatcagttaattgaacaatt

SEQ ID NO: 162600 - DNA, 601 bp, Human
gaaatgaaattttagaaaatcatcctcggattaaaagtcttctaagagtgcctgcagctagcagtgaagtctcttgcgtatctgatatggaaacagtcatgctaaaagttattcagcggcaaatgatatgaaagcgattcagatcttcctgagagttaatgtggcatctaatttgcaaccggggagccaggcttgcaatgaaatgctctgtcgggttggggttgtctaattgcctgcctctctcagaagagaggggaatttatgagagttctatttccagtcaggtctaaagtagagatawcattgcacaatttctagactttgttttgctgccaaaattttagtctgaggctgaagaatccaacagccgtcctgcctgttttgtttgtaaattcacaaactagattgatggcgaaagacagatcaaatgccttatcaggaaggtagtagagtggagcccagcttccaggctaagcagtggaccaataaatgacggatcagttaattgaacaatttggccagactagacaggtgtttgggaatttgttttggtactggttactggtcaggagctagtaacgctaaggtagagtctgagatt

SEQ ID NO: 162601 - DNA, 601 bp, Human
cctgcagctagcagtgaagtctcttgcgtatctgatatggaaacagtcatgctaaaagttattcagcggcaaatgatatgaaagcgattcagatcttcctgagagttaatgtggcatctaatttgcaaccggggagccaggcttgcaatgaaatgctctgtcgggttggggttgtctaattgcctgcctctctcagaagagaggggaatttatgagagttctatttccagtcaggtctaaagtagagatatcattgcacaatttctagactttgttttgctgccaaaattttagtctgagrctgaagaatccaacagccgtcctgcctgttttgtttgtaaattcacaaactagattgatggcgaaagacagatcaaatgccttatcaggaaggtagtagagtggagcccagcttccaggctaagcagtggaccaataaatgacggatcagttaattgaacaatttggccagactagacaggtgtttgggaatttgttttggtactggttactggtcaggagctagtaacgctaaggtagagtctgagatttttcttttctctaagactagccttggagagagctccgacaactttgagaa

SEQ ID NO: 162602 - DNA, 601 bp, Human
atcctcaatgagttctcacaaactgaaccagtaccccaaagccttccttgtgtgccccttgagccttaacatatatgattttttcctttggggagatttttcattaatagaaacacatcagttgctcttttgcgtctggcttctttcgttcgacattatgtttgtgaaagtcaaccatgcagtttcgtggagttgaggctcattcattctcactgctgtagcattccactgcgggaccatgccacacttcctttatccattctactgtggattggccaggactgtttttgcaatggagccrtgggaattggaagctgtcagtgctgagatagaggttgaagggagggatggcctcccccaggcttctgggtattgtccagattttccttgagcaatctcattgtcctgatcagcctgcttctttccccggggcctagtttgtgcaaatgctgagagaagtggccactattagcaagagggttcctcagaaaagaggatccaagtcaggaggcctcttgttctcttggaagcagaatctcttggcagaattctttctgcaatgagtgagcccaatctgtgtgcatgtggctggtatgatgtc

SEQ ID NO: 162603 - DNA, 601 bp, Human
ccggtgtcctgtggtggagcccttgtcaggaaagtttctacaccaatggttctcaacaggggcaattttgccctccaggggacacttggcaatgtctggagacatttttggtttttggttgttaagaccagggagagagtgcttcccttccagcatctagtgggtagaggccagggaagctgcttcacatcctacaatgcacaggacagccctcacaacaatgaattgtctggcccaaaacattattagtgcagaggctgagaaaccatgatctatgccaagcttcaactgtcactcatcsagcaccaggaagtactccctcaaggacccttcctctttagcccctcctcccagcctacttcttttgagtatttattattaatgacatcttactaatggagtcactaatgtgctgcacacccagcatgtgccaggcactccacggacattttatctcatcctcaccatatggttgagtaagctggcagttaagtgccttgccggcggtcgcatagctggtcagggcagagcagggagaggtacctgcagcctcaatctgtctactgaggccgcagtgctctctgtcgagcccacacccagt

SEQ ID NO: 162604 - DNA, 601 bp, Human
aatcactgaggaccccaaacagtgtttattatgtgagatatcaatatttccttcattagaaattaaaactgagaaatccttaaaatctgctaacactttttaaaatgataataaacccttgcatgttaacacatataatgtaattttatgaaaaataacttgtattttccaaataagttttaaatggagaagagtgacattgttttacaaagaaatgttgcaaatctctctaatatctggcttcccaagacagctggattatcttacctgtttctgtactcagtctgttgtgatgtattgytttgtttgaaatgtaggaagaaaatctggcctcccatagaggaaaagggaggacatcctaaggcgatctccctggggccttggcctgcaaaccactgcgcttgtgcagtgggcactgtacaacagggggctgcacagccgtccccaccttgcaggaatttacagtcaaatggggtgggagtggggtggggagggaatagggggccatgggactgggtggaggggggatgtgccatcaataaaagagcaaccgtctgtggagaatttaaatacaaatataaccaaaagctgatctgcctgt

SEQ ID NO: 162605 - DNA, 601 bp, Human
tgtgcgctggcccccaggacagtgaccagtttcgagtggggcgctctcagctgggaaatggggtccaacccaccagggaaaagggctgactaggggccaataggaccctccagatccctgcccagcaggctggacttcagtcccaaggtgataactagaacaagggggccgagcctagtctgtccagcagcgggtggaggagccgcggtaagaaaggcagtcgggtcttacattcaggtacctacttggggcgagaagaccaaatccagtcactccagccctggaggagtcagggcgcccrcccggctgccccacagaaggtgcaattcctaaacatggtcacaaagtagcgcagtgacatctcagctgcttcggagttccaggagagggtttctggctcaggagaatggagtttctgggtgactggaagatgaggctgttggctaacttccctttccttcccacttaggggtctatttccagaagcattcctcatttcattttttccccagtggggcttggctaggggtggggaggcatggggaaaaagtgaagagaagagaacgaaatgcatggaatgcaagcggaggcctctttgtct

SEQ ID NO: 162606 - DNA, 601 bp, Human
aaatgcatggaatgcaagcggaggcctctttgtctacagcgttttcacctccacttgtgcaggttcatattcagggcctggtgaagtcagttctggcacggctctccagtggactggcagtggcccttaaaaatagttctcaggaagatgtgtaggtggcgacgctgagtagtgtttatgtcccaacatgaagagcaggcctcattgtgtgtgtcctgtgattacaactgtgtgaaaatacatgtgtttgagaaaaaatgctggaagaagatgcatgaaaatgtttatacgtccgttgagyttgtatctgaacttttgtctcttcccctctttatgtaatgttatagtatgtatatggtatattgactttcatgatttaaataatcagaaaataaatttactacgaaatgatgaaataaaggagtttgactagatcagtgatcctggaactgtagtgggtaatgaagcacctaaaaggctgctttttttgtttgtttgtttttcctgagacggagtcttgctctgtcgcccaggctggagtgcagtggcacagtcttggctcgcagcaacctctgcctcccgggttcaagcagttctcctg

SEQ ID NO: 162607 - DNA, 601 bp, Human
aaacctcacttcacttctaactttctagggttgaaggggtgagaatcaacatccactgctcctggatactgacttcttccccagtagctacaaccccaaaagtatttaaaaccccaagatatttgtgaaaatgtatttgtccaaaataaaatatctacatgctaaaaagaaagcagtccttgaaatgaacaaaaattcccaagctgagcattacttgtaattggtagaaaaataatcattgcaaaagctaattaaccatccaccctgagcggctccttggcaggcctgaaaatatgatcargaaaattcttttcctatgagtgaggcattatcaaagcagggcagagcctatgggttatccgttgactaggactgacctttccgtgactgccaaaaactttccagtgacaaatgttccagcttccttgtcccaagagaaactaaagtggtaagaaaacaaactgctttatactgaaacataacaagatcaacagcagctgtgacagcatttattaaactgtccgctgtgtaccaggccccatggtcagtaggaaagtatatccctgagggtacaaaaatgaaaaagcgtacatccactcac

SEQ ID NO: 162608 - DNA, 601 bp, Human
gtttttaaaaggctgcctttcccagatggattgatagacttatctcagcctggctaaaaccctggccactccctgatagagaacaaggttcccagcaggcaagggcaggggtggggcccagcagggaccagttttgcaagctcacctggccctacacccgcaaacactcagcttttcctccaagacaagcctcaaggcttggagcaagtctctttgaagttttcttatgaattgctatgcttaacactaaatcatgggaaagattaacacccatgaaactgaagcaggagcacataacagragcttaatatgaatcttccatcttaaaaatatcttattctacatctgaaaagagaaccatttggaaattccacgtcatactcacttatagacttaacagcaatttcaactttaaaaattcattcccacctgcattatatgacttgattcttacagtagccctgtaaagaatattgggtaggaattcttattcccattttagagacgtaaacattcaccatccgcggaccatggggaacacagctgacatcaattgcaagtcagtttctgtggtttactgcagcaagggagagctcactcc

SEQ ID NO: 162609 - DNA, 601 bp, Human
gacggcagagctggtttttgttgctgtgctgtgttttcgtgtagtctctcccaaagggacttggggaatgcgtttgaggtctcttaatacctatgccctagctgcacagctttgggtgatgccctttacctccttacctctgatctctcaggagtaatagtgtcccttccacactgacattctgggtgtgaatgggactgattagaatggtcatcgtggtgccaggagatctgcagtggtgaccttccctggtatcagctatttaaatattatcaggaaagagaaatgtggaagcaaagtyctatccattttaagcatgtgaccttttaccctaactgaaccttaattgactcatttgcctctagcaattcaaagattcccagacacccggaggacaaagatgggattctgtaagaacagcccacgcagtcaatgacccttatgccatttcttgcccggaactgttttattcagggcctgacatgcagcagtgtttgattaagtgctgacaatgaaaataggtatttgatgctgtttggaagaaaactcttacatttcttgaattgaactaagatgtacagaacaacagaaaccattattt

SEQ ID NO: 162610 - DNA, 601 bp, Human
atagtgtcccttccacactgacattctgggtgtgaatgggactgattagaatggtcatcgtggtgccaggagatctgcagtggtgaccttccctggtatcagctatttaaatattatcaggaaagagaaatgtggaagcaaagttctatccattttaagcatgtgaccttttaccctaactgaaccttaattgactcatttgcctctagcaattcaaagattcccagacacccggaggacaaagatgggattctgtaagaacagcccacgcagtcaatgacccttatgccatttcttgccyggaactgttttattcagggcctgacatgcagcagtgtttgattaagtgctgacaatgaaaataggtatttgatgctgtttggaagaaaactcttacatttcttgaattgaactaagatgtacagaacaacagaaaccattatttttaagaatatttaaatgtgccaagttctttgcctatttatgtcaatgaatccagaaaaacaccctgtgagataggtattatccccacttcacagatggggaaattgtggctcagagtgttgcaaactctccttagaccactcagctaataatttcc

SEQ ID NO: 162611 - DNA, 601 bp, Human
actgtgcctggccgagatatcccattttggataggggagcctgggacatattctcaacttccgtgggtctggccactacttatcagaagtttctgctcaccttacacaactgtgagtgatggccaggagcagcctcagtggcccaaggggaaaaacctctggatgaagccctggacccctcacatctcagcctccatcactgcccctggctacccaaagtcaagcccagaaacacagatgtgagcacaaacccaggcagcccatagaaggcacagccctgtgatgtcaagcttaaaaattytgggctacttttaaggtcaccagggatatttcgaaagagctgaagctttttcctccatccaagaatcctctatcttccaggttgtttttatgagctgaagaggaccctccacggctcctcggtgacttagtagtatcaagacaacacctgagaaagctcctttcatgcaaatctctgtctcacgcatgtgaagagaccaccaagcaggctttgtgtgagcaacaaggctgtttatttcacctgggtgcaggcgggctgagtctgaaaaaggagtcagcaaagggtggtggattatcgtta

SEQ ID NO: 162612 - DNA, 601 bp, Human
ggagcagcctcagtggcccaaggggaaaaacctctggatgaagccctggacccctcacatctcagcctccatcactgcccctggctacccaaagtcaagcccagaaacacagatgtgagcacaaacccaggcagcccatagaaggcacagccctgtgatgtcaagcttaaaaattctgggctacttttaaggtcaccagggatatttcgaaagagctgaagctttttcctccatccaagaatcctctatcttccaggttgtttttatgagctgaagaggaccctccacggctcctcggtgrcttagtagtatcaagacaacacctgagaaagctcctttcatgcaaatctctgtctcacgcatgtgaagagaccaccaagcaggctttgtgtgagcaacaaggctgtttatttcacctgggtgcaggcgggctgagtctgaaaaaggagtcagcaaagggtggtggattatcgttagttcttacaggttttgggataggcggtggagtttggagcaatgttttgcgggcagggggtggatctcacaaagtacattctcaagggtggggagagaattgcaaagaaccttcttcagggtgggg

SEQ ID NO: 162613 - DNA, 601 bp, Human
attctgggctacttttaaggtcaccagggatatttcgaaagagctgaagctttttcctccatccaagaatcctctatcttccaggttgtttttatgagctgaagaggaccctccacggctcctcggtgacttagtagtatcaagacaacacctgagaaagctcctttcatgcaaatctctgtctcacgcatgtgaagagaccaccaagcaggctttgtgtgagcaacaaggctgtttatttcacctgggtgcaggcgggctgagtctgaaaaaggagtcagcaaagggtggtggattatcrttagttcttacaggttttgggataggcggtggagtttggagcaatgttttgcgggcagggggtggatctcacaaagtacattctcaagggtggggagagaattgcaaagaaccttcttcagggtgggggagattacaaagtacattgatcagttagggtggggcagaaacaaatcacaatggtggagtgtcatcagttaaggctattttcacttcttttgtggatcttcagttgcttcaggccatctgggtgtatacgtgccagtcacaggggctacgatggctcagcttgggctcagag

SEQ ID NO: 162614 - DNA, 601 bp, Human
cagggatatttcgaaagagctgaagctttttcctccatccaagaatcctctatcttccaggttgtttttatgagctgaagaggaccctccacggctcctcggtgacttagtagtatcaagacaacacctgagaaagctcctttcatgcaaatctctgtctcacgcatgtgaagagaccaccaagcaggctttgtgtgagcaacaaggctgtttatttcacctgggtgcaggcgggctgagtctgaaaaaggagtcagcaaagggtggtggattatcgttagttcttacaggttttgggatrggcggtggagtttggagcaatgttttgcgggcagggggtggatctcacaaagtacattctcaagggtggggagagaattgcaaagaaccttcttcagggtgggggagattacaaagtacattgatcagttagggtggggcagaaacaaatcacaatggtggagtgtcatcagttaaggctattttcacttcttttgtggatcttcagttgcttcaggccatctgggtgtatacgtgccagtcacaggggctacgatggctcagcttgggctcagaggcctgacagtctccttcctgcctg

SEQ ID NO: 162615 - DNA, 601 bp, Human
aggaccctccacggctcctcggtgacttagtagtatcaagacaacacctgagaaagctcctttcatgcaaatctctgtctcacgcatgtgaagagaccaccaagcaggctttgtgtgagcaacaaggctgtttatttcacctgggtgcaggcgggctgagtctgaaaaaggagtcagcaaagggtggtggattatcgttagttcttacaggttttgggataggcggtggagtttggagcaatgttttgcgggcagggggtggatctcacaaagtacattctcaagggtggggagagaattrcaaagaaccttcttcagggtgggggagattacaaagtacattgatcagttagggtggggcagaaacaaatcacaatggtggagtgtcatcagttaaggctattttcacttcttttgtggatcttcagttgcttcaggccatctgggtgtatacgtgccagtcacaggggctacgatggctcagcttgggctcagaggcctgacagtctccttcctgcctgcgacacaggtctaggaattattccacagttgggcactcttggtgtattattgttcatgccctggcccccacctttgtgcc

SEQ ID NO: 162616 - DNA, 601 bp, Human
cacaggtctaggaattattccacagttgggcactcttggtgtattattgttcatgccctggcccccacctttgtgccgcatagagggactccccttcctgaggttaatgattgggaaggtgttaaagcaggaagaactgcaagaaggcactcgtgagtgagcctatccactcattcctggaagataaacaaacgaccagtgtggctctccatactcagagggtggtttctggatgtcagagatttcgccacacaccagctctgtgccaggccttgtgctaggaccccaacatggtcactcratattcacacagtctagcagtctgccaggactgccaggacagaggaccacagactgggtggcctcaacaacagaaatgtattttctcacagttctggaagtgagaagtctgaggtcaaggggtcagcagggtgggtttcttctgaggcctctctccttgtcttctgatggctgcgtctcttctgtctgcacacagtcttctatgtttctgtgtccgatctcctctttttataaagaccccagtcatattggattaaggcccaccccagtgaccttatttcacccaaatcacctctttaaa

SEQ ID NO: 162617 - DNA, 601 bp, Human
ttgggaaggtgttaaagcaggaagaactgcaagaaggcactcgtgagtgagcctatccactcattcctggaagataaacaaacgaccagtgtggctctccatactcagagggtggtttctggatgtcagagatttcgccacacaccagctctgtgccaggccttgtgctaggaccccaacatggtcactcgatattcacacagtctagcagtctgccaggactgccaggacagaggaccacagactgggtggcctcaacaacagaaatgtattttctcacagttctggaagtgagaagtcygaggtcaaggggtcagcagggtgggtttcttctgaggcctctctccttgtcttctgatggctgcgtctcttctgtctgcacacagtcttctatgtttctgtgtccgatctcctctttttataaagaccccagtcatattggattaaggcccaccccagtgaccttatttcacccaaatcacctctttaaagactctggctccaaaagcagtcacattctgaggtactgagggttagaacttcaatgtatgaatttgagggaacacaaagttcagcccattacacccagcaaacactttgc

SEQ ID NO: 162618 - DNA, 601 bp, Human
agtgagcctatccactcattcctggaagataaacaaacgaccagtgtggctctccatactcagagggtggtttctggatgtcagagatttcgccacacaccagctctgtgccaggccttgtgctaggaccccaacatggtcactcgatattcacacagtctagcagtctgccaggactgccaggacagaggaccacagactgggtggcctcaacaacagaaatgtattttctcacagttctggaagtgagaagtctgaggtcaaggggtcagcagggtgggtttcttctgaggcctctctycttgtcttctgatggctgcgtctcttctgtctgcacacagtcttctatgtttctgtgtccgatctcctctttttataaagaccccagtcatattggattaaggcccaccccagtgaccttatttcacccaaatcacctctttaaagactctggctccaaaagcagtcacattctgaggtactgagggttagaacttcaatgtatgaatttgagggaacacaaagttcagcccattacacccagcaaacactttgctaggccctgctgtgacccgggtcctgggcttggcactgggcatac

SEQ ID NO: 162619 - DNA, 601 bp, Human
ggaaactgcaaatctctctttgttctatttgagcttcagcaactctccggaagccttccgcgttagaaaaaaggcttacaaatacacaggaaatttgaaagtgagtagtaagtccacaccaggcccagacagggggcctgtgctgaaaggtgcaggaagcagcagccctgctgagacacacaggagccggctggccggccgctagcagggtgggatggggagtgggggctcagggagcctgggctggggagaggcatccgccctcttcaacagaatgattgggactttctggcagcataarcaataaccggcaggagaccaagaaggcgccgtttagctggctcatgtgtgagtgagtgatgaaactcaccctctggcttggcgccttatggaactatcaactctgcatgggtgtgctcagtgtggaccccaaacctgctccctctggctttgagaggtatttctcccatacaggctggcttcagccagggggttgcctagactcgcccaggcctcagacgaggggaaagggccaaggccggctgccactttctcatcatgtgcctgcctcccttcccaaatagaagggtcaagcccaaat

SEQ ID NO: 162620 - DNA, 601 bp, Human
gaaactgcaaatctctctttgttctatttgagcttcagcaactctccggaagccttccgcgttagaaaaaaggcttacaaatacacaggaaatttgaaagtgagtagtaagtccacaccaggcccagacagggggcctgtgctgaaaggtgcaggaagcagcagccctgctgagacacacaggagccggctggccggccgctagcagggtgggatggggagtgggggctcagggagcctgggctggggagaggcatccgccctcttcaacagaatgattgggactttctggcagcataagmaataaccggcaggagaccaagaaggcgccgtttagctggctcatgtgtgagtgagtgatgaaactcaccctctggcttggcgccttatggaactatcaactctgcatgggtgtgctcagtgtggaccccaaacctgctccctctggctttgagaggtatttctcccatacaggctggcttcagccagggggttgcctagactcgcccaggcctcagacgaggggaaagggccaaggccggctgccactttctcatcatgtgcctgcctcccttcccaaatagaagggtcaagcccaaatt

SEQ ID NO: 162621 - DNA, 601 bp, Human
tgctactcccagtgtttttctctactttttattacaaaagtgttcaactacagaaagaagtttaaaggatacaatgaatttccatattccctccagatagactcaataactgtttgcattttcgtatatttgctgtatgtgcatatttatatgtgtgtgacttgtaaaaccagttgagataagagggggaaaggaagagagaaaaagacacacacatacatatcccatatgaaagttgtggacatcatgatacttcaattctaaatatttatacgctagtatttctttctttttttgagayagagtctcactctgtcacccacgctggagtgcagtggtatgatcttggctcactgaaacctccacctcctgggttcaagcgattctcatgcctcagcctcctgagtagctggaatgaatgcctcttactaaggacattctcctacatagccccagtaccatcaccacacctcagaaaattaaaaataattttatactatccaatatccagaccttactccaattttcccagttgtcccaagatagttgttgatagcgtttttcagactgggatccactcaagatcctcctgttgccctgt

SEQ ID NO: 162622 - DNA, 601 bp, Human
ccgtcccatggcctcttgcggacctctctcccatggcgctggctccttgcacccagctatctgcttgcacacctctctccctgctggaggataagcaccccaagggcagtggccagtcttagctactgttgtttccccaggacccacacaggcctggcatggagcaggcacgtggcaaatgactgttgcatgtttgaatcttcatcagagggctaagcaacacacacctttaaaaagtgagtgagttttggccaggcgaggtggcttatgcctgtaaccacagcactttgggaggccagargcaggcagatcacttgaggttaggagttggagaccagcctggccaatatggtgaaaccccttctctactaaagatacaaaagttagccaggtgtggtggtacgtgcctgtagtcccagctacttgggaggctgaggcaggagaatcactcaaacctaggagggtggaggttgcagtgagccgagattgcgccactgcacccagcctggacaacagagctagactccatctcaaaaaaaaaaaaaaaaaaaaaaaaggaaatgagttttaagtaatttcatctgacaaattctgtacccct

SEQ ID NO: 162623 - DNA, 601 bp, Human
gccaaaaggtttctaagcagtttccaagccgtttcttgcagttttcccatcaagccaggtgaaggcaagtgttatgtccccatcagggtcccccagccccctcttcttagctcaggactggggctttctggggctcacctacagtcttcctcctttccttcctaacttcacacgcatttatcaagcacatactctgcatcaaacctgtgctcaaggacagggaggcaaaggtcaataagatgcactccctccctggggaggagacctaaaacagaccgcaggtgccctgctgcgtggctgkctcaggctctcagagtgtgaaggagagcacctcactcagcactggcagaggccggcaggcctaagtgggccttcaccatatgccaggcctggctaggagcttccctggaagattccaggtgacgcccagcaaccctcaaaggaaaatgctagtattgtccccattttaaaaatgggaaaacaggcttaaaaagtcagatgtctggcccaacatcacacagctaatatggattcagtgaaatatatgcaaaaatactcagcagagtggcaagtagtaactaaacggtaactaaaatacctt

SEQ ID NO: 162624 - DNA, 601 bp, Human
caacatcacacagctaatatggattcagtgaaatatatgcaaaaatactcagcagagtggcaagtagtaactaaacggtaactaaaatacctttttcaaatgacagaacagagagtgggggccagtaatctgcactctcagacaaaactgacaagtgggagaaaggcttgtctcccctgaaggacaaaaaccaggcttgggactggccacacatgatgagaaaactgtgagaaaagaagcaggagagactttggaagagggcttggcaggccggaaagcgctaggtgcacacgacgggcagtgggggctcaaacacaggtgggagcccaggggaggagggagcgattagtcatgctggggaggctccaagggccctttgtccttcctagatggctactcagacgccagtctgcgagcaccccacgctcagctgctccatgcttcagccaccatgcaacccatctggataatggactgttatgaagcatgttggcagccatcgattaggactaaactctatgctcattgggttgtatttgcaaggatgctctgctaagatccacagcagaggtgcatctctctccttctcatttgatggctt

SEQ ID NO: 162625 - DNA, 601 bp, Human
tcatttgatggcttggaattaaaatgccacccaacattctctgccaaagacatgaagatttatgggtcactgtcaatatcaacacatgctggccattatttgagtctccttgctgcttgggactgattgctatttactttgaaagataaatgtggctttgtaatccatgcaggttgctgggaggaatgggttttaaatgcatttgttcttttttttttttttaagacagagtctcactctgtcaaccacgctgtgcagtagcacgatcctggcttactgcaaactccgcctccaggttctyctgcctcagcctcccaagtagatgggattacaagcatgcgccgccgcaccctgctaatttctatatttttaatagagacagggtttcgccatgttggccaggctggtcttgaactcctgacttcaagagatcccccctcctcggactcccaaagtgttgggattacagacaggtgtgagccaccatgcccggccttgggttttaaatgcatttgtttcttcccttggagacctttctattccactccattctgctttgtctggtgatgttggtcccaccctgtacccaccatcagatatt

SEQ ID NO: 162626 - DNA, 601 bp, Human
ttctctgccaaagacatgaagatttatgggtcactgtcaatatcaacacatgctggccattatttgagtctccttgctgcttgggactgattgctatttactttgaaagataaatgtggctttgtaatccatgcaggttgctgggaggaatgggttttaaatgcatttgttcttttttttttttttaagacagagtctcactctgtcaaccacgctgtgcagtagcacgatcctggcttactgcaaactccgcctccaggttctcctgcctcagcctcccaagtagatgggattacaagcwtgcgccgccgcaccctgctaatttctatatttttaatagagacagggtttcgccatgttggccaggctggtcttgaactcctgacttcaagagatcccccctcctcggactcccaaagtgttgggattacagacaggtgtgagccaccatgcccggccttgggttttaaatgcatttgtttcttcccttggagacctttctattccactccattctgctttgtctggtgatgttggtcccaccctgtacccaccatcagatattctaatgtcctccgaggctctggaacaaagaccagag

SEQ ID NO: 162627 - DNA, 601 bp, Human
ccaaagacatgaagatttatgggtcactgtcaatatcaacacatgctggccattatttgagtctccttgctgcttgggactgattgctatttactttgaaagataaatgtggctttgtaatccatgcaggttgctgggaggaatgggttttaaatgcatttgttcttttttttttttttaagacagagtctcactctgtcaaccacgctgtgcagtagcacgatcctggcttactgcaaactccgcctccaggttctcctgcctcagcctcccaagtagatgggattacaagcatgcgccrccgcaccctgctaatttctatatttttaatagagacagggtttcgccatgttggccaggctggtcttgaactcctgacttcaagagatcccccctcctcggactcccaaagtgttgggattacagacaggtgtgagccaccatgcccggccttgggttttaaatgcatttgtttcttcccttggagacctttctattccactccattctgctttgtctggtgatgttggtcccaccctgtacccaccatcagatattctaatgtcctccgaggctctggaacaaagaccagagggaccag

SEQ ID NO: 162628 - DNA, 601 bp, Human
ttctcaaacttgagtgtgcatcacaacccactgaagagctttttaaaacacagattgtggcccccactctagagctcctgattcaataggcctagggtgcggcccaggaatgtgcatttctaacgatgtcccaggtgatgctgattctgttgctggtcctgcatcccacctgaagaactgcctcagaacaagagtgggaagcattagagaccaatcatgggagagatgaggctgctggcagtgtttggcacttgggaaaaagaacagcaccgtctaaaggagaattttattaagtttcagkgaacaatgtgcaatttaaatctttttgtaggaaatcgtcagttaaaggtcaatttccataagtatgtggatctatgtattttggaaatgcattgaaatgttacatgggtctgggaccacacaagctacccactggtggtctgctatacctaggtactaggaaggtcaaggtactgagtaggtcacagtcttgccaccgggatgctttgctaactttattgagtgaaagtagtaagaaatgcctggtattgataagagcccaccgtgctagtttttaccaatggtccctaagcgattttcc

SEQ ID NO: 162629 - DNA, 601 bp, Human
caggaatgtgcatttctaacgatgtcccaggtgatgctgattctgttgctggtcctgcatcccacctgaagaactgcctcagaacaagagtgggaagcattagagaccaatcatgggagagatgaggctgctggcagtgtttggcacttgggaaaaagaacagcaccgtctaaaggagaattttattaagtttcagtgaacaatgtgcaatttaaatctttttgtaggaaatcgtcagttaaaggtcaatttccataagtatgtggatctatgtattttggaaatgcattgaaatgttacrtgggtctgggaccacacaagctacccactggtggtctgctatacctaggtactaggaaggtcaaggtactgagtaggtcacagtcttgccaccgggatgctttgctaactttattgagtgaaagtagtaagaaatgcctggtattgataagagcccaccgtgctagtttttaccaatggtccctaagcgattttccctgcagcagtcagggtttacaggtaaaactgggcccagggcaataaaggggtacagtctaaggactctgggagtttcctgatgaatactagaggtctttggagg

SEQ ID NO: 162630 - DNA, 601 bp, Human
aagtttcagtgaacaatgtgcaatttaaatctttttgtaggaaatcgtcagttaaaggtcaatttccataagtatgtggatctatgtattttggaaatgcattgaaatgttacatgggtctgggaccacacaagctacccactggtggtctgctatacctaggtactaggaaggtcaaggtactgagtaggtcacagtcttgccaccgggatgctttgctaactttattgagtgaaagtagtaagaaatgcctggtattgataagagcccaccgtgctagtttttaccaatggtccctaakcgattttccctgcagcagtcagggtttacaggtaaaactgggcccagggcaataaaggggtacagtctaaggactctgggagtttcctgatgaatactagaggtctttggaggcagacaactttttctttgcagcgggacttcacattataagccatgatgaggctgcaattgcgatttatcagtgctgccttccttccccaggcaacgtactaggaagaatcatggtttactgaaggcaggctaccctccccatcaaagcctagtggactgggcaagcaatcggttgggattcattact

SEQ ID NO: 162631 - DNA, 601 bp, Human
ggtagagcagtggggtggaggaaagtcaacatatttggagatacgaaaaaggcaggtaagtaattgtattcgttgagactttgggtcacaagaataataatccaaaccaaattaacttgtggggaatttatttactcatgtaacatagatgtccaaattataagcttcagggacagctggatctatgaccttaataaagtcaccatgtttcttcattcgctccccacccccttctcccttcataacacttcagagtgccagattcctcagtccttggaactcaaacttccagagagaccayacttcatcacatacctatggcacatgttccagaaatgattctggccaggtgtccacccctgaatagatggccacaggcaggagaatgggatgtctgattggtctgatttgggaaacatcctatccaccacttggataggatcaactttacccaaacaggactgatcaggatccacatgggaggttcgctcctttggaggaggagatgccagcagaccgtggaggactggctgtgaggcacgaggatgagcgggaggcaagggcggctcctgcttccacagaggcgagcaggaggatgctc

SEQ ID NO: 162632 - DNA, 601 bp, Human
ctttgggtcacaagaataataatccaaaccaaattaacttgtggggaatttatttactcatgtaacatagatgtccaaattataagcttcagggacagctggatctatgaccttaataaagtcaccatgtttcttcattcgctccccacccccttctcccttcataacacttcagagtgccagattcctcagtccttggaactcaaacttccagagagaccacacttcatcacatacctatggcacatgttccagaaatgattctggccaggtgtccacccctgaatagatggccacaggyaggagaatgggatgtctgattggtctgatttgggaaacatcctatccaccacttggataggatcaactttacccaaacaggactgatcaggatccacatgggaggttcgctcctttggaggaggagatgccagcagaccgtggaggactggctgtgaggcacgaggatgagcgggaggcaagggcggctcctgcttccacagaggcgagcaggaggatgctcctgccctgctcacacagctgtggctctgcaccttgctccccgctagaaggtgggctatcgtagctaagctacctgggc

SEQ ID NO: 162633 - DNA, 601 bp, Human
aataaagtcaccatgtttcttcattcgctccccacccccttctcccttcataacacttcagagtgccagattcctcagtccttggaactcaaacttccagagagaccacacttcatcacatacctatggcacatgttccagaaatgattctggccaggtgtccacccctgaatagatggccacaggcaggagaatgggatgtctgattggtctgatttgggaaacatcctatccaccacttggataggatcaactttacccaaacaggactgatcaggatccacatgggaggttcgctcckttggaggaggagatgccagcagaccgtggaggactggctgtgaggcacgaggatgagcgggaggcaagggcggctcctgcttccacagaggcgagcaggaggatgctcctgccctgctcacacagctgtggctctgcaccttgctccccgctagaaggtgggctatcgtagctaagctacctgggcagagcagacctcgtgagtgtggggaaaatcctgggcagcataacagactcatttgtagggcaaagggattttcagttagttctgtaacacactggagaaccaacacaatgctca

SEQ ID NO: 162634 - DNA, 601 bp, Human
cccgctagaaggtgggctatcgtagctaagctacctgggcagagcagacctcgtgagtgtggggaaaatcctgggcagcataacagactcatttgtagggcaaagggattttcagttagttctgtaacacactggagaaccaacacaatgctcaagcatcgttcctcccagaggaagcagatgggtgagataaataaaaccacactttcattggcatcctaggatgctcggggccctattttcaaggctgtgtatgttgaatacacatttcagtgatgctttagtctattccacagtgatkctcaaattgtggcccccaggccaacagtatcaccatgccccgggaacttgtttgaaagacaaattctccatcccactcaagacctcctgaatcagaaactctgggtatggggcccggcagtctgggttttaacgcaccctctgggtgattctgaaacaggcaccaaagtttgagaacgtctgcctataaatgtatttgatccaatccatcaagttcaaagggaccacctactataaaaactaaggcttatgttcagggtttattgagcagtctgaatttagaagagtgtgaacgtgaaac

SEQ ID NO: 162635 - DNA, 601 bp, Human
ttgtagggcaaagggattttcagttagttctgtaacacactggagaaccaacacaatgctcaagcatcgttcctcccagaggaagcagatgggtgagataaataaaaccacactttcattggcatcctaggatgctcggggccctattttcaaggctgtgtatgttgaatacacatttcagtgatgctttagtctattccacagtgattctcaaattgtggcccccaggccaacagtatcaccatgccccgggaacttgtttgaaagacaaattctccatcccactcaagacctcctgaawcagaaactctgggtatggggcccggcagtctgggttttaacgcaccctctgggtgattctgaaacaggcaccaaagtttgagaacgtctgcctataaatgtatttgatccaatccatcaagttcaaagggaccacctactataaaaactaaggcttatgttcagggtttattgagcagtctgaatttagaagagtgtgaacgtgaaacagttttctatttctcccattccagccttcagccacgcactatcaagttatatgcttccatccctttatagcatcctgggcagattcctttaa

SEQ ID NO: 162636 - DNA, 601 bp, Human
ggagaaccaacacaatgctcaagcatcgttcctcccagaggaagcagatgggtgagataaataaaaccacactttcattggcatcctaggatgctcggggccctattttcaaggctgtgtatgttgaatacacatttcagtgatgctttagtctattccacagtgattctcaaattgtggcccccaggccaacagtatcaccatgccccgggaacttgtttgaaagacaaattctccatcccactcaagacctcctgaatcagaaactctgggtatggggcccggcagtctgggttttaaygcaccctctgggtgattctgaaacaggcaccaaagtttgagaacgtctgcctataaatgtatttgatccaatccatcaagttcaaagggaccacctactataaaaactaaggcttatgttcagggtttattgagcagtctgaatttagaagagtgtgaacgtgaaacagttttctatttctcccattccagccttcagccacgcactatcaagttatatgcttccatccctttatagcatcctgggcagattcctttaacttttggtcagttcgattattaagttattttactttattct

SEQ ID NO: 162637 - DNA, 601 bp, Human
ccatcaccttcccaggccaaggtcttaggttcccctggaacccctttggctttactcccttcctgggctgggggaaagggtggggatataagctggtacttccaaagcagaaagctggggtttggggctgacagagccgaccttgagcttgagctccatggagtacccagcccaggtcaaatggggtcaggaagccatctgtgccttctggatggctctgtctgaatgattcacttctgcctatggtgggtggaagttcatggttttactcccacatggtgaccacagtgcatggcaattytctagtcaacaggtggggttggggcctctgctacacacaagaggcttctttcttcaagtttaagacttctgatgctcacaagaccctcccatgcccttaccacgtgcagcgctcacccccagggcctggggtttggtgagatgtgtcgcccacatgggctgggatcatattttccccagggaagatgaaagccctcaccctctcacaaagccaattgctaaattttcaagaattttgcaagctgatttttaaacatagccattattttaaaattacattatagaacttacaatgaaacaa

SEQ ID NO: 162638 - DNA, 601 bp, Human
tctgctattgcagcacaaaagcagccacagacaatagacacacaaatggacctggctgtgttccaataaacctaattcacaaaaacacatggtgcaccagatttgtcaggccatggattgctagcccctcatctagacttaagagagccatagaaaaaaaatgttagtaatgaagattaaatttagaactgtcccaattgtaactagcacaaaacattaaggaaatattcttccagtgctcaaaaacaatgatttgattgagcaaagaattcatgtcattgttgaatgattgagtttcaaygtgtccttatttcatttttgtcttcttcattaatgtaaataaacctgtcagccaacctacacttgtcatttgccaccataggttgactagtgagacaagggtccaacaaacatcagcaaaagtattctgtgaaaatcaattgctatttggagtttacaataaagaatactgtatatttcattattatttataaattgtataataccttgatagcaatgaaatgcacaatatatgcatgtatgcgtgtatatatatatgaatatattttcttccagagagccagttgctgagtatccacca

SEQ ID NO: 162639 - DNA, 601 bp, Human
gactagtgagacaagggtccaacaaacatcagcaaaagtattctgtgaaaatcaattgctatttggagtttacaataaagaatactgtatatttcattattatttataaattgtataataccttgatagcaatgaaatgcacaatatatgcatgtatgcgtgtatatatatatgaatatattttcttccagagagccagttgctgagtatccaccaatgcaccactgcctgaggggtgtctacataaaaagagacctaacagcccagagcagcacttgttaaggacccaaggcatggtccmgaccccaaggaagggaagggggtcagggatggatagacaatctggaaagttctccaaggtggtctgagaaggcttcatgggggacagagagccgtaaagcatggtaggactcaatgacaaatgaagaatggctgtacttcagacaggcacacagcatgagcgcaggaggcgaggctgaagtcagggacaccgagacaagagggtgagcatagggaagcagaagggaatgaagtggggtcaaatatatgtaatggcatggaaacatgctatgagatcaagccaaaagaaaagaaaaagtag

SEQ ID NO: 162640 - DNA, 601 bp, Human
aagttgtattactttgatattcatggggaaaaataagcttttccagtatgaagggcaaaaagcactgagccaaacctgaagccatagctaaggacagggcacatctcccctgatgcagcccagaggcccctggagggaggtgctggggggtgaatagagactaggggtgtcactccctcctaggaggactgcaggagcacatgggtagccaatgctaaggcctcctgcccccatgggcctaagtagccctgtccacactggggatctgcccgctacctcatagcctcaggtagatgtctgktctctctttgcaaatgtcccccgcaacccatcacattcataaaggcaacaaattggggaaaacgagaggtcctctgtctttttagggcttcaccactgctgttttcccaactaaagaaatatgtacatatgtttaagtatactttaccatgcgtagaatgggaaaaacagaagttattctagagaacatctcgctcaactcgtttattttactaataagaaaatagaaactatggaggtcaagtggcatacccagggaaacagagctaagtgagaactaggctccagcagagatgatgcc

SEQ ID NO: 162641 - DNA, 601 bp, Human
tagagactaggggtgtcactccctcctaggaggactgcaggagcacatgggtagccaatgctaaggcctcctgcccccatgggcctaagtagccctgtccacactggggatctgcccgctacctcatagcctcaggtagatgtctggtctctctttgcaaatgtcccccgcaacccatcacattcataaaggcaacaaattggggaaaacgagaggtcctctgtctttttagggcttcaccactgctgttttcccaactaaagaaatatgtacatatgtttaagtatactttaccatgcgyagaatgggaaaaacagaagttattctagagaacatctcgctcaactcgtttattttactaataagaaaatagaaactatggaggtcaagtggcatacccagggaaacagagctaagtgagaactaggctccagcagagatgatgcccagggccgggcacctcctttgtcagcatgcaggtatcatcagacaaggccaaaacagcactgggcgatgtgggctgagcagcccttggcttcgaaaacatgatttttttattattttttgagacggagtttcactcttgttgcccagaatggag

SEQ ID NO: 162642 - DNA, 601 bp, Human
ctttaccatgcgtagaatgggaaaaacagaagttattctagagaacatctcgctcaactcgtttattttactaataagaaaatagaaactatggaggtcaagtggcatacccagggaaacagagctaagtgagaactaggctccagcagagatgatgcccagggccgggcacctcctttgtcagcatgcaggtatcatcagacaaggccaaaacagcactgggcgatgtgggctgagcagcccttggcttcgaaaacatgatttttttattattttttgagacggagtttcactcttgttrcccagaatggagtgcaaaggtgcgatcttggctcaccacaacctccacctcccgggttcaagcatttctcctgtctcagcctcctgagtagctgggattacaggcaggcaccaccacgcctggctaatttttgtatttttagcagagacagggtttctccactttggtcatgctggtctcaaactcccgacctcaggtgatctgcccgcttcagcctcccaaagtgctgggattacaggcgtgagccaccgcgcccggcagacatgacgtattctaagcactcctcaaatttacctgtgg

SEQ ID NO: 162643 - DNA, 601 bp, Human
taaagctttctatgactcaggccgcatcattttgtggtcaactactttcactattattgtgtttattctccctaaaccagccaagcaatcccatttggtaatcgaaagagcaagtagcactggcttggtcatttccttcacataaacctgactgaactggatatatggtaaggatttccatcttgtacataaacacttgtccacctccgtgattcacacaattccttttccactctatcccgggcccatgtctccatcctgcccctgatgctggctctgcaggcattttctacatggctgyctgtgtacatgccgtgtggttagtcttaaatcaagggctcctagagtgcataggacataccagtttatactttttctcatcaggaatatgtgtagctggaggattaagaaatacattttcatgagctagacaataacaaaaattaaatggcaaaagtccttgctgtccttagtagctagggagctttaaaaataaatacataagcacctgtttccgtttttttactcctacagaagcagggaaattgctggagaaaaaaaaaaaatgtaagtccatatattctgtactgtgtcccttgga

SEQ ID NO: 162644 - DNA, 601 bp, Human
cagcccttgccagcagaatctggtcacccctctgcccctcaaaattacacatcttatacaactagctcctgtccctgcaccattcctgtcccttgtccttgatcctggtttcccagtggaacaggaaaaaggttttacagagggttttttgccaccatctctttgttcctcaggagatgattaagttgtgcgttaagtggggaaaaagtacattaggtcaaccccaaaatctgccatcgataacatcagagtatgtccatggctttattagttttctagtgaatatttaagagaaaaaggwgctaggtcatagaacattgagaaggctatacatctccccttggctataggtgcaatacattccaagagggagagatggtagtcatgcctcctatttttttaggtgaggtatgtattttgtagttctgctgggacaaaaacagctttcagtcattgaaaaccaaaggcccagtggacatcaggaggagatggcctccctcactgcaagacgacctctgggtcaaagcctagtgaaactttggcttttcccagcaagcaggaagtgacatagacagtgtctttttagagacctcactttgga

SEQ ID NO: 162645 - DNA, 601 bp, Human
aataaagttttggctttttcctggagttctaactctgcaggagaagcagtgaggtaggactttgaggaattcaggaagtggagaacagctcatggtgagaggaaaggctggggccgacttgggatgtggatgtgcaaaaggaaaggtgaaggctggatgggaggcagggtgggcacagttaaggtgggccctgggccaggatggcctcccaaccagagagtagccttcaacatctcagcctcgtactgcgtgccagacactctaccaagccctccacttaggtaataatcacgtcttccamcctcactctcaccctgtaagggagctcttagaataacgctgctctccacggctgggaaacccaggctctgatgggtgacatcacttgttcaaggtcactcagccagtaagggccaggctgggctgcaaactcaatggcccactgcagagctcacacaggtccatttcctactcgccatgatgttttccagggagagtttagagaagctctggagctgggaaaagagggcagctgttagagaacagccagcgagaatgggaagtcaggagacccagagctcaggaacagacttccttggca

SEQ ID NO: 162646 - DNA, 601 bp, Human
tgaggaattcaggaagtggagaacagctcatggtgagaggaaaggctggggccgacttgggatgtggatgtgcaaaaggaaaggtgaaggctggatgggaggcagggtgggcacagttaaggtgggccctgggccaggatggcctcccaaccagagagtagccttcaacatctcagcctcgtactgcgtgccagacactctaccaagccctccacttaggtaataatcacgtcttccaccctcactctcaccctgtaagggagctcttagaataacgctgctctccacggctgggaaacccaggctctgatgggtgacatcacttgttcaaggtcactcagccagtaagggccaggctgggctgcaaactcaatggcccactgcagagctcacacaggtccatttcctactcgccatgatgttttccagggagagtttagagaagctctggagctgggaaaagagggcagctgttagagaacagccagcgagaatgggaagtcaggagacccagagctcaggaacagacttccttggcaggtggcgtagtcccatggcctctttagctctcagttttctcatctgcaagaggacaatgggc

SEQ ID NO: 162647 - DNA, 601 bp, Human
atgggaggcagggtgggcacagttaaggtgggccctgggccaggatggcctcccaaccagagagtagccttcaacatctcagcctcgtactgcgtgccagacactctaccaagccctccacttaggtaataatcacgtcttccaccctcactctcaccctgtaagggagctcttagaataacgctgctctccacggctgggaaacccaggctctgatgggtgacatcacttgttcaaggtcactcagccagtaagggccaggctgggctgcaaactcaatggcccactgcagagctcacamaggtccatttcctactcgccatgatgttttccagggagagtttagagaagctctggagctgggaaaagagggcagctgttagagaacagccagcgagaatgggaagtcaggagacccagagctcaggaacagacttccttggcaggtggcgtagtcccatggcctctttagctctcagttttctcatctgcaagaggacaatgggccagattggtgcttctctgagagaaagtaccagtggttttgaccaagggactgacccgaacatggcatgtaagaggggtttgtttggggttggtc

SEQ ID NO: 162648 - DNA, 601 bp, Human
ggggtttgtttggggttggtccacaggatggttacagaggaaggaagaaagccaccaaggccaatttgaagatgtgcagaaacccagaagtgaggtgaggacggcagttctcaagtgcagagcttgaagtggtcactgctgggagggagacgtcataacaagacccaggaaacacttcaaaggaaaaactaacagcatttaaagattggctgcaatagtaacaataaaaaaagctaacatttactgaaggctataccagttatcccaccaagtgctcaactaccaatcctcacagcagccrgctgcaggaattatcattgctcccactttatagataaggaaactgaagtttatagaggcagagaaacttgcccaaagtcacaaagctggcaactcccagagccaggatttgaacacagtctcagtacagagcctatggtttctttgtttttgagacaaagtctcactctgtcaccaaggctggagtgcagtggctcgatcttggctcactgcaacaattgcttggctccctggttcaagcgattctcctgcctcagcctcccgattagctgggattactggtgtgcaccaccatgccagg

SEQ ID NO: 162649 - DNA, 601 bp, Human
tttgtttttgagacaaagtctcactctgtcaccaaggctggagtgcagtggctcgatcttggctcactgcaacaattgcttggctccctggttcaagcgattctcctgcctcagcctcccgattagctgggattactggtgtgcaccaccatgccaggctaatttttgatttttttttttttttagtagatatggagtttcaccacattggccaggctggtctcgaactcctgacctcaagtgatctgcctgccttggcctcccagaatgctgggattacaggggtgagccactgggcccygccacctatgttcttaatccccgtgcaactctgcctcctatctatgtgccgaagaaaggaacaacactcccctccagacctctgcctttcacacccattggccttggatgcccttgtctccccccggttccgattcccttcaaattccagctcctttaaactttcacaccttactctgtccacccctccacacctgcctcgtgctgtccccccgcccccacatcccactccacccccacagttcaaacctgctcatggaagtcctggaatgtgttttctccctcatcctcagtcccaccc

SEQ ID NO: 162650 - DNA, 601 bp, Human
caccaaccctattctgtccccctaaacagtattacatttagtgtttatgataaaggctttcagcacctttttgaagagttggtaccactggtccactttctgccctgcccttaatccatccaattggtttagatactcacacatacattctttctttctctctccttcccttactggaccccagaccaaagccaaagaaataaatgtcccctctcctgctctgtttccacttagataaattaatcctcagcatgagaggaaccaaagccagcaccttagaagtcaggctcctgtcagctcrgtttgctcacctgcacacagcccttgacttcctcctcctgtgtgggaggagcacagccctgactcagaggccactccaggcaatcctctcctcccaggcaatcctataaggaacccactggctgagctctggcctctcggcagagggggcaggcctgaagaaccctttccaagaccagctgagctctgctggtccgctgggccctgcctgcagagttattggcggagttattcttggtgctcattagcactgcacaggctgtggattattcctttattgctaagtggcccccagaacact

SEQ ID NO: 162651 - DNA, 601 bp, Human
cccttaatccatccaattggtttagatactcacacatacattctttctttctctctccttcccttactggaccccagaccaaagccaaagaaataaatgtcccctctcctgctctgtttccacttagataaattaatcctcagcatgagaggaaccaaagccagcaccttagaagtcaggctcctgtcagctcggtttgctcacctgcacacagcccttgacttcctcctcctgtgtgggaggagcacagccctgactcagaggccactccaggcaatcctctcctcccaggcaatcctawaaggaacccactggctgagctctggcctctcggcagagggggcaggcctgaagaaccctttccaagaccagctgagctctgctggtccgctgggccctgcctgcagagttattggcggagttattcttggtgctcattagcactgcacaggctgtggattattcctttattgctaagtggcccccagaacactgcagactcatccctccttttgaagtccttgtaaaagactccaagaagtcgattccaatctcttctctcccagcgtggactgcccctggagcagcactgggggtgtgt

SEQ ID NO: 162652 - DNA, 601 bp, Human
ttgcgcaggtattcacccgctccactcccatctccttgacctctttcttgccctgtttctcggcgacctaggcattgggtcctggtcagttttccacttttccatcactcccttaggacccctcaacctctctgctcatcaaaaaagtccaataaaggcattcatctctttgaatacttaattttacagtacctcttgcataactttcaagtttgaggtcaatacaaataaaatcatttaaaatgtctgatattaaacacttctgacccgaaaagcaaaaagccttttaacagatagttayattgatacaagagtccacaatgacaggtttcaaagatgaaagtaatggatcagtaaatagaacagtagagaaaacacagatgaaaggcaaataaccccacctgaaaaatccaaagctttcattttttttgaaaaaaaaattgtcaaaagcactgtattattttttaaaatcatgataaaaggagcatgcacctgtcaccctcccaaccccctctatacttgcccctttctatctttaagtgctgtggtctttgtggtgactttattggctcaagtttcctaggctggtactctcagagcc

SEQ ID NO: 162653 - DNA, 601 bp, Human
ctcccatctccttgacctctttcttgccctgtttctcggcgacctaggcattgggtcctggtcagttttccacttttccatcactcccttaggacccctcaacctctctgctcatcaaaaaagtccaataaaggcattcatctctttgaatacttaattttacagtacctcttgcataactttcaagtttgaggtcaatacaaataaaatcatttaaaatgtctgatattaaacacttctgacccgaaaagcaaaaagccttttaacagatagttacattgatacaagagtccacaatgayaggtttcaaagatgaaagtaatggatcagtaaatagaacagtagagaaaacacagatgaaaggcaaataaccccacctgaaaaatccaaagctttcattttttttgaaaaaaaaattgtcaaaagcactgtattattttttaaaatcatgataaaaggagcatgcacctgtcaccctcccaaccccctctatacttgcccctttctatctttaagtgctgtggtctttgtggtgactttattggctcaagtttcctaggctggtactctcagagcctggtttcctaggagcagtactcat

SEQ ID NO: 162654 - DNA, 601 bp, Human
attaatacagggcagaggaattagatcttttggtagagatctaaaattcctctgaagttctatcaagccccatctcctgatgattcagtgctagttctaaaataggaaaacttacttccaaaaccaacagatgtttgggctgtcatcattatgcctgtactaaactcacttgtgatttcactgtgaagtcctgtctgtgtaatttattaggaatcatttatgtaagattatgtagaaaatgttactagtcgtgagatatctatccatctcaatgatttgacttttacagcaatgcgatggracgtgctgagggaccatttggtcaactttccacctaatggtggtgtgattagaactcctagcgggtgactcatagagagtgattagaagtaaaaaggttctggaaattcccccacactctttaaggcagcctttgtcaggtgtcttagtttcgtgaaaggtagactgatgttttccatctggtatacaaaacattttctaagtagttatagaaccttgaacaagccacttagctctctgggcctgagttttctcatcttataaaattaaatccatcaatagatcacatgatctctatggc

SEQ ID NO: 162655 - DNA, 601 bp, Human
tcatcattatgcctgtactaaactcacttgtgatttcactgtgaagtcctgtctgtgtaatttattaggaatcatttatgtaagattatgtagaaaatgttactagtcgtgagatatctatccatctcaatgatttgacttttacagcaatgcgatggaacgtgctgagggaccatttggtcaactttccacctaatggtggtgtgattagaactcctagcgggtgactcatagagagtgattagaagtaaaaaggttctggaaattcccccacactctttaaggcagcctttgtcaggtrtcttagtttcgtgaaaggtagactgatgttttccatctggtatacaaaacattttctaagtagttatagaaccttgaacaagccacttagctctctgggcctgagttttctcatcttataaaattaaatccatcaatagatcacatgatctctatggcttctttattctaaggatgtatggtaattttaaacacttggttagccatcttgaccaaactagcatcacaggtaagaaacaagctgcgaagaccaaaattcttctctggtttatacactctgggtcagaggcaaccactttct

SEQ ID NO: 162656 - DNA, 601 bp, Human
cacccattgtcttgtctgaatcctcatgacaacctcatttttttatagattatacagcattcctacttatatataatagttataactttttattcctaataaactttcgcatgacgtttcatcagattctgatagtttcttttgtttttcattcattgcattcccatccaaatgtttactgaccctgggaaataaatccagtagaccaatgaagcatgaatccaactcacagagggtggttagaactaaaagctgaaatggacttccgtgatcacctgacccactcatccctgaccgtagrctcttgttcacagcggccaaaacgtgcatgtctctcaggggcttcctgcttgtggagcagaacctttgcttgcgggctccttgtgtctgtgagctcctcagaaccgctcttgagctcacagtgcctgatttgcacgtattggtttccgctccgttgcttattctggtcccctcatagaagcaatgttatcctttcttcaaacccgtcctttcccagagagctttgcagccacttttaccgggtttaatgagtcagctgcagagtttatgatccggtactaggccttctgggaagcagctt

SEQ ID NO: 162657 - DNA, 601 bp, Human
gttataactttttattcctaataaactttcgcatgacgtttcatcagattctgatagtttcttttgtttttcattcattgcattcccatccaaatgtttactgaccctgggaaataaatccagtagaccaatgaagcatgaatccaactcacagagggtggttagaactaaaagctgaaatggacttccgtgatcacctgacccactcatccctgaccgtaggctcttgttcacagcggccaaaacgtgcatgtctctcaggggcttcctgcttgtggagcagaacctttgcttgcgggcyccttgtgtctgtgagctcctcagaaccgctcttgagctcacagtgcctgatttgcacgtattggtttccgctccgttgcttattctggtcccctcatagaagcaatgttatcctttcttcaaacccgtcctttcccagagagctttgcagccacttttaccgggtttaatgagtcagctgcagagtttatgatccggtactaggccttctgggaagcagctttcctgggcttacgtcaggctgttaaagaccctcctggccttcctgccgacatttgctcggctactttttcctcctaat

SEQ ID NO: 162658 - DNA, 601 bp, Human
gtatcccttacatcaaatcctgtccgccgcttagaaaaaccacagctaaaagttgtttggcaactcttggtgttcacagggttttcccactgagggtcagggactgcacagcggttgagagcttggactccggggtcagctggaactgcttctaacacaaggaccgctcttaacaaagaactgaggcttcctaaacttcagtttctgggtctgtaaaataataggacccacttcctataaatgttgagaagattaatgggaatgatgcatgtaaaatgctcggtacatgataaaagcccartgattactcattatcccactcaatgcttggggaaaggcaaagcagctaatattaccccagattatagataagaatactgggttcaaaagagatcacttggcttacccttgtctatactgcacctgcatgaatcatggacctgaacccaggtcacggccacctcccagacccttgctctctctgcttccccagcagcgcctctcagagtgaacacctatgtccatgacagtgattcccaaagtgttgtccccaaaccagcagcatcagcatcacctgggaacttgttagacatgttagggt

SEQ ID NO: 162659 - DNA, 601 bp, Human
gaccgctcttaacaaagaactgaggcttcctaaacttcagtttctgggtctgtaaaataataggacccacttcctataaatgttgagaagattaatgggaatgatgcatgtaaaatgctcggtacatgataaaagcccagtgattactcattatcccactcaatgcttggggaaaggcaaagcagctaatattaccccagattatagataagaatactgggttcaaaagagatcacttggcttacccttgtctatactgcacctgcatgaatcatggacctgaacccaggtcacggccacytcccagacccttgctctctctgcttccccagcagcgcctctcagagtgaacacctatgtccatgacagtgattcccaaagtgttgtccccaaaccagcagcatcagcatcacctgggaacttgttagacatgttagggtctcaccccagacctaatgaatcagaaactctgagaatgagggcccacaatctgggttttagcaagatctccagaagattctgatgcacacccgtttgagaaccaaagctccatggaatactaatttgcctttggatctagccctgccgcccactcgagatg

SEQ ID NO: 162660 - DNA, 601 bp, Human
ttatagataagaatactgggttcaaaagagatcacttggcttacccttgtctatactgcacctgcatgaatcatggacctgaacccaggtcacggccacctcccagacccttgctctctctgcttccccagcagcgcctctcagagtgaacacctatgtccatgacagtgattcccaaagtgttgtccccaaaccagcagcatcagcatcacctgggaacttgttagacatgttagggtctcaccccagacctaatgaatcagaaactctgagaatgagggcccacaatctgggttttagsaagatctccagaagattctgatgcacacccgtttgagaaccaaagctccatggaatactaatttgcctttggatctagccctgccgcccactcgagatggatggtccacaaatctcaatgtgattcctaacatgagttaagctgtccaaccctgtgacgttatcaggggatttgtgattaatacatagtgacaccatttaactgtggcagaggttcttacccttggaagctcattagaatcatctagggaacttataacagaaaggcccaccccagaccagttcagatctaaagacagcc

SEQ ID NO: 162661 - DNA, 601 bp, Human
ctatgtccatgacagtgattcccaaagtgttgtccccaaaccagcagcatcagcatcacctgggaacttgttagacatgttagggtctcaccccagacctaatgaatcagaaactctgagaatgagggcccacaatctgggttttagcaagatctccagaagattctgatgcacacccgtttgagaaccaaagctccatggaatactaatttgcctttggatctagccctgccgcccactcgagatggatggtccacaaatctcaatgtgattcctaacatgagttaagctgtccaaccctgtgacgttatcaggggatttgtgattaatacatagtgacaccatttaactgtggcagaggttcttacccttggaagctcattagaatcatctagggaacttataacagaaaggcccaccccagaccagttcagatctaaagacagcctggactgacaaccacagaactacagagctgccacccagactccatggaactctgctaggctggtaatatttttaattcattaagggtttatgtgtttaacaacccaggtccagtaaattggctcctttcctccctatgaaccttggacactct

SEQ ID NO: 162662 - DNA, 601 bp, Human
gtttgagaaccaaagctccatggaatactaatttgcctttggatctagccctgccgcccactcgagatggatggtccacaaatctcaatgtgattcctaacatgagttaagctgtccaaccctgtgacgttatcaggggatttgtgattaatacatagtgacaccatttaactgtggcagaggttcttacccttggaagctcattagaatcatctagggaacttataacagaaaggcccaccccagaccagttcagatctaaagacagcctggactgacaaccacagaactacagagctgmcacccagactccatggaactctgctaggctggtaatatttttaattcattaagggtttatgtgtttaacaacccaggtccagtaaattggctcctttcctccctatgaaccttggacactctggctggtcaagcctccacctcatgcccacttgtttgcacagctactaacgtttatgaagtatttgcttaatgtacctaagctccactgcccagagctatcccacttgatctgaaaacgtcatgatgaggtatggtaagcattaaacattagttcaccatagttctatttttttctaat

SEQ ID NO: 162663 - DNA, 601 bp, Human
ctgggaccttcaggcctgccctcgggaggactggccaccaggctttacagcccagagcagagaaacactgtggccgttgcaaaactccttgagtgaagtgaccctaccctctactaaaaacgtggcccagtggattccagttactaacaaagctcgttgagaagatgcaagaaaggaatggaacaatggctaggacctccccgcggcagcacttcccccaagagaatagaggagctgatgggcacgtcacatttttctcaatgctggatgacattccatcaccttcctcatcttcatggatttttttttttttttttttgagacaaggtctccctttatcacccaaactggagtgcagtggtgcaatcatgcctcactgcagtcttgacctcccaggctcaagggatcttcccacctcagactcctgagtagctgggactacgggtacataccaccacacccggataatttttgtaattttttagagataaggtttcaccacattgcccaagctggtctcaaattcatggcctcaaacagtgcttcgggttcagcctcccaaagtgctgagattacaggcatgagtcaccgcacccagctg

SEQ ID NO: 162664 - DNA, 601 bp, Human
aggactggccaccaggctttacagcccagagcagagaaacactgtggccgttgcaaaactccttgagtgaagtgaccctaccctctactaaaaacgtggcccagtggattccagttactaacaaagctcgttgagaagatgcaagaaaggaatggaacaatggctaggacctccccgcggcagcacttcccccaagagaatagaggagctgatgggcacgtcacatttttctcaatgctggatgacattccatcaccttcctcatcttcatggaattttttttttttttttttgagacaargtctccctttatcacccaaactggagtgcagtggtgcaatcatgcctcactgcagtcttgacctcccaggctcaagggatcttcccacctcagactcctgagtagctgggactacgggtacataccaccacacccggataatttttgtaattttttagagataaggtttcaccacattgcccaagctggtctcaaattcatggcctcaaacagtgcttcgggttcagcctcccaaagtgctgagattacaggcatgagtcaccgcacccagctggaatgcattctttgaattttaaaaga

SEQ ID NO: 162665 - DNA, 601 bp, Human
acagcccagagcagagaaacactgtggccgttgcaaaactccttgagtgaagtgaccctaccctctactaaaaacgtggcccagtggattccagttactaacaaagctcgttgagaagatgcaagaaaggaatggaacaatggctaggacctccccgcggcagcacttcccccaagagaatagaggagctgatgggcacgtcacatttttctcaatgctggatgacattccatcaccttcctcatcttcatggaattttttttttttttttttgagacaaggtctccctttatcacccaarctggagtgcagtggtgcaatcatgcctcactgcagtcttgacctcccaggctcaagggatcttcccacctcagactcctgagtagctgggactacgggtacataccaccacacccggataatttttgtaattttttagagataaggtttcaccacattgcccaagctggtctcaaattcatggcctcaaacagtgcttcgggttcagcctcccaaagtgctgagattacaggcatgagtcaccgcacccagctggaatgcattctttgaattttaaaagactgtaaatgagagatttgtt

SEQ ID NO: 162666 - DNA, 601 bp, Human
gcaaaactccttgagtgaagtgaccctaccctctactaaaaacgtggcccagtggattccagttactaacaaagctcgttgagaagatgcaagaaaggaatggaacaatggctaggacctccccgcggcagcacttcccccaagagaatagaggagctgatgggcacgtcacatttttctcaatgctggatgacattccatcaccttcctcatcttcatggaattttttttttttttttttgagacaaggtctccctttatcacccaaactggagtgcagtggtgcaatcatgcctcactrcagtcttgacctcccaggctcaagggatcttcccacctcagactcctgagtagctgggactacgggtacataccaccacacccggataatttttgtaattttttagagataaggtttcaccacattgcccaagctggtctcaaattcatggcctcaaacagtgcttcgggttcagcctcccaaagtgctgagattacaggcatgagtcaccgcacccagctggaatgcattctttgaattttaaaagactgtaaatgagagatttgttcagagaagagggtgtttcctatgtacaaaacc

SEQ ID NO: 162667 - DNA, 601 bp, Human
actaacaaagctcgttgagaagatgcaagaaaggaatggaacaatggctaggacctccccgcggcagcacttcccccaagagaatagaggagctgatgggcacgtcacatttttctcaatgctggatgacattccatcaccttcctcatcttcatggaattttttttttttttttttgagacaaggtctccctttatcacccaaactggagtgcagtggtgcaatcatgcctcactgcagtcttgacctcccaggctcaagggatcttcccacctcagactcctgagtagctgggactacrggtacataccaccacacccggataatttttgtaattttttagagataaggtttcaccacattgcccaagctggtctcaaattcatggcctcaaacagtgcttcgggttcagcctcccaaagtgctgagattacaggcatgagtcaccgcacccagctggaatgcattctttgaattttaaaagactgtaaatgagagatttgttcagagaagagggtgtttcctatgtacaaaaccaaagaccagcttttattttttattaggtattatagtcacaaaggtatgaaagggtatatagtaa

SEQ ID NO: 162668 - DNA, 601 bp, Human
tcacatttttctcaatgctggatgacattccatcaccttcctcatcttcatggaattttttttttttttttttgagacaaggtctccctttatcacccaaactggagtgcagtggtgcaatcatgcctcactgcagtcttgacctcccaggctcaagggatcttcccacctcagactcctgagtagctgggactacgggtacataccaccacacccggataatttttgtaattttttagagataaggtttcaccacattgcccaagctggtctcaaattcatggcctcaaacagtgcttcsggttcagcctcccaaagtgctgagattacaggcatgagtcaccgcacccagctggaatgcattctttgaattttaaaagactgtaaatgagagatttgttcagagaagagggtgtttcctatgtacaaaaccaaagaccagcttttattttttattaggtattatagtcacaaaggtatgaaagggtatatagtaataagtctaagaaatttttatgaagtttttgaagtaaaaagcatttttataaaattttaaataaaaattttaataaaattactcaattgttaaatgtaacttaaa

SEQ ID NO: 162669 - DNA, 601 bp, Human
ggctggaatacagtggtgtcatctcggttcactgcaacctctacctcccagattcaagcgattctcctacctcagcctcccgagtaactgggattacaggcactcgccaccatgcctagctaattttttttgtatttttagtagagatgggggggggggtggtctcaccatgttggccaagctggtctcgaactcttgacctcaaatgatccaccagccttggcctcccaaagtgctggggttacaggtgtgagccatcacacccagctgataagtagctttaaacacaagtgaggattcyattccatcaggaatggctgctttatgcagaagaactctaagattacatcaggctaagggtgacagaatgctgtaatccattagccttatctgtcatggtcatggcagcagcaagaggcagtctgagtgccatacactgcagtaatctaggggtgagctgaatagtgaatggagatttgcctaaaagaaacttctggagtcagtgctccaaaactctgaatcaaccaaatgaatgaattgagccaaatagaaatgcatgactattcaatatttattatgtagagaggcttagaaagggcag

SEQ ID NO: 162670 - DNA, 601 bp, Human
actttgggaggccaaggtgggtggatcacctgaggtcaggagttcaagaccagcctgatcaacatcgtgaaaccccatctctacgaaaaatacaaaaaattagccaggcatggtggcacgtgcctgtaatcccagctactcgggaggctgaagcaggacaatcacttgaacctgggaggcagaggttgcaatgagcaaagattgcaccattgcactccaccctgggcaacagagtgacatttggtctcaaaaaaaaaaaaaaaaaaaaaagaaatcttagcaggattacatctgtaacccyggcactttgggaggccgagggaggtgaatcacatgaggccaggtgttcaagaccagcctgaccaacatggtgaaaccctgtctctaccaaaacatacaaaagttagccaagtgtggtagcatgcgcctgtaatcccaactactcaggaagctgaggcatgcgaatcacttgatcctgggagatggaggttgcagtgagccaagatcctgtcactgcactccagcctgggcaagagagtgagactcttgtctcaaaaaaaaaaaaaaaaaatcttgccccttccctcaaggggctcacagc

SEQ ID NO: 162671 - DNA, 601 bp, Human
acggcagccagaagcaacagcctctgcagtcccagcagctgggacctcatgcctcaaccaaggatcagcactgggtattggctcagagtagtgaaggctgctgggggcctgtgtttcctgcatttcctatgtttatgctgccagggtgggttttatgtgaccagagagaagcagggaaaattgctgagaagtcagagatctgccagggaatcagtgatgagccccaggaaatgctttttgtctaaaaatatgccatttccgaaaggaaaacagtcattagagggtgtgagaagccctcgtrgtgaggaaagcaaaactgtaagactcaatgggaggccagtggaacaacagagaagcccattacccacccacttcctgtgcgattaacaagacgtttggaggatgaaaggcaagcagacaaaatgacaacccacagacacaactccaggggaaatgtctggggacagcataggaagacgcagcagggaggtaggaggagaaaaaactgctccagttaatatctttctggcatcggctggttcagctatagatttggctaaaattacctgtgtacttactagacgccaggcagttagggggc

SEQ ID NO: 162672 - DNA, 601 bp, Human
aggccagtggaacaacagagaagcccattacccacccacttcctgtgcgattaacaagacgtttggaggatgaaaggcaagcagacaaaatgacaacccacagacacaactccaggggaaatgtctggggacagcataggaagacgcagcagggaggtaggaggagaaaaaactgctccagttaatatctttctggcatcggctggttcagctatagatttggctaaaattacctgtgtacttactagacgccaggcagttagggggctttgcttaaatcactctcctgcattcttcacayagcacttgatgaaggaggaaagtgagtcttggaggttaagtgacttgtccaaggttacacagctgggaagggagaaagacatggctccatcccaggttccctgatcccaaatctccccctcattgcaatgtaccaagctgcctccaataagatcaagagtcttgacgatccccaagctagtccactcagtccagttttcctgccagactatagctgttttgcattccttatcttgtgttgaagcaaaccgggtaaggaaactccccaccttttttattaatgactcattttcagccaaaa

SEQ ID NO: 162673 - DNA, 601 bp, Human
ctatagatttggctaaaattacctgtgtacttactagacgccaggcagttagggggctttgcttaaatcactctcctgcattcttcacacagcacttgatgaaggaggaaagtgagtcttggaggttaagtgacttgtccaaggttacacagctgggaagggagaaagacatggctccatcccaggttccctgatcccaaatctccccctcattgcaatgtaccaagctgcctccaataagatcaagagtcttgacgatccccaagctagtccactcagtccagttttcctgccagactayagctgttttgcattccttatcttgtgttgaagcaaaccgggtaaggaaactccccaccttttttattaatgactcattttcagccaaaacacattgcagccacatcaggtacatgtgcccactcagcaaagacgtactgtgagaaagtaacatctaagttacttggtccaaagcccttctacatcaatcatcaagcaaccaaccctcctttgctgaaatctccaggggactaggccctttggtgggggaagaggggacggtttcttcaggggcatctcacccctgggaagtgcatcctct

SEQ ID NO: 162674 - DNA, 601 bp, Human
tgaagcaaaccgggtaaggaaactccccaccttttttattaatgactcattttcagccaaaacacattgcagccacatcaggtacatgtgcccactcagcaaagacgtactgtgagaaagtaacatctaagttacttggtccaaagcccttctacatcaatcatcaagcaaccaaccctcctttgctgaaatctccaggggactaggccctttggtgggggaagaggggacggtttcttcaggggcatctcacccctgggaagtgcatcctctctgctgggggcagtaaaaaggctttacrtgggccactgtggctcatgcctgtaatcccaacactttgggggcccaagcagggtgattcacttgagcccagaagtttgagaccagccgggcaatataaagagaccccatctccacaaaaaaatacaaaatttagctgggcttgatggtcccacctgtggtcccacttacttacttgggaggctgaggcaagaggatcagaaggtcaaggctgcagtgagccatgattgcaccactgcactcaaacctaggcaacagagctagaccctgtctcaggaaaaaaaaaaaaaaaaaagaggct

SEQ ID NO: 162675 - DNA, 601 bp, Human
ctttacatgggccactgtggctcatgcctgtaatcccaacactttgggggcccaagcagggtgattcacttgagcccagaagtttgagaccagccgggcaatataaagagaccccatctccacaaaaaaatacaaaatttagctgggcttgatggtcccacctgtggtcccacttacttacttgggaggctgaggcaagaggatcagaaggtcaaggctgcagtgagccatgattgcaccactgcactcaaacctaggcaacagagctagaccctgtctcaggaaaaaaaaaaaaaaaaargaggcttttcacgaatttcacattccaccctccaccatctttgatgtaggtaatttatcagcattttgtagaggaggaaacaaggtctcccctacgttgagcccaaatcagtttgaccttggggaacacagtgagcatccctgcgtggaggtacgcaggatccctgagggtgacaaccttcgaggtcgttccctggcctctctgcccagggtgagcatcctcagagacctcagctctcctctcagcatgcaattctcctccactcatggccctcccagctgcccctggcttctcaaagct

SEQ ID NO: 162676 - DNA, 601 bp, Human
tctcccctccatcttccacaccataatccaggtgatccttctaagaggcaaaggtaatcatgtttcttccctgctcaagatctgtcaaaagattctgtggcctccatagaaaaggcagacagcccggccacccaggcccttcaccatctgcctcttgaccatctccagtgtcctgcagtgtcctgaatataccttttccctgcctctgcccaacacactcccgttctttcaacacccaactcaactattaccttctctccatcagatcttccctgaaccaccccccagaaacaaaggtgastgtcccctctggttccccacagccaccccaccacttacccctgtgctcaggcactcctggagcactgcattgcaaccattggctcacacatctgtctctaccagcaaaccactaaaccgtgaataagtggcttcctgagccaggccttgtgcaatgaatggatttgcaacaaagggagccactgagagattacatgagccaagtcatggcaattagtccccatggaagcagcagctcagggcagggtccagacttgggcagacttaactatgcaggacattccattaacaataagcacca

SEQ ID NO: 162677 - DNA, 601 bp, Human
tgggactagcaggcttctttttctgtcccatttagtctaatatcacatttaacacaccatcctctaagggacagaagtcacaggaagccatgcagtctggttcctcctgatttctcctgtgtgccacatagttatgcttccttctgggaaggtgtgagttggagtcagtcccctcctgcatgcagctggggaaactgaagccaacaccattttagttactcacatggagctaagacaatcatacaaaactcaggcatggggtcagcccaccagcagtgtggacctcaccctgccggctgcrttccaaatgacagtggcatggtgccacagaaaaaacatgaggtgtgcagctggacccccagaagccctgactctgccaggtgctagctctgggacatcttgggcaagccatttggcccgagtctttttccccacctatgaaacaagccagagagctcattcctcacaaggctgtggtcagaatgtgcctctgtacttgagaagctgtaaaatgttcctcagttgctgcccttagtagggagctcagaggaaagctagttttgcctgtgcgtttctgtcggattgccctgtacccagggca

SEQ ID NO: 162678 - DNA, 601 bp, Human
caaatcaaacaacctggtctcagaactggtcttgcaccaccatggtgttaagctgccttcccacttcatccatgtttgctaagccgggtgggatctttcccctacaaactcctataggcggccacatttttcttttaaagatattttcccttcgactatagtccacaggcatcagaggatgaagctagcaggttgtctgtatgtagactttcttccagggaggaaagcagctttgctatctcctacctttttaaacaaaatctgccttgattttgtctgccaagatatgtctttggatggsgtaaagcacttctgagggaagctacgtgagccacgttgtagctggagagagaattgaaagaggaagccgagctgagaccaccacagttccggggctggagcccagctttgcagaatgcctgtatagcagtttgaccccaacagatgaggctgttagggacagaaatgaaaagcactgagagaggggaagtgtgggtggagcttatggacattctatgagccaaagcaattttgaagtctaatcatttggagggaaaatatttgtcatgtcattttaaagggtacaaaacaacacagagga

SEQ ID NO: 162679 - DNA, 601 bp, Human
cacatttttcttttaaagatattttcccttcgactatagtccacaggcatcagaggatgaagctagcaggttgtctgtatgtagactttcttccagggaggaaagcagctttgctatctcctacctttttaaacaaaatctgccttgattttgtctgccaagatatgtctttggatggggtaaagcacttctgagggaagctacgtgagccacgttgtagctggagagagaattgaaagaggaagccgagctgagaccaccacagttccggggctggagcccagctttgcagaatgcctgyatagcagtttgaccccaacagatgaggctgttagggacagaaatgaaaagcactgagagaggggaagtgtgggtggagcttatggacattctatgagccaaagcaattttgaagtctaatcatttggagggaaaatatttgtcatgtcattttaaagggtacaaaacaacacagaggaaaatgaaagggttagaaaataattggagcgcttctccctttacccttgtagaagacagctctccggttttcagctccactcattctgtcctccattggaagctcccccagtgtcttagagat

SEQ ID NO: 162680 - DNA, 601 bp, Human
gtaaagcacttctgagggaagctacgtgagccacgttgtagctggagagagaattgaaagaggaagccgagctgagaccaccacagttccggggctggagcccagctttgcagaatgcctgtatagcagtttgaccccaacagatgaggctgttagggacagaaatgaaaagcactgagagaggggaagtgtgggtggagcttatggacattctatgagccaaagcaattttgaagtctaatcatttggagggaaaatatttgtcatgtcattttaaagggtacaaaacaacacagaggaraatgaaagggttagaaaataattggagcgcttctccctttacccttgtagaagacagctctccggttttcagctccactcattctgtcctccattggaagctcccccagtgtcttagagatggatgatgtaaaagttagaaaatgcctgtgtttcctgcttgccttaatttaagaaactgcttgactgaaaagtgactgaatttcatttataggataaaatacttgatctccagggaagccaggcctcaatagatggatttttaccatgtcacttccccctagacctgtgggaactgacc

SEQ ID NO: 162681 - DNA, 601 bp, Human
ctcaggtgtggtgcccaattcatctttcatagaccaatattttgtttcccaaatgtgccttgtacatttctccaataccttcactctctagctgttggtgagggaaaggacaaaaattagagtcataaaatcaccattaaccccccagcttgaccactcactagctagtcatttaggctccgtgggcctcagtttgcttctctgtaaaatgaggcagaaaactatgaaagtgcctccaatctaagttccccaggctcctaagacaaggcctggcccatagaaggcacacagtacatgttgyttgagcaaataagtcagtttcttgtatggtatctggcatgtgatcagcataattaatggttgcttaaaaattaacagtctgttccccaccagtaacattcatcttcttcctcttggcctggtgaaatcttacgcattcttcaaagctaacatcacattctgctttgtctgagaaaccttcccaagaccacaccaactagaagtgatctatctccctaaactcctaagacatgtgttgtccataagcttcattcattcattcattcattttatgtatttatttattttcgaaatggagtct

SEQ ID NO: 162682 - DNA, 601 bp, Human
tggcatgtgatcagcataattaatggttgcttaaaaattaacagtctgttccccaccagtaacattcatcttcttcctcttggcctggtgaaatcttacgcattcttcaaagctaacatcacattctgctttgtctgagaaaccttcccaagaccacaccaactagaagtgatctatctccctaaactcctaagacatgtgttgtccataagcttcattcattcattcattcattttatgtatttatttattttcgaaatggagtctcgctttgtcacccaagctggagagcagcggcgcwatctcggctcactgcaacctctgtttcctgggttcaagcgattctcctgccttggcgtctcaagtagatgggattacaggtgcctgccaccacacctgactaatttttgtatttttagtagagatgaggtttcactatgttggccaggttgatcccaaacccctgacctcaagtgatccgcccccaccttggcctcccaaagtgctgggattacaggtgtgagccactgtgcccggcctataagtttcatttaaaacaagcttgtccaaccttcagcccaggactgccttggtccagaag

SEQ ID NO: 162683 - DNA, 601 bp, Human
atggagtctcgctttgtcacccaagctggagagcagcggcgcaatctcggctcactgcaacctctgtttcctgggttcaagcgattctcctgccttggcgtctcaagtagatgggattacaggtgcctgccaccacacctgactaatttttgtatttttagtagagatgaggtttcactatgttggccaggttgatcccaaacccctgacctcaagtgatccgcccccaccttggcctcccaaagtgctgggattacaggtgtgagccactgtgcccggcctataagtttcatttaaaacmagcttgtccaaccttcagcccaggactgccttggtccagaagctttgaatgcagcccaacacaaattcataaactttcttgaaacgttatgagattttttcatgattttctttttgtagcttatcagctaccgttagttttagtgtattttatgtgtggcccaagacaattcttcttccaatgtggcccagggaagccaaaagattggactgtcctgatttagaacttgggactcatggccttgtactgtaggttcccctctcaaaggatttcttagctgttcagttatgtcacaagctt

SEQ ID NO: 162684 - DNA, 601 bp, Human
ttatctcacagactgacctacacatgtatgagaaaagtcattgagaagattcacttttgggttatctgtagtagcaaaagactggaaacaaatgtctatcaacaggtaactggataaataaatcaggatatatccatgtacaagaacactatgcagccttttaaaagactgaagttggccaggcacgacagctcacacctgtactcccagcactttgagactgaggcaggcagatcacctgaggtcaggagttcaagaccagcttggccaacatggcgaaaccccatctcttctaaaaaaatataaaaattagccaggcctggcacctgtaaccccagctactcgagaggctgaggcagggagaattgcttgaacctgggaggcagaggttacggtgagccgagatcgggccactgcactccagcctggccagcagagcgagactccatctctaaataaatagatagaataaagtagaaatgtatgtacttgtgtagaatattctccaagatataagtgaaaagacaaggtgccaaccagtatgcatggcttcatccagcttatgtaaaaagggagatgtacacatgtgcacttgtatgtg

SEQ ID NO: 162685 - DNA, 601 bp, Human
ttggccaacatggcgaaaccccatctcttctaaaaaaatataaaaattagccaggcctggcacctgtaaccccagctactcgagaggctgaggcagggagaattgcttgaacctgggaggcagaggttacggtgagccgagatcgggccactgcactccagcctggccagcagagcgagactccatctctaaataaatagatagaataaagtagaaatgtatgtacttgtgtagaatattctccaagatataagtgaaaagacaaggtgccaaccagtatgcatggcttcatccagcttaygtaaaaagggagatgtacacatgtgcacttgtatgtgcctatcctgtctccagaacaatagcaacggctgacttggggcagcagggaaagagcctggggtcagaagcaggaggagacttgtcactatattcggtattctcattcatatggactaaattttttagcaagtgcatgcattatctttcttttaaattttaactttatttttaatcagatgatgaagtcacatgcacaaaatcatgaaaggtacaaaatggtacatggtaaaacgtcttcctcccagccctgtccccagccacc

SEQ ID NO: 162686 - DNA, 601 bp, Human
cctccctgggtttgggggcttttgaaagggcccaggtttagacatcaggaaacctgtatttgaggcctgactctgccattaactgagcctcctggagtgattcgcttctcatcccaagccttgcacagactgggtggtgattcctgaggcccagaacctggccagccttatagcgtcagtcagggatgtgttagtggagcccttcactcagcgaaagcatagctggctgagtctctagacagagagtgtgttgttcaggctaaactatctccctaccatggacataaaatgacatgggtakagaacacactaaattcttcaaggtaacaaatttaaattcttcaaaaagggagtggctatttaaaatatctctagttcatttttagcattactgaaattcaatgtaaatcacagtggccatatagagttgacatataaccctccctctgtcaaacaccaggttactaaagtcacagggattaagaaatgacccttggtaacaaaagttaccaatgtagaccagttatgtggcaggtggggagagctattctaaggttccttctaactccaaggggctcagatcggatatttggcaagtaag

SEQ ID NO: 162687 - DNA, 601 bp, Human
ttcaaggtaacaaatttaaattcttcaaaaagggagtggctatttaaaatatctctagttcatttttagcattactgaaattcaatgtaaatcacagtggccatatagagttgacatataaccctccctctgtcaaacaccaggttactaaagtcacagggattaagaaatgacccttggtaacaaaagttaccaatgtagaccagttatgtggcaggtggggagagctattctaaggttccttctaactccaaggggctcagatcggatatttggcaagtaagcaattggcacactgacsctgcagtttacaaagtgattcctacgatcctgagggtagaagaagattttgctcctggcagaggttttgcaggatgtgggtggggttggagaggaggctgctgtgagggtagaagggggtaacctctgtcccttcaccatgtttatcttgccatatcaccatccagcattcacagtccattgcccaaaataaaccacagatacaaagtagaaagatacttcatctattttctaagtaaatctaggaagttaaagatcacagctgtctccaagaccatgcccgttgagtaaaaatatctct

SEQ ID NO: 162688 - DNA, 601 bp, Human
tcctactccatttggtgataatccactgtgtgctaggcacccttctgggcaccagcatatagaaaaatgccttagcattcgtccctgccctcaaaagggccttgggatcaagaagaagtggacacgagcacatctgactaaacacaacatcatggagggtgtatccaggatatgagcaaaatgctcagagacaactctttttatttacgtcacaaatgcttctacagcacctactatgggccaggcatcatgctaataagggctttaccaatattaattcatttaatcctcacagcaacccactgagatgaatactattcttatcctttggtactgtggggaaactgaggcacagagcagggaaataacttgcccaaggttacacagccagtcagctccaggtggggctcatggggcatgggccctggagcccacacactctgactccagggcccacactcctaccgtcgggccacactgcctcacaacacactttctcgccaaattcagagacacataactaaaaccacttacaaatggagtatgccaactgagaatgctacagaacacattgaggaagtgacatttacactaaaatctg

SEQ ID NO: 162689 - DNA, 601 bp, Human
gaagtgacatttacactaaaatctgaatgatgaacaggagttaactagactaacaggggaggaagtgggttgcaagccgtggttctgggtggggaaggagtgcaatgtgttccaggaactcaccaaggccaccagaaaaggagggtggaaaagaaggaagaaaacagctcaagaagaggctaaaacatgagcagcaaccatagcattcagcaccctcactacaggccaagggtcattccgtagttgggttccgcaagaatgataggaacctaacagctttggcaggggtaatagcatcagytatgcatcatccactgatcacttgggctgacatgtagaatgcattggaagaggacggcggggttaagcagggagaccccgggggaggcagcagcaaggagagagttgatactcccttggatgggctggaggtggataaaaatggattcaagcgagttttaggagacagtatcaacatgttatgctgcatgtttgcttatgatgggtgaggagagggaggagtcaatggtggctctgaagattctaggtattcacagggtcgggaagcacttgtttgtcacaggtttgttgggtgccggag

SEQ ID NO: 162690 - DNA, 601 bp, Human
gcaggggtaatagcatcagttatgcatcatccactgatcacttgggctgacatgtagaatgcattggaagaggacggcggggttaagcagggagaccccgggggaggcagcagcaaggagagagttgatactcccttggatgggctggaggtggataaaaatggattcaagcgagttttaggagacagtatcaacatgttatgctgcatgtttgcttatgatgggtgaggagagggaggagtcaatggtggctctgaagattctaggtattcacagggtcgggaagcacttgtttgtcacmggtttgttgggtgccggaggggaagaaagtcccgtgcaacagccacatgcaatgttcatcactcccctggctctcaggctgcttcagggctccagaccctcgcacgtgctgatctcgggctaagggctgtttccttccttcgactgaagacctttcatactgtaagattcagcttgaaagtctctccctccatacacatcacacgctgacactggaccaggcacttatttggatctcacaacatctctgcaaagaagatattgctatgcctgttttacagactactgagaatcagagaag

SEQ ID NO: 162691 - DNA, 601 bp, Human
cggcaagggaacagactaagatggctagaaaatgcccctctttcatctctagaattcatctagtgaagcacttcccaagcctcaggtatccagggtctccctgttcttcctagaagtaggttccagtgaacagaaagcccacagcataactaagaaaaagctgtgtgtctctaccatgctggtgaatccatgctgctccttgacctgccactccttgacatggacggctctattctaacagtgccactctctcatgtcactgtccctctgcctggttcctcctcctctcttatctgcctgsagagtcccactccttggatgagtctcacccagagcatccctcccccatctcctcaggctgggtgtagggtgaccagctgtcctagtatgactgggcctaacggatgttctggtttgtgggactttgggtggtatatcagctcaatcccatgcaaaccaggatggttggtcaccctagttaggcatgtggattgcccctgcttatggcaagcccagcaagtatccaagctgtcttgcactcattggttctctcctctgctctttccccaaaagtagttatgaccctctgagatgaagccct

SEQ ID NO: 162692 - DNA, 601 bp, Human
ggcatgtggattgcccctgcttatggcaagcccagcaagtatccaagctgtcttgcactcattggttctctcctctgctctttccccaaaagtagttatgaccctctgagatgaagccctgtgccttgttcatcactgtattctcaacatctaggcctggtacagaccaggttgtgtggtcaatgtttgtgcaatgaacgtacgagcccagactcagcatatttaggagatggctcctaccacccagcaattagagaggggaggcaacgcaggcggaggacatctaccaatgcagcacatragcaagacacagggcctgagaataactgaaccctggcccacagatgccaaagaactggttttgcttgtttgtttcatttgccagtcagaagcgtgggggataatttagtggaatcccttcacagataggttttaacttgaaataattcaactataggtgcttggcaaacaatcaaatagtgaacaggcccaagagagaaggaaataatttagatggcagatggcagttggctccactagaagtgccacctggtgagcacgggcccacagtgggtgtgaggcgggacaacgggggcacact

SEQ ID NO: 162693 - DNA, 601 bp, Human
acatctaggcctggtacagaccaggttgtgtggtcaatgtttgtgcaatgaacgtacgagcccagactcagcatatttaggagatggctcctaccacccagcaattagagaggggaggcaacgcaggcggaggacatctaccaatgcagcacatgagcaagacacagggcctgagaataactgaaccctggcccacagatgccaaagaactggttttgcttgtttgtttcatttgccagtcagaagcgtgggggataatttagtggaatcccttcacagataggttttaacttgaaataaytcaactataggtgcttggcaaacaatcaaatagtgaacaggcccaagagagaaggaaataatttagatggcagatggcagttggctccactagaagtgccacctggtgagcacgggcccacagtgggtgtgaggcgggacaacgggggcacacttccctcctgcgtgtgtacctcacactgtgctaggatgattatggttctggcatacaaagtcacttatttttcatgcaacctggtccctaaacttaagaaaatgcctttatctggtaatcaactgggaaaaacattggctgaacccc

SEQ ID NO: 162694 - DNA, 601 bp, Human
cagggcctgagaataactgaaccctggcccacagatgccaaagaactggttttgcttgtttgtttcatttgccagtcagaagcgtgggggataatttagtggaatcccttcacagataggttttaacttgaaataattcaactataggtgcttggcaaacaatcaaatagtgaacaggcccaagagagaaggaaataatttagatggcagatggcagttggctccactagaagtgccacctggtgagcacgggcccacagtgggtgtgaggcgggacaacgggggcacacttccctcctgygtgtgtacctcacactgtgctaggatgattatggttctggcatacaaagtcacttatttttcatgcaacctggtccctaaacttaagaaaatgcctttatctggtaatcaactgggaaaaacattggctgaaccccatactttcaagtacttatgagattttcaaaggtggttcttacacactaacttaagagtccccagatggtgagtcccagctgcgccacttcataactaaatgatcttaagtagctaatgacttaaccttgtagagcttccattctcatgggcaaatgaaggataa

SEQ ID NO: 162695 - DNA, 601 bp, Human
cccttaataaatagcttccagacagcatgtcatttaaaactgaatgcatttttgcttctcagttgttggacatattatttactacctgatggtcttgctctggcccaaacaagctaattattgcaattccagagtacatgccatcatccagaaatagctttctgtagagtggggactgaaattaacaggcaattagcaagtttaaaaggatttcctttccccatccccacccctggcacctctaacacattaaagctcatcacagcagttattttaaggaaattcagcagaggtacttgcrgggcccgaggtcatcttgtgttggccctggatagatcatgaaatcctgttgccaaggagcatggtgggaatgtggcaggaaggctaaagtcaggaaagccacctcagccactaagtagccatatggcctggggcaagccactactcaactctgagcttcagtttcttcatcagtaaggaagtggccaggcacggtagctcacacctgtaatccagaacttggggaggccaaggccagtggatccctcgaggtcaggaggtcaaggccagtctggccaacatggaaaacccccatttctac

SEQ ID NO: 162696 - DNA, 601 bp, Human
taaatagcttccagacagcatgtcatttaaaactgaatgcatttttgcttctcagttgttggacatattatttactacctgatggtcttgctctggcccaaacaagctaattattgcaattccagagtacatgccatcatccagaaatagctttctgtagagtggggactgaaattaacaggcaattagcaagtttaaaaggatttcctttccccatccccacccctggcacctctaacacattaaagctcatcacagcagttattttaaggaaattcagcagaggtacttgcagggcccraggtcatcttgtgttggccctggatagatcatgaaatcctgttgccaaggagcatggtgggaatgtggcaggaaggctaaagtcaggaaagccacctcagccactaagtagccatatggcctggggcaagccactactcaactctgagcttcagtttcttcatcagtaaggaagtggccaggcacggtagctcacacctgtaatccagaacttggggaggccaaggccagtggatccctcgaggtcaggaggtcaaggccagtctggccaacatggaaaacccccatttctactaaaact

SEQ ID NO: 162697 - DNA, 601 bp, Human
ctctgaactgccccattttctgaaaagtgtccgaagtacagcccaggcatggggcattcagcacaaagggcccaagtcttgagagggagtagtttaggagtgaagaaatcccagcctcccactatccagtcttaaggtaaaaagaattgtacagatgagcacctttcttccccttggtatttccctttggcatgacccaaagaccactcccataaagggccataccctagtgttttctgacaatctagggatgaattccctattacatctcaggatgggagaaaaacaggatttgggagtyctggtttaatcactaaatgaacttaatcttgacttctggttttgtcatctgcaaaaggcaagtggtcctgatggctacttaataaagctgtctgtgagccaaatgagagtgtgcatctgcaagtgcattgtaaactgcaaaaataattgtggttctctctgggccgccttctacttcacaacaatactgagctgaccttacagataagctgaacagatggttgcctccatggtagtatttgaatagcaccagaaagtttcacctctccaaagcatctttctgctggcctgaaattcaacc

SEQ ID NO: 162698 - DNA, 601 bp, Human
cggttagggtttttcaaggatagtttgatgtacaggggattagggaatgggtgctgcagattggttggggatgaaatcatagggttatggaaaacggtccttgtgcactcagttggcctctgggtgggggccccaagactggctgagtcatgagcctcaagtccggatgtagtcagtctaaaaaacaactcaaaagatccatcttaggctctacaatagtgatgttatctacagaagcaattaggcaagtcacaaatcttgtgacctctggccacatgacccctgagcagtaagggatgayagaaaatttgcctatatcttagcagaattcaggcccctttcataatcctgaccttctggcctttcactggttttgcaaaagtggttgagtttggggagtggctattatccttgctgtaaggttcaactataaactaaattcctcccaaagttagcttggcctacacctaggaatgaccaaggacagcttggaggttaaaagcaagatggagtcaactatgtcagatttctctgtcatcatttcacaaaggcagtttcactgtgacctgctaatactgtggggaaaagaaaaaaacagtac

SEQ ID NO: 162699 - DNA, 601 bp, Human
tggttggggatgaaatcatagggttatggaaaacggtccttgtgcactcagttggcctctgggtgggggccccaagactggctgagtcatgagcctcaagtccggatgtagtcagtctaaaaaacaactcaaaagatccatcttaggctctacaatagtgatgttatctacagaagcaattaggcaagtcacaaatcttgtgacctctggccacatgacccctgagcagtaagggatgatagaaaatttgcctatatcttagcagaattcaggcccctttcataatcctgaccttctggcytttcactggttttgcaaaagtggttgagtttggggagtggctattatccttgctgtaaggttcaactataaactaaattcctcccaaagttagcttggcctacacctaggaatgaccaaggacagcttggaggttaaaagcaagatggagtcaactatgtcagatttctctgtcatcatttcacaaaggcagtttcactgtgacctgctaatactgtggggaaaagaaaaaaacagtactcattgggccttaggcatattctaggttctttgcaatacttaattttgtttttaatctcaa

SEQ ID NO: 162700 - DNA, 601 bp, Human
ctgagcagtaagggatgatagaaaatttgcctatatcttagcagaattcaggcccctttcataatcctgaccttctggcctttcactggttttgcaaaagtggttgagtttggggagtggctattatccttgctgtaaggttcaactataaactaaattcctcccaaagttagcttggcctacacctaggaatgaccaaggacagcttggaggttaaaagcaagatggagtcaactatgtcagatttctctgtcatcatttcacaaaggcagtttcactgtgacctgctaatactgtgggraaaagaaaaaaacagtactcattgggccttaggcatattctaggttctttgcaatacttaattttgtttttaatctcaaaccagtctgagacaggatttactattcagcacatttttgaaactgggaaaatgagtctcgagatgtttaggaaacttgctaaaaggtcacatgagtgacagggttaggacttaaacatgcgtggggtcgggaagatggcaggcacagggtatcaggccaggggagatgccctagagccagcgacactcagcctacttaacttcttctaagagccggtcacc

SEQ ID NO: 162701 - DNA, 601 bp, Human
cagtaagggatgatagaaaatttgcctatatcttagcagaattcaggcccctttcataatcctgaccttctggcctttcactggttttgcaaaagtggttgagtttggggagtggctattatccttgctgtaaggttcaactataaactaaattcctcccaaagttagcttggcctacacctaggaatgaccaaggacagcttggaggttaaaagcaagatggagtcaactatgtcagatttctctgtcatcatttcacaaaggcagtttcactgtgacctgctaatactgtggggaaaaraaaaaaacagtactcattgggccttaggcatattctaggttctttgcaatacttaattttgtttttaatctcaaaccagtctgagacaggatttactattcagcacatttttgaaactgggaaaatgagtctcgagatgtttaggaaacttgctaaaaggtcacatgagtgacagggttaggacttaaacatgcgtggggtcgggaagatggcaggcacagggtatcaggccaggggagatgccctagagccagcgacactcagcctacttaacttcttctaagagccggtcacctccat

SEQ ID NO: 162702 - DNA, 601 bp, Human
ggatgatagaaaatttgcctatatcttagcagaattcaggcccctttcataatcctgaccttctggcctttcactggttttgcaaaagtggttgagtttggggagtggctattatccttgctgtaaggttcaactataaactaaattcctcccaaagttagcttggcctacacctaggaatgaccaaggacagcttggaggttaaaagcaagatggagtcaactatgtcagatttctctgtcatcatttcacaaaggcagtttcactgtgacctgctaatactgtggggaaaagaaaaaaacagtactcattgggccttaggcatattctaggttctttgcaatacttaattttgtttttaatctcaaaccagtctgagacaggatttactattcagcacatttttgaaactgggaaaatgagtctcgagatgtttaggaaacttgctaaaaggtcacatgagtgacagggttaggacttaaacatgcgtggggtcgggaagatggcaggcacagggtatcaggccaggggagatgccctagagccagcgacactcagcctacttaacttcttctaagagccggtcacctccataaggaca

SEQ ID NO: 162703 - DNA, 601 bp, Human
ggatttactattcagcacatttttgaaactgggaaaatgagtctcgagatgtttaggaaacttgctaaaaggtcacatgagtgacagggttaggacttaaacatgcgtggggtcgggaagatggcaggcacagggtatcaggccaggggagatgccctagagccagcgacactcagcctacttaacttcttctaagagccggtcacctccataaggacagccagagcttctgccaggaaagaaagaacgttgatgctattcgttttccaaaagagcgtatctcctccggctaatctgaacrtatttcttacagggctcttgaatgcccctttgtagctgagtgggtgaaacggcatcaccaacatttggccctgctgctccactgagagccggcgccgttcgcgggataattatcctgtagtcttctcacctccggagagaatgcaaggcgccctccttccaaatctggcccgtcacgccagcaccacttatttttagaagctgttttcccctcatagtttcacaacctctaatctgccactctccagtgaatataaattaaaacacaacaatgaaatatggagaaatgttttctcccgtc

SEQ ID NO: 162704 - DNA, 601 bp, Human
aaatgacagcacctgccaaacacaatagggaaatagttagtccagccaggcagtgccatagagtggtcagagcatgggaatttcaagcagacagcagcaggctttaatcctcactctactctccccagatgtgtcaccaaggcaagtcactcagcttctctgaggctcagtttcctggcctgtagagtgggaataattataatactatcttggttgtcaggtttaaaagaccaaatgaatgtcactgcctggcagactacttaaaacaataagaggtgctaaagttactttaaaccaaccytctccaccctctccttccccacctcagtttcataccccagagaccaaattcctgatggattcctaaatgatatctctgccaaatactggtgccaggtgctgggcaaggcacagttttgcaaccagctgtcaggcagcaacaacttcacagtcgtacttttattcagtgtgtggtaaaacttctgggacaagagtcaaagtcgtagggctttagtgggaaactgccattgcctgaccagaggtacaaagcactggcccttccctcatccctggcctgacctaagagggctggggtaccaca

SEQ ID NO: 162705 - DNA, 601 bp, Human
acccccacaaaagtattagctatgaactatcattgaatttcgttttacaaacaaggacaatccaaagaggccaagttacctgcccaaggccacacagtccacaagagcccaagttcccactcaggcccattctcttagctctgtgccacccagctctgcaaatgtagccacccaaagccaatcaagccagtggtagagttctaaaaccaaatctagggctctgtcccaccaatctccacctggtgcctggaattcctctatttttgttttttgttctgttttgttttaaagtttcactcayccccctccttaaacccaaatatccctgggacaggatggaaatccataaacaggtgcctgagtaagacatcattcacagagccttttcctcctgacagctggccaagaacaggagagggggccctgggcaaatctgcaggattacatcagagcttattttcccccgtatgcccctaattttctacatgctcttccattcctgatggattcctaaatgatatctctgctaaatcctggcgccaggtgctcttccattctcccagtgatccagaactttcttgctgtcatgaagaaaactgat

SEQ ID NO: 162706 - DNA, 601 bp, Human
aaatcaacttcacatgattaggaagctcacataactagcaaggcgaggaggttctctctgccggccacctcctcccgccagcactccaccacagcctgcctactgtctgcccgtttggactagcagctggtgctgtgggatctttaactccactgaaattatgtcacaaaattggggcatcgtagggaacctaggaaaacagacaagaaataaagactccatatgtgcctggcccacacccgagtttggctcactatgcacacattagatcctgccattcacaatttaaaatatatatatwtttttttgtgtatatatacatatatacacacctagaaaaaaagtatgtattttgtatatatacaaaatttattacgtataaataaaatttatacaaaatttattacgtataaataaaatttatacaaaatttattacgtataaataaaatttatacaaaatttattacgtataaataaaatttatacaaaattttgtatatatttgtatatgtgaaatattttttaaatgttaatatatctataatatttatatatttgaatatataagtttatatatatttatatggctcactataaaa

SEQ ID NO: 162707 - DNA, 601 bp, Human
gatctttaactccactgaaattatgtcacaaaattggggcatcgtagggaacctaggaaaacagacaagaaataaagactccatatgtgcctggcccacacccgagtttggctcactatgcacacattagatcctgccattcacaatttaaaatatatatatatttttttgtgtatatatacatatatacacacctagaaaaaaagtatgtattttgtatatatacaaaatttattacgtataaataaaatttatacaaaatttattacgtataaataaaatttatacaaaatttattacrtataaataaaatttatacaaaatttattacgtataaataaaatttatacaaaattttgtatatatttgtatatgtgaaatattttttaaatgttaatatatctataatatttatatatttgaatatataagtttatatatatttatatggctcactataaaagaaattgaaacctccttaagcatgaacaactcccacgggtgttttcttcatgagacgcacaggaagatggcaatgggtactgaaaggaatgaattgcttgtgggggaactttatttactagaacaaccccaggtagga

SEQ ID NO: 162708 - DNA, 601 bp, Human
ttcctggcaggcaaagaaagtccaacactataaatcaagacctctgttcataaaacagaagatgtctgactgtttgaaatcaattcttgtatatcattccagagagaagactaactccgaataccttaattatgcgttagcacaatttagacgaatactcacaaaattaagcagagaacccaagccctgctacagaagtcttccccctcaaaaaaaaaaaaaaaattaagatggagtctccctctgtcacccaggctggagtgcagtggttcaatctctccagggattacaggtctgcgcmactgcacccggctcatttttgtatttttagtagagatagggtttcactatgttggccaggctggtctccaacccctgacctcaggttatccacccgcctcagcctcccaaagtgctgggattacaggcataagccaccgcgcccggcccttttaaagtaaatcttgattgatggacatgatgaagtccgtgaggtacaaatgcactgccttttacaaaagtaactggttccttggaggtgtccattgggaagatggcagtagttagagctgccactgaggaagacataataggcagctct

SEQ ID NO: 162709 - DNA, 601 bp, Human
caattcttgtatatcattccagagagaagactaactccgaataccttaattatgcgttagcacaatttagacgaatactcacaaaattaagcagagaacccaagccctgctacagaagtcttccccctcaaaaaaaaaaaaaaaattaagatggagtctccctctgtcacccaggctggagtgcagtggttcaatctctccagggattacaggtctgcgccactgcacccggctcatttttgtatttttagtagagatagggtttcactatgttggccaggctggtctccaacccctgacctcaggttatccacccgcctcagcctcccaaagtgctgggattacaggcataagccaccgcgcccggcccttttaaagtaaatcttgattgatggacatgatgaagtccgtgaggtacaaatgcactgccttttacaaaagtaactggttccttggaggtgtccattgggaagatggcagtagttagagctgccactgaggaagacataataggcagctctcattccaaggcagctgagccacgaagaaggctggcctgagtggtcagtgtgcagtaaatccaaatctttaaatgcagttc

SEQ ID NO: 162710 - DNA, 601 bp, Human
aacctggctctttccggccaaaatatgatctttacagagctcaacatgccttgcacacactaggtgtttaataagagctgaaggatcaaagagaatggatcctgaccatgattacaattaattaagaaagtgattaacaggaaagggaagattggtgtttctctcaggcgagctttcctaattcttcctctaccatcaaactgaaaaaagccaatagtctcccctatctcaaatccaggatcctcggaagggtttgttaagtcacagccagctggaccccacctcgcaaggatgtggttcmataggtctagagcgggacttacaatctgcatttctaacaaattcctggtgatgttgccgctgctggtccgaggccctcactctgagaatcactttgagcccctgcgttatcaataggggccatattgcccccaagagggtgaaattgtatcttgaggtgggtgatgaaaaaagtttttattataaagcagatatatatatatacacacacacatatatatacagtacacaaacagggtgcagtatatccctggtgctaaaacttcacgggtagacaattagggggtaaaaatgtctagaa

SEQ ID NO: 162711 - DNA, 601 bp, Human
ctaggtgtttaataagagctgaaggatcaaagagaatggatcctgaccatgattacaattaattaagaaagtgattaacaggaaagggaagattggtgtttctctcaggcgagctttcctaattcttcctctaccatcaaactgaaaaaagccaatagtctcccctatctcaaatccaggatcctcggaagggtttgttaagtcacagccagctggaccccacctcgcaaggatgtggttcaataggtctagagcgggacttacaatctgcatttctaacaaattcctggtgatgttgccrctgctggtccgaggccctcactctgagaatcactttgagcccctgcgttatcaataggggccatattgcccccaagagggtgaaattgtatcttgaggtgggtgatgaaaaaagtttttattataaagcagatatatatatatacacacacacatatatatacagtacacaaacagggtgcagtatatccctggtgctaaaacttcacgggtagacaattagggggtaaaaatgtctagaaagactctttaggggggcaatcatgataaaacattgagaaacactgacctggcccaagtg

SEQ ID NO: 162712 - DNA, 601 bp, Human
acaattaattaagaaagtgattaacaggaaagggaagattggtgtttctctcaggcgagctttcctaattcttcctctaccatcaaactgaaaaaagccaatagtctcccctatctcaaatccaggatcctcggaagggtttgttaagtcacagccagctggaccccacctcgcaaggatgtggttcaataggtctagagcgggacttacaatctgcatttctaacaaattcctggtgatgttgccgctgctggtccgaggccctcactctgagaatcactttgagcccctgcgttatcartaggggccatattgcccccaagagggtgaaattgtatcttgaggtgggtgatgaaaaaagtttttattataaagcagatatatatatatacacacacacatatatatacagtacacaaacagggtgcagtatatccctggtgctaaaacttcacgggtagacaattagggggtaaaaatgtctagaaagactctttaggggggcaatcatgataaaacattgagaaacactgacctggcccaagtgcctacttggtgcttactccccagcagctgagccagaagccctcacctgcagaga

SEQ ID NO: 162713 - DNA, 601 bp, Human
ggaggtctgatttggtacaagagatccagaacttgtgtccagctggagtaaggagagtaaggtatagcagagacaggacaaagtaaattggacctcagagacagggcacggggcagagtctgattccaactgaaacgtaaggatccccacatccctcaacagtccctcagatggtgaggtttaggacacagtaaggaggggtggaaagagcatgggtttgggtatgtcttccctcatgaaaaccgtggagccagaagcagtagtgttacagtgatgtcatcccctgaggctcagtttcctygtaggtaaggtgggaatggaaatgactgctgcataggctgtgagatgattttgtgagatgtaagcgcccaacagatggtggtgatgacgatgttggaatcaggtgactctagcctcttcactgtcacgcttgctctcgtctgaacgtgcttccatgtctccatattgctcttgtgtccacaagcaaaagcaataatccattgccatttaaccagcacaaaactgaatgaggctgtcaccttccttttctgaaacacatgcttcagacagcgcagtctacagtcacttgagggctgggaga

SEQ ID NO: 162714 - DNA, 601 bp, Human
agaacttgtgtccagctggagtaaggagagtaaggtatagcagagacaggacaaagtaaattggacctcagagacagggcacggggcagagtctgattccaactgaaacgtaaggatccccacatccctcaacagtccctcagatggtgaggtttaggacacagtaaggaggggtggaaagagcatgggtttgggtatgtcttccctcatgaaaaccgtggagccagaagcagtagtgttacagtgatgtcatcccctgaggctcagtttcctcgtaggtaaggtgggaatggaaatgackgctgcataggctgtgagatgattttgtgagatgtaagcgcccaacagatggtggtgatgacgatgttggaatcaggtgactctagcctcttcactgtcacgcttgctctcgtctgaacgtgcttccatgtctccatattgctcttgtgtccacaagcaaaagcaataatccattgccatttaaccagcacaaaactgaatgaggctgtcaccttccttttctgaaacacatgcttcagacagcgcagtctacagtcacttgagggctgggagaagatgctgtacaatatttactcctgtt

SEQ ID NO: 162715 - DNA, 601 bp, Human
cctcagatggtgaggtttaggacacagtaaggaggggtggaaagagcatgggtttgggtatgtcttccctcatgaaaaccgtggagccagaagcagtagtgttacagtgatgtcatcccctgaggctcagtttcctcgtaggtaaggtgggaatggaaatgactgctgcataggctgtgagatgattttgtgagatgtaagcgcccaacagatggtggtgatgacgatgttggaatcaggtgactctagcctcttcactgtcacgcttgctctcgtctgaacgtgcttccatgtctccatrttgctcttgtgtccacaagcaaaagcaataatccattgccatttaaccagcacaaaactgaatgaggctgtcaccttccttttctgaaacacatgcttcagacagcgcagtctacagtcacttgagggctgggagaagatgctgtacaatatttactcctgttgaaaattataatcaataagtccctgactgttttcatatgtgctgctactaagctaccactccctgaccttgagcagatagatttgggatccacgtgtagccctgttaaattttgtcttttcagatttagtctctccc

SEQ ID NO: 162716 - DNA, 601 bp, Human
ccttctgttctcctttcactccctcatttgatcagcctctgggtcctgctgactccaccttaaaatgcctcctgtgcaccctttcctctgcgtctctacaaccgcacgcctcacagggatttgtcatctcctcccagaacattgcagtgatttcctaacaggccccctcgcctatatacctagactctttctgggagggatttaaggtggctcagcctatgtatattcacatgtctccacctactcccaatgtgatcattacctagaggcctctcatacttttttttttttttttttaatrcctgaagtttttttgtttattcctttttgttttccagctctacccaccagtatttttttgttgatgacagatcttctcctaaaatgacaaagaatttagaaacattttccatgtatttttaacatctgcgtcagtgaacaaagaaatcatagttgatgatggggtggggagggagaaaagggaaacttaattagctttagtttttataagaacttccatcagcgctgaatgaactggaatatgacatctgattgggcctaatcacaaggaagagtacattaacttgccgtgaatatattt

SEQ ID NO: 162717 - DNA, 601 bp, Human
aaaatgacaaagaatttagaaacattttccatgtatttttaacatctgcgtcagtgaacaaagaaatcatagttgatgatggggtggggagggagaaaagggaaacttaattagctttagtttttataagaacttccatcagcgctgaatgaactggaatatgacatctgattgggcctaatcacaaggaagagtacattaacttgccgtgaatatatttaccagtttttacaataccatttttaaatctctacagaagccaattttcttacaagaaaattaccctaccaagattttttttagaacaagcaaacccaaatttctttcttaccctaacccagttcatccagctctgacactgtggcctgaggacagacactgatgctatcttggagcctctgcctctccacccttcaggaatgttctgcaccctgaaggaggtaggaaaacttgaggatgcaaagaaaaaccagacatctgttatgtctcttgatgttagggagtgggagtgaaattccagctcacccactctcctggggaggctagaatttaatgggatgcttgagatgcgtgggccgagggtgaggctgcagccaaagat

SEQ ID NO: 162718 - DNA, 601 bp, Human
acagggcacagagcaagtgtctgagggcaagtcacctggacacagcagtggcagaaaccaaggagtaggcatgccaggcaggtctccagcagcctctgagtttccaggcacagggcccacaccagggtggactttttatatgtacatacacacccacacacccacacccccacccaaacacacacactgcaccagtcccgtttcctcagatggacatttttcagaagaaagccaatgacactagcaagtccatgacccatttcaagatatgacaggacatcattttccaagtggagaaaasaaaaattctcagaaagccctgtataccacagaaatccatacaccagtttcaagtctcatccaacagaccagccagagtgcagggccacagggcaccctggctggagtgaacaagctccctccaaaccccctcaagattctaggcccaccagcataaaagtcctcttgatggtggggtcattccaaccccatctggggttgtaacctctcagagcagaggaaaataaacaggctgttgtcaggcagcccagggcagaagtgatgacacctgctcattctgaatttatctttattatacatt

SEQ ID NO: 162719 - DNA, 601 bp, Human
gaagatgctacaggtgtgggggtgtgttagtccattctcacactgctaataaagacatatttgagaaatacccgagactaggtaatttatagaggaaacaagcttaactgactcacagttcagcatggcttgggaggcctcaggaaacttacaatcattgcagaggaggaagcaaacacatccttccgcaaatggtggcaacaaggagaaatgcccagcgaaggggtaggggaagctccttataaaaccatcagatctcgtgagaactcactgtcacaagaacaagctgggggaaaccackcccatgattcaatgatcttcacctggtccctcccaggacatgtggggattatgggaactacaattcaatatgagatttaggtggggacacaggcaaatcataggagtggggaaaccaggagaacagggaaataaaattggttttcacaatagctaaactttccctatcctcttgagagtatttctaagcaaaagagaaatatacttttctttttgctttctctaaaaaaagaaggaaagaaggaaggaagaaaaaaatggagggagaggaggagggaaggaaggaaggaaggaagcaaag

SEQ ID NO: 162720 - DNA, 601 bp, Human
ggaaagaaatctccaaacaacaagaggcactgtgaccaattcacataagactatcactaagacatcaggttttaacttgtaacttgcttttttccttgttagtggtatgttaaacaatggtatatcatgctatttgtgtatactggattcaatgaaatactataataaacaagtaagcaaaacataagatcataacacgtcctgaaaggacctctcagcaagagtgacacattgccaagtaatgcacattgttccacatggagttggtgaggataacagcacttccttccagaaatacttyagtatacaaagtgctgtcacgtgatgacgtctcatttcagcatctcaacaaccgcacctggaaggccttattattttgtatatttacggatgaagagactggatctcaaatagcttaagagacttccctaacataactcagctaatgcctggaagacccaaaactagaatccagggctcctgactctacatcctatgtttttcttctcggctacatgaaatggtacaaaatacgaattaaatgattatccatggtcttgtgtaattctggcatgtttccagctaagacttctcagctgtt

SEQ ID NO: 162721 - DNA, 601 bp, Human
ttttttccttgttagtggtatgttaaacaatggtatatcatgctatttgtgtatactggattcaatgaaatactataataaacaagtaagcaaaacataagatcataacacgtcctgaaaggacctctcagcaagagtgacacattgccaagtaatgcacattgttccacatggagttggtgaggataacagcacttccttccagaaatactttagtatacaaagtgctgtcacgtgatgacgtctcatttcagcatctcaacaaccgcacctggaaggccttattattttgtatatttayggatgaagagactggatctcaaatagcttaagagacttccctaacataactcagctaatgcctggaagacccaaaactagaatccagggctcctgactctacatcctatgtttttcttctcggctacatgaaatggtacaaaatacgaattaaatgattatccatggtcttgtgtaattctggcatgtttccagctaagacttctcagctgttcattcaactcaaaggcatccttcagtcctcttccccattcttctctgtctcggggatctgcctggggagagagtgtggtgaaagcag

SEQ ID NO: 162722 - DNA, 601 bp, Human
aagctaaattggcgctgacaactggcaataggtattgagagtctttttaaaagttgatgtcacttaatctagtaatcccatttccaggaattcattcaaagagaattaatctgggatatagagaaaggtctatgaataagattgcatcacagtgtggtttacatttggaaaaaactgtggttgtaacttaagttacaacagtagagggttgttcaaatattataattctggtacaaccacacgttaggattctctcttgccaattattgatgtcgtgggggagtgttcaagacaaaacatwgagttataaaatcaggattctaaattatatatatacacacacatacacacaattaaactcaaacatacacatggagacacacacagcattttaaaacctagaaggaaatcacaaccataatacaatagttatctctgattatgggaatacaggtaattttggtgattttctctatgttttcttttttttctttttcttttttttttttgagacggagtctcaatctgttgccccaggctggagtgcaatggcatgatctcagctcactgcaacctccttctcccaggttcaagcgattct

SEQ ID NO: 162723 - DNA, 601 bp, Human
tggttgtaacttaagttacaacagtagagggttgttcaaatattataattctggtacaaccacacgttaggattctctcttgccaattattgatgtcgtgggggagtgttcaagacaaaacattgagttataaaatcaggattctaaattatatatatacacacacatacacacaattaaactcaaacatacacatggagacacacacagcattttaaaacctagaaggaaatcacaaccataatacaatagttatctctgattatgggaatacaggtaattttggtgattttctctatgytttcttttttttctttttcttttttttttttgagacggagtctcaatctgttgccccaggctggagtgcaatggcatgatctcagctcactgcaacctccttctcccaggttcaagcgattctcctgcctcagcctccccagtagctgagactacaggcatgagccaccaagcctgactaatttttgtatttttagtagagatggggttttaccatgtttgccaggctggtctcgaactcctgacgtcaggtcatccacctgcctcggcctaccaaagtgttgttgggattacaggcatg

SEQ ID NO: 162724 - DNA, 601 bp, Human
ggttcaagcgattctcctgcctcagcctccccagtagctgagactacaggcatgagccaccaagcctgactaatttttgtatttttagtagagatggggttttaccatgtttgccaggctggtctcgaactcctgacgtcaggtcatccacctgcctcggcctaccaaagtgttgttgggattacaggcatgagccactgcacctggctgtttttctctaagttttctacaatgttttattttgctttttaagacagaaagtccacgcaaaccagtcaggaatagatgtgaaaaatggggatggggcctttgaaccaggagcaatatgagaaggtgagaaggatggcctgggccggctgggtctgcgagactacctggaaaagccacgggaatcacagcccacagggtgacatctccagatccagcagtcttttaggaaggcagatggagtctcagacctgtcccacccatcttaaagtggcctggtcacagggtcagagcttcagcagacagaggcgccctgggataagttgccaaatatgggttgagcaacagtggcactggaacgaggtaggaggcggggaaaggggatggaaggtaa

SEQ ID NO: 162725 - DNA, 601 bp, Human
caaaccagtcaggaatagatgtgaaaaatggggatggggcctttgaaccaggagcaatatgagaaggtgagaaggatggcctgggccggctgggtctgcgagactacctggaaaagccacgggaatcacagcccacagggtgacatctccagatccagcagtcttttaggaaggcagatggagtctcagacctgtcccacccatcttaaagtggcctggtcacagggtcagagcttcagcagacagaggcgccctgggataagttgccaaatatgggttgagcaacagtggcactggaacraggtaggaggcggggaaaggggatggaaggtaaaatcctgcccctgtcctcaaggtacttacagtcaatgtgaggaaggctgacagccataaaatgatgacctatgacaacgagggtcgttccacacacatcctccagaccccggcacaagacctccgcctttcatctccattatattgggcaaaacacaaagcatcaacgaaaaaaaaaaaaaagtaaaagtacatagaaaaggagacacagaggaatacagaaaagcaaaaacctccttcaaactggtggatgtttcatcccaaagga

SEQ ID NO: 162726 - DNA, 601 bp, Human
acagtggcactggaacgaggtaggaggcggggaaaggggatggaaggtaaaatcctgcccctgtcctcaaggtacttacagtcaatgtgaggaaggctgacagccataaaatgatgacctatgacaacgagggtcgttccacacacatcctccagaccccggcacaagacctccgcctttcatctccattatattgggcaaaacacaaagcatcaacgaaaaaaaaaaaaaagtaaaagtacatagaaaaggagacacagaggaatacagaaaagcaaaaacctccttcaaactggtggaygtttcatcccaaaggacgctcgacctttctcaggcatcctgccactgaagaagtcaattactcacggcccacagtccctaggttccgctcagcacagtctggaatcaagggttcatttaatggaagcttaacagattcagatttctctaatattccacatccccttctgccaagaagctgctttgaaagatgacactcccttgatgtgaatttgcagcctgccccattaacaaggcttcagtcagaaaacatttttaaatcaaccctgttccagacacttgctcccaaggacaaactaga

SEQ ID NO: 162727 - DNA, 601 bp, Human
gtatttggtattataaggagtattttatattatttcaaataggattatgcactatttcattatacccttatctcatatagaagacatttttaatgctatttgattgaaagtagaccagagactcagaaaggttaaacctctttcctagtaagtataaaaagttaatgcaggccaggtgcagtggctcacgtctggaatcccaacactttgggaggccaaggcgggaggatcacctgaggtcaggagtttgagaccagcctggcaaacatggcaaaaccccatctccagtaaaaatacaaawattagccaggcatggtggtgcacacctgtaatcccagctacttcggaggctgaggcaggagaacagcctgaacccaggaggcagaggttgtggtgagccaagatggtgccacagcactccagcctggacgacagagtgacactccatctcaaaaaaagttaatgcagaaataaggctgcatatcggtttcctattgcttctgttaacaaattactacaaatttaattagttaaattgacactatcttacagttctggagtcaaaagtcctaaaattaaggtgtcaacagaactgtgtttc

SEQ ID NO: 162728 - DNA, 601 bp, Human
ttaaaaaacaaaaagggcctttggagatcatcagccaatccccttattctataaaggggcagaggagtaatacaactatcccagtgtcaaatagggagtttgtgagacataatgagggcctgaattagatctggaggaaaaaaagtaaatggaggtatttttgagaaaaatcagtgagctgaacggcaatagggtaggagaaatgtaggggtcaagggtgcctaaagttcatggcttggggatgtcactcacagagctggggacagatagaggaaagacacttttgagggaaaatatgtaktcagtgtgttctagaactcggatctcttcttagtgtcactgtgaaattttccattacttcatctcacttcctgttctctcataagcgcgaacacggggctgtaatcatcgtctgaccaccacatgttagtgcactgtgtttcttgctgacacctggctaggctttgaggatgagtttccatcccaacatctaccaacatacaaggagcccaaggcaatgggattttctgcgcatctttgcttgaaccttaaaggtgctgccccattgtcttctggtaggcctcgtttctgggaagacgtc

SEQ ID NO: 162729 - DNA, 601 bp, Human
gagtttgtgagacataatgagggcctgaattagatctggaggaaaaaaagtaaatggaggtatttttgagaaaaatcagtgagctgaacggcaatagggtaggagaaatgtaggggtcaagggtgcctaaagttcatggcttggggatgtcactcacagagctggggacagatagaggaaagacacttttgagggaaaatatgtattcagtgtgttctagaactcggatctcttcttagtgtcactgtgaaattttccattacttcatctcacttcctgttctctcataagcgcgaacacrgggctgtaatcatcgtctgaccaccacatgttagtgcactgtgtttcttgctgacacctggctaggctttgaggatgagtttccatcccaacatctaccaacatacaaggagcccaaggcaatgggattttctgcgcatctttgcttgaaccttaaaggtgctgccccattgtcttctggtaggcctcgtttctgggaagacgtctattgaattcttatctttgtcactgagtatgcagtttgactttttacctctagcttcttttttttttttttttttttttttggtcactggttttc

SEQ ID NO: 162730 - DNA, 601 bp, Human
atacaaggagcccaaggcaatgggattttctgcgcatctttgcttgaaccttaaaggtgctgccccattgtcttctggtaggcctcgtttctgggaagacgtctattgaattcttatctttgtcactgagtatgcagtttgactttttacctctagcttcttttttttttttttttttttttttggtcactggttttcagcaatttgattattctgtggcttggtgtagtttccctcatattttttgtgttttgagatcattgatcatcttggatctatgtatttagtgctttcatcaaaygtagatatttttccaccattattatttctttaagcatttcttctgtcccctttcttgtctcctttggaattttcaattacatatatatgaggcctcttaaaattgcccgacagctccctgatgttctgttaatttattttcagcctttattctctgtgtttcaaatggatggtttctgttgctgtgaattcaagtccactaatcttttcttctgcaatgtgtaatctgttattcatcccacctaatgtatttcatatctcagacattgatttttgaatctctagaagttcagtttagact

SEQ ID NO: 162731 - DNA, 601 bp, Human
gtcactggttttcagcaatttgattattctgtggcttggtgtagtttccctcatattttttgtgttttgagatcattgatcatcttggatctatgtatttagtgctttcatcaaatgtagatatttttccaccattattatttctttaagcatttcttctgtcccctttcttgtctcctttggaattttcaattacatatatatgaggcctcttaaaattgcccgacagctccctgatgttctgttaatttattttcagcctttattctctgtgtttcaaatggatggtttctgttgctgygaattcaagtccactaatcttttcttctgcaatgtgtaatctgttattcatcccacctaatgtatttcatatctcagacattgatttttgaatctctagaagttcagtttagacttcttatatctcccatatttcttcttagcatgcttacattttcttctaccatcttgaataaatgaaatatagttataagaactgttttaatgttcttgtggactaattttaccatctataacaattctaggttggttttgattgattgatttttctcttcattatgggttgtattttcctgcttct

SEQ ID NO: 162732 - DNA, 601 bp, Human
atatttttccaccattattatttctttaagcatttcttctgtcccctttcttgtctcctttggaattttcaattacatatatatgaggcctcttaaaattgcccgacagctccctgatgttctgttaatttattttcagcctttattctctgtgtttcaaatggatggtttctgttgctgtgaattcaagtccactaatcttttcttctgcaatgtgtaatctgttattcatcccacctaatgtatttcatatctcagacattgatttttgaatctctagaagttcagtttagacttcttrtatctcccatatttcttcttagcatgcttacattttcttctaccatcttgaataaatgaaatatagttataagaactgttttaatgttcttgtggactaattttaccatctataacaattctaggttggttttgattgattgatttttctcttcattatgggttgtattttcctgcttctttgcatgcctggtaatttttgactagataccggacattgtgaattttacctaattggtgctgggtattcctacattattttaaatgttcttcagctttgtcctggggtgcagttaaatta

SEQ ID NO: 162733 - DNA, 601 bp, Human
agtttgacccttttgagacttgctttaaaactttgttagatgggaccagaacagcctttagtctagggcaaatttgccccttgaatccaaacactgtttatgttgttaatgatgacaaaatatccatgtcccacactattccttactaagtctcccttcaacaattgtgtttgagtagaactgttaactgcctcacctcactctcctgtgtattcacaaggcaaagatccccaaggttttgaccaatacccaatgttgttttggtgccagcttgcacagcaccagggctcttgcctctcakagagaattgtgccccctctctccactatgtggcacagcacattgagctcaacaacgttctatcagactgatgttgccataacactgcatatcttcacccaggaggggcgacagccctaagtctcttatgtggcaaaataaaatccaactttcagtgctaaaaaggccctgcttttctggagcgaaccccttcagaggtctcacaagcatttaaaagagaatttctagaccacaagtttcagtgtggagagctgcaggcttagagaattgcagggatgtttgaagccctgcccacagttcc

SEQ ID NO: 162734 - DNA, 601 bp, Human
cccctctctccactatgtggcacagcacattgagctcaacaacgttctatcagactgatgttgccataacactgcatatcttcacccaggaggggcgacagccctaagtctcttatgtggcaaaataaaatccaactttcagtgctaaaaaggccctgcttttctggagcgaaccccttcagaggtctcacaagcatttaaaagagaatttctagaccacaagtttcagtgtggagagctgcaggcttagagaattgcagggatgtttgaagccctgcccacagttccaggaaacaccctktgtatatgagctcctttcccacacaaatgtgagaaggaggctatgaccctggaaattgaacacagggcaacagaaaccctgccgaaactattcttgcattgacattagacacaaaaacacccatataagcttgatttgctgtcacagtcaaataaaacaataacatgtaagcatttcaaagagattccactgacattctcacttgtgattctgacaacaagcgtgtaagtaagaaaggcaggcgtcacagctcctaagtgacagacgaggaaatcagccttgcggaggttaaatgatctc

SEQ ID NO: 162735 - DNA, 601 bp, Human
atgtaagcatttcaaagagattccactgacattctcacttgtgattctgacaacaagcgtgtaagtaagaaaggcaggcgtcacagctcctaagtgacagacgaggaaatcagccttgcggaggttaaatgatctcaacaaggtcagacagctagttggtgcaaagtggggccctgaacccagatcttctgactcttggtcaagagctctattcattccgctgtgtctgctctcttactatatcagaaaagggaacagccaccaacttcctgtgttgaccctagaccaggacttcttgatsacagcacacttaacatttggggctggataattctttgttgtgagaggctgtcctgtgcattgaagggtgttgagcagtatccctggcctctacccactaatgccagtagaactccccttgccccctgttttgacaaccaaaactatctccaggtgttgccatgtttccaaatgccccaaggtgggggaaggtaacagcagagcaaacttacccctcagttgaaaaccactgccctaaatgatgcctgagaatgctgtccacgtgtttgagaaagcagtggtgattaagttagttctgtga

SEQ ID NO: 162736 - DNA, 601 bp, Human
acccaatccactttccaaggaaacatttctggaaggcaacacggaattagttaatgtgatgagaggcagaacagagcagttaagatgcaggctctgcacataccacaacgtggatgaatctcacttaatgttgggtgagaagagccaggcccaaaagagcatctattgtgtgaatctactaactcgaagttcaagagcaggcaaaactaatctccggtgatggaagtctgaacagttacatctgctggtggtgttgcctggagacacgtttcagagaatagaaatgttctctgccttgatsgtggtggtggttacggtggttgtaaacataatagacactcacaacactcacagagctatacacttaggattcgtcacctaaaaaaaaaaagaaagaaaaagaaaagaaaagaatgttgactctagaaccaaattgtctaagtttcatccctgaggatgactctggttaccttagagcattttgtgaaaagttaataaactacacagggtatacaggaagtgcacaataagtatttgcatcattataattaacagaactacacttcagccaagcgcagtggctcacgcctgtaatcccaga

SEQ ID NO: 162737 - DNA, 601 bp, Human
cccaatccactttccaaggaaacatttctggaaggcaacacggaattagttaatgtgatgagaggcagaacagagcagttaagatgcaggctctgcacataccacaacgtggatgaatctcacttaatgttgggtgagaagagccaggcccaaaagagcatctattgtgtgaatctactaactcgaagttcaagagcaggcaaaactaatctccggtgatggaagtctgaacagttacatctgctggtggtgttgcctggagacacgtttcagagaatagaaatgttctctgccttgatgktggtggtggttacggtggttgtaaacataatagacactcacaacactcacagagctatacacttaggattcgtcacctaaaaaaaaaaagaaagaaaaagaaaagaaaagaatgttgactctagaaccaaattgtctaagtttcatccctgaggatgactctggttaccttagagcattttgtgaaaagttaataaactacacagggtatacaggaagtgcacaataagtatttgcatcattataattaacagaactacacttcagccaagcgcagtggctcacgcctgtaatcccagaa

SEQ ID NO: 162738 - DNA, 601 bp, Human
tttccaaggaaacatttctggaaggcaacacggaattagttaatgtgatgagaggcagaacagagcagttaagatgcaggctctgcacataccacaacgtggatgaatctcacttaatgttgggtgagaagagccaggcccaaaagagcatctattgtgtgaatctactaactcgaagttcaagagcaggcaaaactaatctccggtgatggaagtctgaacagttacatctgctggtggtgttgcctggagacacgtttcagagaatagaaatgttctctgccttgatggtggtggtggytacggtggttgtaaacataatagacactcacaacactcacagagctatacacttaggattcgtcacctaaaaaaaaaaagaaagaaaaagaaaagaaaagaatgttgactctagaaccaaattgtctaagtttcatccctgaggatgactctggttaccttagagcattttgtgaaaagttaataaactacacagggtatacaggaagtgcacaataagtatttgcatcattataattaacagaactacacttcagccaagcgcagtggctcacgcctgtaatcccagaacttcaggagg

SEQ ID NO: 162739 - DNA, 601 bp, Human
tcagccaagcgcagtggctcacgcctgtaatcccagaacttcaggaggccgaggcaggcagatcacgaggtcaggagatcgagaccatcctggctaatatggtgaaaccctttctctactaaaaatacaaaaaaaaattagccgagcgtggtggcaggtgcctgtagtcccagctactcgggaggccaaagcaggagaatggcgtgaacccgggaggcggagcttgcagtgagccgagattgtgccactgcactccagcctgggtgacacagagagactctgtctcaaaaaaaaaaaaaaagaaaaaaaagaactacacttctagccagtcaggcaaagccaaggattaagagagttactctgaatttctctgctgccccctctgcctcacctcccatgcattgaacacagagtgtatatgtaagtcctcccaccccaaccatcaagacaggcacatctgccatttttctctgtcttcttcagttccttccaggttctctctgccttgcttaggagctgcccctgtttgcagagctcttcatcaatagactgaatatttacagaatagcgcagttttgattaaacagttcatttcactgga

SEQ ID NO: 162740 - DNA, 601 bp, Human
actgcactccagcctgggtgacacagagagactctgtctcaaaaaaaaaaaaaaagaaaaaaaagaactacacttctagccagtcaggcaaagccaaggattaagagagttactctgaatttctctgctgccccctctgcctcacctcccatgcattgaacacagagtgtatatgtaagtcctcccaccccaaccatcaagacaggcacatctgccatttttctctgtcttcttcagttccttccaggttctctctgccttgcttaggagctgcccctgtttgcagagctcttcatcaatrgactgaatatttacagaatagcgcagttttgattaaacagttcatttcactggagactggggtggtgtattgtgtctcctccggagttattcttggcatcagcagcccttgctcttagcatccgtttctttacattttaaggtggagcataagaagaactgcagtgaaacagatcagatggggggcaggtgggatttctctttacctttccccggctatttcttggtggatttatcccgttatcttcgctgctatttgctccttgctatcttttattcttctcttttgaaactggccgag

SEQ ID NO: 162741 - DNA, 601 bp, Human
tgattaaacagttcatttcactggagactggggtggtgtattgtgtctcctccggagttattcttggcatcagcagcccttgctcttagcatccgtttctttacattttaaggtggagcataagaagaactgcagtgaaacagatcagatggggggcaggtgggatttctctttacctttccccggctatttcttggtggatttatcccgttatcttcgctgctatttgctccttgctatcttttattcttctcttttgaaactggccgagtcagaaggaaataaacaaatgcaagggtgygtagaaagagcattagatggtaggtccagaaacttggactctacatccagcatctagtgatgtgattgattgatatctgttttagcttttcggcacctcaggttttgggctgttttttttttttttttttttttaatctgttaattgaagtgattggtctagatttgtggtctttgaatgtgtgtcagccatggaaaccttcctacaaacagaatctcaagcagcaaatgttaaaacctaaaagcaattttgtttgggttgaaacaaggtgggcgggcagtcaggaacccacccttttaa

SEQ ID NO: 162742 - DNA, 601 bp, Human
gtttctttacattttaaggtggagcataagaagaactgcagtgaaacagatcagatggggggcaggtgggatttctctttacctttccccggctatttcttggtggatttatcccgttatcttcgctgctatttgctccttgctatcttttattcttctcttttgaaactggccgagtcagaaggaaataaacaaatgcaagggtgtgtagaaagagcattagatggtaggtccagaaacttggactctacatccagcatctagtgatgtgattgattgatatctgttttagcttttcggsacctcaggttttgggctgttttttttttttttttttttttaatctgttaattgaagtgattggtctagatttgtggtctttgaatgtgtgtcagccatggaaaccttcctacaaacagaatctcaagcagcaaatgttaaaacctaaaagcaattttgtttgggttgaaacaaggtgggcgggcagtcaggaacccacccttttaacttctgtgtcctctgccatctcctgtagcagcccccaaagtagttccacaagatccttggccttgggatgctagagcacaacgtctaaaccatt

SEQ ID NO: 162743 - DNA, 601 bp, Human
actggaagcggatcctcccaggaagcagttgcaggcggtcatgctacagtgagttgctgatagtaggaggggaagaaagaggaagggggagtggaagatgactcagtggggggtgagccagtgcctggaagagaggaatgtgtgagcagaatgaggaagttagcaaaagctggttgaaggtaggaggtggaaagacaagttcagccctcaacaagttaagcaggttatataagaagtccaggcatggatgacgatgatcataatcatgatggggaggatgacaaagatgactaggaacgcyctgtcatctctctctctctctctctctctctctttccttcctggttgtgtgagtttgcagggagacgggaggttgtgaagaacaataaccagaagagagtttgcgtcttcatcagaaagcacctggggcaggtagagttggtgctagcttctccatccatccctgacaccccagccccattcatcattcagcagaagacaggctgggctggcccaacttggtcctgtacccccaccaccccagaaccccactggtccatagtgaggatcccttctctttgactctcctccttctctgtga

SEQ ID NO: 162744 - DNA, 601 bp, Human
cgaaggccccgggctcacctccagcctcaggctggctctggctgctgcccctgttccatcctggcaagcggaactgaacaggcccgactccacagcccccggtgctgccagctgcaagctctgctgactccaacctcaggcccctgcgtgcctgcttctaaatccacacgttcctgctccttcctgcccctgctgccctctcagaatgccacttctttctgccaagacctcaggcattgctatggcccagccccatctttattgatgtcggggctctgtccccttgcagagcccatcccaytgccacccacatctgggacagcaaaagacttctcagtttcctccagagttcagtttcttccaaaaagctcggcacatcttagctgccagtgtgaactgtgagctcccagagatgcccgtggcactttccaacattcgtcacttttgacacatctaaaatatcctagctcccagagctgcgtgagcaccagcccagatggaccggctgctggggaagcatcagtctctccagggcctctgtgaagccctggggcagtagggggatgtctgacaaagcttcctaactgaggagccccacttc

SEQ ID NO: 162745 - DNA, 601 bp, Human
acttctcagtttcctccagagttcagtttcttccaaaaagctcggcacatcttagctgccagtgtgaactgtgagctcccagagatgcccgtggcactttccaacattcgtcacttttgacacatctaaaatatcctagctcccagagctgcgtgagcaccagcccagatggaccggctgctggggaagcatcagtctctccagggcctctgtgaagccctggggcagtagggggatgtctgacaaagcttcctaactgaggagccccacttcctctcgctctgggcacccctgccaaatragcgggcacctctatgttccagcagccctcgctgcccagcttctgagctgcaagccagcttccttccacagaattctctgcaccttggcttccggtggctccaagcactttgccatctgccgagtcagttctgccagagatgaagcagctgatgtggggagttctctgtgggggccacctttcctctctcaggtcacctttactctcagaaggaaactgaccccctgacctattaaatagctgaaatcaagggccactaggggcccaagtcggtgaaggtgcaactgaaggcaagaaggt

SEQ ID NO: 162746 - DNA, 601 bp, Human
gcagtggtgtaagggcagaaccctggctggagtgttttgcagtcagactgatttcctcattagcagagagtgttaaccggtagcctagtttggctcctcgaggtgcctgattcagacagagcatcccacagctggagcaccctagctggtggaggcagggactcagccaagtaggctccagagctgccacctaagcccagtagatttctcttgcccagaacaacctggccaaatggaagatgggaggctgaaatcctcactccaaggaggggcctccttttcttggcacaaaggcaccgcrccaagctacacagctaaggcagtgtgctacctaaagcaggtgcacagaattcacagagaggtaccaaataggctggcaaagaccttggtggataagtacccacaaatatctggaaggaactatgttgggttgagacatgagaaggaagagatcttaggcaagtttggaaagggaaacaacacattgaatgccaacccctggactagacatttcatcaacttcgttcatcctcactaccacccacacaagacggtcttcctatttccaacttagaagaaggaagttgaggctcctactggt

SEQ ID NO: 162747 - DNA, 601 bp, Human
tcactggtgtgactacctcttctgaagacatgagaaaagctccagtttcagaaggtatgcttggagaatgtgctgcttctagcttatccaatatggaaccaatttcttcactcatagctaaagcatatcctttcctcacagcttatcatagagtggccaggtttaaatgagtcaatacaaataagactgctggaaaagtgcctggcacagagaaagcattcaatatatatcagcttttaaaaatgctgaagatcaatttgaatatatatgtatatataaagagatataaataggatcacaygtaaggaactgattctacttttaggaaactacactaagaaaatactaatagattccgataaatatttatacataaagaacatcatcagagaattgtttgtaatagggcaaataaaaccttgaaacagcatacattttcaacaatagtggagtaagtaaataaattacggcactttttccaagtatgttttgaagaatttttgatgctatgagaaaatgataatgataagtgaagaaggatttaaaaccatttatgtaacatgatctcaattatacacactgtaaataagaatctatggaa

SEQ ID NO: 162748 - DNA, 601 bp, Human
agtggccaggtttaaatgagtcaatacaaataagactgctggaaaagtgcctggcacagagaaagcattcaatatatatcagcttttaaaaatgctgaagatcaatttgaatatatatgtatatataaagagatataaataggatcacacgtaaggaactgattctacttttaggaaactacactaagaaaatactaatagattccgataaatatttatacataaagaacatcatcagagaattgtttgtaatagggcaaataaaaccttgaaacagcatacattttcaacaatagtggartaagtaaataaattacggcactttttccaagtatgttttgaagaatttttgatgctatgagaaaatgataatgataagtgaagaaggatttaaaaccatttatgtaacatgatctcaattatacacactgtaaataagaatctatggaacaaatatctccataagaaaacattatgaagatatactccaaatgttatttgtgtttttttctaaataataatattctttattttttcagcacttttcaaattatactgaaatatattttcagcatacatacaatgagcatcccttaattct

SEQ ID NO: 162749 - DNA, 601 bp, Human
ggaagaagaatgggttgggaggaaggaaaatacatttagtttggccttgctgagtctgtagtgcccaaagagtacccaggcaaagatgcccagtcgagagctggtgatgtgcaaagctaaaacttgtaggaagaaactgcagtaaaggtatgagggtgggcacagcagtgagtccttgaagccacgggcttcccttaggatgcccaagtgtcctaagtgttctaggaataagcgacagactctgatctcatggaggctcagacccctgggcttcagggctctattccttccacccctaaaygtgacctgaagtggcccctgcctccctcagtcctagaggctgctgctcaattacagtgaagaatctcttatagactcacggtgacttaaacgctatttggtgctgtggctgctatttcactgaagattacagggctctcagagttaaccacataaaacttgctgctatatatttgtaacctcctttttcaataacacatagggaaaccatcttgggtttcaggaccaaaaaagtgtgagtgcctggccaccaggaatgctataactgatcccgcttccctctttgatgtggccaaaaaga

SEQ ID NO: 162750 - DNA, 601 bp, Human
tttctctttgtcccaagttcttcaactatgaatttttgccaactacttcaagttaaaaatgttcttccatgtcatgcccacccagtgattctgtttgtttctacctcttgaagttacacaaaataagtctagtctaccttctccacaacagcccttcaactctcatgtcatcctcccaatcttatttttataggcaccagagccccactttctttaacaattgctcgtggatatgagctcttaaagagtctttcctccatctagacttgactgatgctttatcttctctcgacctcttccctaaagcccctacgcagggcattcctccgctgcaacacagcaaccacttttaatagttgcttttcaagcttgcatcccccaccccaccatggggctggggactcctgaaaggagccacatgctgtctttgcctccaactagtacctagccagggggcctggggcataatacatgcttaataagtgtttgttgaggaagtgaataaatgaatgagcacatacctgtatacagtatacagcttcctcgctcatacacatgttaaagagagctaaagcctccgggaagggagaaaagagagggc

SEQ ID NO: 162751 - DNA, 601 bp, Human
tgtcaggcattgttctgagctctttacaaatatcttatttaatcctcctaacaacctcataagataggcactatttttatccccattttattttcatatgaccctcttaacatttgaggcagctatcctaaaatgaagaaaggtgtagtgtttcagtctctgaataaaagaaaatgagctacattaggtccaatgtataaatggctgaagattgagtgccagcctttgatccaagatctggatctggcaggacacctcaccgctcactaacatttattgagcacccaccattgtgcccagkgctaccctccatgagttcgctgacaggtggaggaagcacacacctggataaataaatcaccccgctgcagggcaagtgtattaggatcagggaggcagtacggtgctgagagcaagaaggagtaattatctctgactagatgagaaggcttcctggaggctgtgaagtctcagttccattttaatgaatggagcagcagagacagagcaggaggtgaggtgcaaaggtaccggcatccaaaagggcatttgggaactgttggtagcaggagaacgaaaagagaggaggaggtgggggatg

SEQ ID NO: 162752 - DNA, 601 bp, Human
attttcttcattatctcagaaaagttattcaaattcttgctcacacctccttttaataaaatatgatgcatttcattctgtcttcatagtgaaaaatcattgccctttgctgagaattaataaccttttgagttaataccctttgggtaggaaaattggtttcattaacacctccccttgcactttgtaggttcatcatctcttggtcctgctgtcccctgaaaccaaaagcccaagacatattatttgagaagcctgaatgattttattctcagaaagaatgatcagggtccttattaawtgggctgaattgagttcactgaccaaaaaggtcagagcggccttgtgtctgctcctcagccgcaggggagcccaccttctaccagaaggaagggatgagagcttcctctcccagctcttggcctgatccctaatcttggcagaaaagatgcgcccatcttgacatgccacgccatggaaacgcgccaccttgccaggctctaccaggcctcttggcagaggtgtccgtctctggtgcagcaccacagacaggacagctgtcgggctgcctggcagagttggatggccactcacccacccc

SEQ ID NO: 162753 - DNA, 601 bp, Human
tatgttaaaaacaatcttcctctccttttccacctcccacggccttggaaagcctccgaatggacattcctctactcttttctgttgcaaactctttagcagcagcctggcatctggagcatgaagcccagactcttcagcatcccagggccctccatgctctggcctgcctggccttgtctcctgcctctttatgtatgcaaggttgcatgcctgtgagcctcgactcatgttgctccctcagccacccctgacccccgcaacaaaacacacacacacactcaatcatcctgcaaggccrgggtcaacatcacattccctgaaaagccctccctgaatgccacaccctccctcaagcggcatccactactccctctgtgattcccccaaccctgccccacactcacccctgtaccttgtccctgcaaggcttacctgatataatctgtctgcacgtgaggacaagttgagcctcaggagctaatacatagtgtcacccagctaagatgctctattcactgtctctctaggtagggatgtagggatgaaattggagacagcgacacctgggttcaaatcctgtctctatcagtttttggca

SEQ ID NO: 162754 - DNA, 601 bp, Human; identical to SEQ ID NO: 18302

SEQ ID NO: 162755 - DNA, 601 bp, Human; identical to SEQ ID NO: 18303

SEQ ID NO: 162756 - DNA, 601 bp, Human; identical to SEQ ID NO: 18304

SEQ ID NO: 162757 - DNA, 601 bp, Human; identical to SEQ ID NO: 18305

SEQ ID NO: 162758 - DNA, 601 bp, Human; identical to SEQ ID NO: 18306

SEQ ID NO: 162759 - DNA, 601 bp, Human; identical to SEQ ID NO: 18307

SEQ ID NO: 162760 - DNA, 601 bp, Human; identical to SEQ ID NO: 18308

SEQ ID NO: 162761 - DNA, 601 bp, Human; identical to SEQ ID NO: 18309

SEQ ID NO: 162762 - DNA, 601 bp, Human; identical to SEQ ID NO: 18310

SEQ ID NO: 162763 - DNA, 601 bp, Human; identical to SEQ ID NO: 18311

SEQ ID NO: 162764 - DNA, 601 bp, Human; identical to SEQ ID NO: 18312

SEQ ID NO: 162765 - DNA, 601 bp, Human; identical to SEQ ID NO: 18313

SEQ ID NO: 162766 - DNA, 601 bp, Human; identical to SEQ ID NO: 18314

SEQ ID NO: 162767 - DNA, 601 bp, Human; identical to SEQ ID NO: 18315

SEQ ID NO: 162768 - DNA, 601 bp, Human; identical to SEQ ID NO: 18316

SEQ ID NO: 162769 - DNA, 601 bp, Human; identical to SEQ ID NO: 18317

SEQ ID NO: 162770 - DNA, 601 bp, Human; identical to SEQ ID NO: 18318

SEQ ID NO: 162771 - DNA, 601 bp, Human; identical to SEQ ID NO: 18319

SEQ ID NO: 162772 - DNA, 601 bp, Human; identical to SEQ ID NO: 18320

SEQ ID NO: 162773 - DNA, 601 bp, Human; identical to SEQ ID NO: 18321

SEQ ID NO: 162774 - DNA, 601 bp, Human
ggtgcatgtctgtagtcccagctacttgggagactgcaggagggttgcttgagcctagaaggtcaaggctgcagtgagacatgatggtgccactgcactctagcctgggtgacagagtgagaccctgtttcaaaaaaattcaatttaattttaaaaagaaaggggcaagcatccagtctcgtgacatcagggcatcacttaaatgggactgtactgttaaaccaaaatgtggccacgaaaataccgacacatacaggtgttacatacaaaggctaacaaaatcactttccctttttcttcytcactcgcgcctgctctgagttaattcactttcattcagccttgccggcactggctgccttctttgggcagcaacaccctggacaacaccatcctgggcccctcaatcctatgatcttcagcttccctctgagttagaggcatttcgggtctaggaacaagccctctgggcttggagaaaacacaagaggtctcattcctaccatctccatgagagaaatccatacacggagggggaaaaaaaaaaagccctctttgatgtttgcaaagagagtcataatatctcccagagccaacatct

SEQ ID NO: 162775 - DNA, 601 bp, Human
tctttaagacctgaaataatttctcctgccagaacttgggagtatgttgtactggtctctttgcagtcacaggattaaaagcgttttccccaaatcattttttaacgtccttattaaacatgtcataaggtaaagtgggcaaaatcactcacacttttttccttaatctttgtaatagcatcattgtgctgggggtggcagggtagaatgataggcaaattgtcttttcttttcttcctttttttttttttaaagaaaaacacttacaaaaatccaaataagagtaaataattaggactgsgtgtggcggctcacacctgtaatcctaacactttgggaggccaatgcaggaggattgtgtgagcccaggattttgagaccagcctgagcaacatacagacctcatctctacaaaagaggaggaggaagaagaagaaggaggaggaggaggaactagttctcagcaggaaccagttctcagcctgaaagactcatttatatttaaagttaatttcatttaaagatttctccaaaaaagggcagtcatgcaagattctccgtgcagacatggagtttctcaggagtgctcctgcaaactcaa

SEQ ID NO: 162776 - DNA, 601 bp, Human
gttgtactggtctctttgcagtcacaggattaaaagcgttttccccaaatcattttttaacgtccttattaaacatgtcataaggtaaagtgggcaaaatcactcacacttttttccttaatctttgtaatagcatcattgtgctgggggtggcagggtagaatgataggcaaattgtcttttcttttcttcctttttttttttttaaagaaaaacacttacaaaaatccaaataagagtaaataattaggactgggtgtggcggctcacacctgtaatcctaacactttgggaggccaakgcaggaggattgtgtgagcccaggattttgagaccagcctgagcaacatacagacctcatctctacaaaagaggaggaggaagaagaagaaggaggaggaggaggaactagttctcagcaggaaccagttctcagcctgaaagactcatttatatttaaagttaatttcatttaaagatttctccaaaaaagggcagtcatgcaagattctccgtgcagacatggagtttctcaggagtgctcctgcaaactcaagggtgcctcagccatcagcgcaggttccgtccccagcccgttccc

SEQ ID NO: 162777 - DNA, 601 bp, Human
tggccatttgctttcaagggacagactcagcttgcagaacgaaaacagcaggcgatatagaaagagtcttttggaattagacacacctggctttgaatcctgctccactgaactatctggataactataggtctccaaacctccacttccttatttatattcaccaggataattaacactgtgtcggtctaggtctcagcagaaaacaggactccactggcctggatcagctgaagaaagcaagtgggactccttacaacagggtgggcagtgttaaggaaaccaacaaggactgaggcgrctccctgcctctaacagcaggacagatggagccagggaagggactagctgtgggaaaaccagagccatggaggaggggctgctgataatcgtgggagggcagtggctgcacagtcaggctccagagcacgggggagcagagggaaaatgcccctgcctctctcttctccgccctgatctcctgctagtgcctctccctccagtggtcacacccaaccagaaaccaatcgacaagggagcccggcagatgcagcctaagggatcccatcctggggctcagagctgagcagtggagggcaga

SEQ ID NO: 162778 - DNA, 601 bp, Human
gttgtaaagagaaatgagataattatatgaaactattagctcaatgtctgggacatagtgaagcgctaaatagtagttatcataattgctgttattagttcatagccatccctctattactgaatatttcaggtgttttcagtgtatttttacacaaatgttaggacattttttaactgaaatctctttccacaattcaactttttccttagaatatataaagctagtggtcctgggtataaacatgtaaaagttcaagttctggagtcaggttgtgtgagccgacgccccagccatataygacttactagctgtgtgatccgagaaaagtcacttaacttctctgtccttcagtttcctcttctctaaaatgagataataatcgtatcatttgtttgagggtcaagtgagatgacagaagcaaagcacttggcaaaaaccaaaatagatattagccaatgttattatcatgcatactgccattatatgctcttttttttttttttttttttttttgagacgtagtcttgctctgtcacccaggctggagcgcagtggcgcgatctcagctcactgtaagctccacctcctgggttcacac

SEQ ID NO: 162779 - DNA, 601 bp, Human
acgacttactagctgtgtgatccgagaaaagtcacttaacttctctgtccttcagtttcctcttctctaaaatgagataataatcgtatcatttgtttgagggtcaagtgagatgacagaagcaaagcacttggcaaaaaccaaaatagatattagccaatgttattatcatgcatactgccattatatgctcttttttttttttttttttttttttgagacgtagtcttgctctgtcacccaggctggagcgcagtggcgcgatctcagctcactgtaagctccacctcctgggttcacrccattctcctgcctcagcctccccagcagctgagactacaggcacccaccaccacgccccgctaattttttgtatttttagtagagaacggggtttcaccgtgttagccaggatggtctcgatctgttgacctcgtgatccgcccccctcagcctcccaaagtgctgggattacaggcgtgagccaccgcgcccggcctcattatatgcttttaattgcatttagcactgggctaaacacacagtagacttccaattaatacatatcatattaaactgaattgaagatcggttactatga

SEQ ID NO: 162780 - DNA, 601 bp, Human
ctcttttttttttttttttttttttttgagacgtagtcttgctctgtcacccaggctggagcgcagtggcgcgatctcagctcactgtaagctccacctcctgggttcacaccattctcctgcctcagcctccccagcagctgagactacaggcacccaccaccacgccccgctaattttttgtatttttagtagagaacggggtttcaccgtgttagccaggatggtctcgatctgttgacctcgtgatccgcccccctcagcctcccaaagtgctgggattacaggcgtgagccaccgygcccggcctcattatatgcttttaattgcatttagcactgggctaaacacacagtagacttccaattaatacatatcatattaaactgaattgaagatcggttactatgagtgttccttgagaactctggaaggtaccctgactattcataaggaggttaacccaaggccagtcctcccacatcttaccccctcccccactttggaaagaactttctttttgtctcagtttgacttacaagactgttcatttgttacagagtttccttgacaaacccccaaatagtgtaagacctctcca

SEQ ID NO: 162781 - DNA, 601 bp, Human
catcacattgctttattccaggcttgggatttgagcatctattgtattacagcaggggtccccaacccccgagctacagacagtgggcaattaggatccgggcctcacagccagaggcgagcagtgggcgagcaagcataaccgcctgagctccgcctgtcagagcagtggcaacataagatcctcatagcagcgcaaaccctattgtgaactgcacatgctagagatctaggttgcatgctccttatgagaatctaatgcctgatgatctgaggtggaacagtttcatcctgaagctatsccccctgcccccacactggtccatggaaaaactgtcttccatgaaacccatccctgatgcccaaaatgttggggactgctggtgtatagggtactgtagtaggcaccagatactacctgagctagctcttatctaaagcagaaaactcttggccaataaatcaactcttagtatttggctcttgttgtgaacataaataaacatttggtgcttcagagataacccctttagtaaacccaagagatatccccactcacatgagcaaattatatacaaaatcccaatgggaagattagttta

SEQ ID NO: 162782 - DNA, 601 bp, Human
gtttcatcctgaagctatgccccctgcccccacactggtccatggaaaaactgtcttccatgaaacccatccctgatgcccaaaatgttggggactgctggtgtatagggtactgtagtaggcaccagatactacctgagctagctcttatctaaagcagaaaactcttggccaataaatcaactcttagtatttggctcttgttgtgaacataaataaacatttggtgcttcagagataacccctttagtaaacccaagagatatccccactcacatgagcaaattatatacaaaatccmaatgggaagattagtttatgccaaggataggattgtgtaatctagaaacttggcaatacaggcataccaggacactggagctggcagtaccctctgctgggcttgctgtatagctaccaacctccggtagaaatagtaccatttaggagttagtagattgattgatgaagagatgaatttccacatgctgggtacaagggatggatagtcaagtggctagttaccgtgatctaattttttgaaattctcctatgacaaagcttgaaactcaggtcttgaatcctcagaggtgatttccat

SEQ ID NO: 162783 - DNA, 601 bp, Human
ttgttgtgaacataaataaacatttggtgcttcagagataacccctttagtaaacccaagagatatccccactcacatgagcaaattatatacaaaatcccaatgggaagattagtttatgccaaggataggattgtgtaatctagaaacttggcaatacaggcataccaggacactggagctggcagtaccctctgctgggcttgctgtatagctaccaacctccggtagaaatagtaccatttaggagttagtagattgattgatgaagagatgaatttccacatgctgggtacaaggratggatagtcaagtggctagttaccgtgatctaattttttgaaattctcctatgacaaagcttgaaactcaggtcttgaatcctcagaggtgatttccatgttgttagatgttaatgtgcattgtgatacgtcacccccaagcaaaccatcagttcattcatcccacaaaagtttattaagcacctactgtgtgcaaggcactgttaggattcgtggattaaccattgtctaaacaggaaaggcaaatacgcagcaagtattccataaatcccttatccttttcccaaaccagacactca

SEQ ID NO: 162784 - DNA, 601 bp, Human
ttagtagattgattgatgaagagatgaatttccacatgctgggtacaagggatggatagtcaagtggctagttaccgtgatctaattttttgaaattctcctatgacaaagcttgaaactcaggtcttgaatcctcagaggtgatttccatgttgttagatgttaatgtgcattgtgatacgtcacccccaagcaaaccatcagttcattcatcccacaaaagtttattaagcacctactgtgtgcaaggcactgttaggattcgtggattaaccattgtctaaacaggaaaggcaaataygcagcaagtattccataaatcccttatccttttcccaaaccagacactcatcttgccacaagcctggacatggcctcagaatccatctcaacagagggatccaggcagttcttatcaatcaaatggaattaacatgccgtattaaacctgtttgcaatcttggagctagaacactgtagatgcttagagaatatggagacaagagagctcaggaggtcaaggctgcagtaagccaaggtggcactgcacccaagcctcagtgacagagagagaccctgtctcaaaaaaaaaaaaaaaaaa

SEQ ID NO: 162785 - DNA, 601 bp, Human
gtcaagtggctagttaccgtgatctaattttttgaaattctcctatgacaaagcttgaaactcaggtcttgaatcctcagaggtgatttccatgttgttagatgttaatgtgcattgtgatacgtcacccccaagcaaaccatcagttcattcatcccacaaaagtttattaagcacctactgtgtgcaaggcactgttaggattcgtggattaaccattgtctaaacaggaaaggcaaatacgcagcaagtattccataaatcccttatccttttcccaaaccagacactcatcttgccmcaagcctggacatggcctcagaatccatctcaacagagggatccaggcagttcttatcaatcaaatggaattaacatgccgtattaaacctgtttgcaatcttggagctagaacactgtagatgcttagagaatatggagacaagagagctcaggaggtcaaggctgcagtaagccaaggtggcactgcacccaagcctcagtgacagagagagaccctgtctcaaaaaaaaaaaaaaaaaaaaaaacccaaaacaaaaacaaaagccaatcctggtctggaagctggaccctgcatcca

SEQ ID NO: 162786 - DNA, 601 bp, Human
ggctagttaccgtgatctaattttttgaaattctcctatgacaaagcttgaaactcaggtcttgaatcctcagaggtgatttccatgttgttagatgttaatgtgcattgtgatacgtcacccccaagcaaaccatcagttcattcatcccacaaaagtttattaagcacctactgtgtgcaaggcactgttaggattcgtggattaaccattgtctaaacaggaaaggcaaatacgcagcaagtattccataaatcccttatccttttcccaaaccagacactcatcttgccacaagccyggacatggcctcagaatccatctcaacagagggatccaggcagttcttatcaatcaaatggaattaacatgccgtattaaacctgtttgcaatcttggagctagaacactgtagatgcttagagaatatggagacaagagagctcaggaggtcaaggctgcagtaagccaaggtggcactgcacccaagcctcagtgacagagagagaccctgtctcaaaaaaaaaaaaaaaaaaaaaaacccaaaacaaaaacaaaagccaatcctggtctggaagctggaccctgcatccaaccctgg

SEQ ID NO: 162787 - DNA, 601 bp, Human
aaatacgcagcaagtattccataaatcccttatccttttcccaaaccagacactcatcttgccacaagcctggacatggcctcagaatccatctcaacagagggatccaggcagttcttatcaatcaaatggaattaacatgccgtattaaacctgtttgcaatcttggagctagaacactgtagatgcttagagaatatggagacaagagagctcaggaggtcaaggctgcagtaagccaaggtggcactgcacccaagcctcagtgacagagagagaccctgtctcaaaaaaaaaaaacaaaaaaaaaacccaaaacaaaaacaaaagccaatcctggtctggaagctggaccctgcatccaaccctggggaatccactggggagaatatggagacaagagaaagaagtccaagcagtaatcagccattttggaatgaggtaggataattttcaaaacagctccatagctgtgccaccatgcaagctaagcaaacaccatctagggtgagggaagctaagagcacagatgctgctatttgaccttaagcaagtcactttcatctatctgagctccagttttcttatttataaaatgggg

SEQ ID NO: 162788 - DNA, 601 bp, Human
aaaacccaaaacaaaaacaaaagccaatcctggtctggaagctggaccctgcatccaaccctggggaatccactggggagaatatggagacaagagaaagaagtccaagcagtaatcagccattttggaatgaggtaggataattttcaaaacagctccatagctgtgccaccatgcaagctaagcaaacaccatctagggtgagggaagctaagagcacagatgctgctatttgaccttaagcaagtcactttcatctatctgagctccagttttcttatttataaaatgggggtgatamtaacaatgcctacatcatagcgttgtgatgagtaaatgagatgatgcaatgcattcaacaatgcaaaaatgtattatcatttaacgatgccatgtatttaacaacgcctgtctaatagtaagccatttgctttcagtaactaaatgtagactgtattaggtaaagaagaataaaataaattatcctcttccaaccaacccatcagtaggaggacattccagacatgtgataaaacagaaagattttaggcccaagttctagaactacagttatcttatttccattaggaaatacacttat

SEQ ID NO: 162789 - DNA, 601 bp, Human
ccaaaacaaaaacaaaagccaatcctggtctggaagctggaccctgcatccaaccctggggaatccactggggagaatatggagacaagagaaagaagtccaagcagtaatcagccattttggaatgaggtaggataattttcaaaacagctccatagctgtgccaccatgcaagctaagcaaacaccatctagggtgagggaagctaagagcacagatgctgctatttgaccttaagcaagtcactttcatctatctgagctccagttttcttatttataaaatgggggtgatactaacwatgcctacatcatagcgttgtgatgagtaaatgagatgatgcaatgcattcaacaatgcaaaaatgtattatcatttaacgatgccatgtatttaacaacgcctgtctaatagtaagccatttgctttcagtaactaaatgtagactgtattaggtaaagaagaataaaataaattatcctcttccaaccaacccatcagtaggaggacattccagacatgtgataaaacagaaagattttaggcccaagttctagaactacagttatcttatttccattaggaaatacacttattgaaa

SEQ ID NO: 162790 - DNA, 601 bp, Human
tactaacaatgcctacatcatagcgttgtgatgagtaaatgagatgatgcaatgcattcaacaatgcaaaaatgtattatcatttaacgatgccatgtatttaacaacgcctgtctaatagtaagccatttgctttcagtaactaaatgtagactgtattaggtaaagaagaataaaataaattatcctcttccaaccaacccatcagtaggaggacattccagacatgtgataaaacagaaagattttaggcccaagttctagaactacagttatcttatttccattaggaaatacactyattgaaactcacagagcttgtttccaggaactgccccggaatataaacgcttggtcactagggcatatatttcttggctggagctctgccccaccctgaaacacaccccatcagagagcagcaataatgtaaaatggcaatgtgttctctcttgccttgtcaaatgcctaaaaggcatatattctttgatttacgaaaggagaccctcaccaaacacatgaaatattacagcagaacttgcatctagaactcagtgagaatgccagatgtcctatactcctattctgccatcttttgttg

SEQ ID NO: 162791 - DNA, 601 bp, Human
atgagatgatgcaatgcattcaacaatgcaaaaatgtattatcatttaacgatgccatgtatttaacaacgcctgtctaatagtaagccatttgctttcagtaactaaatgtagactgtattaggtaaagaagaataaaataaattatcctcttccaaccaacccatcagtaggaggacattccagacatgtgataaaacagaaagattttaggcccaagttctagaactacagttatcttatttccattaggaaatacacttattgaaactcacagagcttgtttccaggaactgccccrgaatataaacgcttggtcactagggcatatatttcttggctggagctctgccccaccctgaaacacaccccatcagagagcagcaataatgtaaaatggcaatgtgttctctcttgccttgtcaaatgcctaaaaggcatatattctttgatttacgaaaggagaccctcaccaaacacatgaaatattacagcagaacttgcatctagaactcagtgagaatgccagatgtcctatactcctattctgccatcttttgttggtgaatatttatcattattacattacaaacacaatata

SEQ ID NO: 162792 - DNA, 601 bp, Human; identical to SEQ ID NO: 18322

SEQ ID NO: 162793 - DNA, 601 bp, Human; identical to SEQ ID NO: 18323

SEQ ID NO: 162794 - DNA, 601 bp, Human; identical to SEQ ID NO: 18324

SEQ ID NO: 162795 - DNA, 601 bp, Human; identical to SEQ ID NO: 18325

SEQ ID NO: 162796 - DNA, 601 bp, Human; identical to SEQ ID NO: 18326

SEQ ID NO: 162797 - DNA, 601 bp, Human; identical to SEQ ID NO: 18327

SEQ ID NO: 162798 - DNA, 601 bp, Human; identical to SEQ ID NO: 18328

SEQ ID NO: 162799 - DNA, 601 bp, Human; identical to SEQ ID NO: 18329

SEQ ID NO: 162800 - DNA, 601 bp, Human; identical to SEQ ID NO: 18330

SEQ ID NO: 162801 - DNA, 601 bp, Human; identical to SEQ ID NO: 18331

SEQ ID NO: 162802 - DNA, 601 bp, Human; identical to SEQ ID NO: 18332

SEQ ID NO: 162803 - DNA, 601 bp, Human; identical to SEQ ID NO: 18333

SEQ ID NO: 162804 - DNA, 601 bp, Human; identical to SEQ ID NO: 18334

SEQ ID NO: 162805 - DNA, 601 bp, Human; identical to SEQ ID NO: 18335

SEQ ID NO: 162806 - DNA, 601 bp, Human
ggggggtggccgaggggaggggctcgccgtcgtgggcggggccggcttgtcagggcctcagccttgggatgtcttcctggtgggttcatctcccgcttcaggctctggccccgcgcgagcctcttgactagaatattggcgcaggggctctggagacccgggcctcccgctgtaggtggggccagtttcctcggagcgcctggaaaccgaaggcaggcaaaagagcacgggaccaaccctttgagtgtctgcagtgtgctacagtgctcgttcttgaagcagagaaactattccacccttmaggtgtgcagacatcagaagtcctacctccagggtggaagccggcctccaagttggaagtgcacagggctccggcagcggggtggcggggagttgggaagaatgcagatttccgggcccctgatgccgacctagtacacacagttccagcgtgcagttgggagtgcatgttaccggtaccccaggtgacccattatgagagttgaactgcccagaaacctgcctctggagggagtctggttcagcatctggtggagggcacccctgggaagcccatttccagccccttcccaggtgtgca

SEQ ID NO: 162807 - DNA, 601 bp, Human
cattgtaacttatttacccttcacttatggaaaggacagctacattgccttttttttgttttttctgctattacaagttgtgtagtagtggactctggtgtgtgtgtgtcttggtgcagaggagctggcatttctgtaggattgagacctagtggtggtattgacagggttgataagtgttggttaaatgtgttgtggagttactgtgttatgtttttcaaggaaagagaccacacttgttagtccccgctctgagggagagacctattgtgtcacgactccaccttcttgaaaatgtttmcttctcccaattctccttttgcatgtgtgagaacattgagaacgtttaaaacagtaccagcaaaaccactgtcactcccgcacgcctggtggctggctctcttggccatcttcagttctggttttacagagattggaaagtgtgtggtgggcgctcagccctggagcagtaggatgggggctggtgtggcgccatctccactccccccttccccctcgctgaaagaaggctggaagctgtgctgcctgagcaaactgataggacgcagttcattaaaccagtagcctgtgtctggggctt

SEQ ID NO: 162808 - DNA, 601 bp, Human
actgtgttatgtttttcaaggaaagagaccacacttgttagtccccgctctgagggagagacctattgtgtcacgactccaccttcttgaaaatgtttccttctcccaattctccttttgcatgtgtgagaacattgagaacgtttaaaacagtaccagcaaaaccactgtcactcccgcacgcctggtggctggctctcttggccatcttcagttctggttttacagagattggaaagtgtgtggtgggcgctcagccctggagcagtaggatgggggctggtgtggcgccatctccacyccccccttccccctcgctgaaagaaggctggaagctgtgctgcctgagcaaactgataggacgcagttcattaaaccagtagcctgtgtctggggcttcacatgtctggaacacagcagagatgggggcctgatccttctgagtaggtgccctgaagcccaattctcaagcttctgacagcctcctgcccttagatcctgtgtgctcccactttacacatagctttaatctgattggttactggggaagggcaaaagacatggatggcagctaaaggcaggggaagaaacaaaccagcag

SEQ ID NO: 162809 - DNA, 601 bp, Human
agctgtgctgcctgagcaaactgataggacgcagttcattaaaccagtagcctgtgtctggggcttcacatgtctggaacacagcagagatgggggcctgatccttctgagtaggtgccctgaagcccaattctcaagcttctgacagcctcctgcccttagatcctgtgtgctcccactttacacatagctttaatctgattggttactggggaagggcaaaagacatggatggcagctaaaggcaggggaagaaacaaaccagcaggttgttaacatatgcatgtgtaagtgtgtgtgyttaaatgggtcatgaagaagccctacagtcaaccagcactggaacaagcatggggccatttgtggagaggcacatgtttctccgcagcaatccctgaggtctgcatgagagaccctggaataatgaacactctagcagggatcttgagataccatggcactgtgaagtgtgttcagtttgtgctttcaggaagcaattaaaatagttttaaaaataaaaacttctagaatagtacactcaactttcacaatcctaagacttccagactgtttgctctaggggccaggcatcattctgttt

SEQ ID NO: 162810 - DNA, 601 bp, Human
tagaatagtacactcaactttcacaatcctaagacttccagactgtttgctctaggggccaggcatcattctgtttgtgttagtttacatcaagctatctaatcttcacaaggaccctatgaagtaggctctattattaatactaaatttcaaataaggaagctaaggctccagtgccttaggaatcatgcccaaggtcacacagtaagtgagggtggaacagggattggagctggggcttgagcctgggcagccgcccccgaggtgggtgtacctgctgtgtcctactgccactcctgtatggaccagtgtttcaggtcactgcaggtgagcagggccctgtggtagtagaaatctggatgtccccagcacacggcttcccgcacagatttttgctgcttcttaaaggttgagggagtagtatagtgaacactcctatactcttcccatagggtcattgggtaatattttgccacatttttctcctttcctccttctctttttctttctaaagaaagaaaaattaattttttgtctatatttttctcccttttccatctcgcctctctctttaaatattatatattatctgatacgcagt

SEQ ID NO: 162811 - DNA, 601 bp, Human
aagaaataaacaaaaattgtcctaagtccacacacctgaacctgtttttcttttctttctttcttttttttttttgagacgaagtcttgctcttgtcccccaggctggagtgcaatggcacaatctcggctcactgcaacctccgcctcccgggttcaagtgattctcctgcctcagcctcccaagtagctgggattacaggcgcctgccaccgtgcccagctaatttttgtatttttagtagagacggggtttcaccatgttggccaggctggtttcgaactcctgacctcaggtgatcygcccacctcggcctcccaaagtgctgggattacaggcatgagccaccacacccgaccttttctttcctttcaaagccccaaatgggattattttcttgagaagtcaacttcctgtcgagatgggaataaacttttctccagcttggcaattcagaagcagccactgtgctgtgtggctgaggttggggtcatggagacagccaccagtgcagtcctcggggtgggagatactgagttcagaaggctttggacactcttctgggccaaaataacagaaactcgaacttgttttactcttgg

SEQ ID NO: 162812 - DNA, 601 bp, Human
ttaaggctattcacctgggccactggctggggtgctgctcaaagccaggatctgggagccggggtcagcaccttgggtgcacctgggcatcatagcaacaacaaaccccaacacattttcagggaccagggcggataaatgggagttaatgacatggttcccacacatccgaatctgggatatgtaaatgtgacacacagtctgagcatttggcaggctctccatggtcttgctttgcatagtttggcctatctgctctccagacttactgccccgttgtcctcacctgcatgactgtccrtgtctggtttgtttactcgtcattgaaggcatccacaggggtgccatctgcccccatgtccctctcccactaggcatgctaagtggcctgcggcagggcaggcagggactcagattccctccatcccatcgctgaggtcttacttccttcttccgcccgccttacacgtggaaggtttctcctgtgcttgtccaccagttgttgtttttgtcttctagcacggatggtgtggcagaaggaggccttggacagcagcacgttaggacccacaggggctctggccccttgcagctgtgtgtt

SEQ ID NO: 162813 - DNA, 601 bp, Human
atcatagcaacaacaaaccccaacacattttcagggaccagggcggataaatgggagttaatgacatggttcccacacatccgaatctgggatatgtaaatgtgacacacagtctgagcatttggcaggctctccatggtcttgctttgcatagtttggcctatctgctctccagacttactgccccgttgtcctcacctgcatgactgtccatgtctggtttgtttactcgtcattgaaggcatccacaggggtgccatctgcccccatgtccctctcccactaggcatgctaagtggcstgcggcagggcaggcagggactcagattccctccatcccatcgctgaggtcttacttccttcttccgcccgccttacacgtggaaggtttctcctgtgcttgtccaccagttgttgtttttgtcttctagcacggatggtgtggcagaaggaggccttggacagcagcacgttaggacccacaggggctctggccccttgcagctgtgtgttctgagggaagatgcccaaggttttattatcttttccagagcgccctttttttctgcttgcatggcaggccctttctaaaattacagtc

SEQ ID NO: 162814 - DNA, 601 bp, Human
accacacccagcccagaactactgttttaaagcaggtgctgggtcactttccaggatcctcacagcctgacctgagccccccttcccagagtcaccctgtgacacagcatgtggggtgatgctcctggcatcccagccccaggcgcatccagcctcagcttctgcgtctgtatcctcctggataaacccagactggctgcagaaaagtggtacagcctgtgagcttctgtgagcatcctgttgttgctatggagaccctgttgctagacatcaggcatgctcagactagggagtggtgacyctgtctcaggtgagcctcacgtgttaccaggtaaccaacccctctcaggtaccaacaggctgtacctggctagactctttaattagcagaagtagatgaactgaaacctcaacctcaaggtgaaagactcagtcaccagtcatcagaacagttctggacaagtccacctctctgaggtgggcttgaaagttgccctgcaccctgtgtcagtagtcttgggcagtcttacagggacaggagagattgtgcctgcaggtggccatgctagtcctgccgagtgaccccaccccaaggaaagga

SEQ ID NO: 162815 - DNA, 601 bp, Human
tgagcctcacgtgttaccaggtaaccaacccctctcaggtaccaacaggctgtacctggctagactctttaattagcagaagtagatgaactgaaacctcaacctcaaggtgaaagactcagtcaccagtcatcagaacagttctggacaagtccacctctctgaggtgggcttgaaagttgccctgcaccctgtgtcagtagtcttgggcagtcttacagggacaggagagattgtgcctgcaggtggccatgctagtcctgccgagtgaccccaccccaaggaaaggactttcggagaycaggcattctctgggtgagactccccacactgggcagtcttgggtgaggatgccggctgccctcccagggacgcagtgccctgctgggtgccccgccttccctcctgagacccaggcaccatgacaggtttcttaactgacagctctttagtagagaacagaaatcctgtttgcagcaaaacttgcctcactggatcgcttcataacagctccttcaagtggggcgagctcatcgctgcggtcggcatctcagccatcagcagcccggagaatcccactcaggacttaggtttgctattt

SEQ ID NO: 162816 - DNA, 601 bp, Human
tgcaggtggccatgctagtcctgccgagtgaccccaccccaaggaaaggactttcggagaccaggcattctctgggtgagactccccacactgggcagtcttgggtgaggatgccggctgccctcccagggacgcagtgccctgctgggtgccccgccttccctcctgagacccaggcaccatgacaggtttcttaactgacagctctttagtagagaacagaaatcctgtttgcagcaaaacttgcctcactggatcgcttcataacagctccttcaagtggggcgagctcatcgctgcrgtcggcatctcagccatcagcagcccggagaatcccactcaggacttaggtttgctatttttgtgtctcgcctgggcttcgctcgtttccacaggcattccacttcttgtttacaggagtaattgccttcatgagctttgggccatctgcggatatatgtatttttttctttattttctttcttttttggggcagcagttctatgtttgcaaatatgaggattgtttcctaaagggaagcatgaggccttcttgaggctggcctcttggctgctgagctgggccttcgcacccctttcct

SEQ ID NO: 162817 - DNA, 601 bp, Human
atcttcagggctgggtctaccaacccggtctgtgcatttccagcctcctgtgtgcttcccagctctgaattatgaccactgggctgatttatttcttctgacatttgcaagctgttaggtggcagagatcagtgaataaaaacttaataaaaggctgtatttaatcccatgcatcctaggctgagccaagttcccttaggattgagcatcaccagatagaacccagagaccactggcattgggacctccagggtggctacttggagtttttgtggggagggcagtttcttgaccgtggagyatgacgaggctggacccacctccccgtctgtatgcagccaccatgcagcccacctaggctgtgggctctgttgatgccgccttggagtgtgcggcttgctctgggtgggccttccaggggaggagggactgcagaggtagtgacagggaagggaccctgggccagggggctgggctcaagggtggctccacatctgactttgtggcctcatttcctggtctgtcacttagggagttttgctggggcctgttaaagggggagtgcctggaggtatcaaagcaggggcttgtggccctggtc

SEQ ID NO: 162818 - DNA, 601 bp, Human
ggtgttgcctcctggctgtagagggcccccttgtgaagaggggagccccaggttggggggcctgggctgggcaaagtccctgccatctggcctgcccacttggggctggctgtgttgggcctggtcccaccagggcttgggctgcttccagatctgttttcattttcaattccctttattgctataaaaccacttcggggctgcagagaacaagctgttgtcctcagctgacctcagattcctggcctcaattgtttgcctcttgctaattttagcttctgatcatttccactcttatccwccccccaaagggagacacagaccaagaatagctgctgggaaggggggctgtggtggctgtggccagagttccaacagtgagctggcagggctgtggagtggctcgctgtggccaagcctggggcagggggctctcggcaggcaacccccacacccttcccctctctcaccgaggactctatactgcaggcatgggcctcagaggagaagaggacttcactgttccttcttttaaacagaaaccaggctgcttctggggaaaaagtacacccccacagccctgcctagcttgaagacccct

SEQ ID NO: 162819 - DNA, 601 bp, Human
gtggccaagcctggggcagggggctctcggcaggcaacccccacacccttcccctctctcaccgaggactctatactgcaggcatgggcctcagaggagaagaggacttcactgttccttcttttaaacagaaaccaggctgcttctggggaaaaagtacacccccacagccctgcctagcttgaagacccctgagagtccctaactcccctgagcccttcagactccaggacccaggttgtagtgtggggtcagacgtggcacttgactacagccaggccctggatacagcgtcagtgtrgaggcctcaggcctatccaatccctacccagcttggccccagagcctggcacagctctgccctcccagtgagtgtcaggctgcagttgactgacagcaatgtccagtccaggacatcagcccaggcctgcaggatgggactttgcctgcctggggcagggagagaagcagctgaccaaaccccaaaccgtggtgtgctggtgagcaggcctggggagagccagaggagggatgggctgaaatccagcgaggaggaatggcctccaggcagggcctagggttgcaatccttgtccatatat

SEQ ID NO: 162820 - DNA, 601 bp, Human
gacttcaagtgatctgcccaccttggcctcccaaagtgctgggattacaggcgtgagccactgcacctggtcatattaatagtttttaaacttctgtttggagaacttcagacagatgcccacatcttcaggacacccacattttcagcacctgctagccccctgcagtcttatctctgcccctcccccaccaccgtcctctccagttgttttgaaggaaatcccagatgcaatatcaatttgtccataaatatttcagtgccttacatcttcaaatgaaagcctgatacgtctaattttmatactgggctaacagtaagtgtgaagcaaaaaatccaaagcctgaagtcaccccacatgacttggtattgggaattgtgtggatccagccctaaaacccccgagcttggggttggagccaccatttaaagaagtgttggagcccatctcgccatccctcagcctcgagttataactagtcataggtaaaaagaaggcaaccaggacacaggtgtttatgagatcaaaagcaacaacaaccgaaacaatcaacagtgctactaaggtaacacagataggtgaggaagaggccaggtgctca

SEQ ID NO: 162821 - DNA, 601 bp, Human
ggatcctgtctttctgtacgttcattgtgataagcaggtcacccccaccatctgccagcttcttcagctactgcctttggtatttacctttcccagctcgataacgtgctcataggggctcttcttgatggtagaagagtgttaggcattatctcctgacttcccatgatggcacatgagcgcctgcaggcacccttctcccacccatgtgataattggatatttaggatggagccagcatgcggtattttgggggatcatgacagtaaatgctagttgcaggtgacccatacattacacrtgtttctttcccttagactcaatagttgccatttctgcttggttttcccagtgctgttgtccccacacccccagccccccatttgtccccacacacccagtgtggcctgctccgtgtggcctggataacatctctgtgggggttggctgtcatcctgggacccctcccctaccatccaggccccacttcctggagcccctgccatctgcttcttggcagagctcctgctgcatagcctcctggaaggggtgcactggaggccatttttcctttccttctgacttttattttagggttggg

SEQ ID NO: 162822 - DNA, 601 bp, Human
ctgctgatccttgatgtctggtgacacggcccagagagcctcgagctgcgtgggggcttctgggtgcccatcaggctcagcgacggtggcctcctgtgggtggtctactgggccatctccttccgggttttcccccaagaggagtgttctgctcctgcctgggggagggagggtggtcctgctgcacactgggagagaagctgggaggcagcactctgtgagtgggctgttccccacacccctgttctggaggctgccctactctgagctgggtctggagtcgtcagtccagagctccctyctgtgtagaccctcccagaaagtcagcctctggttcctggcaggtgcaggaagggcaagcagccatctgtaaggtgaggaaagaccttgtgtccacagctgctttatctgatgttcaggtgccccccaccaactgcacccccacccccgccagagactcccgagcctttgtggggaaacgtggattgcttccttgccttctctgctgtctttctaatttcttgcttccagattatttttgttactctctttcccttttgctttgtctgttaaaatccactttctttcattgtagtgggat

SEQ ID NO: 162823 - DNA, 601 bp, Human
gatgtctggtgacacggcccagagagcctcgagctgcgtgggggcttctgggtgcccatcaggctcagcgacggtggcctcctgtgggtggtctactgggccatctccttccgggttttcccccaagaggagtgttctgctcctgcctgggggagggagggtggtcctgctgcacactgggagagaagctgggaggcagcactctgtgagtgggctgttccccacacccctgttctggaggctgccctactctgagctgggtctggagtcgtcagtccagagctccctcctgtgtagaccytcccagaaagtcagcctctggttcctggcaggtgcaggaagggcaagcagccatctgtaaggtgaggaaagaccttgtgtccacagctgctttatctgatgttcaggtgccccccaccaactgcacccccacccccgccagagactcccgagcctttgtggggaaacgtggattgcttccttgccttctctgctgtctttctaatttcttgcttccagattatttttgttactctctttcccttttgctttgtctgttaaaatccactttctttcattgtagtgggatctggggctggaa

SEQ ID NO: 162824 - DNA, 601 bp, Human
cagatcttttgttcattttttaaattggcatttgcttattgttgagattgagttctttatgtattttagatacaaattgcctttacttttgatcagcctcaaatgaagagcatttttatcagctaaataaacctggctctgtaattgtggattccaacctcatattcctgtcttgccttgtgtttcagaaaatatctgaagaggtgcataggaatgtcatccctgggctatcaccagccatcagggctgtgttggtatgcaagcagtcacattgcctcccgatgcccagaacaaggatgtyaaccgcacactggctcctgaagccagagaacattcccttcaagatggcagaggaaaggcgggggcagtggggtcagctggacatgcgtcaccctaccgtgctcagggaagatgcttctggcttcccctgggaggcagctagtgatgagggtctcacaatggaaaggaaatggaaatgtctgttctttgggttcagctctcatgagtccacaggtagcaccgttcatctggagaaggccttcacttgcacaatccatgatctggaagcttctgtggcaaggggccgatatacgtctcccta

SEQ ID NO: 162825 - DNA, 601 bp, Human
gcatttgcttattgttgagattgagttctttatgtattttagatacaaattgcctttacttttgatcagcctcaaatgaagagcatttttatcagctaaataaacctggctctgtaattgtggattccaacctcatattcctgtcttgccttgtgtttcagaaaatatctgaagaggtgcataggaatgtcatccctgggctatcaccagccatcagggctgtgttggtatgcaagcagtcacattgcctcccgatgcccagaacaaggatgttaaccgcacactggctcctgaagccagrgaacattcccttcaagatggcagaggaaaggcgggggcagtggggtcagctggacatgcgtcaccctaccgtgctcagggaagatgcttctggcttcccctgggaggcagctagtgatgagggtctcacaatggaaaggaaatggaaatgtctgttctttgggttcagctctcatgagtccacaggtagcaccgttcatctggagaaggccttcacttgcacaatccatgatctggaagcttctgtggcaaggggccgatatacgtctccctacttatccattgaggagcaataagggtt

SEQ ID NO: 162826 - DNA, 601 bp, Human
gtgttggtatgcaagcagtcacattgcctcccgatgcccagaacaaggatgttaaccgcacactggctcctgaagccagagaacattcccttcaagatggcagaggaaaggcgggggcagtggggtcagctggacatgcgtcaccctaccgtgctcagggaagatgcttctggcttcccctgggaggcagctagtgatgagggtctcacaatggaaaggaaatggaaatgtctgttctttgggttcagctctcatgagtccacaggtagcaccgttcatctggagaaggccttcacttgcrcaatccatgatctggaagcttctgtggcaaggggccgatatacgtctccctacttatccattgaggagcaataagggttgtgactcgggtgtgcgtgaaggagagaagctccagagcccttgtctcaggtggcttctggccttctgttggcagaaaccattggtattctattatttctgtttttaaaagggaccttgagaacggaaattttcaagtgtgttttgtaacccttagcaaaaggagagcaaacacctttatgaaattctggcatgtggtccttttaacctttccaggcagtgt

SEQ ID NO: 162827 - DNA, 601 bp, Human
cacactggctcctgaagccagagaacattcccttcaagatggcagaggaaaggcgggggcagtggggtcagctggacatgcgtcaccctaccgtgctcagggaagatgcttctggcttcccctgggaggcagctagtgatgagggtctcacaatggaaaggaaatggaaatgtctgttctttgggttcagctctcatgagtccacaggtagcaccgttcatctggagaaggccttcacttgcacaatccatgatctggaagcttctgtggcaaggggccgatatacgtctccctacttatycattgaggagcaataagggttgtgactcgggtgtgcgtgaaggagagaagctccagagcccttgtctcaggtggcttctggccttctgttggcagaaaccattggtattctattatttctgtttttaaaagggaccttgagaacggaaattttcaagtgtgttttgtaacccttagcaaaaggagagcaaacacctttatgaaattctggcatgtggtccttttaacctttccaggcagtgtactggttcatgcaaactagtgctattcccttcttagggattggggtgctgggttctgt

SEQ ID NO: 162828 - DNA, 601 bp, Human
agagaagctccagagcccttgtctcaggtggcttctggccttctgttggcagaaaccattggtattctattatttctgtttttaaaagggaccttgagaacggaaattttcaagtgtgttttgtaacccttagcaaaaggagagcaaacacctttatgaaattctggcatgtggtccttttaacctttccaggcagtgtactggttcatgcaaactagtgctattcccttcttagggattggggtgctgggttctgtggaagcagtcccagtggtgagctggagcttgggtgaaaggtacrtgtgtgtacatacaccactttgttacatagtgttattgcattaattctgactgtccaaagtgattcatttgatgaaggcagaaatgcagaaaggacagtcacacacaaatcccatcttcctgaggtaacctctgtttccttcctgcaattagagctctggcatatgcatttcatgtgtgcatttgagggtggggctcagccacttggtagtctgttttcttccctgtccacgttcccaggggctgtttatcagcagctcacattggtggttcagaagaacattcgagagagacagctggg

SEQ ID NO: 162829 - DNA, 601 bp, Human
tttttaaaagggaccttgagaacggaaattttcaagtgtgttttgtaacccttagcaaaaggagagcaaacacctttatgaaattctggcatgtggtccttttaacctttccaggcagtgtactggttcatgcaaactagtgctattcccttcttagggattggggtgctgggttctgtggaagcagtcccagtggtgagctggagcttgggtgaaaggtacgtgtgtgtacatacaccactttgttacatagtgttattgcattaattctgactgtccaaagtgattcatttgatgaagrcagaaatgcagaaaggacagtcacacacaaatcccatcttcctgaggtaacctctgtttccttcctgcaattagagctctggcatatgcatttcatgtgtgcatttgagggtggggctcagccacttggtagtctgttttcttccctgtccacgttcccaggggctgtttatcagcagctcacattggtggttcagaagaacattcgagagagacagctgggctggctccgtgtgcttactctccctcgtctaccccatccaacagattgtgaagcctggttccagtaaccttggggatg

SEQ ID NO: 162830 - DNA, 601 bp, Human
ccaggttggtcttgaactcctgacctcaggtgatcctcctgcctcagcctcccaaagtgctgggattacaggcatgagccaccatgcccagcctttagtcttttcttttatggtttgtggactttgattcatagaaggaacttctgtcttacagttttctcctagaatgtttgtggttttatttttcacattagaatctttgacccatttagaatttatcctggtgtagggtgggaagaatgaacccagcctttccagatgctaccgaagtgtcctcataacatgtattgactgctccctrccctaggggttcgagatgtcactctgtcctttgcacagttaccactacctttcgttctaattctgccatttctgctgggcttcactggccagtgatcagcttacgaaactgttgaatcctggtggtctcgtttcccccacgtcattgttttgcaggattttttctggctattactgtgtgtttttctgtatgaatttttaggatcaagttatcctattcgaaaacaaagcaaagcaacaagaaaaatgcctactttaaaaaatatcttcgcaagcattgtagaaatgtggagccacacat

SEQ ID NO: 162831 - DNA, 601 bp, Human
cctttagtcttttcttttatggtttgtggactttgattcatagaaggaacttctgtcttacagttttctcctagaatgtttgtggttttatttttcacattagaatctttgacccatttagaatttatcctggtgtagggtgggaagaatgaacccagcctttccagatgctaccgaagtgtcctcataacatgtattgactgctccctgccctaggggttcgagatgtcactctgtcctttgcacagttaccactacctttcgttctaattctgccatttctgctgggcttcactggccrgtgatcagcttacgaaactgttgaatcctggtggtctcgtttcccccacgtcattgttttgcaggattttttctggctattactgtgtgtttttctgtatgaatttttaggatcaagttatcctattcgaaaacaaagcaaagcaacaagaaaaatgcctactttaaaaaatatcttcgcaagcattgtagaaatgtggagccacacatttgcccaaggaggattctctcactgaagcagtgttgcctccgacactgtggcagcctccagccaggcttcagcaccctgccagctcttgca

SEQ ID NO: 162832 - DNA, 601 bp, Human
cttctgtcttacagttttctcctagaatgtttgtggttttatttttcacattagaatctttgacccatttagaatttatcctggtgtagggtgggaagaatgaacccagcctttccagatgctaccgaagtgtcctcataacatgtattgactgctccctgccctaggggttcgagatgtcactctgtcctttgcacagttaccactacctttcgttctaattctgccatttctgctgggcttcactggccagtgatcagcttacgaaactgttgaatcctggtggtctcgtttcccccaygtcattgttttgcaggattttttctggctattactgtgtgtttttctgtatgaatttttaggatcaagttatcctattcgaaaacaaagcaaagcaacaagaaaaatgcctactttaaaaaatatcttcgcaagcattgtagaaatgtggagccacacatttgcccaaggaggattctctcactgaagcagtgttgcctccgacactgtggcagcctccagccaggcttcagcaccctgccagctcttgcatgtgaagagtggatagtagtgtgtgatcagcggcactagaccagagcgc

SEQ ID NO: 162833 - DNA, 601 bp, Human
aaaaatgcctactttaaaaaatatcttcgcaagcattgtagaaatgtggagccacacatttgcccaaggaggattctctcactgaagcagtgttgcctccgacactgtggcagcctccagccaggcttcagcaccctgccagctcttgcatgtgaagagtggatagtagtgtgtgatcagcggcactagaccagagcgcctgggacagggcacacctgccccccatgtctctttcactactgggcggctcacaaacatgcttcccggggccccttggcccataggtgataacattgttatmtcctccaagcaccactgtgcagcaggcatgtgccccacgtattctcccacttaaccctcacagtgactgagaaacaggctggatgacaatccctgaggcatcaacaaaggagtggaggtagagcaggctgcttccttgccccaggcaggttccagctgcggctctagctctggcgccagccagctgaatgacagctcactctctcctcctgggcctcacttcccttacctgctcagtgggtgggtaagagcttccaacctggacttcctgcgaagccatgtgcatgtcagctccatgtgg

SEQ ID NO: 162834 - DNA, 601 bp, Human
cccctcccctcttctccatgctccacacttgggagctcatctccagatcctgacctgattacatctgcaaagaccctttttccagataagatcacatgcacaggttctggagggttatcacttggctatatcttttgggggaccattatctgccctactgctggcagcacggagctttttcgaggccatagcgtcacaactcagggcaaacagggtctgaacctcatctgtcagacctgacatggttaatgctaaaccatttaatgctggactttcccaagcttttaatgactagtgtgcrttgtgaatctccaagagtggaattatcatgcaacattttcactctttagttgacaaaattttttttctggaaacgataaacagttttatacaatgataacatttctttgaacatgttttgggaaatattggactagatatttaaggaactatatttaaacacttcttcttcttgttatggaagaaacaaatacataggatttttttaaaaggcccaagccaggcgtgtggctcatacctgtaatcccagcactttgggaggctgaggaagacagatcacttgaggtcaggagttcaagac

SEQ ID NO: 162835 - DNA, 601 bp, Human
aagcttctattagtacaaaattatcttcgaggactaaaaattccatgacaatatagaaacacatatgcggatttgtttcactcttgtaggttgaaacatgtagttaaagacaaatataagcactctgaatagagtctttcttcagcaaaacagcaatgtcagcacaggcagcaaactacagcagaaattgagtgcaaagttcaaaaatcatttcctaagagtatcaagtacttaaaacgtagtatggctaggttaatgtttactttcactttatttcacttaacattgggttatcaagtayatgtcagatatctttccctggatctgctacagattattggaaattttaatttattgaaggagtttcatatctagagaccgtgtgtaaaataagtggcagagcatcttctcctgccatcatctacactataaagttgtcaaaataatttttaatagtatgtatacaaatgtttcaaacttatgaagatctattaaaaatctgtactactatttataattgactgctattcattgaattttaacaaaaaattaggacaaaatagatccttcagaaatacttcatatatcatggaagcttgag

SEQ ID NO: 162836 - DNA, 601 bp, Human
aacaaggaatggctgaagaatcagcacaagttgggagaggctacagagacgtgaaaactaaatgtattgtagacattaaatgtgatcttgaaccagaaaaagcacactagtagaaaatctagtaatagtcagataaggtcagtagtttagtcaataatattgtactaagccaggcgcagtggctcatgcctataatcccagaactttgggaggccagggtgggtggatcacaaggtcaggagttcgagactagcctggccaatatggtgaaaccccgcctctactaaaaatacacacacamaaaaaaattatccaggagtggtggcacatgcctgtaatcccagctactcaggaggctgaggcaggagaatcgcttgaacccgggaagtggaggttgcagtgagccaagatcacagcactgcactatagcctaggcgacagagtgagactccgtctcaaaaaaaaaaaaaagaaaaaagaaaattaccagtagcactatgccaattgttgtgtactgtatttataagatgttaacattagcagaagtttgaaaaagggtatttagagctctacactattttgcaatttttctgtagttcct

SEQ ID NO: 162837 - DNA, 601 bp, Human
ttcatcaactgatattttcaaagctctgaattgtttaacaaaaaattttatcctatgaaactcatgtaaactatagtattaacatatattacattaacttataattttacatgttaatataaaattttacattacttttaattttacatgttaatgtaaatataattttacatgttaatgtaaaattgtaaattacaaatatataattatatataaatataagctatgttttgttatatatataattttacattaacataattttacatgtagaattataaattaaaaatatatatattttatataattataaaaattaaattataaattataaatacacattattctgcaatttctatagaaaatatctgtgacaaccagctgctcccacagatgttactgggttttgcaaatataaacattctaaataatgtaattttctctcagagaaataacatgcagaggattttattttgaaaactccttaaatgtgataactataaagaacacatcactattactatcagatttagtaataactctttcaaaattgtaacaataaaagtatccaaatcagattcaaattcaactctggccaatc

SEQ ID NO: 162838 - DNA, 601 bp, Human
gatattcatcaactgatattttcaaagctctgaattgtttaacaaaaaattttatcctatgaaactcatgtaaactatagtattaacatatattacattaacttataattttacatgttaatataaaattttacattacttttaattttacatgttaatgtaaatataattttacatgttaatgtaaaattgtaaattacaaatatataattatatataaatataagctatgttttgttatatatataattttacattaacataattttacatgtagaattataaattaaaaatatatatattttatataattataaaaattaaattataaattataaatacacattattctgcaatttctatagaaaatatctgtgacaaccagctgctcccacagatgttactgggttttgcaaatataaacattctaaataatgtaattttctctcagagaaataacatgcagaggattttattttgaaaactccttaaatgtgataactataaagaacacatcactattactatcagatttagtaataactctttcaaaattgtaacaataaaagtatccaaatcagattcaaattcaactctggcc

SEQ ID NO: 162839 - DNA, 601 bp, Human
tctggccaaatacatataccatttctttcacatttgaaggtaaattgcaaccttataaacatacacaattattatgtgtcaattaaaaataaaacaattttaaaagaaagtaaattgcaagcattatgacactctgtcccagcatttaatcttaagaataaggatattctctttataaccacaatatcattatcaaagtcaaaaaaattaatattgactctatattgcaactacaaaatagtacatatttgaattcttccaactcttccaattgtctcttacaagtgtatgttatgtttcytttttttttttttttttttttttgagatggagtcttgctctgtcgcccaggctggagtgcagtggtgtgatctcggctcactgcaagctctgcatcccaggttcacgccattctcctgcctcagcctcccgagtagctgggactacaggcacccgccaccatgcccagctaattttttgtatttttagtaaagatgggtttcactgtgttagccaggatggtcttgatctcctgacctcgtgatctgcccatcttggcctcccaaagtgctgggattacaggcgtgagccaccgtgcccg

SEQ ID NO: 162840 - DNA, 601 bp, Human
aaaaaggaacaattttgtggtacactgcatttaaaataatctgtgggacatcaaggttgatacagggaagactgcaaggcttaggagggaagtctgggcacaaaagtagctggctatgatcttgggaatatttctctaaaacacactgttcatttgtaaagtgaggaaaataccacctatctcatctatttcacaaaacagaaataggatgtacataaatactctctctgtatgtagttttttggggattttgtgtgtgtgtgtttttgttttttgtttctgtttttttttttttttttttagacagggtctcattctgttgtccaggctggagtgcagtgatgtgatcatagctcactttaactttgaactcctgggctcaggcaatcctcccacctcagcctcccaaagtgctgggtataatagcatgagtcaccatgcccagccatgttttgtaaactgtaaaacattctaaaatcatggagtagcattattaaactgtaggaaacaaaataataaataagtattgaacatatattcaataatctcttacaaatggtaatgttagggacaaaaattggaccaaaatagtaagttgcac

SEQ ID NO: 162841 - DNA, 601 bp, Human
ctaaggcagaaataaaaaaaaattaagctatttatttctctcaaaatagaatacctaattctctgtttaagtcaacataggcttcaaatcttggagtccttttttgcagcgaagacaggatctgcagagaagacaatcactctaccatgctgttatggcctttttttcccccttacaccaaccaattctgacatcaactttaaaattctccaatcctctgaacaccaactgggtctccaacaattcaattctattctgacactaactacccagagttagtgtcagactccgtaggtttaaragtccacaagattgccctcacttcaaatgccaattgcaagtattaggtcccctggttacccacaatgcagtccatcttggctacaaatttgaagtctccacaaccccctcctgaggtctgatatttggctagtactcacagaactcaggaaaatgctttttccttaccattacaggcttattataaaaaaaaaaaagaactcaggaacagccaaatggaaaagatacacagggtggtaaggtgtgtgggggcgggtgtgtgggagacagtgcttctatgcactctccaggtatgccaaca

SEQ ID NO: 162842 - DNA, 601 bp, Human
tttttttttttctttctttttttgagacggagtctcagtctgtcacccaggctggagtgcagtggcacgatcttggctcactgcaagctccacctcctgggttcacgccattctcctgcctcagcctcccaagcagttgggactacaggcgcccgccaccacgtccggctaattttttgtattttttagtagagacggggtttcactgtgttaaccaggatgttttcgatctcctgacctcgtgatctgcccaccttggccttccaaagtgctgggattacaggcctgagccaccgcgccyggccaagaagggtcttttcaataaatgatggttaaatggataccccatgagaaaaacaaaacaaacttcaggctctcttataccaacacaaaattaactttcgataaattacgacattaaatataaaaggtaaaaacaatgcttctaaaagaaacgcaggaaaacatcttcatgagctgaaggtggacaggtttctttgaaaacaggatccaaaagaacaaaatcaataaaggaaagaataaactgaactacactaaaattagttattcttgcttattaaagactcattaaaagggcaaa

SEQ ID NO: 162843 - DNA, 601 bp, Human
gagagatcagattgttactttgtctgtgtagaaagaagtagacataggagactccattttgttctgtactaagaaaaattcttctgccttgggaggctgttaatctataaccttacccccaactccgtgccctctgaaacatgtgctgtgtcaactcagggttaaatggattaagggtggtgcaagatgtgctttgttaaacagatgcttgaaggcagcatgctccttaagagtcatcaccactccctaatctcaagtacccagggtcacaaacactgcggaaggccgcagggacctctgyctaggaaaaccagagacctttgttcacgtgtttatctgctgaccttctctccactattatcctatgaccctgccacatccccctctccgagaaacacccaagaatgatcaataaatactaaaaaataaataaataaataaataaataaattccagacacagcttcactaatgaattccaccaaacatacctaaagattatttaaagaatacctaaatacgtaaataaaatatctgaataaaaatatctaacgaatatcttaaaaatacctaaaccaatatcaaaagaaaaatgtacataa

SEQ ID NO: 162844 - DNA, 601 bp, Human
tgaagtttgcaaaactagaaaaataaatatcatgaaaatactaacaaaagttttgtatctactaactatgcaacaaatattacaaagtcctatgtaatacaagacataggacttttaaggcaagagggaggtctttttcataatgataaaagggtcactctacccagaatatgtatcatctctaaatctgtagatacctaatgagcacatgatcaaaacagaattaaaaaaataaatagaaaactccataatcataggggagattttaacgtatatctaccagtaattgatagagaaggggaaaaaaacaaaattcttactaaagaatatagaatacctgaacacaaaaaaaacccgacataataacaaagataactggatctaacaaatccagactaggcattcttttcatgtgtacaaaaaacatttaccaaaatttcagtatgtattgaccaataaagcaaatatcaatgaatttcaaaggactgaaatcacatagtacattttctaaacaaagtggagttaagctagaaaacagtactaaaaagttaaatagagaatgcttctatacttgaaaatcaagcagtatacctcaaaataa

SEQ ID NO: 162845 - DNA, 601 bp, Human
gcttgcctagagtagagctgggggttactaaccaaaaaagaaattttctgacatgatagaaatcttgattgagggaggggggattggccacatgatatatatgtgtgccaaaattcatagggctatctacatttaaaatccgtatgttttactatatgtaaattgcagtagcgcacgcctgtaatcccagcactttgggagattgaggaagggagatcgagtgagcctaggggtttgagaccagcctgggcaatacagcaagactctgtctgtagaaaatttaaaaattaaaaaaaaaaaattagctaggcatggtggtacacacctgtaatcccagctacttgaaaggctgaggcagaaggatcacttgagcccaggagttcgagactgcaatagctataatcacaccaccatactccagcctggtcaacagagcaagactgaccgactgactgactcactcacacacacacacacacacacacacacacactctctctctgtatatatatatacatatatatatacatatatatatacgtatatatatatacatatatatacatatatatatatacatatatatatatatatagtattg

SEQ ID NO: 162846 - DNA, 601 bp, Human
atttctgggttcttcactctgctccctaggtctatgtgtctgtttttgtactagtaccatggcgttacggttactttagtcttacagtatattttgaagtcgggtaatgtgatgcctccaactttgttctttttgctcaggatggctttggctattcataaaagagataatcttacacccatgtttgtatgttcataggagcattatttacgatagataaaacatggaagcaacccaagtgtcaatcaacagacggataagcaaaatgtaatatatccatacaatggaatattattcagcrttaaaaaggaaggaaattctgacgtgctacaatatggatgacccctgaagatattatactaagtgaaataagcctgtcacaaaagacaaatactctatgattccatttacatgaggtaatgagagtagtcaaaattatagagacagacagcaaaatgttggttgccagaggctggctatacaagttaatggggagttactgtttaatgggtacagggtttcagttttaaaagatgaaaagagttagatgggtggtagtgatggttgcataaaattatgaatatatttaatgacactgaac

SEQ ID NO: 162847 - DNA, 601 bp, Human
aacagagaatattctcaggaaaacaaaacaaaaacaaacaaacaacaacataagcccaacttttccaactctgtctttataccataacaacttctccttccctacccttccgtatccacatcaaaatgaataacccacaaaaacaaaaaacacctaccaattcaatgttttatcagctgcctggaaatcaactgccaaaaggagtttgggtattttgtgaaatactaacttaagtatttgccacagttttgtcaaattcacaccatcgtactgttgaatggaaataaatagagtgtagggygtttgctatgaattttgagagctgtaatgttccagtggaaaaataaaacaaatccatagattaacatagacaatagataccacagaaccctgacgactctggaggcttgtaaatcctttgagtaaagcaaatgctaaaatcagttttcaaagacacaaattcagtggaagtatttctgcccagtatcaagttaactatcctcttttggtcaacagcattggttccatgtacatgtatctcctttactaagtaacagtaaatggttaagagaatgctctgtggtgctggaaaagaaacaaa

SEQ ID NO: 162848 - DNA, 601 bp, Human
aaaaaaaaaaaaaatcacattctcatgttcattgcagcgttattcacaacagccaaaaggtataaacaacctaaatgtccatttatgatgttaatgactaaaaaaaatgtgatatatacacacaatggaatattattcagtttttaagaagaagaaaatcctgctatatgctacaacatatataagcattgaggacattatgctaagtgaaataagccatcacagcgggcaaatactgcattattccacttctatgaggtatttatagtcaaacttacagaaacagaagatagaatggcarttgccaggagtttgagggaggggaaaatggaaagttgctatccaatgggtacagagtttcagttatgtaagatgaaaaagtgcataaacaatcttgtgctgtacacttagaaatatattgacaggctaaatctcatattatgtgttttttaccaaaatttttttaaataaaaaacaatctacaggagaatatttgggggcatgcaaatgggtacagggtgaaggggtttatctagaagaataatctacatagaagaagaaacaagtataaaggcccagacctatttggtaaactgaaata

SEQ ID NO: 162849 - DNA, 601 bp, Human
gacacagcaagactctgtcacttaagagaaaaaaatcatttcaagtcacatgaattcaaaaatgccatagtgaatttgtaactgcatttcattattatatatttcctaagtcaacactataaaaatattttttcaaggggaccttaaactggaaaaaaatgaaaaaacacagatacggtaaactataccagaggtatcctcaatgcagctaagaaaatttgataagtttggacaatcaatctgaaataagaatgcagatggctaccaagttagaaaaaagatttccagcctgttatgaggsctaaattcaaaatgaactttggaacctgaattcattttaagaaaaaaaaaaaaaaaggaaattcagaaaggatcaggaatatgactaaaattgaaaagattaaccagattaagtgatggcaaggatagggagtaactggaaccctgttctactggtggaagtaaattggttcgaccattttataaaaatgttttgctacacctgctaactctaaacaaacatatatcttcacgctatgattcagcagctccacttgaaggtcaaaagaagaatgtttatgtatgccaaaaacatgtacaa

SEQ ID NO: 162850 - DNA, 601 bp, Human
agatactttttgaaagaagccatatatttggccaaaaaagcatacacaaaatgcttagtatcactaattatcagagaaatgcaagtcaaaaccacaatgagataccatgttataccagtcagaatggctattattaaaaacaaaaaataatgggcccagcacactggctcacacctgtaatcccagcactttgggaggccgaggtgggcagatcacctgaggtcaggagttcaagaccagcctggccaacatggtgaaaccccttctctagtaaaaatacaaaaatcagctgggcgtggtrgtgggcgcctgtaatcccagctactcaagaggctgaggcaggggaattgcttgaacctgggaggcggaggttgcagtgagccaagatcgtgccattgcacgctagcctgggtgataagagtgaaactccgtctccaaaaaacaaacaaacaaacaaaatgccaactatgtttaattttgaaatttctcttctaaatgcaaaaaaaattgacagaagtagagcccttgggaaaaagcagagattatggataagttgtagggaaatacagaaaaagattacgtgtaggtaagtataatagtg

SEQ ID NO: 162851 - DNA, 601 bp, Human
cccattaaaaagtaggcaaaggacacgatcagatactttttgaaagaagccatatatttggccaaaaaagcatacacaaaatgcttagtatcactaattatcagagaaatgcaagtcaaaaccacaatgagataccatgttataccagtcagaatggctattattaaaaacaaaaaataatgggcccagcacactggctcacacctgtaatcccagcactttgggaggccgaggtgggcagatcacctgaggtcaggagttcaagaccagcctggccaacatggtgaaaccccttctctastaaaaatacaaaaatcagctgggcgtggtggtgggcgcctgtaatcccagctactcaagaggctgaggcaggggaattgcttgaacctgggaggcggaggttgcagtgagccaagatcgtgccattgcacgctagcctgggtgataagagtgaaactccgtctccaaaaaacaaacaaacaaacaaaatgccaactatgtttaattttgaaatttctcttctaaatgcaaaaaaaattgacagaagtagagcccttgggaaaaagcagagattatggataagttgtagggaaatacagaa

SEQ ID NO: 162852 - DNA, 601 bp, Human
caattccaataaaaacaaaaattgacaaatgagacccaattaaactaaagagcttctgcacagcaaaagaaactatcaacagagtaatcacacaacctacagaatgggagaaaatatttgcaacctacagaatgggaggagatatttgcatccaataaaggtctaatatccagaatctataagaaacttaaattaatgagcaaaaaacaaacaaccccattaaaaagtaggcaaaggacacgatcagatactttttgaaagaagccatatatttggccaaaaaagcatacacaaaatgctyagtatcactaattatcagagaaatgcaagtcaaaaccacaatgagataccatgttataccagtcagaatggctattattaaaaacaaaaaataatgggcccagcacactggctcacacctgtaatcccagcactttgggaggccgaggtgggcagatcacctgaggtcaggagttcaagaccagcctggccaacatggtgaaaccccttctctagtaaaaatacaaaaatcagctgggcgtggtggtgggcgcctgtaatcccagctactcaagaggctgaggcaggggaattgcttgaa

SEQ ID NO: 162853 - DNA, 601 bp, Human
gaaaaaacatttcatgctcaataggaagcatgaatattatgaaaatggccatactgcccagagcaatttacagattcaatgctatttctaccaaactaccaaggacattcttcacacaattagaaaagactattttaaaattcatatggaaccaaaaaggagcctgaatagccaagataatcctaagcaaaaagaacctaagcagaaagctggaggcaccacattacccaacttcaaactatactacaaggctgcagtaaccataacagcacgttactggtataaaaacagacacacagaytcatggaatggagagcccagaaataatgctgcacatctacaaccatctgatcttcgacaaagttgacaaaaacaaatggggaaaggctccctattcaataaatggtgttggggtagctggttagtcatatgcagaagactgaaactggaccccttccttacagcatatacaaaaatcaacttaagatggattaaagactcaaatgtaaaacctaaaactacaaaaaccctagaagacaacctagaagataccattctggacataggccctggcaaagatttcataacaaagacatcaaaa

SEQ ID NO: 162854 - DNA, 601 bp, Human
ttgggaggctaaggcaagagaatcacttgaacccgggaggcggacgttgcagtgagccgagatcacgccactgcactccagcctgagtaacaaagtgagactctgtattaaaaaaacaaacaaaaaaccttcaacaaactaggccctgaagaaacatacttcaaaatattaagagccatctatgaaaaacccacagccaacatcatactgaattgagcaaaagttagaagcattccccttgaaaccagaacaagaaaaggatgccctctctcaccactctattcaacatatacagcactgsaagtcctagccagagcaatcaggcaagagaaagaaataaaaggcatccaaataggaagagaggaagtcaaactatctctgtttgcagatgatatgatagtatacctaggaaactccacaatatctgtccaaaagctactagctctgataaacaactccagcaatgtttcaggatacaaaatcaatgtacgaaaatcagtaccatttctacatacctacaatgtccaagctgagagtcaattcaagaacacaatctcatttacagtagccacaaggaaatgcaatacctaggaatacagct

SEQ ID NO: 162855 - DNA, 601 bp, Human
aaaaaaaaacaggagagaaagagagagagatagctccaaataaacacagtcaaaaatgacaaaggggacattaccaccaaacccacagaaatacaaaaaaccctcagagactactatgaacacctctatgcacaaactagaaaacatagaagaaatgaataaatttctggaaacatacaacctcccaagattggaccaggaagaaatttaatccctgaacagaccaatagtaaagtgaaattgaatgaataataaaaagcctaccaaccagacaatgcccaggaccagatgagctcacagytgagttctaccagatgcatagagaggaactggtattgttcctactaaaaccattccaaatgcttgaggaagagagactcctccctaactcattttatgaggccagcatcatcctgacaccaaaacctggcagagacacaacaaaaaatgaaagcttcaggccagtatcaatgatgaacatggatgcaaaaatccttaacaaaatactagcaaaccaaatccggctgcacatccaaaagctaatccttcatgatcaagtggactttatccctgggatgcaaggttggtttaatatatacaa

SEQ ID NO: 162856 - DNA, 601 bp, Human
gcagccaggatgaacatctgctgccaccaagagactgggacattaggaagcctggggcattctaagcagatctttggagggaaggcattcagagtggatgaagggaggacaaagatgctggaccaaaggggtaggaagctggggatccagcacagggctaccgtgcacaggtattcattcttggcccccaacaactccaaaggaagggaaacaaagtcagttgactaaactcaccttataccacaatcaaacccccaagggcatcaaagaagataaaaacaaacaaacaagcaagcaagcaaaaaaaaaaaaaaaaaaaaaccacacatccaaaagacagcaacttcaaagactgaatgctcagctcatacagatgagaaagaaccagtgtaagaactctgccaatttaaaaagccacagtgtcttctcacctccacacaaccacactagttccccagcaataggtcttaaccaggttgaaatgactaaaatgacagaaacagaattcagaatatggataagaatgaagatcatcaagattcaggagaaagctgaaacccaataaaggattctaaggaatacaataaaatgatttgggaga

SEQ ID NO: 162857 - DNA, 601 bp, Human
tcatgttaatactgcctgttaccactttgtaaaatttaaaatatcaacattaaaaagagtaaaatagggctaggcatggtgactcacacctgtaatcccagcactttggaaggctgaggcaggtggatgacctgaggtcaggagttcaagaccagcctggccaacatggtgaaaccccgtctctactaaaaacacaaaaaattagctgggcgtggtagcgggtgcctgtaatcccagctagtcgggaggctgaggcagaagaatagcttgaacccgggaggcgcagggtgcagtgagccgmgatcgcgccattgcactccagcctgggcgacaagaacgaaactctgtctcaaaaaaaaaagtaaaatgagacctagcccatctcagagtagaaacaataaaaaactcagacctgttacccagaagcaacaaaacatgcaataatattacatcatttggatttttctcaagcacaattatcaaaagcaaatttcttctttgttctattaacatgttttataatatgagaaatcattcactgcctccattcatttctttcttttaaacattataagccattaccccctagaatactttttgt

SEQ ID NO: 162858 - DNA, 601 bp, Human
ggaatagtgtttttatttttcttcagagtctcaaattttaaccaatacattatctacagaatttaataccttttttcaaggtcatttggaaggaatttattccttaatttatagtattaaaccttcataatttctagaaggcaactaaacattaaggataggggactctgctcctataaaacaagtggctattaatatagtccaattatttccattcagagaaaaaaaatgtagtgaaagttggatactgtagctctactaaccatttctaatcagaatgtagcacattactgcaatcttmcaataactaagatgaaaagcataatccctatatatgactaaatgactattactgagccaaattacaggccctctatgggcttctggacctcaaattccacatgatttaaaaaagaaaaaactactaaacacatttcatgttaatactgcctgttaccactttgtaaaatttaaaatatcaacattaaaaagagtaaaatagggctaggcatggtgactcacacctgtaatcccagcactttggaaggctgaggcaggtggatgacctgaggtcaggagttcaagaccagcctggccaaca

SEQ ID NO: 162859 - DNA, 601 bp, Human
tctgtccttcataatattctttgtccagagtctagctcatcccatactaacatagatccttcaggttatgattacaattttcatacatattttccagttcttttcatttttagtttttattcaatttctatactttataaagcaggtttcctgtatatatcatacaaacgggtttcccttttttattcagtgtaacaatctctaccttttattataacatgagatcatttatatgtattataattatttatatggtcttatttcttttctattggtcttatctatttcatttatcatcttyttttcttcattggggatttttgagtattttttaagtactctatttcatctcaacactgagcttaatgaccattatgtgtattcacggtttcagtgattgctctaaagtttacaacataattttttttttaatgtagtctcactctgacacccaggctggagtgcagtggcatgagctcagctcactgcaacctctgcctctgacattcaactgattctcgtgcctcagcctcccgagtagctgaaattaccagcacatgctaccatgtccagctaatttttgtatttttagtagagacga

SEQ ID NO: 162860 - DNA, 601 bp, Human
tcccaaactgctgggattacagacgtgaaccactgtgcccagcctatctgctcattctaacatctaggttagacctgggttggttatgattgatcaatttctctcctcattatgggccaggtttttctacatctttgcgtgcctggtaattttttattggatgcctgacattgtaaattttatcttgttaagtgctggatatttttgtaatcctataaatattcctgagcttaattttgggatgcagttatgttacttagacacaatttaatccttttgtgttttgcttttaagatttgtyagtcagcattgcccaagcagtatttaatcttgtactagtactctccaccactgaggaaagatccttctgagtagtgtaaccaaagccacatgaattatgaggttttccaatctagctggtaggaacagacactattaccaattttgttcccactaagccttttgggtggtttttagttgtaataggaatgacagtaaatctgattcctgttattccatactggctggaaatgaaatggacttttcctacttcttagatggaagctttagtccttgcttttacaactttctttatctgtaa

SEQ ID NO: 162861 - DNA, 601 bp, Human
cctagagaaccactaatttgatttctatgactgtgccttagtttgaattttctagaattttacataatggaattgcagaatgtattctggattctttcactcaaaatgaactgagatttttccatatcattgcaggtaacaatagcccactccttttattaataagtataccactgtatgcatatacaacaatttggtttatgtacatttggggttgtttcctgtttggagctattacaaagaaagttgctataaacaataatgtacacgtctttggtggacatatgcctccatttctctygagaacctatgtagaaactaccaaagtgttttacaaagtggcttccattgcaatgtcttcaagtttaccagtattttcttcaatgtcagatctgctgttaatctcatctggtggcttttcacttcagacatcacagtcttcaactctagttgttcaactgggtcatttctacatttccaatgccttattttaaaccttccctctctctttttgaacacaggtaatacagttaataataactgctctaatgtcattatctgttcttttttttttttttttttgagacatagtctcgcttag

SEQ ID NO: 162862 - DNA, 425 bp, Human
gaaacagtatctctctgttgcccaggctggagtgcagtggcgcaatctcggcccactgtaacctccacctcctgggttcaagtgattttcctgcctctgcctcccgagtagctggactacaggcacatcccaccacactcagctaatttttgtatttttagtagagacgggggttaaccatgcaggccaggctggtctcaaactcctgaccacaagtgatctgcctgccttggcctctcaaaatgctgggattataggcatgagccaccgcacctggccagatttatccatgtttatatgygtacaaacaaatagctccaagtttagctctttttttttttaacatgaaatgggtgttgaatattgtcaaatgctttttcttatttactatactaatatggggatgtacagtgatggattataag

SEQ ID NO: 162863 - DNA, 601 bp, Human
aaagaaaaatgccaggcgtggtggctcatgcctgtaatcccagcactttgggaggccaaggcaggcagatcaactgaggtcaggagttcgagaccagcctgcccaacatggtgaaaccctgtctctactaaaaatacaaaaaattagccaggcgtggtggcacatgcctgtaatcccagctactcaggaggctgaggcaggagaatcacttgaacctgggaggcggaggctgcagtgagccaagattgcaccactgcacctagatgacaagagtgaaactctgtctcaaaaaaaaaaaaaagaaaagaaaaaaagaaaaatgactgaaaggtaaaaaagcaaaaatagacatgatgctaatgagaaacagtgagaaatcacaattttccctgtgccccacaattatttttcaggaatcaaatctacttataaattaatcagctgatttctggcactacactattttaaagatcagtgaatcagaatgtacttatctttcatatatctgcttatgttaggttgctgctagtctacagtttcagattaaaatataattcaattccatttacagttaagtacatgaataccaaaaagactgatt

SEQ ID NO: 162864 - DNA, 601 bp, Human
tttttatttatttttatttatcttttttttgagatagggtctcactctgtcgcccaggctagagtacagtggcacgatctcggctcatggcagcctccaccttgtgggttcaagcaattctcccacctcagcctcccgagtagcttggattacaggggcgtgccaccacgcccagctaatttttgcatttttagtagagatggggttttaccatgttggccaggctggtctcgaacccctgacctcaggtgattcacttgcctcggcctcccaaagtgataggattataggcgtgagccaytgcgcccagccaaaagttgaaaattctaagtttatgcctggccattaaaatgacccagtaactaatgtgaaaacattcaataattatttccacctcaaacatctaaaactctagaactaactcattttttttccttctttctccactctctctggaagaaaaaaaagtgtgtaagcccaggtgcagcagctcacacctataatcccagcactttggaaggccgaggcaggtggatcacaaggtcaggagttcgagaccagcctggccaacatggtgaaacctcatctctactaaaaatgc

SEQ ID NO: 162865 - DNA, 601 bp, Human
ttaggtaacttggatgaggtctctggtgttacctatatatcttttactccagatatcttttttgttaaagctctcactctttgaaatgaataaattactattgtactacatatgacctactatcttgataagcacagaaaatttcattcaccaaatttctttgccagaaaattcacatacatttcaaactcctaacctgaaggtaaaaacttgctgaagtacttcaaatgtttcttgaaaccaatacacattaagaaatacattgtatacctttacatcataagccaggaaatgcacttatcaacagatattttttgagccacctactctgtatcaggactactctagccactgagaatatagcattgaacagaacagcctaaaataaaattctctgatcttagggagcttacatttgagtaggaataaataagtaaccctatatagttgaatgttgaaagtgacaattttttgactaaaaataaagcagggaaggggggataaagaatgtggggttgagcttagcaattttaaacagggccatcaaggtgggtctcacttggagaatgtgacatttgagcaaaaacttaaaaggtgaagg

SEQ ID NO: 162866 - DNA, 601 bp, Human
catgtgatcattgtataaatgtattgagttccactgtgaaaactgaaaaaacaatgagaccctctattccagagagaaaatcttaataaaaaatttacatcaccaggcacagtggctcatgcctgtaatcccagcactttgggaggccgaggtgggcagatcacctaaggtcaggagttcaagaccagcccgaccaacatggagaaaccccatctctactaaaaatgcaaaattagctgggcatggtggcacatgcctataatcccagctactcaggaggctgagggaggggaatcacttsaatccgggaggcagaggttgcggtgagccaagatcgtaccattgcacctcagtctgggcaacaagagtgaaactccgtcgcaaaaaaaaaaaaaaaaaaaaattatatcagtgtttttcaagctttactctgcagagctcaatgaattttcctcaaaggtatgctttctttagcaatgagagagattggaactccatttatactttctcttccttccaacttggatcctttcccttcagtcagagaagtaccattttgacaatttttaaaaattatactggagttatgctaaagacttta

SEQ ID NO: 162867 - DNA, 601 bp, Human
aaacaatgacatctcctgtctgcttttaattatgtggattacctattttatgacagtgattacactttgttaactaacctacaaaataatgttctacatgactagatacagaaccatacctataactatttaacttaatttcatctgaggttcacatcaacattattataaacacatggaccataagtttgtagtttgtaattttgtaactgtgtgcaaattccacttcccattaacatacggtctaaacatagaaaataaagagcaatccaagaactctttaaattcttaacccaaaacmaactattaacagaccatccaatacaactacacaagatttaactttttcagttcagtgatttctacttcagtgaagccaaatttaattttatttttgctactatctacctaaaaatcaagacatttggcaagtggtggggggaaagcttgacaatgttcaaaatttagggacacaagtctccctaccacaaaaaaatcaccaagttgttgtatttaaaagagaaaaatttgtatcaacaacagaaaatctaaaaataaacatagttctggaataatactgtatgaaaagattcctcataaa

SEQ ID NO: 162868 - DNA, 601 bp, Human
attaacataacttttacattagcaggagtctccatttgtccctcctcccactatgttttttgttcacctttgaacttttctctcttattcttccaatacaaaaaaagaatcattataacttggtaaaaatccacaaagccaaatagagaagtatattttaatgctagataaagtactcattctccaataaacactgcatttcagcagcactgtagactcctgcttgcctagggagtgagtgactggcaatcaaactaaggtcagctacatggcaatgaagaacgtttccattagcccaggyagacattttgataaatccatttaatcacgctactggaaagcaacagattataaacaatgacatctcctgtctgcttttaattatgtggattacctattttatgacagtgattacactttgttaactaacctacaaaataatgttctacatgactagatacagaaccatacctataactatttaacttaatttcatctgaggttcacatcaacattattataaacacatggaccataagtttgtagtttgtaattttgtaactgtgtgcaaattccacttcccattaacatacggtctaaa

SEQ ID NO: 162869 - DNA, 601 bp, Human
agtggctcacgcctgtaatcccagcactttgggaggccgaggtgggaggatcacctgagttcaggggtttgagaccagcctgtccaacatggtgaaaccccatctctactaaaaataccaaaaattagccaggcgtagtggtgggcacctgtaatcccagctactcaggaggctgagacaggagaattgcttgaacccaggaggcggaggttgcagtgagctgagatcatgccattgtactccagcctgggcaacaagagcgaaactccgtctccaaaaaaagaaagaaagaaaaaaaaaagatgtcaaaatatttttatttgatgagtcacaaaataaaactcacaacttaaaaataattattaccatcaacttttaaggttctgcatggattttgttttgttttttaaattgtctcccacaaaatcagctttcaatatatatgctattttaaaaatctctagttttatagaaagatacattgaataaacatactaaaagaagtaaaccctagcttttaagttatgtgttaataaaaagtacattaacataacttttacattagcaggagtctccatttgtccctcctcccactatgttt

SEQ ID NO: 162870 - DNA, 601 bp, Human
agtataattaacagtttgttttctccttcctaattttactgtgatttataatagaatttatagttgtatcacagaggccactggagtactgcttcaccctttcaattaattagtgaaatctgatttcttttttaaaagggcttaaaatgcttttcaactgttacaaagattatgattaagagtttgctcttcgattctcagaaagcttgaaattctgttttctgaaacacataatttactttaaaaacattcagtttacaattataggcactcatatggtaattttgctgctcttagtttmtaccatttcttcccctagaaagaaattatattaatacaaagactcaattaccaggcaccccctagtggcagtaaaatcaagttaagaagtttttttgttttcttgttttttaacaggacatggtttgagatacagttttctgtatgtatacttctttaacaaaacttaagagtgagacggtttgtcagtgaacaatttaataactattttattttatttattttatttagagacagggtcttgctctactgcccaggcttaaagtacagtggcatgatctcagctcactgtaacctcaaa

SEQ ID NO: 162871 - DNA, 601 bp, Human
aggacacagcttgtttttattaagtaatcaataagtcattgatgaactgaatctttcctgtaataatatgaaacagtataattaacagtttgttttctccttcctaattttactgtgatttataatagaatttatagttgtatcacagaggccactggagtactgcttcaccctttcaattaattagtgaaatctgatttcttttttaaaagggcttaaaatgcttttcaactgttacaaagattatgattaagagtttgctcttcgattctcagaaagcttgaaattctgttttctgaamcacataatttactttaaaaacattcagtttacaattataggcactcatatggtaattttgctgctcttagtttataccatttcttcccctagaaagaaattatattaatacaaagactcaattaccaggcaccccctagtggcagtaaaatcaagttaagaagtttttttgttttcttgttttttaacaggacatggtttgagatacagttttctgtatgtatacttctttaacaaaacttaagagtgagacggtttgtcagtgaacaatttaataactattttattttatttattttat

SEQ ID NO: 162872 - DNA, 601 bp, Human
gtgtgagggaccctctggtcacaggttggacaactaggctttaggctgtccaccatgtgaaagaagcatcccatgaaaggcacactataaacactcctgtccagttccccttgattttctgttaaggtaaggtagctaactgctgaggtactagaagtccaatttagctgggggctctcaaaacacttgtctttctgttttatcttttctcttttttttttttttttgagatggagtctcactctgtccccgggctggagtgtagtggtacagtcttggctcactgcaagctctgcctccygggttcacgccattctcctgcctcagcctccccagtagctgggactacaggcacctgccaccacacctggctaatttttgtatttttagtagagacggggtttcactatgttagccaggatggtctcgatctcctgacctcgtgatccgcccgccttggcatcccaaagtgctgggattacaggcatgagccaccgcgcccggcctcaaaacacttgtcttctaattggtggacttaagactacaaatttctaagtatcattttggctgtatccacagttttagtacctagcaatctcat

SEQ ID NO: 162873 - DNA, 601 bp, Human
atatttgagtagaggcctaaataaagtgaagaaatgagccaagttgttacctggtagtatcattactggcaggagaatagcaaaatataaatgctctaaggtttaagcacacttagaaggtttaaagaggaacagtatggctggtgagctatgagccagagggacagcgataaaagacgaagttagagagaaagacaaggataagattatgtaagtcttttataggtcccagtaaggaacttggatttttattagaagtgtaatagaaagctagtggagagggccaggcacagtggctcaygcctgcaattccagcactttgggaggctgaggcaagtggatcacctgaggtcagaagtttgagaccagcctagccaacatagtgaaaccctgcctctactaaaaatacaaaaaatagccaggcatggtggcacatacctgtaatcccagctactcgggaggctgaggcaggaaaatcgcttgaacccaggaagcggaggttggaatgagccgagattgcgccactgcactctagcctgggcgacagagccagactccgtctcaaaaaaaaaaaaaagaaaagaaaaagaaaactagtgga

SEQ ID NO: 162874 - DNA, 601 bp, Human
ttaccaaaagaaaaagccacactgtatgaatatcaatacacattccgaccaggtgcagtggctcacacttataatcccagtgctttgggagggtgacatgggagaatcacttgaggccagaagttcaagaccagcctgggcaacacagcaaaaccccatctctttttttttcttttttttctgagactgagtttcgctcaggttgcccaagctggagtgtaatgtcctgatcttggctcactgcaacctccgcctcccaggttcaagctattctcctgactcagcctcctgagtagctggsattacaggcacctgccaccacacctggctaatttttgtatttttagtagagatggggtttcaccatgttgggcagactggtctcgaactcctgacctcaggtgatccacctgccttggcctcccaaagtgctgggattataggcgtgagccaccacacccagcacaaaaccccatctctacagaaaatttaaaaattagccaagcatgatggcacatgcctgtagttagtcccagccacttgggaggctaaggcaggaggacgactgcttgagcccagggtggttcaaggttacaatgag

SEQ ID NO: 162875 - DNA, 601 bp, Human
acctcggctcactgaaacctctgcctcccgggttcaagcgattctcctgccccagcctcctgagtagctaggactacaggtgtgtgccaccacgcccggctaattttttgtatttttagtagagacggggtttcaccatgttagccaggatggtctcaatttcctgacctcgtgatccgcccatctcagcctcccaaagtgctgggattataggcatgagccaccgagcccggccaagtggcatttgttttttttttttttgagatggagtcttgcactgtcacccaggctggagtgcagwggcgcaatctcggctcattgcgacctcaacctcccaggttcaagcagttctcctgcgtgagcctcctgagtagctgggattacaaacacacaccaccacatccagttaattttggtatttttagtagagacggggtttcaccattgtggtcaggctggtctcaaactcctgacctcgtgatctgcctgcctcagcctcccaaagtgctgcgattacaggcatgagccaccgcacccagccaagtgggaatttttattgcacataagttataaggtgagctattacaacttactgaaaaca

SEQ ID NO: 162876 - DNA, 601 bp, Human
atcaatatatgtatgttgaatgaatttgaggacagaaatggcgagtaatggaaagacttcctgaggtttgaaggcctttcaaaggtagatctattgtacaactattctccaaaatgtggctttttctctagagcttgtctgacatcccctcatgtcaaaaacaagctcactacaatctttgttcatattgttctcatcctcctttcctttgctcccttccaaatactgcacagctttcagatcacctttcaggcctctacttgggtttagtaatgaccttctcttctcctctgaattcctrtatcacatactttattgtcttgtacagtttgctttgtttcatgtgtggataccctgaattctagactatatatgtttttataataactgattacttatcagtatatcccttggaaagtagcacactagaaggtgattcaattcaactgtataaagattcaagaaatacttctgcatattctgaactgcatacaaagaactactgattatcatttttttagcctgaggtttcattttactcacaaaattatacttctgaaaggttaattgcccctggtcatcaagctacaaagaggtggaa

SEQ ID NO: 162877 - DNA, 601 bp, Human
aaacataaccccaaggtttctggcctaagtaaataagagaatggaattatatttaacaagaaaaagtggagtagtggcaggtgaggtggagaaattgagagtgaagttttcgttcaaagtttgagatgtccattgagatgttttgagatgtctattagacagtcaaaaaaaaaaaatgtcatgtagagttgaatataagactcaaaggtcaagtaagagagcccagagcaggagagtcagtaccatatagtcagtttttaggcttcgaggccaaaacaaatcacctagaaaaataagtgayacagacaaaagagaggccaagatggaaccctagggcatttcagtcatttgaaatcaagcagaggagaatgagtcagtttaaaggagattgataaatcatcagtgagagaagagaaaaatcaagaaagtctagtataagggagccaaaagaaataactgtttcaaataggagggtgggatcagttacgccaaatgctactgaggcattaaaggtgggaagggcagaaaaatgaccacattcaggaagcagccaaaagctcaatgtgactgcagtgaaggctgcgtgagagaagtctactgg

SEQ ID NO: 162878 - DNA, 601 bp, Human
gatcagaattagacagataggacgggcacggtggctcacgcctgtaatcccagcactttggcaggccgaggccagtggatcacgaggtcaggagatcaagaccatcctggctaacacggtaaaaccccgtctctactaaaaatgcaaaacattagccaggtgtggtggcgggcacctgtagtcccagctacttgggaggctgaggcagaggaatggcatgaacctgggaggtggaggttgcagtgagctgagattgtgccactgcactccagcctgggtgacacagcgagactctgtgtcaaaaaaaaaaaaaaaaaagaattaggcagataatctgtctgccctattgtcttccatagcgttcacaggttaattgtagactatacttagcgagcaccaatatatgtaacatgaaatattagtaaccaaaataaaagaaaatcacacccaactaaaatagaatttcttgaagcaaggacctttgtcattatatccataaaaattaagcataatgggctgggtgcactggtgcacacctgcaatcccagcactttgggaggccaaggcgggtggattgcctggactcaggagttcgagacca

SEQ ID NO: 162879 - DNA, 601 bp, Human
caatcctgtttcatttaatagaaatttccctctgggtgaaaaatagtgcaaagttttcttttaaaaatgcaaggctttcaaaaattaaaaaaaatatatatataaaatacactaaaaaaatgaccaggaacctttgtgttttgaacattttttcctttccctcaattatattagtcaggatttattcttggacctattaatactgaaaagaaattcctgaaactggtgagatagattaatttacaatttagcacatatggtatcattaagctttcacattaataaaagacaaatactagcrttataaaataaaactacaaaatagtttcacaattatatttttatcttgatgcaatcaaactaactttccaatcatgcaacaagaaaaaatgtacatacttaagtgtcattgtggattgaatagctgtagataagggcaccttgtccttcacctgaaactaccccctccatcacaggtgttgcacaagttgaagcagaaaagtcacagaactaggcccagagaggtcccacatcctttatctaagttgtacagaataaaacagcctatgtgtacctgtctactcacagagaagcaagtgac

SEQ ID NO: 162880 - DNA, 601 bp, Human
tgcccagttgcagaagaaattatctctttcattcttgctaaaatgtcattcgtgatttcaaattttaaaaaatcaaactataatatatgttaattaaattggttcattctaattgatccaatatatgccatttatcttgcagtaaaaacaaaccacttacacttttaattaaataagcacacaacttaatttaccctcttgcatatgcacattctcagttaccctactcttacttcagttctgtgccagcaaccccaaccctccccatactggaaaacaaaacaaacaaaccaaaaaaaaaacccaatactttaaaacatttacagaaaggccatgttagttaaggagttatagtcaacccactactagaacatcaataattagcacaatctgtgaaagactacatattttaattactgttactggccaccagcattaaaggagaatagtccaaaatatacgctagtcaagcaagttaagaaagtagcaagtagaataatagacacaacatacaaaatccgacgttaggttcaaatgctcagaatcagagttagccttatcattatttagcccagattatttttaaggattggtataatct

SEQ ID NO: 162881 - DNA, 601 bp, Human
cactattacaacctgtcaagtgcatattgtaaaacaggattattacagtattggtcaccagtgcaattatttactctctgccttttcttgcatataaaaaaatcttatgtttattagtttctgataactgaacggaatttctcttaacccaggcatttcaaaactaccaacacataaatcacagatgatgaaatgtggtcagctatcatgtttgatacacatatcttaagtaacaaaaggctaaagactgttcttaattcttaaaatgtcattgcttctatcgtcttgaaatgcaggtagrcaaatacttatatgggccaaaaaagatatccaatccagattattctaaaatagttccagagaggggaaaagacttgtcagttccaaagagctgcattataaatattaaatttattacttcaggggataatttgttaagaatcacaggaaacctcaatatttataaaatgatccctactgatttatattcatttgaagtggtatgatttcaacagatctcagttttcaaatgcaacttgaaactaataatatatatgcatatttaaaagatgcataatcgtcttttctgaaagctgaataa

SEQ ID NO: 162882 - DNA, 601 bp, Human
caaaagctttactaggttcctgtctcagcttcttctggaattagtcaaatcacatttatttcttcattagattctttttaatcaaccccaacaaacatttgcctttgattgttatgcctcaattacttaaactttgtgggtatttgactttgcagcatcaagtttttaggaaattataatcataatcaatgtgtggaatagctgtagccaaaacagaaaaagattccttcctagccttcatctaaatggataccatatatctctggatactatggactaaaactgtactggcatttttttwaaattctattttgaactctaagtacaaacagaattggtttctctgtgtcactcatgggactttcccagtattattcttttccaaagtaccttctttcctcacgcttccttcattcttttccatcaagcgtccatgttcagtattatttttcctactgccctccctccacccccatgcattagctgtaagtagatgtaaagcttggtgtaagtccaaaaattgtatgatcaaaatatatacttagcaaattgtttggctaaatctttcatgtaggatgaaagattattaccacaattcatt

SEQ ID NO: 162883 - DNA, 601 bp, Human
cttgaaattgagttttcattaaaaaaatcaggaatcttactaattatctcacttataattaattttatttaaatgtgattttctttataagttttccttcatagtaatgattatggatctcttctataacactatagccaggaaaaaaaaaaaaacccacaaaggtctccaaaccaaaactttattaagtatttgctatggtaactaccataacgtgataacaatatacctacaaaaagttatggcatgtaggccaggcttggtggctcacgcctgcaatctcagcactttgggaggccgrggtgggcggatcacctgaggtcaggagttcgagactagcctggccaacatggtgaaaccccatctctactaaaaaatacaaaaaaaaaaaaaaaaaaaaattggccaggcgtagtggtgggcacctgtagtcccagctactcgggaggctgaggtggagaactgcttgaacccaacaggtggaggttgcagggagccgacacagtgccactggactccacctttggcgacagagcgagactgtctcaaaaaaaaaattatggcatgtattaaattgatagattctaactgtcagcaaaat

SEQ ID NO: 162884 - DNA, 601 bp, Human
ttctaaaaaatgaaacacgcggtggctcacgcctgtaatcccagcactttgtgaggccaaggcgggcggatcacaaggtcaggagttcgagaccatcttggctaacacagtgaaaccctgtctctactaaaaatacaaaaaattagctgggcgtggtggcaggcacctgtaatcccagctactcgggaggctgaggcagaagaacagcgtgaacccgggaggtggagcttgcagggagccgagatcgcacccactgcactccaggctgggcaacagagcgagactctatctcaaaaaaaawaaataaataaataaaaataaaaataaaataaaataaaacaaaacagaaaataacaagtattggttagtacatggagaaatggaaactgttctgcattgctggaggaaatgtaaaatggtatattcactgtggaaacctgttcctcaaaaacttaaacacagaattaccatatgattcagcaatcccatttcttgggtgtatacgtaatagaaatgaaagcaggacctcaaagatgtatttgtacacccatgtttatagcagcattattcacaatactcaaaaggtggaaacaacccaatg

SEQ ID NO: 162885 - DNA, 601 bp, Human
agatagaacgtgatatagattggtttaatgaaattgaattaatttcaacaaatactatttgttctttgactcttcttaaaaaattctgtatagagaatataaacatcagtaagatatagtacccctcctcgaagagtatataggctataagatggcctaaaccaattatacaaatgaatgttgtatgaggcacaatatcactgtgtggtatttcaaggctaactcaggagataaggagaggttatcttcatatacgacacagaattatagaaggtttcctgaaggatgtgtcagctgagtrtagtcttcttgaaacacatacggatctttgaatggcatgaggagaaggggtaaggctgagggagaagagctgagggaactacatgagcaagaaatcacatccttttaaaaaatttatgtgttcagaggcaggtaagtaaatatcagttggtaaaatctgaggtacatggaaagacaaataacttctataaaaagtattctagagttaataaagttgtattcacctacattgtctcactttcattctcacaaacaacatgtgtcagggaagtgatcctactgttatgctaactttactgat

SEQ ID NO: 162886 - DNA, 601 bp, Human
gtaattttttaaatgtttttggccgggtgcagtggctcatacccataatcccagagctttgggaggccaaggcaggcggatcacctgaggtagggagttcgagaccagcctgaccaacatggagaaaccccgtctctactaaaaatacaaaattagccgggtgtggtggcacatgcctgtaattccagctactcgggaggctgaggcaggaaaatagcttgaacctaggaggcggaggttgtggtgagccaagatcgcgccattgcacttcagcctgggcgacaagggcaacactccatcaaaaaaaaaaaaaaaagtaatattttaaggcctcaagacattacattttttatttgttggtattatagcatctatgactaggaaaaattaatcagttagttacctcttataatgtgaaaggaaatctttcagctaatttgagatggttcacactattggtttccaacttggaaattgaaaggtgagttagttaagcaatagatgccaaaaacttagtagtagcaaagtcatagcaggagtagcttaacaaggtgataatagacagaaatgccatccttactgtgctattgaaacatgtgtg

SEQ ID NO: 162887 - DNA, 601 bp, Human
ttttttgaggagcaatttggcaatattaaaataaaattcatgtacccttcaaccctgccatttcatttctaagaactgatcctggagaaattcatgcaattcataaagatgagctcttatgttttacatttctgaattcctgagtcatttataataaaaatgactcatgtatttctttagtaattaaaaaagtaaacactgtgatggaaaattgttatacttctgaatgtcaatctgaataaatgaaataatttcattttagttcttattactaagttttaaaaatatgaattggggctgracacggtggctgacgcctgtaatcccagcactttgggaggccaaggtgggtgggtcacctgaggtcaggagttcgagactagcctgaccaacatggagaaaccctgtctctactaaaaatacaaaattagctgggcatggtgggcgcatgcctgtaatcccagctactcaggaggctgaggcaggagaatcgcttgaacccaggaggcggaggttgtggtgagccgagattacaccattgcactccagtctgcgcaacaagaacaaaactctgcctcaaaaaaaaaaaaaaaaaaaaaag

SEQ ID NO: 162888 - DNA, 601 bp, Human
agagatacttaaaagtgtgtctggtcaggttatctgagtctaacttgctactttgcaagatcagctttcagcattactctcagagatttgtaggcaggagggcagaaagcctatcttaagaaaagtagctgccttggccatgagcaaagttataagagtaaagtcaccaaaattacacacctagttaagtttaggtgaatacagtagagttggaaactggctccaaatgacaatttaattaaatcgtatcaaatgaattgacactatgaaagaaagtctactactgcacaccaaaccctarggactgatgctgccaatgctcaaaagctccatacgactggcctttaattaagaaagtaaaacccaacccaaggattcactgttagggctggctctgaaatgtagatatagctattttagaaagaaaataccaggaataccttagcaatcccacttaatgtattattaagatcaggaaaaaaaatttaaccacatgattcattaaataaggaggcattctgaataaactgcctgaagtctcctgttaaaaaattactcctatttatccattaacaaagctattccttagctcatccctgcc

SEQ ID NO: 162889 - DNA, 601 bp, Human
tcattgcagccttgtttatcatcacacaaaatcatatcaaaacacaaaattggcataatctaatatccaataatgtaacagttaaataaataaaatactgtgcggttattaaagtgatgaaccagcatcagcaaagcagagcccagaggtcaaatccagtctactgtctgtttctgtccataaagttacactggaacacagccacatccatttgtttacatattttctctggctgtttttgcactaccaagatagcagagttgagtacatgtaacagagactgcatggcctaaaaagcccwaaataggaattatctgtctcttcccagaaaaaaatttgctgacccctaatatggaagaatatttggttatataaaaagttgttacgtgatctttttaaaaaccaggttacaaaataatatgcatctctgtttaagttatgtctgtataagtataggtacatatgtatgcataccatatgtatgcacagaaaaaagatcaggccaggtgcagaggatcacacctgtaatcccaatattttgggaggtcaaggtgggcggatcccttgaggtcagaagttcaacaccagtctggccaacatg

SEQ ID NO: 162890 - DNA, 459 bp, Human
gtgaaaacctgtctctactaaaaatacaaaaacaaaattagccaggcatggtggcgggcgcctgtagtcccagctactcaggaggctgaggtgggagaatagcgtgaacccaggaggcggagcttgcagagagtcgagatcgcgctactgcactccagwctgggcgacagagcgagactccgtctcaaataaacaaacaaacaaacaaacaaacaaacaggttatgttttcctatcgtaggctagctgaaacaaggcccaaaagaaataggttagtttcctaacagtcagacaagaccttgtcacgaagggcaatatttcctctgtacactttatggaaacagtgagggaacaatacttttccaattatttaatggcttagtaaataatatgaaaaaaatgtttcttacagcctgcaataaataaaattacaatcactcaataaaagctcttaaaatct

SEQ ID NO: 162891 - DNA, 601 bp, Human
gaaggacacagttctttcagagaaggagggaagatgaagaaatatgaggaagaaagagggagggggaagggaaagggagaagaaggggaaaagggaaaaggaggaaagagaagagaggaagatggagggtaaagagatagggagaaatagatgatagggaaagaaagaagagagggaagtgagaaagagagggggaaggacactgattgatttgggacttgagagcactttagagaagtaaaaagaacacacgcacaggctggggtgcagtggctggcatgcccagctgccaatattgtgytgcttctgacggagtttcatctttagagtatgttaaattccagttaaggacaagtggcacttcacagggtaacatttcctaagggcctttttgtcttacacattttttttttgatcagcattggctcaagatcatgctgaaccttcatgatcttttcaattcttgttttacatgcaaatgtttcaattagttcaggaggaatttaataaatgctttgattaccagctgaacattaaacttacattacaaactatactgtatttggatctagagttctagattgacaacagattttctaat

SEQ ID NO: 162892 - DNA, 601 bp, Human
tggccaggttggtctcaaactcctgacctcaggtgatccacacgcctcagcctcccaaagtgctgggattacaggcatgagccaccgtgcctggctagataattctttcaatggaagactcaaagcatttaattgtgcttattatcaaagccaattagactgaaagtggcaaaagagaaaggaggatataaaactgaaaatttgactgtcacttactgagtcgtctgtagcagaagttggccagccctcccataattggtggcgaacggggatacttgtaaggtcatacacatttctcttyacctatgaaaagaaagaaacaggacaattaaaatagaattttcacatgacttacagtttccaatcaatttatgagacatacagtgtatttcttgttttcttctagattcaaaacaagaatttgaaactataaaaacccaagtcaaaaaattttgtaaaaaagaacaaaatcaaatttaaaagcagattctcaatgaagactagatgaaataagagttaagaaatatcctccctctcttgttttcaactcctggctgacttcatttcttttcagtcaagaaacttcaggcacccagttcac

SEQ ID NO: 162893 - DNA, 601 bp, Human
ttcaagtgattctcttatctcaacctcctgagtagtgggattagaggcggccgccaagtgattctcttatctcaacctcctgagtagtgggattagaggcggccgccaccatgcccagctaatttttgtgttttcagtagagatggggtttcaccatgttggccaggttggtctcaaactcctgacctcaggtgatccacacgcctcagcctcccaaagtgctgggattacaggcatgagccaccgtgcctggctagataattctttcaatggaagactcaaagcatttaattgtgcttaytatcaaagccaattagactgaaagtggcaaaagagaaaggaggatataaaactgaaaatttgactgtcacttactgagtcgtctgtagcagaagttggccagccctcccataattggtggcgaacggggatacttgtaaggtcatacacatttctctttacctatgaaaagaaagaaacaggacaattaaaatagaattttcacatgacttacagtttccaatcaatttatgagacatacagtgtatttcttgttttcttctagattcaaaacaagaatttgaaactataaaaacccaag

SEQ ID NO: 162894 - DNA, 601 bp, Human
gaggtggaggttgcaatgagccaagattgtgtcattgtactccagactgggcgatagagcaagattccaagtcaaaaataaataaataaacaaactcctgacctcaggtaatccaccggcttcggcctcccaaagtgctgggattacaggtgtgagtcaccgtgcctgaccaaaaataaaggttttgctattttctgattattaaagtttctgatttttaaaatttcataatccacaaagcatgttccaaaggcatactgtttacattgtaattagattcaagtagcatctacataaattrtcttaaaacttttctgtcttccacaaagaattcttttatattaaaatatatagtggtgatgctggaagaggagtgaactgtagttattatccaggcagaaacataatatttactagaaaatgttaaaagataattcaattcctaggcataatcattatttcagtattgatcattacaagatgtttacaaagtcccaatttctttttagccctatttattttaaaaattagatgtaacttgagatttccagaaacattctcatttttacttttactttttaaaaaaacttaggtatctggt

SEQ ID NO: 162895 - DNA, 601 bp, Human
acacataggttattctgaagcaagtctcagacatcacttcatttctttaaaccagccaattcttgcctgtaattgtaatctgtaattacaataactttttttgcagttatcttaattataatgtcgactcatttactgagtgtctactatgagccaggtactgtatttatattatcacttatcttcataatagttctgcaaattagtgacaaaattaaagctcagagaatttaatgatatgctcaggtcttaattatcttcttctattaatattactatttcttgtaacaagttcttagamaatactgagaacatttctgttttcttcatgcctcctcaggtaaacagtagaccatcatgtatgaacattattcttttatttttgtaaaaataaaggtagcacattttctatcaaatttctcactcaagcaagaaaaacaacaaaaaaaaaaccacaagaaaaccacaaacacatccctatccttagccatagatgaccagccaataattctaattatatactataacatcaatgctaaaatcagtttttcagaaacaaatttaagcacctaaacctaaagatttttttttctggaagtgt

SEQ ID NO: 162896 - DNA, 601 bp, Human
tctttggcaaaaaattaaatgttataaaaaccattaaaacatgggtctcataaaagaccatgccaactcaattcaatgaattagcacctaaaatgtataaggcactattttacaggcagaagaattgatcatatttcatcgactttgcctatcattcttggaacttgtacctgataagccaatttcagtctggtttctacaagggtggggtgcaaaagcagttggcttttccaaccctgtgaagccccacatttccagagtttctctattatcttatgtccctgctcttaaacaagacaaytatttttgctttaaactttttattatgaaaattttcaaatatatacaaaagttgagagaacagtataataaacccaatatatgtatcacctagattcaacaatgattgatagatgcctaatctaaattagctctatcctcactcactctgccacacataggttattctgaagcaagtctcagacatcacttcatttctttaaaccagccaattcttgcctgtaattgtaatctgtaattacaataactttttttgcagttatcttaattataatgtcgactcatttactgagtgtctact

SEQ ID NO: 162897 - DNA, 601 bp, Human
aagcattattaaatccaggaatttaaaaagaactacatgtattcatattgtctgcattgtaataaggtatctaaacataattcacagtgttaaaattatttctcctatctagaaaccaagagcttccttgttaaagtgtaaaatgagattttgcctacttgtaactccttgttctcacagctgaactgtcacagcatgaaaacattttcctactggtaaagctttagatacctatttccctgatcaaagagtacaaaaggaacggagttactgacaattcatacagtatcccacaccctaytcgagtacaaccacaagcaaagaaaatacgttaactctgaagggagatgggcaacaatgttgtaaatgagtgttgacttcactgagtaacctgaaaatgcccaagactgaagtctattaggttcataagagactcaagattataaaagaattgattacaagaggtctatttctttctcctgttgggtgagtcaaaggttaatgagaagtatactgaacaaaacatctcttgtgttactgcaaagtatttctcatgcaggataaaaatgtaagtgaaaaagtattttaatctagttaatta

SEQ ID NO: 162898 - DNA, 601 bp, Human
ctgggcacggtggctcatgcctgtaatcccagcactctgggaggccgaggtgggcggatcacctgaggtcgggagttcgagaccagcctgactaacatggagaaaccccatgtctactaaaaatacaaaattagccgggcgtggtggtgcatgcctgtaatcccagctactcgggaggctgaggcaggagaatcgtttgaatccggaaagcagaggctgcggtgagccgggatcacaccattgcactccagcctgtgcaacaagagcgaaactctgtctcaaaaaaaaaaaaaaaaaaaaagtaataaaactgaaagagttggccgggcacagtggcttaggcttgtaatcccagcactttgggaggccgaggtgaggatcacttgaggccaagagttcgaggccaaaagttcaagaccagcctggccaacacagcgaaaccctgtctctactaaaaatacaaaaatgagctgggcatggtggtatacgcctgtaatcccagctacttgggatgctgaggcataagaatcacttgaacctgggaggcagaggttgcagtcagctgagatctcaccaccgcactccaccctgggtgacagag

SEQ ID NO: 162899 - DNA, 601 bp, Human
cttttaaaaagtcctggagtagccttcattctagggccaatttatccactccactaaggtgttaactcttctgaagatagctactgaatgccctgtgtattcactgaggtgtctctacaatgtgtagttggaagaaacttgaagcagttttagttttgtgtaaactctggggattgtttaccttatagctccagttaactactctttttcctaacaatttctctttgcttagccttctggattttcaccctatgcatgcacagagactggtattcagctaaagacttggggaaccccatgyagatttctggagatttttctctgctggtagtctgctttgcaaaatatagccgctggagcctcccaaaactccaatctctgtcccttcaactcagcgaaattaccaagttctgttttactttccctttcctgctatgggatccagaagttgcctccaggcagaatttaagactctcatagaactcttgtttccttcttcagagtcctgttggctaatatctgaaaacagttgtttcatgtattttatcctgtcttgcagttgtttacagagagggggaaaatcccaaagcagttatccctt

SEQ ID NO: 162900 - DNA, 601 bp, Human
gtttgagaccagcttggccaatacggtgaaaccccgtctctactaaaaatacaaaaattagccaggcgtaggggcatatgcctgtaatcccagctactcaggaggctgaggcagaagagtcacttgaacccgggaggcagaggttgcagtgagccaagatcacgccactgcactccagcctgggcgacagagtgagactccatctaaaaaataataataataaaataaaataaaattcttgtagtcagttgaatcttgttttttaaagttcatttttaataatcttttccttttaatgtatttcatacttactgtaattatcaatatggttagatttaaaccatattgctgtttgtatttatcccatctgttctctgttccctttttttctgttttcttttttgttgttgttgtttgagacagagtctcattctgttgcccaggttagagttcaatggcacgatcttggctccctgcaacctctgcctcccaggttcaagcgattttcctgcctcagcctcccaagtagctgggattacaggcacctgccatcatgcctggctaatttttgtagacagggtttcaccatgttggccaggct

SEQ ID NO: 162901 - DNA, 601 bp, Human
tacaaaaattagccaggtatggtggcaggcacctgtaatcccagctactcgggaggctgaggcaggagaatcgcttgaacttgggaggtggaagttgcagtgagccaagatcgcgccattgcactccagactaggtgacagagcaagactccgtctcaaaaaaagaaaacaaaaaaaaaaacccagaaaattgttttaggaacactagctctttcacatttccatacaatttttggaattaatttgccaatttctatgaaaaatgctattgagattttgattggcattgcagtgaatccayagctgtctgggaggaggtactgccttaaaaatactgaatgtaggccaggctctgtgactcactctgtggctcacacatatatatatgtgtgtgtgtgtgtgtgtgtgtgtgtgtgtgtgcgtgtgcatatgtgtgtatacatatatacacatatatatatagtaatgaagtccaatttacccattttttccctcttataagcttttagtgtcctctctcagaaattttttcctatcccaagattttctcctatattttccccaagtttaatagttgtagcttttgcatttaagtcatctc

SEQ ID NO: 162902 - DNA, 601 bp, Human
aattttgttctttttgaaaactattttaggctgggcatggtggctcacatctgtaatcccagcaccttgggaggccaaggcaggtggatcacctgaggtcaggagtacgagaccagcccaataaacatggtaaaaccccatttctactaaaaaaaaaaaaaaaaaaaaaaatacaaaaattagccaggtatggtggcaggcacctgtaatcccagctactcgggaggctgaggcaggagaatcgcttgaacttgggaggtggaagttgcagtgagccaagatcgcgccattgcactccagmctaggtgacagagcaagactccgtctcaaaaaaagaaaacaaaaaaaaaaacccagaaaattgttttaggaacactagctctttcacatttccatacaatttttggaattaatttgccaatttctatgaaaaatgctattgagattttgattggcattgcagtgaatccacagctgtctgggaggaggtactgccttaaaaatactgaatgtaggccaggctctgtgactcactctgtggctcacacatatatatatgtgtgtgtgtgtgtgtgtgtgtgtgtgtgtgtgcgtgtgcata

SEQ ID NO: 162903 - DNA, 601 bp, Human
cagccaattaaacacagttgtaagcacccctctatttttgcacatcaaaaaaaaaaagaatttctgttacctccaaaacagtttataatgctatcttcacaatctttctcaaatacagaattataggtaattgattatgtttaaaacccaagggtctaaaagtacaacttaataagctggactactacttcagcaatatttccattgctcaagaaaatgacttattaagaaatcgtatcacatatgttacagctgttcaaatgcaatagacagcatgttagcttgcaaacacaaatgccasagattaagtagtgcacatatgtattataaacaactttccatttttcagttataaaatagggttgggtacaaggctgccaacaagacctttctctgtaacaaaaaagaacctgtttgtggtttttgtttgttttaaagagcaggggtgtctctggagaaagcagtaatatgtattagaatactgggctagcagttattaaatgcaatttagagccaatcactgatttttcagtgccatgcttaatataatgcaagaaacttttactattcattttactccagaggcattctgggcacttta

SEQ ID NO: 162904 - DNA, 601 bp, Human
caatgtcatgatgcgaagcaacaattgatttgactgttgattaagtcaccttgggttcaaaaggctacttaccatgcataaatgttcattttcagccttccttttgggtgagaaaatttgtaagactttacagccaattaaacacagttgtaagcacccctctatttttgcacatcaaaaaaaaaaagaatttctgttacctccaaaacagtttataatgctatcttcacaatctttctcaaatacagaattataggtaattgattatgtttaaaacccaagggtctaaaagtacaacttrataagctggactactacttcagcaatatttccattgctcaagaaaatgacttattaagaaatcgtatcacatatgttacagctgttcaaatgcaatagacagcatgttagcttgcaaacacaaatgccagagattaagtagtgcacatatgtattataaacaactttccatttttcagttataaaatagggttgggtacaaggctgccaacaagacctttctctgtaacaaaaaagaacctgtttgtggtttttgtttgttttaaagagcaggggtgtctctggagaaagcagtaatatg

SEQ ID NO: 162905 - DNA, 601 bp, Human
agcatgaggaaatcttgcaccagccagatctgtccccatcaggacataaatcatccctttgtccagtgtatccatgctgtatactcaacctgcctattagtcatttagtagaccttatcagatttatcagattgactgtcaaggtatcacagtgcttgtgtttaagttacccttattttacttaataatggccccaaagctcaagagtagtgatgttggcaattcagatatgacaaagagaagccataaagtgcttcctttaagtgaaaaggagaaagttcttgacttaataagaaaaaamaatcatgctgaggttgctaagatctccaaaaagaacttgttttctataagtgaaattgcatttgaaggaaaaagaaacatctgctagttttgctgctgcaccccaaagtgcaaaagttacaaccacaatgtctgtggtaagtgcttagttaagatgaacaaggcattaaatttgtgggtgaaaaacataaacagaaaatattttccaatgaatggtcatgtgttgcaccagaaagcattgaacctatatgaagatttcagcaagggatcctctgaaataagtgtttgattttattattaa

SEQ ID NO: 162906 - DNA, 601 bp, Human
atgagagacttgccatgtttaaatgtgaacagaatttctagtacaatgagatcaaagaaaaaatatattagatattattgataacatatgtttcctgagaaaatagaaggtgatggggtacagaacacaggtgaagaaacttattttactcagcctgaactagaaacaacattttctgtccccatattcattgctctttttctacacacagctatctgatttgaaactgtaggattttggtcagtggcaatactctaatgttcagtataaggagctcccaagttttaatcctgtctctgcrgccttggacaaattttaaagtacctagccttttatcttcatgtttaactggggatatttaatatcatttcttaagttttatggatcaattagtaaacccttggctaacagttttagagatgaaaaaggctagaaggacaataccttctccttcttggatgtcaaaagcttaaaagtgattaaacttgtcaactgtctctagaccaatgcaactaaaagaattgtcaaacaggtgcacacagtagtcacacttcacagtaaattacagaaagacctagttaccgttttcatctcacattcc

SEQ ID NO: 162907 - DNA, 601 bp, Human
cggctcactgaaccctccgcctcccaggttcaagagattctcctgcctcagcctcccgagtagctgggattacaggcgtgcaccaccacgcccagctaattttgtattttaataaagacggggtttcaccatgttggtcaggctggtctcgaactcctgaccttagatgatccacccacctcagcttcccaaagtgctgggattacaggcgtgagccaccgctcccggcagagaatcctacactcttaacaacaatacagggaatccactactacagcataaatttgttctgatacaactyctcacaccttaaaatctggccattcctcatttcttctgggcattcttctctaatcatcctgtcaacaaatattaagtatctactatgtacctaaggatagagagagaaaaagaatggtattcttgcttttgaggggttcacaaacagtagtgaataaacttatacacaagaagtgtaactaattttaccaatgtggttaagtcccacaatcaatgctttggtagtacaagaagagataatgtctaactttgcctgaagacttcaagagaaatgtcacaaaggagtgtcagctgagtctta

SEQ ID NO: 162908 - DNA, 601 bp, Human
gggctcaagtggttctcctgcctcagcctcccaaatacctgggactacaggggcgcaccaccacacagttaatttttttgtatttttaatagagacagggtttcaccatgttgccctgggtggtctcgaactcctgagctcaggtgatccacccacctcggcctcccaaagtgctgagattacaggagtgaggcactgcacctggcccagccccgatctttcttaggttggaggttacctggggccagcacctcctagaggaagatgaggagccctggagggtgggtgtctatggctaatstctgccagagctgaccagcacacaaaagctcctgggctccatgccgaccacactcctgtctgtcttgctccctagaaagattcccctgctggccaggcacagtggctcacgcctgtaatcccagcactatgggaggccaaggcaggcggatggcctgaggtcggaagttcgagaccagcctggccagtatggtgaaacccagtctctactaaaaatacaaaaattagccgggcatggtggcaggtgcctgtaatcccagctactcaggaagctgaggcaggaaatcacttgaattcggga

SEQ ID NO: 162909 - DNA, 601 bp, Human
aggtctgcttctgagccttgggggtgccccctccagtcactggcactgtgcctgcattttcttttgttaggtgttccgggccatggggccccctcaggcagaggctggagcagggagatatgccgcacactttccggaccagccctgtggagggaggcacaccctgctcctaccctagttctcagtcctctgatggtgggggctcctcccctgctcaagtgttggtcttagatcttggctccatactcctaagctacatgccacagccctggaagtaccaggaagtcccacagctcagggyggggttatggctgtgctggggtttctgatgtgctcctgagtcactgggaaaatactcaggtggaacaatgcactctggctgggctgcaaagggggtgctgtgtacacgctcctgcaaggcagctaggaatgggccttcgcaggagccagtgagcaggagggcttgcagatatgccccagtcttacggggaagttagccccgatctttctttttttcttttttttttttttttttttttttttgagatggagtctcactctgtagcccaagctggagtgtagtggcgggatctcagctcac

SEQ ID NO: 162910 - DNA, 601 bp, Human
tttttagtagagacaaggtttcaccatgttagccaggctggtctcgaactcctgacctcatgtaattcaccagccttggactcccaaagtgctaggattacaggtgtgagccagcacacctggccccttgctctattatgttttatttctgcgtggtagatctttctccatccctttactttgagactgtgggtgtcattatgtgtgagatgtgtctcttgaacacaacagatggttgggtcttatctttttattcagtttgtcattctgtgtcttttaagtgaggcgtttagcccatttrtattcaaagttagtactgatatatgtgattttgatcctgtcattgtggtgttagctggctgctatgtagacctgattgtataattgcttttcagtgtctgtgggctatgtgcttaagtgtgtgtttgttgtagtggtatcattcttttgattccaagtttagtactcccagaaggacctcttataaggctggtctatttgaaacacattccctcagcatttgcttgtctgagaaggattttgtttctccttcacttataaagcttagtttgctgggatatgaaattcttggttgaaattt

SEQ ID NO: 162911 - DNA, 601 bp, Human
attgtttttccatttatttgtcatctctgatttctttcagcagtgttttgtagttctcattttagagatcttccacctccttggttagttgtattcctaggtatttcattttctttgtggctaatgtaaatgggattgtgttcttagtttgactctcagcctgggtgttactggtgtatagaaatgctactgatttttgtatactgatttttttttttttttttgagacagagtctcactctgttgcccaggttaaagtacagtggcacaatcttggctcactgcaacctccacctcctggattcaagtgattcttgtgcctcagtctcctgagtagctgggattacaagcatgcgccaccatgcccagctaatttttgtatttttagtagagtcaggatttggccatgttggccaggctggtctcaaactcctgacctcaagtgatctgcccacctctgcctcccaaagtgctaggattacaggcatgagctaccgcactcaggctgtacattgattttatatccagaaaccttgctaaattgtctatcagttctaggagcttctggcagagtccttagggttttctaggtatagaatca

SEQ ID NO: 162912 - DNA, 601 bp, Human
ttaaaactaccaatcaaaatatgcaaaataaagaccaaatttaccttcaacataatttgaacttacgcatcttcattttttgacagacatactgttttcatttcatacttaatgttcctgtataattagctttgcattctaatgtatttcatctctgtggacttcatgggaattacagtaatccaaatgtcattcagctctacgttgtaagacatgattgctcttaaatttatgaggatgaataatgtagctaataaaaacattttcaaatttataatgtatattaaacattaaaaaaatmcaacagatttgaaatgtctcacataagaataatacacaaggaattatactttttaggactcccactcaagtaaatacaagaaatagtaagtaatcactcaatatacatgtgtttatttactggttcttatatatacacatgcattgcaagaaaaatcttttatattaaaaaaacaaacaaacaaaaaaaccaggcagggcatggtggctcacacctgtaaccccagcactttgggaggccgaggcgggcagacctcaaggtcaagagatcaagaccgtcctggccaacatagtgaaaccc

SEQ ID NO: 162913 - DNA, 601 bp, Human
aggtttaactaaagaaaaaaaaagtttctaattcaaccacaaaaacagtgtcacaaaatgtaatttaaacctgtaaaagcaggttgcataaaaaacattcagagagctacaaaataggttcccagggtcgagctttgtgcagcatctgaattatgcaggaatgctatacaagtgaacatttcctttaaaacaaaatcaaaccaaaaaggtaaacaaggcagcaccagcaattacactttaccagccagcaatggtgatgagtgggcctctttaaatttacttcattgtgctggagtatttrattcactttgttaattcttttgtgtcaagttactaattcaataatgaaatttccagttaaagcaaagcagctacttttagacttatgaaagacttagctttgtattagggagaaagaattttcttctaatatttgcttttttccacttacaaaccagaaaattatcattagacaaggtagatattaacacaaaaagaaaaaggaaaaacctcacacccttaaatgtgcttcaagctagttattataagcctctctgtttcaagtgcaaaataatctcaaaattatgccacctctgaaaga

SEQ ID NO: 162914 - DNA, 601 bp, Human
acaggcacatgccaccacatctggccaactttttttaaatttttagtagagtcttgctatgttgcccacactggtctcgaactcctgggctcaagcaatcctcctaccttagcttcccaaagtgctgggattacaggtgtgagctactgtgcctgaagattcccagcttttaaaaatgacatcatctccacctgaaacataaaccaaccaggctgacttgtcaagcttttaattttggggatgcaggaacatggtgaagttgaattatggaaaaaaaaaaaaagttaagtcattagattgyccaaaatataactatattttaagaccatgaaaagaataaagagaacaacttatgttgcaaaaccacgtttcacctgtttactcccccacacccccacagttagcttctatagccaggaaatttataaacaaaaatctcactttaacttttctatactctactcaggtcaggcaaacatagtcattagtgatttgaattagtttgctaaataaattaaagtatacttttaaaagacagctgtcaaagaaaaagacaatggattgtgtttggagaacagattaaaaaacattgatcaaatct

SEQ ID NO: 162915 - DNA, 601 bp, Human
agagatcaaaactctgtcatcctacatctttggaagtctgcccaggccataaccatgtatgacatttctgttctgttcactagggaaatggtaatcctaagagaggctgcaacattgcttcaatgagtacaacggatgaggggacctgctgtcctaggaggggaggggaagaagtagtgtcttactgaagaaggagaagtcctaccccaaaatgtctccccctatctctcaaatcatttgtatcactgacaacgaagtatctggaaaaatgtgtcattgtaaggtaacttctttggtaggyagatgtcactatacttcgttgcagaggtataaaagcagagcaattatgaacttggactccaaagccattcttctagggtttgaaatcctggctctgctggttaagagcttgtatgactctggacaactctctcaccttctcagtgccttaatttccacctctgtaaagtcttataagttacaagattgttgtgaagattcaagagtatgtgtatctgaatctgtctatcaaccaatatatctatctatgcttgactgtatgaatgttgctaaatcactctgggggaacagacagacagta

SEQ ID NO: 162916 - DNA, 601 bp, Human
atttttagaaaatataattactttgtataaaaatgctatttatattaacatgtaattcacttgttatcttaaatattattttcttcaatattaatttttagaatggtaaatgtcaatgaatataatccacataaacaaaagctctctggggtctttgatgatttctttacaagtgcaaaaggatcctgagaccaaaaagctgtgaactgctgaactatgtaatgtgtacatatgcaactaattttcatgaataatgacaactattacttgaaacaactgagaagacaaaaaagctctttcgaaatcttagaatcttttcgatgtttcttctttacacaataaacaaagcatatagtattttctttgtattattctttatgttattcttcacatgaaaataaaatactaggacaatatgcaaaggaaaactccagtaaaccatcatgactgatctctggctatgtctaacaagttgttagtaaaacacagtattatcatgttaagcttggtcctcagagcatttaaggccattcttaatacttctttctttaaaaatatgaattagtaggctgggcgtggtggctcggtgtgagacacctgt

SEQ ID NO: 162917 - DNA, 601 bp, Human
gactttttcactgtgttgtatttatttatttattttcttgagagggaacctcgctctgtcacccaggctggagtgcagtggtacgatctcagctcactgcaacctccacctcccaggttcgagtgattctcctgcttcagcctccgaagcagctgggattacaggtgtgtgccaccatgcctggctaatttttgtatctttgtagagacggggttttaacacgttggccaggctggtcttgaactcctgacctcaggtgatctgcccacctcagcctcccaaagtgctgggattacaggcytaagccaccacacctggccacagtgtttttatactgatgttaaaaaaagcaatggtaggcaaatctgctggtacttcagcacaaattaaggtagtaacaccaagctgttaaaaatctccagttccatttactcactgtaaaaatggcagtttcatttaataatgtccctgttaaatcagtaaaaattattaagtaatttaatttatttattaagtaaattttgactcttaatacatgtcttttaatattctatgtgacaaatgggaagtatgtataaaggacttctacagcataccaaag

SEQ ID NO: 162918 - DNA, 601 bp, Human
tacttgtcaaaactggttaataaagaagacaatgataagacatgattattcctagagctctgtataatctcacaattgcaagtattaaaagtccttataaacctgtctttaaaagatactttgaaaaatgtcttgggaagatgatgaatatacatacataggacaaatgaaaccaaaacaaaacaaaaaataagcaaatgaaaaaattacaactgtccttaatgacacctagatagggatagtatttgattattactttctccacagcgtagggataataaggttgagtttatgggtaaaacaatgagaaaatgcctagcacacagttggtggctcaacaaacattactttttactagtctgtgaagaatatctgtggcttgagataaaatgtccagcgaaaaggatggactctagaaaacatgactttagcagaaacaccttcctcacctagactgttccatgagagaagcccactgtcaccttatattctggggtctttctaagttagcctgttccttaattaacacaagagtagttatcttattcaattcaattatttagtctttacaatgtcaaccaaaaagaaaaaaaaaagtgac

SEQ ID NO: 162919 - DNA, 601 bp, Human
gagggtggatcatttgaggtcaggagttcaagaccagcctggccaacatagtgaaaccccgtctctattaaaaacacaaaaaattgagccgggtgtggtggtgcgtgcctgtaatcccagctacctgggaggctgaggcacgagaatcacttgaacccaggaggcagaggttgtagtgagccgagatcgcaccattgcactccagcctgggtgacagagtgagatcctgtctcaaaaaaaaaaaaaaaaaattatagtttaaataaagttcatctgtgctatttagttatgacctccattrtatacacttttgaagtcttggtgatgacttttcctagcacatagtaagagctcaataaatatttcttaaataagttaaaacatccatgctctctttcccatttccttataaccatggtcagagttgggcatgaaagtgctgtttgtagccatggaacagaatttaaatatttccttataatattctttaggcttgggccaggcgtggtggctcacacctgtaatcccagcaatttgggaggccggggggggtgggggttgggggtggatcacgaggtcaggagttcgagaccagcctggc

SEQ ID NO: 162920 - DNA, 601 bp, Human
caggtgcagtggctcatgcctgcaatcccagcactttggaagggcgtggcaggtggatcacgacttaaggtcaggagttaccagcctggccaacatggcgaaacctcgtctctactaaaaatacaaaaatttcaccgggcatggtggtgggtgcctataatcccagttactcaggagactgaggcacgagaatagcttgcacccgagaggtggaggttgcagtgagccgagatcgcaccactgcactccaccctaggcaacagagcgagactccatctcagaaaaaaaaaaaaaaaaaaaaggcttttactgctttctacagttccaaattctcaatgtgtcatacaagacttactcactttcacctcatctcttatcttccttttcccccgactttcttctgcactaacagcaacctacacttatctcttctcatttgctacatcaaatcatgctttttttctctgaatggaatgaatggaatatgattcctttgattctttatttggctgtgactcattctttataatccaatgtggatgtcacctcctctagtctttttttatttcctttatttaaaaaatattcatttacaaataac

SEQ ID NO: 162921 - DNA, 601 bp, Human
ttgcagggaccagctagggttaggtgacaggaattagactatctgtgtatatgtgggcagctgcagggccatctgtgattgcaagcacagtggtaggggcaggagccaaggggcaagatcacctacttatagacataaaactgtgacagccagggctggcagcatgcagtagcctagctgctggggtaagcctcaggtacatgtagtggtgggtttgaagcctgtgatgagtggtcacagagctgttttcaggcacacatgcagtagctgtgttgtgtccctgggccaaagaacccacagrggcagcagctggggtggctctggggaggagggatttcaggtgcttaggcacctgaaaaatacgaagtctgctgaggagggattctagacccaagcaggagcagctcaggtgactccaggtggggaagggagaggagtggtaggtcacacacccagagactgtcaaggctgctgggctgtgttcccaggccagaacaactacagcagtagcagtcttgcagctctgggtctttgcccattttttaactgggttgttatattacttagttttaggagttctctatattttatagacattgat

SEQ ID NO: 162922 - DNA, 601 bp, Human
atgccttaggtaagaagacggtccaagcaagatatctggctacatgcttgtctgtcctatgttcaataaataaagtctataaatattacttagtaaataaaatttctatcttttaaaatgtggcactatgtacttaagttataaaatggggaaactgatccttcagtctatgtagaataacctaatataacataaatattttgccagaaaagcattaatagaaacaaaatataagactcataattagcctgggcatcatggccagatctcatctctacataaaaaaaaaaaaaaaaaaaargaaaaaagtctggcatgatggtgtgccgctggtcttagttacttgggaggctgaggcaggaggatcacttgagcccacgaggtcaaggttgcagtgagccttgtttgcaccactgcactctagcctgagtgacagagtgagaccctggctcaaaaataaaagactcataaaaatttagctagagggaatgtcagaggttagacagttgttgaatcatagattttaaagctggaaggatcttaaaaatctgtcatcggcggttttctaacttattttcatagggtttcctccctcccctag

SEQ ID NO: 162923 - DNA, 601 bp, Human
cctgattagtttcatattgattttggcctatcaaattctaagaataagttataataataacaacaggacataagcgttataaaatttttatcaaataaactcatttgctagagtaaagcttactattttttccttttaaggcttacatacttcctaaactttctgtgatacctgtagaccgaaggtctccaaccttcgggaaatgaagaatgcttacaaactaaataaagacagggatttttgtctttttccccagcatatagtatacaagtaagtgcaaaacaaatgagaaaatgggtayaactggagaagtcagagacaaagtaagttatgcgtctctcaaaaagctcacattaatttatatttggcaggtggaggcaatggtagcatttctaaactttccacttccttactgcagtggttctcaggtttctctttgtgaaatatggtacactatcctcacattgttatggataacatgaaatacactacatatgaaagctctttgtaaactgaagatgagatgtaataataatgttttacatatgagttgtaataataatgttttaattcagtaaaaattactgagaatttactacct

SEQ ID NO: 162924 - DNA, 601 bp, Human
tctctttcagtcttctttgcatctttaaactagcctgggtcccagcctgtttgatgaaagaaacaagaacactgatacaagccacagccccttggcaaaaaagatacccaatagcaatggcaatgtaaaatcagttttagtaaatgaatcaagaattctgatgctttagggaaagtaatgtgaacctggcaccattaacaaattcagaactcttcttcttaggagctctctaactgaacagacagagggatgtcaacccctaattcagcttgatcgtatctcagcaactacatttaatgagacagtgggaaaaagagagctgtccacttttaaatcagcatatttctaactaaacaatggcaatggctaaatctttaaaatgcctatttctctcaagaacactgcaatggaacatttagactttgggaaagagattagtgatttacattgctatctcactgatttaatttaaatgctcttccaaaccaaacacacatgtgccgaagaggctactaagaaacccaacatgcagagttctctataagtgcagccgacagtgttgactgaaactaaacttggaaatccagggcactaatgcaca

SEQ ID NO: 162925 - DNA, 601 bp, Human
tccctattgagaatatggatgtattgttggctgtgtgcaaaagaatgtgtgcaataaagcgattacatcaattagcatatgctagagttaagctattaccaactccactggacttgtgcagaaagtcctgccttcttcactgaagttattaaaaaataaacttactactaggattatatattagacttgttttgccttttctgaacatcattaaaaacatcaggtttctctaaaagttcaaaaacatattagaaatgtctgttgcactgcaaatataagatgagaaatgtatttttgttttcaggttattcttgaatttaaaaagtttttataagttaaggtacattttcacaattgcaaataactgcatgtgttagctgcaacgagcagcttttgtctaatgaaatgcaatggtagagagtttaatgctgaggatgaaaaatgtttatgatgatgataaacacaatgattttttttttaatagaagcccaacttgtaacttgtgaacaacagtattaccttgctctgttggagtcctttgtcagatcccaagcccaggttataaaattttgactcagataagaaacaatggattcagcac

SEQ ID NO: 162926 - DNA, 601 bp, Human
acctttagcacttctcaagactaccaagggcttcctgtcactgttttaagaatggctctgaaatccaactagataaggtggcccaaaagactgtacaatattttccaaggaaaaaacctccaatttagatatgcaatattgaaattataagcaacattcttggatggaaataaatgcatacattcatttgctaaatgctttctgggtttctttttcctagaatttaaaaaagtgccttgtttactgaaaccaacaaaatgaataagctcttcaggagatcacaatttagcaggggagatgrcagacattaatcattacagctaaagtttcatgtctcagttcatatttggaatgttctaagatcaacctaagaattattccaacatattttgtacacagtgggctggaaaatctaagtattccactaagaaagaaggttattagaatcatttaagaggtgtaaaaatccaaatcatcaacatcacaggggttatgacattctatagaaatgtttcttttcttattccaatttgttagagaaattaggaaatttaatttataatagcaagtgatactcatattctggtgacttcatcaaagc

SEQ ID NO: 162927 - DNA, 601 bp, Human
gctgaggtgggaggactgcttgagcctagcaggttgaggctgcagtaagttgaaactgtgccactgcattccagcctgggcaccagagcaagacccctgtctcaaacataaaataaaataatataaaataaaataaaataaaataaataaaataaaatagaaaatcagttttctttaagaacagcaactgacacattttaatgtgtacaagtctgcttcaagaactaacaagttaatacatagctttcctaatagccacataataaaatttgttgctgagacagtaaattatttgagagcwgctcagagaatccagtagctcatttattactgggactaggctatgtaatttctcagatttgaggtatggcaatcaaggctttttaatttttcacataaccttgcctcattccttccttagctgaggtgtgtagaaaactatttgctgaaaaggactttcttggtgctgatcatgtattgaggggaagaaaagcacatgaaagcaatctatttaggattcttaaattgttgctgtagctacagactgagttagccaacagtagataaactgtcaaacagcttttaaaaagtctttagagtt

SEQ ID NO: 162928 - DNA, 601 bp, Human
agtcaaaaactaatagatgttgacacagatgcagtaaaaaggaactcttatacactgttggtgggaatgtaaattagtacaacctctatgaaaaacagtattcagattcctccaagaactaaaagtagatctaccatttgattcagcaatcccactactgagtacccaaaggaaaaaaagtcattatatcaaaaagatacctgcatgcatatgtttattgcagcacaattcacaatggcaaagatagggaatcaacttcaagtacccattaaccaatgagtggataaagaaaatgtggtaygtatacatatatatatataaaattaggtgtgtgtatatatacatggtgtatatatatggtatgtgtatatattatatatatggtgtgtatatatatggtgtgtgtatatataatagaatacaactcagctataaaaaagaataaggtcttcaatgaaaccccgtctccactaaaaatacacaaaaaattagctgggcttggtggcgggcgcctgtagtcccagctactcgggaggctgaggcaggagactggcgtgaacccaggaggcggagcttgcagtgagccaagatcgcgccactg

SEQ ID NO: 162929 - DNA, 601 bp, Human
gtggtttctatgagcccaggagaccagcctgagcaacatggtgaaacccctgtctctacaaaaaaaaaataataatagctgggcatggcggcatgagcctgtagtcccagctacttcagtcaggaggctgaagtgagaggatcacttgagcccaggtggtcgaggctgcagtgagtcaagatcgtgccactgcattccagcccaggtgacagagcgagacacacacacacatacacacacaccaggaccctgacacacacacacacacaccccaggactctgacacacacacacacacacmccccaaaataaaacccaaagcttctaaaaagcttctgcatagcaaaagaatgggagaaaatacatccgacaaaggattactatcaagaatctacaaggaactcaaacaaatcagccagaaaaaaacaaataatcccattaaaaagtggggaaacaacatgaacagacatttttcaaaagaagatgtacaaatggccaacaaacatgaaataatgctcaatatcactaatcatcagggaaatgcaaattaaaaccacgagataccaccttacaccagtaagaacagcagaacagccattat

SEQ ID NO: 162930 - DNA, 601 bp, Human
ctcaaatttttttctaaacagacaatataatgcctcacgatgcaaatgcacatattgtaagcatgttggagaacaaaccaaaggtaatgttaagaaaacacaggatgagattttgggagaatttaacctaaaaaagcatatctcatctgcctgaggcttccagtaatagtaaactgttaaattatctcaatagattagtagtcagagttttaaaaagccacgtaatttttttttttttgagatggagttttgctcttgttgcccaggctgtagtgcaacggcgtgatctaggctcacctcracctcccaccttccaggtttaagtgattctcctgcctcagcctcctgagtagctgggattacaggcaagtgccaccacactgggctaattttgtatttttagtagagacagggtttctccatgttggtcaggctggtctcgaactcctgacctcaggtgatccacctgcctcggcctcccaaagtgctgggattacaggcgtgagccaccgcgcccggcaaaagcaatgtaatttcttaatctttctccttgttgccatctagaaataactcaaatgcaaaaggctttgaggcacttaaa

SEQ ID NO: 162931 - DNA, 601 bp, Human
caatccactggcctcaccctcccaaactgctgggattacaggcatgagccaccacacccggacctcaaatttttttctaaacagacaatataatgcctcacgatgcaaatgcacatattgtaagcatgttggagaacaaaccaaaggtaatgttaagaaaacacaggatgagattttgggagaatttaacctaaaaaagcatatctcatctgcctgaggcttccagtaatagtaaactgttaaattatctcaatagattagtagtcagagttttaaaaagccacgtaatttttttttttttgagatggagttttgctcttgttgcccaggctgtagtgcaacggcgtgatctaggctcacctcaacctcccaccttccaggtttaagtgattctcctgcctcagcctcctgagtagctgggattacaggcaagtgccaccacactgggctaattttgtatttttagtagagacagggtttctccatgttggtcaggctggtctcgaactcctgacctcaggtgatccacctgcctcggcctcccaaagtgctgggattacaggcgtgagccaccgcgcccggcaaaagcaatgtaatttct

SEQ ID NO: 162932 - DNA, 601 bp, Human
aaattgtgtttaccatttgtgtaaaactggggaaaaataaatacatattaatttggtttctttttttgtttgtttttgagacagagtctcactctgtcgtctaggctggagtgcggtggtgcaatctcagctcactgcaacctttgccacctgggttcaagcgattctcctgcctcagctacctgagtagctgggattacaggcacgcgccaccacacctggctaatttttgtatttttagtagagatggggtttcaccatgttggtcaggttggtctcgaactcctggccttgtgatcckcctgcctcagcctcccaaagtgctgagatcacaggcatgagataccgcgcccggccattaatttgtttatatacaaaataacctctggatggataaataagaatgttgcctctggggagggtcacatagatatgggtttaagaaggagactttttattacatacctttttatgcctttgaattttgattaatgtgaatgtgttagccaatcataaaactggtaaaagagcaagtcccttacatgaagaaaaactgcatgtaatcccaaacctttaacagtgttaaacatatttttctatt

SEQ ID NO: 162933 - DNA, 601 bp, Human
agtatactttagtatgcagcagaagtgctttacccatacctcccattgtgccacataaactattaaaagggttaaaatttaataaaagtaataatttttactgcttcatcaaggacattcttaaggctttttcttttcttttttaactaaatacatggcaatgaagaatatgactactattgcagttttgtgttatggctttgattcgtgctaaggtgccaagagtttttataaactattccttttgagccactagtgcaaatgtcaacacagtaaaaaaggcaaaaaaaaaaaaaaaaaagtcttattacagttaggaaaataattttgaccttacagatatcctaaaagggtctagtctgatgtctacaaaccacaccttgagaaacactagttcttgcaacattgcctctgacagggaaagcaggaatgaagtgttatcttcattatccatttaccctatgcaaatcagttcccctggaggtctttttaaacactgtttatgaaattgaatgctctagttatagagaaaacataaaatgctagaggtctggttttatttgggttttaaaggcactgcaatttacacatatcccctcct

SEQ ID NO: 162934 - DNA, 601 bp, Human
gcaaaaatagattctaaaatgtcgctactgtaatgtagtaatacttgttttcctcctcacccactctttgccaatagcccctcattaaagcaaaagatttctttgtcccaaggacctcatccagtgatatgtacttggtaggtactttgtaaacctttacaaaaccaaatactactaatgaaaatgtctaagagagaaagctataggcagttctgtcaaaaacagagatccatataatgtatataccctggttaaaaatagagcaatcagtgatataaaggttagtcctttctgggccacygaagagtgattcagtgtataaatatggttcaggcttgggtttatttaacaaaagttttaaacataggtatttccggttgtgctatggaatcatcaaagtgatgaatacaatttaaagttaaatttaaataaattcaggcctaggaagccagcctccaaacctgttcactgatttaattttaatttcaaacttaagtcttatttctaattttttaaaaataaaggcaaattcacaattacaagggacagtgtttcttgtcacatattcagcagctaccaaatcattatggtctatgtatag

SEQ ID NO: 162935 - DNA, 601 bp, Human
aatccacttccacttaatgaagaggcaatacatttcttcttccttaggattttcttaataacattttatttctctagttcactttattaatgcgctatataatacatataacatacaaaatacatgttaatcaattatattattggtaagacttctggttatcagtaggctgttagtagttaagttttgggggagtcaaaagttatacctgcatttgactgtgtcaagagttgacaccctaacctccacgttgtttaagagttaactgtagtttgaactacactagtttgtactggtttgyagttatttattatactatattcatcattacttttatgtttcaatgaaccattgttgagccatgatccattttgggaagctaagaatataattgacttaagcaaggaaaaatgaatgtaaatctgacaataacatatgaatgacatgaagttcagatgtcagagtcaaacacctctgttaaatgaatgcttgccaagacaaaacaatcaatgcaatcaatccttattatctattaacagtctaataaattgtaacagatgtgataaattaaatgggatttggaagaatataatttatctta

SEQ ID NO: 162936 - DNA, 601 bp, Human
tgcctcttctgcctcctctttcacctcctctacctcttttggctctgcttcctctaagacagcaaggccaacctctcctccacctctcctcagcctgctctacgtgaaggtgacaagaacaaagacctttatgataatccacttccacttaatgaagaggcaatacatttcttcttccttaggattttcttaataacattttatttctctagttcactttattaatgcgctatataatacatataacatacaaaatacatgttaatcaattatattattggtaagacttctggttatcagyaggctgttagtagttaagttttgggggagtcaaaagttatacctgcatttgactgtgtcaagagttgacaccctaacctccacgttgtttaagagttaactgtagtttgaactacactagtttgtactggtttgcagttatttattatactatattcatcattacttttatgtttcaatgaaccattgttgagccatgatccattttgggaagctaagaatataattgacttaagcaaggaaaaatgaatgtaaatctgacaataacatatgaatgacatgaagttcagatgtcagagtc

SEQ ID NO: 162937 - DNA, 601 bp, Human
gtggcgtgatctcggctcactgcaacgtctgcctctcaggttcaagtgattctcctgcctcagcctcctaagtagctgggactacatgtgcgtgccaccatgcccagcaaagatttttatattttaagtagagacagggtttcgctatgttggccaagctggtctcaaactcccagcctcaagtatctgcccacctcggcctaccaaagtgctgggattacaggagtgagccactgtgccgggcccctgatgacttttttgattctacaaattgtagcaggtatgaagtggtacctcatgyggctttgatttgcagtcacctggtgagtaataatgttgagcttcttttcatgtgctattggccacttgtatatcgtccttggagaaatatcttttcgaaccctttgccagttgttgctgggataatttgtctttttgttattgagttgtaagagttctttatatattccagatacaagtcccttattattagattaatgatttacagtaattgtctcccaatctgtgggttgtactttcactttcttcgtggtgtcctttgaagtagttagtcaacagtactgattctgcctcatctttt

SEQ ID NO: 162938 - DNA, 601 bp, Human
ctaaatgtctacatatcatcctttaagactcaaatgtttactccttaagaagtcttgtttgtgtcatttccgtatcatacttattgccattgctgtttttcataccatattgcaagtacctgtttcctgggatgataggtaattggaaagaataaccagggtcaaggcaaatctgtaactggaagaaaaatgccagataattctcagtatcccccatgagaggcatgaaaatcaggataaagtaatttggagaggtaaaagtgacatgtcaaaaatactaatggaaggcaactgagtatcyttctctgtattttttctacacaaattgtctacgatctgcaaactggaccaacatgaattcaacttctttacactatttctttgctcatgttttcccaatcttgcaatcatctctccttttacctctgcacatgcaaactgtactgtactttccagaaccagatcaaatcttacctcttaggccatgcacaggggctcgctcctgtaatcccagcactttgggaggctgaggcaggtggatcacttgagtccaggagttcaagactagcctgggcaacatgatgaaaccccaactctacta

SEQ ID NO: 162939 - DNA, 601 bp, Human
atggccaggcacagtggctcatgcctgtaatcccagcactttgggaggacgagttgggcggattgcctgagctcaggagttcacaaccagcctgggcaacatggtgaaaccctgtctctactaaaatacaaaaaaattagccgggtgtggcggtgtgcacctgtagtcccagctgctcaggaggctgaggcagaattgcttgaacctgggaggcgggggttgcagtgagccgagatggcaccactgcactctagcctgggtgacagaacgagactctgtctcaaaaaaaaaaaaaaaaaaatttaaatttaaaactccagtaactagattaacagaaggatgaaatgaaatcaatatatcacatagcatctgggactatggcatgtaattgatgactattaacctaataataatcccaataatattaatcttcatcctttcaataactagatgtgtgactttagggaaaatagctgaatttcccctaaggactgtttagggaggacctggggcaaatcagctgtcactaaatagcatcatttttctataggtaaaatggaaatggtagagggggggaagcaagggatgattcatgaataat

SEQ ID NO: 162940 - DNA, 601 bp, Human
ttatcagtggctttcacatcaactttaagccaatcataactgggtttggagaactgagttctctaataaagaccaactctcagttagagactcaaaggaagagtgtgcttagaactgagtgacttagggtcagcaacacaaggcagactcttaaaacccaagaagacagcaaggaaatgcaaggttacatgagactgctcagcctcactcctaaaacaggatatggagagaagaaacaatttagtgagaactgaaactacccattcatagcttagcccgcttgattttattagcaaaaatwatgatggtcacatacagggttgtatcaaagactgacagtcttttcactggagactgggggcacatgagcattccgagtgaattaggtaaaagtacagtattggtttcattgactgtttgacaggaactaaggtcaggcagttgactcacaagtataaattgtataaccatatcatagtgctcagtggctgctggaggctggacttgccctatatgtcagcagcctgttttaagatccaggttagctaataataaagtgttggggtctgttggaatactgtattttagtatagctgaatat

SEQ ID NO: 162941 - DNA, 601 bp, Human
aaaaatgaaatagaacagaaagcccagaaagaaatcctcacatatatgttggattgatcttcaacaagggtggcaagaccattcaatgaggaaagaacagtctcctcaacaaatgatgttaggaaagctggatatccacatgcaaaagaataaagctggaccctcatcatacctcatattaaaaaaaaagcttaaaatgaatcaaagactcaaatttaagagctaaaaccataacattcttagataaaaacataggtgaaaatcttcatgaccatggattaggcaatgatttctttagtasgtcattgaaagcataaaaagaaaaaaacagagaaattacacttcatcaaaattaaacctttttcactcaagagagtggaaagataatccacagaatggaagaaaatatttgcacgtgatgtctgataaaggattactatccagaatatataataaactccaacaactaaacaacaaagaaactaaacaagctaattaaaaaatggtcaaaggctgggacaactgtaatcccagcacttcgggaggccaaggtgggtggatcacctgaggtcaggagttcgagaccagcctgaccaatatg

SEQ ID NO: 162942 - DNA, 601 bp, Human
tctcttcacattttctctggcttcacgttcatccttaaagaaaaagattcaaatattttttgacatattacttttttttgaaaaaaaagagaaaaaaaactaatggtaatcccttttttattcctatatgaacttataattaaataagagacttttaaagtgtataggacataaataagcaaacaaacaataagatgagcagcatggtacatagtggaaataagaatgtttgaatcctaactctacaaactgtgtgaccttgtataagttatttaacttctccaggtctcagtttcctcacttgcaaaacagaaataatatttgtcttatagggtcactgtgagaattaagtgcaataatatacaaactatctagcaaaggacctggcacttagttcattttcattattagttctcttctccttttctcctgatttttctgagataaacttggagactgtcagtattggaactaaggactgggagggagaacaaagactaggaagtaatccctgggtcagtgtagaaagaggccaaaagcaaaatactctggttaacctcattccataccacaccacaccacaccactaaagctctggtta

SEQ ID NO: 162943 - DNA, 601 bp, Human
gtgattataaagtccgctgtaatgtaatgtcctaggccttcatattcactcaccacttgctcactgagtcacccagagcaacttcagtcttgcaagcttcattcatggtaagtaccctacacaggtgcaacattttttatcctttgtactgtacctttttatcatttttattgtaccttttctacatttagatatacaaacacttaccattgtattacagttgcctgcagtattcaatacagtaacatgctgtacagatttgtagcctaggagcaacaggttataccatataatagcctakgtgtgtagcaggctatactatctatgtttgtgtaagtaaagtctaggatgtttgcacatcaacggaattgccaatgacacattttcccatccttaggtgatacaagactatatcatttttcacaaagtggtgagtgctatggagggagtgcagggaatgctggtagaaggtggggggaggggtaaaattttaaatactgtaaacctcagtaagcaaaggtctaaaggaaagagggttccacatggatatttagatctaaaagaagtatattataggcaggagtcacagtaagtagcaagg

SEQ ID NO: 162944 - DNA, 601 bp, Human
tttgttacactatgccaaatttgtctcgtgtaactttcaactcattggtcccagttctgcccctgcagcctcaaaaaatcagatccctcttttacaaggcacgccttcaagtagctgaagacaacaatcacatctctcatggtccttccttctttagaggtaatgttccttaaatgacatgatttccagctccctcaccttcctaccagccctgctccagacatgctcctatttcttcaggcttcgtttttcagcatgaagcctaaagactatttcaggggtagtttgttttttttttaawttttttatttccatgggtttttggggaacaggtatttggttacatgagtaagttctttagtggtgatttgtgagattttggtgtacccatcacccagtgggtagtttatcttagtgcagagttaaacaggaccattaagttaatctctggttgggattacacctctaaaacaggagctagcttttttgttggcagccacaacgcgttattaacgtgtattcagcttaattcgaccataacctctactaaaggaatctatttctacacatttctgtgaaatttctgcagcttcattttgtg

SEQ ID NO: 162945 - DNA, 601 bp, Human
tgagctataattgtgtcactgcactccagcctgtatgacagagtgagactctgtctcaaacaacaacaacaacaacaacaaaactgcatcacattgtaccccataacaatataaaattattatatgacaattaaaattttatttgtatgtattttttttgagacagagtcttgctctgtctcccaggctagagtccagtggtaggatcttggctcactgcaacctccgcctcccaggttcaagcaattctcgtgcctcagcctcccaagtagatgggattacaggtgcacgccactacacytggctaattttttttttttttttttgagatggagtctcactctgtcgcccaggctggagtacagtggtgcaatctcagctcactgcaacctccgccctccaagttcaagtgattctcctgcctcagcctcccaagtagctgggattacaggcgcctgccaccgcgcctggctaattttttgtatttttagtagagatgggatttcaccatcttggccaggctggtgttgaactcctgacctcgtgatccacccaccttggcctcccaaagtgctgggattacaggtgtgagccaccacgc

SEQ ID NO: 162946 - DNA, 601 bp, Human
tgacagatgtgctaattagcttgatttactctttctacaatgaatacatatatcaaaatatcacattgcaccaggcacagtggctcatgcctgtaatcctagcactttggatagccaaagtaggcagatcatctgagcccaggagttcgagactagtctgggcaacatggcaaaatcccatttctataaaaaatacaaaaattagttgggtggtggtgtcatgcacctgtggtcccagctactcgggagggtgaggtgggaggatcacttgagcacaggaggctggggctgcagtgagctrtaattgtgtcactgcactccagcctgtatgacagagtgagactctgtctcaaacaacaacaacaacaacaacaaaactgcatcacattgtaccccataacaatataaaattattatatgacaattaaaattttatttgtatgtattttttttgagacagagtcttgctctgtctcccaggctagagtccagtggtaggatcttggctcactgcaacctccgcctcccaggttcaagcaattctcgtgcctcagcctcccaagtagatgggattacaggtgcacgccactacacttggcta

SEQ ID NO: 162947 - DNA, 601 bp, Human
tttcagttttgaagctataaaatggagataatatctgcctggtataaaaggttttggacatgagtttgaaatctgcttctttgagcttttgatttcttaactgtaaagtaaggatactccaatctcatagggttgttgtaagaattcaattacatgatacctgtaaagttcctagcactttaacatataatgggaacatacaaggggaactcaataagtagaagagagcattattattatttcacaggctgtttgttaatttgcatcattcattcattcattcaacaggtatttactgagygtcagttaggtttcaggtactgtcctaggtgccaggaatgtattagttaacaaataaagttcttgccctctaagaacttttattctagtagcagggagacagtaaacaactatatacctattatgtcagatagtgaacagttcagtggagaaaaagagagcaggataagaggaataggggttgtcagtctggcagggtggggaaggtagggcagagagggcagggaaggaagactattattttatatgggttggtcagcaaaggcctcaataaaaaggcagtatttgagcagctacctga

SEQ ID NO: 162948 - DNA, 601 bp, Human
atctacctacccacaactcagcgagcctctactttgtgctagacctgtgtaagtactgtgccagaaactgagggtacaaaggcaaataagacagtatagctgctgccctaaatgaacttatacagagcaattcccagagggccctgacataaatgaggtaaaaaatctctatgaggaaatacgcctgtctctcacactaggaaaaacaccataaagtaactcaggaatatttccaattatgaaagaaatctgctggtttggtaaaacagaagacaaatgttaaactctagatatttctaaytgaacaccactctcaatcttttgttattaggcatgtaaggcacattgtttgatatctttacttgaaaactggtagtttccaaacagttgatattggacaaagattctttgtcttcttgaaaccaaaacactgaaaaaaaaaaagaaaaaaaaaagaggaaggagggaatggggttggggagaaaaataatcaccattaccatcacaccagctatactattagattcttaccctgtgttaattttatatatattatatacattatatatattttatatattatattatatattaataccaa

SEQ ID NO: 162949 - DNA, 601 bp, Human
gaaatgcatatttcccccataacagagtgtattattaccttaggcatttgggtgaaatttagtcattcaattatgacagagctagtaattgttagagctggatgggtctttagaggtcatctctgtagcatatggggacagaaaagcccagtgagtggaaagaacttacccaagtttattcagcattcatggcaaatctggattcttcattcctagcctatgcctttagatggactgtttagtgaagacaccagctctaaggtattataatgttaaaatggtctcaaacttggcacactgycggggacaccctgggcaccaaacaaaagctgtaaccttctccttgcagtggtatccttgatggtggctttggtcactatactattaaatgacaatataagtggggaaggcccagaggggattctattaagaatggaatggggaggaaaaaaccgtcttagtctaaaaacaggagatgatccaagtcttcagaatgagaataaagaacataaaatgaatatacaaagaacgagaacaggcatgtttccccatcctggaaagtcctggaatctggaagacataatttcaagcaaataaaaga

SEQ ID NO: 162950 - DNA, 601 bp, Human
tttcttgagggaacaactttacctccaataatgatttatttgggtccagttgagttacctaaaaagatgaagaacacatattcaaaagactgaaacaagcactatattctctacatggccttcattttatctatgcacactgattctgaaactatgcactggcacgaagagtctcgcagtatcttagttgatcttcaaaataacctgcaaggcaggtgttgttattctcattttataaatgaggaaaccagggctcaggaaaatcaaatctcatagtcaagtttggtggaggtacctttcytgcacagctcagcctggctggcagaacagggggcccttgggaaaggtgctggttaacaactgactggcattcctagagacctctgcttggttagcccctaatagaggggagggactcttctgcttggtgggactacagctaagcctttggggctgatcttcctcttagaactacattataaactgtagaatggccattccaccatgcccaacgatgaagatctcccctggtgaggggaggcatatcatacccttgttgatggtatatttagtttggaaaaaaaacaggcaatgtcataat

SEQ ID NO: 162951 - DNA, 601 bp, Human; identical to SEQ ID NO: 31355

SEQ ID NO: 162952 - DNA, 601 bp, Human; identical to SEQ ID NO: 31356

SEQ ID NO: 162953 - DNA, 601 bp, Human; identical to SEQ ID NO: 31357

SEQ ID NO: 162954 - DNA, 601 bp, Human; identical to SEQ ID NO: 31358

SEQ ID NO: 162955 - DNA, 601 bp, Human; identical to SEQ ID NO: 31359

SEQ ID NO: 162956 - DNA, 601 bp, Human; identical to SEQ ID NO: 31360

SEQ ID NO: 162957 - DNA, 601 bp, Human; identical to SEQ ID NO: 31361

SEQ ID NO: 162958 - DNA, 601 bp, Human; identical to SEQ ID NO: 31362

SEQ ID NO: 162959 - DNA, 601 bp, Human; identical to SEQ ID NO: 31363

SEQ ID NO: 162960 - DNA, 601 bp, Human; identical to SEQ ID NO: 31364

SEQ ID NO: 162961 - DNA, 601 bp, Human; identical to SEQ ID NO: 31365

SEQ ID NO: 162962 - DNA, 601 bp, Human; identical to SEQ ID NO: 89883

SEQ ID NO: 162963 - DNA, 601 bp, Human; identical to SEQ ID NO: 89884

SEQ ID NO: 162964 - DNA, 601 bp, Human; identical to SEQ ID NO: 89885

SEQ ID NO: 162965 - DNA, 601 bp, Human; identical to SEQ ID NO: 89883

SEQ ID NO: 162966 - DNA, 601 bp, Human; identical to SEQ ID NO: 89884

SEQ ID NO: 162967 - DNA, 601 bp, Human; identical to SEQ ID NO: 89885

SEQ ID NO: 162968 - DNA, 601 bp, Human; identical to SEQ ID NO: 89883

SEQ ID NO: 162969 - DNA, 601 bp, Human; identical to SEQ ID NO: 89884

SEQ ID NO: 162970 - DNA, 601 bp, Human; identical to SEQ ID NO: 89885

SEQ ID NO: 162971 - DNA, 601 bp, Human; identical to SEQ ID NO: 89883

SEQ ID NO: 162972 - DNA, 601 bp, Human; identical to SEQ ID NO: 89884

SEQ ID NO: 162973 - DNA, 601 bp, Human; identical to SEQ ID NO: 89885

SEQ ID NO: 162974 - DNA, 601 bp, Human; identical to SEQ ID NO: 89883

SEQ ID NO: 162975 - DNA, 601 bp, Human; identical to SEQ ID NO: 89884

SEQ ID NO: 162976 - DNA, 601 bp, Human; identical to SEQ ID NO: 89885

SEQ ID NO: 162977 - DNA, 601 bp, Human; identical to SEQ ID NO: 89883

SEQ ID NO: 162978 - DNA, 601 bp, Human; identical to SEQ ID NO: 89884

SEQ ID NO: 162979 - DNA, 601 bp, Human; identical to SEQ ID NO: 89885

SEQ ID NO: 162980 - DNA, 601 bp, Human; identical to SEQ ID NO: 89883

SEQ ID NO: 162981 - DNA, 601 bp, Human; identical to SEQ ID NO: 89884

SEQ ID NO: 162982 - DNA, 601 bp, Human; identical to SEQ ID NO: 89885

SEQ ID NO: 162983 - DNA, 601 bp, Human; identical to SEQ ID NO: 89870

SEQ ID NO: 162984 - DNA, 601 bp, Human; identical to SEQ ID NO: 89871

SEQ ID NO: 162985 - DNA, 601 bp, Human; identical to SEQ ID NO: 89872

SEQ ID NO: 162986 - DNA, 601 bp, Human; identical to SEQ ID NO: 89873

SEQ ID NO: 162987 - DNA, 601 bp, Human; identical to SEQ ID NO: 89874

SEQ ID NO: 162988 - DNA, 601 bp, Human; identical to SEQ ID NO: 89875

SEQ ID NO: 162989 - DNA, 601 bp, Human; identical to SEQ ID NO: 89876

SEQ ID NO: 162990 - DNA, 601 bp, Human; identical to SEQ ID NO: 89877

SEQ ID NO: 162991 - DNA, 601 bp, Human; identical to SEQ ID NO: 89878

SEQ ID NO: 162992 - DNA, 601 bp, Human; identical to SEQ ID NO: 89879

SEQ ID NO: 162993 - DNA, 601 bp, Human; identical to SEQ ID NO: 89880

SEQ ID NO: 162994 - DNA, 601 bp, Human; identical to SEQ ID NO: 89881

SEQ ID NO: 162995 - DNA, 601 bp, Human; identical to SEQ ID NO: 89882

SEQ ID NO: 162996 - DNA, 601 bp, Human
ctgggcgtggtagctcacgcctgtaatcccagcactttgggaggctgaggtgggcagatcatgaggtcaagagatccagaccaccctggccaacatggtgaaaccccgtctctactaaaaatacaaaaattagctgggcgtggtggcgcacacctgtagtcccagcttctcatgaggctgaggcagaagaatcgcttgaacccaggaggtggatggaggttgcagtgagccgagatggcaccactgcactctagcctggcgacagagcaagactccgtctcaaaaaaaaaaaaaaaaaaaagatagtagtactgtcttatacaagaataactaacctatggtagattagtgctatattgctatataaataattcatatctgtcatgtgatttccattttgaactgcctacagatagtgtccctcaacattttaatctactttttttaatcccccgactcttctgcttcagtaggaaaaattcgttttctttccctctagattatcatctgatgccatcaaactgtctgtgtaatttaatcagtctcttaaatcagcattgtcagttacagagaagccttgagacagatgattggaagcggg

SEQ ID NO: 162997 - DNA, 601 bp, Human
gtctgtgtaatttaatcagtctcttaaatcagcattgtcagttacagagaagccttgagacagatgattggaagcgggtatagatctgagcagtcgttacagtctgatatatgggatgagagcacagtggatctgtgtttgggtacctccacctctttttgagtgcatgattgtacctgcattagttatcaggtatgctgttagttgacccgacagccccattgggatttggaaaagaaaaaagtttatagccattcagttgaagtttaaatttagggctcgaaattgtgttgattcagtsgtgacttctatttttcctcttaatgcctttcacttcttctttttttttttttttcctttttaaagagaggaggtctggctctattgtccaggctggagtgcagtggtgtgatcctagctcactgcagcctccaactcctgcctcatcctcctgagtagctgggactgcaggtgcagaccaccaagcctgcataattttaaacagttttttgtggagatggggttttgctgtattgctcagattggtcttgaactcctggcttcaagtgatcctccctccttagcctctgaaattgctggg

SEQ ID NO: 162998 - DNA, 601 bp, Human
taaatttagggctcgaaattgtgttgattcagtggtgacttctatttttcctcttaatgcctttcacttcttctttttttttttttttcctttttaaagagaggaggtctggctctattgtccaggctggagtgcagtggtgtgatcctagctcactgcagcctccaactcctgcctcatcctcctgagtagctgggactgcaggtgcagaccaccaagcctgcataattttaaacagttttttgtggagatggggttttgctgtattgctcagattggtcttgaactcctggcttcaagygatcctccctccttagcctctgaaattgctggggcttgcacttctggtctcaatgtttatttcctgcttccccccctccgcccctgccaccccatatagtcctgccttttcttgagtgctctctttctccattttattatttttcagtatttccaatctttcctgtttattttttcatctcttccttgtgctatactattgctaattgtgcttatgtacttgttagctgtgaaggagtgggaaatagaattatggatggtttattctgaccactccattttagtcttgacacatagacct

SEQ ID NO: 162999 - DNA, 601 bp, Human
cattcatgtcaagatgactaagtttggatttttgcgattgtcctatgagaagcaggacacacttttgaagcttctcattctgtcaatggctgctgtattatgtgagtgtgcatgtgaacctctctttctttggggatagaaagaagaaagtctagaaaaaaattgaaaatcgctatcttaaaatgccttgttctttttagcagattgttacatttttccattcctcattagtataattttatgaaggcaaaataaaaggaatataaaagtcagggctatgggccacatgcagtggttcacrcctgtaatcccagcactttgggaggctggggtgggtggatcacttgaggctgggagtttgagaccagcctggccaacatgatgaaaccctgtctctactaaaaatacaaaaactagttgagtgtggtggtggatgcctgtattcccagctacttgggaggctgaggcacgagaatcgctcgaacctgggaggcagaggttgcagtaagccgagattgcaccactgcactctagcctgggcaacagagcaagactctgtctcaaaaaaaagagggctgtgatcatctttgaaagaatggga

SEQ ID NO: 163000 - DNA, 601 bp, Human
tttttctttttttgtttgagattgggtctgactgtcacccaagctgaagtgcagtggagtgatcacggcttactgcagccttgacttgtggggcctaagtgatccccccacctcagtttcccaagtagctgggaccacaggcatgtgccaccatacctagctaattttttaaaaattttttgtagagatggagtctcactatgttgcccaggctggtctcaaactcctgggctcaagcaatcctccctcctcagcctcccaaagtactggcattacaggtatgggcttccatgcccagccyacttttgtttcttgatcccaatctgttaggcttctttctcagaccctctgaatgagcaaatattgatgttagataatcaaggaatgcaagagcatctgctttgtcgtcaagagctgttagggaccataagggacttgacacttccttttgcagaggaggaaactgattcccagagtggtgaatgcagtccagacctattcctactaacttatacttcctctctcactctgcctctcctactggtagctaaaggacacaattctgacacatactgatgtctgcaaccctcatctcttctgt

SEQ ID NO: 163001 - DNA, 601 bp, Human
caggcatgaactactacaccggcctcttctttatttttatttattattattattattattttttgagatggagtttcgctcttgttgcccaggctggagtgcaatggcacaatctcagctcaccacaacctctgcctcccgggttcaagcgattctcctgcctcagcctcctaagtagctgggattacaggcacgcgccaccacgcctggctaatttttgtattttttgtagattgggtcttgtcatgttacacaggctggtctcaaacttctgtgctcaagcgatccatccacctctgcytcccaaagtgctgggataacaggcattaactactacgccggcctcttatttatttttatttgttattattattaattttttttgagatggagttttgctcttgttgcccaggctggagtgcaatggcacaatctcagctcaccacaacctctgcctcccgggttcaagcgattctcctgcctcagcctcctaagtagctaggattacaggcatgcgccaccacgcctggctaattttgtatttttagtagagacagggtttctccatgttggtcaggctggtctcgaactcccgacctca

SEQ ID NO: 163002 - DNA, 601 bp, Human
gagtgcaatggcacaatctcagctcaccacaacctctgcctcccgggttcaagcgattctcctgcctcagcctcctaagtagctgggattacaggcacgcgccaccacgcctggctaatttttgtattttttgtagattgggtcttgtcatgttacacaggctggtctcaaacttctgtgctcaagcgatccatccacctctgcttcccaaagtgctgggataacaggcattaactactacgccggcctcttatttatttttatttgttattattattaattttttttgagatggagtttygctcttgttgcccaggctggagtgcaatggcacaatctcagctcaccacaacctctgcctcccgggttcaagcgattctcctgcctcagcctcctaagtagctaggattacaggcatgcgccaccacgcctggctaattttgtatttttagtagagacagggtttctccatgttggtcaggctggtctcgaactcccgacctcaggtgatccacctgcgtcggcctcccaaagtgctgagattacaggagtgagccactgcgcctggccttattattattattatttattttattttttg

SEQ ID NO: 163003 - DNA, 601 bp, Human
ctggagtgcagtggcaatctcggctcactgtaacctctgcctccaaggttctagcgattctcctgcctcagcctcctgagtagctgggattacaggcacatgccaccgtgcccagctaatttttgtatttttagtagagatggggtttcaacatgttcgtcaggccagtctcgaactcctgaccttgtgatccacctgcctcggactcctaaagtgctgagattataggcatgagccactgcacccggctcatttccttatgagaaaagcagtgctttagttgagacaagcatggagatasaagtaaacagacttatggtagtgtaaaatgattttcatggcataatatctgatgttaaactgatttttcattgagtaatgctgaatttctcaatggtgtatcctgaggagcaaaattcaccacaaatttacaacaaagtttatttcttgctataggtactttaattatcggactaccaggttcctggctgaggaggggttttataaattccataactggtttgatgaccgagcctggtaccctttgggacgaatcattggaggaacaatttacccaggtgaggagaccagatgtgttttt

SEQ ID NO: 163004 - DNA, 601 bp, Human
aaacagacttatggtagtgtaaaatgattttcatggcataatatctgatgttaaactgatttttcattgagtaatgctgaatttctcaatggtgtatcctgaggagcaaaattcaccacaaatttacaacaaagtttatttcttgctataggtactttaattatcggactaccaggttcctggctgaggaggggttttataaattccataactggtttgatgaccgagcctggtaccctttgggacgaatcattggaggaacaatttacccaggtgaggagaccagatgtgtttttttttwtaaaaaaaaaacagaaatatttgtatgctagagaaccagtttcttttatttctaatagctttgtcttgtgacacttgtaatttcatcctgattacaggttcctaaaagtgcatcttacataaacaggagtacatttgtagtagagtggagatgggtggtttttatacattctagacttctgattgaatccttaggggagaaatttataggcttactgcagttgctatgttagtatttctggtgatttgtcaagacttacatagtcactttattgtatctgggattttccctttctttttc

SEQ ID NO: 163005 - DNA, 601 bp, Human
aacagacttatggtagtgtaaaatgattttcatggcataatatctgatgttaaactgatttttcattgagtaatgctgaatttctcaatggtgtatcctgaggagcaaaattcaccacaaatttacaacaaagtttatttcttgctataggtactttaattatcggactaccaggttcctggctgaggaggggttttataaattccataactggtttgatgaccgagcctggtaccctttgggacgaatcattggaggaacaatttacccaggtgaggagaccagatgtgttttttttttwaaaaaaaaaacagaaatatttgtatgctagagaaccagtttcttttatttctaatagctttgtcttgtgacacttgtaatttcatcctgattacaggttcctaaaagtgcatcttacataaacaggagtacatttgtagtagagtggagatgggtggtttttatacattctagacttctgattgaatccttaggggagaaatttataggcttactgcagttgctatgttagtatttctggtgatttgtcaagacttacatagtcactttattgtatctgggattttccctttctttttcc

SEQ ID NO: 163006 - DNA, 601 bp, Human
ttataaattccataactggtttgatgaccgagcctggtaccctttgggacgaatcattggaggaacaatttacccaggtgaggagaccagatgtgtttttttttttaaaaaaaaaacagaaatatttgtatgctagagaaccagtttcttttatttctaatagctttgtcttgtgacacttgtaatttcatcctgattacaggttcctaaaagtgcatcttacataaacaggagtacatttgtagtagagtggagatgggtggtttttatacattctagacttctgattgaatccttaggrgagaaatttataggcttactgcagttgctatgttagtatttctggtgatttgtcaagacttacatagtcactttattgtatctgggattttccctttctttttcccttaagttctggtaagacaacctaatggagtttcttcttcctgttacaggtttaatgatcacctctgctgcaatctaccatgtactccattttttccacatcaccatcgacattcggaatgtctgtgtgttcctggcccctctcttctcctccttcaccaccatcgtcacgtaccaccttaccaaagagctcaag

SEQ ID NO: 163007 - DNA, 601 bp, Human
ttaccctttttttcttacaggatgcaggggctgggcttcttgctgctgccatgattgctgtagttcctggatatatctcccgatctgtggctggctcctatgataatgaaggtaagacttttaaaatgctgaagaagatcatctcacctcattatccaacagagcttcacaaagtgcagtctatggtttagcaataataaaaatggtaactgggtgagaatattagaaatgggcaggaacggatcttggacaagctcatgttctcttcccatcatcctttccagaaaggtagttggtaacytttcttacaagtctttggttcatctctgcactcataaaatagttaactattgttttaacattataatcatttgctttattttcctacataaagggagtggatgtccttaaaattttaatgactgattgacttattctcaattcaacatacatttgttgaatgttattgggaaaacatagtattaagtgttaggtaatgactaagattactttgtgcataattataagaaattaaagagataggtaatgaataaggttatattggcccatcatctattaaggaagattaaaatggacatgt

SEQ ID NO: 163008 - DNA, 601 bp, Human
attgtaagtgcttcaggaagtaaagcacaaacctttaaccacattgctccacagggttaacagacaactgttaaatcaaagaataatgtggtatgtttgatttctcttgtgaaattatcatgaaaatgcaaaccttatctagaggtcaacaagtatttctttactgattacctactgcagattgtccccaacttatgaagcgtgacttaggattttttggctttagaatggtgtgaaagtgatctgcattgagtagaaaccgtacttccagtacccatacaagcattctgtttttcacttwcagtacggtagtcaataaattacatgagattctcaacactttattgtaaaataggctttgtgctagatgattttgcccaactgtaggctaatgttaaatgttctgagcatgtttaaggtagtctacgctaagctgtgatgttccataggctaggcgtattaaatgcattttctacttaagatattttcaacttaaaatgggtttatggggatataacccaatcataagttgaaaagcatttgtatatgcagtttgctaatcacttgaaaatgtaaaaagaataaaaatgcggtcatagtc

SEQ ID NO: 163009 - DNA, 601 bp, Human
ctccacagggttaacagacaactgttaaatcaaagaataatgtggtatgtttgatttctcttgtgaaattatcatgaaaatgcaaaccttatctagaggtcaacaagtatttctttactgattacctactgcagattgtccccaacttatgaagcgtgacttaggattttttggctttagaatggtgtgaaagtgatctgcattgagtagaaaccgtacttccagtacccatacaagcattctgtttttcacttacagtacggtagtcaataaattacatgagattctcaacactttattrtaaaataggctttgtgctagatgattttgcccaactgtaggctaatgttaaatgttctgagcatgtttaaggtagtctacgctaagctgtgatgttccataggctaggcgtattaaatgcattttctacttaagatattttcaacttaaaatgggtttatggggatataacccaatcataagttgaaaagcatttgtatatgcagtttgctaatcacttgaaaatgtaaaaagaataaaaatgcggtcatagtccttaaggaagttttggtcttcttacagggaaagaaatacaggcagc

SEQ ID NO: 163010 - DNA, 601 bp, Human
ctaaggcaaagaatgattaagtgctagaagagaactaatgtgatatggaacatagagaggagtgattgatttcagtttggcagattgggaagagatgatatttgagttggaccttgaatgatgagaattttagtggatgggaatttggggaaaattacagtctaggctaaggaaataacctgagcaaaagccagagatgtgataatgatagtgtatcttatgctttagggggctgcaaatattctgtagaaaatatggctggtgaattaaacccttccctagattggccctgattccttcrgggcctcagaactcatttgaccatttggtttgaactagataagaataatgcaggcctgcactggacttactcattttttttccttagtattaacatacatatccttttacctacagcctgtcctttcatcagagcacatggcagcctttggggtctttggtctctgccagatccatgcctttgtggattacctgcgcagcaagttgaatccacaacaatttgaagttcttttccggagcgtcatctctctggtaggctttgtccttctcaccgtgggagctctcctcatgctgacaggta

SEQ ID NO: 163011 - DNA, 601 bp, Human
catttggtttgaactagataagaataatgcaggcctgcactggacttactcattttttttccttagtattaacatacatatccttttacctacagcctgtcctttcatcagagcacatggcagcctttggggtctttggtctctgccagatccatgcctttgtggattacctgcgcagcaagttgaatccacaacaatttgaagttcttttccggagcgtcatctctctggtaggctttgtccttctcaccgtgggagctctcctcatgctgacaggtagggaaggctcacagcttttttycttttttctttttttttaagatggagtttcgctcttgttgcccaggccggagtgcagtggtgcgatctcggctcactgcaacctccacctcccaggttcaagcgattctcctgcctcagcctcctgagtagctgggattacaggcgcctgccaccgcgcccgccaccacgcccagccaattttgtatttttagtagagacggggtttctccatgtttgtcaggctggtctcaaactcccgacctcaggtgatccgcccgcctcggcctcccaaattgctgggattacaggcgtgagccac

SEQ ID NO: 163012 - DNA, 601 bp, Human
agttggcctctattactgctttagcaacctgtctgatgcccggatttttatcatcatgtatggtgtgaccagcatgtacttttcagctgtaatggtgaggatgccctcagtctggtagactttttcactctaactctgaggtgcttttttatctgtctggcagaattcagaaagtactgatgattgtgcacatgcttccctctgagcatttgagggaatgagttgtaagttgttgatcctttccaggaacgtatgggacactcatacattctggttgtggggtccaactttcttggattcrtaactttgtattatagaagcatttttgcactttgttggataatatgaccctgggtgtcttaaaacgggagatgatatttttttcttgaaggcttgggagtattacccagtgctagattgttagaggagggatttgaattttttttttttttttttttttttttttttttgagacagagtttcactcttgttgcccaggctggagagcagtggcgtggtcccggctcaccacaactgccgcctgctgggttcaagcgattctcctgcctcagcctcccaaatagctgggattactggcatg

SEQ ID NO: 163013 - DNA, 601 bp, Human
ggcctctattactgctttagcaacctgtctgatgcccggatttttatcatcatgtatggtgtgaccagcatgtacttttcagctgtaatggtgaggatgccctcagtctggtagactttttcactctaactctgaggtgcttttttatctgtctggcagaattcagaaagtactgatgattgtgcacatgcttccctctgagcatttgagggaatgagttgtaagttgttgatcctttccaggaacgtatgggacactcatacattctggttgtggggtccaactttcttggattcgtaaytttgtattatagaagcatttttgcactttgttggataatatgaccctgggtgtcttaaaacgggagatgatatttttttcttgaaggcttgggagtattacccagtgctagattgttagaggagggatttgaattttttttttttttttttttttttttttttttgagacagagtttcactcttgttgcccaggctggagagcagtggcgtggtcccggctcaccacaactgccgcctgctgggttcaagcgattctcctgcctcagcctcccaaatagctgggattactggcatgcacc

SEQ ID NO: 163014 - DNA, 601 bp, Human
gaaagtactgatgattgtgcacatgcttccctctgagcatttgagggaatgagttgtaagttgttgatcctttccaggaacgtatgggacactcatacattctggttgtggggtccaactttcttggattcgtaactttgtattatagaagcatttttgcactttgttggataatatgaccctgggtgtcttaaaacgggagatgatatttttttcttgaaggcttgggagtattacccagtgctagattgttagaggagggatttgaattttttttttttttttttttttttttttttttgagacagagtttcactcttgttgcccaggctggagagcagtggcgtggtcccggctcaccacaactgccgcctgctgggttcaagcgattctcctgcctcagcctcccaaatagctgggattactggcatgcaccaccatacccagctaattttgtatttttagtagagatggggttttccatgttcgtcaggctgatcttgaactcccgacctcaggtgatccacccgccttggcctcccaaagtgttgggattacaggcgtgagccactgagaatacacacattctcttatatacttt

SEQ ID NO: 163015 - DNA, 601 bp, Human
attttgtatttttagtagagatggggttttccatgttcgtcaggctgatcttgaactcccgacctcaggtgatccacccgccttggcctcccaaagtgttgggattacaggcgtgagccactgagaatacacacattctcttatatactttaaatcatctctagattgtaatactaataactaatactaggtaaatggttgttaatactgtattgtttagggaacaatgacaagaaaaaagagaggagagattttatatattgtagtaaaatagtgtttctcatatttttttggtctcaamccacagttatgaaatatactttatatcattattcaagacacacatgcatatgtacatgcatataattgaaacaaagtttaagaaatacatactaatactgcaactatttcaagtattttctctttcactttttgtggaggtcatgtttgatgaaaacccctaaattgatgtcttgatctactaataggctgaaatctgtaaattgtggaacactgattagactgatcatgcttcctgtctctgttaggtgcgtctaatgctagtgttggcacctgttatgtgcattctctctggcattgg

SEQ ID NO: 163016 - DNA, 601 bp, Human
acaggcgtgagccactgagaatacacacattctcttatatactttaaatcatctctagattgtaatactaataactaatactaggtaaatggttgttaatactgtattgtttagggaacaatgacaagaaaaaagagaggagagattttatatattgtagtaaaatagtgtttctcatatttttttggtctcaaaccacagttatgaaatatactttatatcattattcaagacacacatgcatatgtacatgcatataattgaaacaaagtttaagaaatacatactaatactgcaactrtttcaagtattttctctttcactttttgtggaggtcatgtttgatgaaaacccctaaattgatgtcttgatctactaataggctgaaatctgtaaattgtggaacactgattagactgatcatgcttcctgtctctgttaggtgcgtctaatgctagtgttggcacctgttatgtgcattctctctggcattggagtctcccaggtgctgtccacatacatgaagaatctggacataagtcgtccagacaagaagagcaagaagcaacaggattccacctaccctattaagaatgaagtg

SEQ ID NO: 163017 - DNA, 601 bp, Human
tgatctactaataggctgaaatctgtaaattgtggaacactgattagactgatcatgcttcctgtctctgttaggtgcgtctaatgctagtgttggcacctgttatgtgcattctctctggcattggagtctcccaggtgctgtccacatacatgaagaatctggacataagtcgtccagacaagaagagcaagaagcaacaggattccacctaccctattaagaatgaagtgagaagcaatgttaagagtagacttgggaaactctgtgtgtgtgtgtgtatgtgtgtatgtgggcagcrgggggtgggaggagtaaagtagagcactgtcctaggtggtcagaattaactcatatagcctctgacttattttgatcaatctcatctatatgaatgtgtctaagaagttgtcctgtgttgtgtgaatttagtttggttaactacacaattaattctttttccttgtttaggtggcaagtgggatgatactggtcatggctttctttctcatcacctacacctttcattcaacctgggtgaccagtgaggcctactcttctccgtccattgtactatctgcccgtggtggggatggcagta

SEQ ID NO: 163018 - DNA, 601 bp, Human
tttccttgtttaggtggcaagtgggatgatactggtcatggctttctttctcatcacctacacctttcattcaacctgggtgaccagtgaggcctactcttctccgtccattgtactatctgcccgtggtggggatggcagtaggatcatatttgatgacttccgagaagcatattattggcttcgtcataatactccagaggtgaagatttgggaggggtgggaattgtgggttaggggcaaaggggaagacatttgatgttacagtgaatcatacagcttttagatgggtggaaagctkggtgaaactggaactttgcaactctagtcttgaatgagccttaaaggtgaacctccattcaattctgggatcttttgtagttactcttactagtaattatctagactttgcatgcacacttttattgatatgatgattttaacatgaggtagaacatcccagttataaaagaagaaaaaagttatagataaataatacatgttcactttagaaaaatcagaaaattgaatcaagaagaaagatataaatcttgtgtaaagtgatcaccttatgataactgcttttaacattttaatttat

SEQ ID NO: 163019 - DNA, 601 bp, Human
agatttgggaggggtgggaattgtgggttaggggcaaaggggaagacatttgatgttacagtgaatcatacagcttttagatgggtggaaagctgggtgaaactggaactttgcaactctagtcttgaatgagccttaaaggtgaacctccattcaattctgggatcttttgtagttactcttactagtaattatctagactttgcatgcacacttttattgatatgatgattttaacatgaggtagaacatcccagttataaaagaagaaaaaagttatagataaataatacatgttcastttagaaaaatcagaaaattgaatcaagaagaaagatataaatcttgtgtaaagtgatcaccttatgataactgcttttaacattttaatttatatcttttgagaatctgaagtgatttcctttacaataactattaggaatatcatttctgagacaatttgttaggaataaaaacttttaagagtctcttaattcttgtccatcgtatcatgtgatttgagtttccaccccatctttatagtaagtgatttttgcaattctgttaaaaggttatttaagaaaattgtctaatgacacta

SEQ ID NO: 163020 - DNA, 601 bp, Human
ccttaaaagttaatgtaatgcctgtttacactttaaaaagttaagcagttcacagccgggtgtggtggctcacacctgtaatcccagcactttgggaggccaaggcgggcggatcacttgaggtcaggagttcatgaccagcctgggcaacatagtgaaaccttgtctctacaaaaattagccaggcgtagtggcacatgcctgtagtcttagctactcaggaggctgaggcaggagaatcgcttgaactcgggagggagaggttgcagtgggctgacattgcgccattggactccagtckgggcagcagagtgaaactgtttcaaaaaaaaaagttaaacagttctgaaggtttataataaaaagtgatagttcactgcccaaaaatctaagcccccttaacatcagtccccagaagcaatgattcctgcagctatttcttctagtacttacatgcatatttctaaatactgtgtatacagtttcccctccatatccgtgggttctgcatctgtgggttcaaccaaccacaaatggaaaatatttgtgaaaaaaaatcataatacaacaataaaaatcatacaaataaaaaatacagtat

SEQ ID NO: 163021 - DNA, 601 bp, Human
aggagaatcgcttgaactcgggagggagaggttgcagtgggctgacattgcgccattggactccagtctgggcagcagagtgaaactgtttcaaaaaaaaaagttaaacagttctgaaggtttataataaaaagtgatagttcactgcccaaaaatctaagcccccttaacatcagtccccagaagcaatgattcctgcagctatttcttctagtacttacatgcatatttctaaatactgtgtatacagtttcccctccatatccgtgggttctgcatctgtgggttcaaccaaccacaratggaaaatatttgtgaaaaaaaatcataatacaacaataaaaatcatacaaataaaaaatacagtataacaactatttacatagcatctacactgtattaagtattataggtaatctagacatgatttaaagtatatagacagatgtgcataggttatatacaaatactataccattttatataagggacttgagcatttgtgaattttgatattctggtgggaggggatatataagttagactttttattttttaaagaagataatacgataaccattaaaaaacaatgcagaggccg

SEQ ID NO: 163022 - DNA, 601 bp, Human
cataatacaacaataaaaatcatacaaataaaaaatacagtataacaactatttacatagcatctacactgtattaagtattataggtaatctagacatgatttaaagtatatagacagatgtgcataggttatatacaaatactataccattttatataagggacttgagcatttgtgaattttgatattctggtgggaggggatatataagttagactttttattttttaaagaagataatacgataaccattaaaaaacaatgcagaggccgggtgcgatggctcatgcctgtaatcygagcactttgggaagactcttgaggtcaggagtttgagaccagcctgcccaacatgatgaaaccccgtctctactaaaaaaatacaaaaattagccacatgtggtggcacatacttgtaatctcagctacttgggaggctgaggccagataatcacttgaacccaggcagcagaggttgcagtgagttgagattgcgccactgcaccccagcctgggtgacagagcgagactccatctcaaaaaaaaagaaaaaagaaaaatgcaaaacactgttactgtctagatccatgaaaacatgt

SEQ ID NO: 163023 - DNA, 601 bp, Human
ggaggattgtttccaggacacccccacccctatcctcacccctcaccaggataccagaatttgtggatgctcaggtcccttatataaaatggtttagtatttgtatataatatacacacattctcttatatactttaaatcatctctagatgataatactaatccctaatactaggtaaatggttgttaatactgtattgtttaggtaacaatgacaagaaaaaagtctatccatcttcattacagatgcagtcatctgtttttttgttttgtgaatatttttgattagaggtttgttgartttatggatgtcaaacccacagatatggaaggccaactgttttggttaatttgttacactgaatttatttttcaaggtcaaattattcattgggctttactaataggagttctgtaacatttgagaggcataataaaaataaaaaaagttgggcctggcccagcttctttttttgtagacaaccatatcttttgaacaatgggctctccttgatgcagttcctatcatcatcatcattattgtttttgagacagagtttcactttgtcacccaggctggagttcagtggcacgatgtctg

SEQ ID NO: 163024 - DNA, 601 bp, Human
ttgttgaatttatggatgtcaaacccacagatatggaaggccaactgttttggttaatttgttacactgaatttatttttcaaggtcaaattattcattgggctttactaataggagttctgtaacatttgagaggcataataaaaataaaaaaagttgggcctggcccagcttctttttttgtagacaaccatatcttttgaacaatgggctctccttgatgcagttcctatcatcatcatcattattgtttttgagacagagtttcactttgtcacccaggctggagttcagtggcackatgtctgctcactgcagcctctgcttcccatgctcaagtgatcttcccacctcagcctcctgagtagctgggactacaggcacacaccaccatgcccggccaatttttatactttttgtagagattgggtttcgccacattgcccaggctgttcttgaactcctgtgctcaagtgatccgcccatctcagcctcccaaaatgctaggattacaggtgtgagccatcacacccagccattcctattattttcactcttccattcatagagcttatgaggtttttgcttcagacatacctgc

SEQ ID NO: 163025 - DNA, 601 bp, Human
gatcttggctcactgcaacctccacctccccggttcaagcgattctcctgcctcagcctcccgagtagctagaattacaggtgtgctctaccatccccagctaatttttttttttttttgtatttttagtagagacattgtttcactatgttggccaggctggtctcgaactcctgacctcaagtaatccacccacctcggcctcccaaagtgctgggattacaggcatgagccaccgcacccagcctgttattttatatatgaggaaattgaggtacaaataggttatttaactgcctagtgtcacataactaatggcagagtcaggattcaaactgacaaagagtggctccaaattctgtgcttttgaccgttactttttattgtccttaagggtattacagtgaagacaggaacaaaagggaaagaaagtgacttttcgtatcttctgatgactacattgagagttatttgattaggttaagtctctccttctgacttcaatttcttgattctgtactagggagaatttctgacatgaatgcaggtctttgacttctggtaggcttttttctctgatccatgcaagggttgctagtgt

SEQ ID NO: 163026 - DNA, 601 bp, Human
ttaagtctctccttctgacttcaatttcttgattctgtactagggagaatttctgacatgaatgcaggtctttgacttctggtaggcttttttctctgatccatgcaagggttgctagtgtattagaggctctgaatgacaatcctcaggaatagagggccttggaagtcggctccctatgtctgtcttatcagagataagacattgactggcaagcatcatcttgcatagaacttaagctagggtaacacttgatttgcccttactacctcatgcccttttttgcaggctctactctcamcaaattgcaggctgaggaataatcatcaattagtagatggtttcctgaatccatatactgtctctctaggaaattagcactgtagaaagaagtgtgttctttttcatccctctctagagcgtcctccaggctttgaccgtgtccgaaatgctgagattgggaataaagactttgagcttgatgtcctggaggaagcatataccacagaacattggctggtcaggatatacaaggtaagcagatgctatacgtctcagaaagcaacttttatttttggagattggtttcaatgcttataaa

SEQ ID NO: 163027 - DNA, 601 bp, Human
catacaggaaaaaacattagggtttggtactagcagcggtttcaggcattaactgggggtcttaaaacatatcccccaccatgggccaggtgtggtgactcacgcctgtaatcccagcactttgggaggccaaggcgggcaaatcaccaggtcaggagttcgagaccagcctggccaacatggtgaaactcccatctctactcaaaatacaaaaattagtcgggcatggtggcgcacacctgtagtcccagctactcaggaggctgaggcaggagaatagcttgaacctgggaggtggagkttgcagtgagccaaaattgtgccattgcactccagcctgggcgatagaatgaaacttcatctcaaaaaaaaacaaaacaaaacaaaacaaaaaaacacatcccccgaggatagcggggaaccactgaatttttactaaatgcctaagacatccttctttaatttgtgtaacatatcacccccttctctttctagtccctcctgaaagagtacttttctcagatcccttttcttgactactattaagaccctagaaagtagcgagcaagtgatacaaggaatctgcatactcaaaggccac

SEQ ID NO: 163028 - DNA, 601 bp, Human
acagtacaatgaaatattttgaaagagagagagaaagagagaccacattcacataatttttattacaatatattgttataattgctctattttgctgtgagctgttgttagtctcttactgtgcctaacttataaactgaactttatcatatgtacgtacatacaggaaaaaacattagggtttggtactagcagcggtttcaggcattaactgggggtcttaaaacatatcccccaccatgggccaggtgtggtgactcacgcctgtaatcccagcactttgggaggccaaggcgggcaratcaccaggtcaggagttcgagaccagcctggccaacatggtgaaactcccatctctactcaaaatacaaaaattagtcgggcatggtggcgcacacctgtagtcccagctactcaggaggctgaggcaggagaatagcttgaacctgggaggtggaggttgcagtgagccaaaattgtgccattgcactccagcctgggcgatagaatgaaacttcatctcaaaaaaaaacaaaacaaaacaaaacaaaaaaacacatcccccgaggatagcggggaaccactgaatttttactaaatg

SEQ ID NO: 163029 - DNA, 601 bp, Human
catgccaatatccacacccaaatgtgtattaatttgagtacacctttgcactttatgtttagaaagtagaaattagtggctgggcgtggtggctcacgcctgtaatcctagcactttgggaggctgaggcgggtggattgcctgagctcaggagttcgagaccagcttggacaacatggtgaaaacccatgtctactaaaagacaaaaaaaaaaaaaaaattagtccggcgtggcagcgtttgcctgtaatcccagctactcgggaggctgaggcaggagaattgcttgaaacaaggaagyggagcttgcagcgagccgagatcatgccactgcactccagcctgggcaacagagtgagactctgtctcaaaaagaaagaaagtagaaattattagcagcacattaatgcgtttgctcaactttctagatgtcctcaaatgtttaaatagaatcaatactatatccgctttctataacctctaaaaagagaattaaattttctaaaaatcacaattatgtgtagttttccctagctgactatttggtatttacttgtcttcaacatgtagtatatctgatgacaggcagtttattgtgtgc

SEQ ID NO: 163030 - DNA, 601 bp, Human
cctttttccttgctgacatactttttatcctttgaagtttataaacaagctttaagataaagcagctttcttctctttataatcagttgtataccctttccatacttacccagtgcccatttaacaataacaatagcagtcaacacttgctgagcacttactatgagccaggtagtactctaaaccagattcgaaacatggattaattcattcattcttcacaacaattatacaaggcagatgctaatgagaaaaaaattgaaacatagtgaatttaattcacttgtctcagctcacactsccagtaatggtaaaagtgggatttgaacttgggcagcacggctacagagcccatattcctaaccacttaacaattccaagtctttatgaattctgtaattggcatcggtatgggcatcagaataacataccaagttcctaatcataacctaggagagcagtttagaaactggctctgcgtgaaaattagctgggcgtggtggcccacacctgtaatctcagctacttgggaggctgaggcaggagaatcacttgaacctgggaggcggaggttgcagtgagccgagatggcgccattgca

SEQ ID NO: 163031 - DNA, 601 bp, Human
atgtcaaacacaaatgatacccgtgagagcaagatttcaaaaataagcaagtatgtatatatacaccagggcacagacacttgaaatcagaaagtaatgagggcactattaactaaacaaaatgcccatatatcacatcacattcctgattttgtttgtatcaggaatgcgacgtgatatatgggttttaaaagcaaaaagactttcttagtgcacaatgcatataattggtgatggaacaaataaaaggaacccaagaaaacacaatgtaatggcagtgcttggggcatctgcttattcrttattttcctaccattacaagaaaacactttgaagagaactcatcaagtactcgttagccatctactcagcaggatttcagagcagacttcttaaaccatgggtgataccctaatctccatcaggcactattagagctgcattaatccaggctaattctaaatccaagtgccattagcattctagagccaagaagcaaataggatttgctttctccaagacaaaattccaaggcaccacacccgctggaaaggtcactgcaggactactctttacatcactgcattacattctctgctgc

SEQ ID NO: 163032 - DNA, 601 bp, Human
cacaatttgtttttagtggggaaagatggagctacatttattacatttctttttaaaattctgatatgtacattataagaaaggatttctacaattcttattccttaacttatttcagaaagatttcttacaaaaaaagaggagggaggttggggaaaatttcaaagtcacaaacacacatcaggaagatacataaattattcaacaccaagagattaatgtaaatcagtaaacaaagcccttaagataatgaccgccatggaagccaatggcacctgaattaatattaatgaggccgggmgcgatggctcacgcctgaaatccagcactttggaaggccaagatgggcagatcgcttgactccaggagttcaagatgagactggccaacatggtgaaaccctgtctctacaaaaaatacaaaaattaaccaggcatggtagcatgggcctatagtcccagctacttgagaggcttgaagtgggaggatagcctgatccatgggaagaaccttaggaagtcgaggctgcagtgagccatgattgtgtcactgctctccagcctgggtgacagaacaagacactgtaaaaaaaaaaaaaaaa

SEQ ID NO: 163033 - DNA, 601 bp, Human
gtaggtaagggaataatgccaatacagtgagtgcttacttactacccaaaatgttctatcgaacccacgggttgcaagatcctgccctctaacaatgtagaatctaaatcctgcattgtgtcattccaacatcacggacactctcaggtaaatactgtatataaaagaaaccaataaatacacctctgtctacacaatttgtttttagtggggaaagatggagctacatttattacatttctttttaaaattctgatatgtacattataagaaaggatttctacaattcttattccttaayttatttcagaaagatttcttacaaaaaaagaggagggaggttggggaaaatttcaaagtcacaaacacacatcaggaagatacataaattattcaacaccaagagattaatgtaaatcagtaaacaaagcccttaagataatgaccgccatggaagccaatggcacctgaattaatattaatgaggccgggcgcgatggctcacgcctgaaatccagcactttggaaggccaagatgggcagatcgcttgactccaggagttcaagatgagactggccaacatggtgaaaccctgtctct

SEQ ID NO: 163034 - DNA, 601 bp, Human
agtttataaccgtttcagtttcagaggcctacaatctaaatgatcaggaattccctccttgacatctaatgtaggtaagggaataatgccaatacagtgagtgcttacttactacccaaaatgttctatcgaacccacgggttgcaagatcctgccctctaacaatgtagaatctaaatcctgcattgtgtcattccaacatcacggacactctcaggtaaatactgtatataaaagaaaccaataaatacacctctgtctacacaatttgtttttagtggggaaagatggagctacattkattacatttctttttaaaattctgatatgtacattataagaaaggatttctacaattcttattccttaacttatttcagaaagatttcttacaaaaaaagaggagggaggttggggaaaatttcaaagtcacaaacacacatcaggaagatacataaattattcaacaccaagagattaatgtaaatcagtaaacaaagcccttaagataatgaccgccatggaagccaatggcacctgaattaatattaatgaggccgggcgcgatggctcacgcctgaaatccagcactttggaaggc

SEQ ID NO: 163035 - DNA, 601 bp, Human
tagctgggaccacaagcatgcgccaccatgcctggctaattttttgtatttttggtagaaatgggggtttcaccacgtggcccaggctggtcttaaattactgaactcaagcaatcacccacctcggtctcccaaagctgagattacaggcatgagcctccatcaacaattttgaggaagactgttgagttactgaatgtttttctaactggattccacatctcaagccctgctaaaccaggggccccggagaggtacctcagtgtcagagcagttgccattcagagcctcgatgtttggwtccctccagtcttctgagagtgaagggatgtaattgtctgtcagagcatcccaaaccctgtaaacaaagagaagctctcattaacacacatctgtggcctggccccgcctggaggaaggaagagctgggccgggagaggagagaggcttctgtgtgtgccaggctgagatcatctgccttccagcatgcaggggcaaagcagcttaaaaactgaatcagaggcacatccaggggagaaagtgcatggagcttggccaggggcttcagtgtgaaaggtgtttgcttgagggaagaggaatt

SEQ ID NO: 163036 - DNA, 601 bp, Human
tccccttggttgagtttcataaacaattctaggccagcatggtggctcacacctgtaatcccaacactttgagagtccgagttgggtggattgcttgagctcaggagtttgaaaccagccttggtaacatggcaaaatcccatctctacaaaaaatacaaaaattagccgggcatggtggcgtatgcctgtagtcccagctactcggggagggggtggtgggtaaggctggaggatcacttgagcccaggaggtcaaggctgtagtgagccgagactgtgccactgcactccagcctaggygacacagtgagaccctgtctgagaaaaaaagagagacttcttccccactgtgtggctacattgctaatatctgggccccacctctggccattgtcaagtgcaagatccgtcagcacttgttctcagcactgtttttgtgggcctgaactattcatttaagatgggaaaatctaatttttttaaaccatcattatttgaacccaagagaagcccatgacagtttcctcctcttatttccggcctgaactgttcatttaagatgagaaaacctgatttttttaaaccaccattatttgaacc

SEQ ID NO: 163037 - DNA, 601 bp, Human
aggtgggatgcccacaagtatctttctaaaagaggcccaagggagcactttagacccttctaccatgtggggacacagtgagaaggtgccgtctgtgaaccagaaagcaggttctcaccagatattgaatctgccagtgccttgatcttggacttccctgccaccagagctgtgaaaatcaacttctgttgttaataaattacttagtctaacgtatcctgttacagcagcccaaactgactaagaaaccattccatatgtagattcagataggaggggcaatttggatcttctgaaaggycaccccctttatggcctttgcaaatcaactcaaaataaatatcatctttatttttcagaagcccctaagctactttctcccttggagtcagtaactcatggagtgtgactctggtccagacacataaacgtccccttggttgagtttcataaacaattctaggccagcatggtggctcacacctgtaatcccaacactttgagagtccgagttgggtggattgcttgagctcaggagtttgaaaccagccttggtaacatggcaaaatcccatctctacaaaaaatacaaaaattagccg

SEQ ID NO: 163038 - DNA, 601 bp, Human
cttcacaactgaaactagaaaaccaagtgaggcagaaatttgcttttaacatagagccattaaatgattttatcttttgctgtgctctgaatgtttatgtcccaccccccaaatttatatgctaaaatcctaatgcccaaagtgatggtattagacagtgagaccttgtggaggtgatgatatcatggaggtgggatgcccacaagtatctttctaaaagaggcccaagggagcactttagacccttctaccatgtggggacacagtgagaaggtgccgtctgtgaaccagaaagcaggtyctcaccagatattgaatctgccagtgccttgatcttggacttccctgccaccagagctgtgaaaatcaacttctgttgttaataaattacttagtctaacgtatcctgttacagcagcccaaactgactaagaaaccattccatatgtagattcagataggaggggcaatttggatcttctgaaaggtcaccccctttatggcctttgcaaatcaactcaaaataaatatcatctttatttttcagaagcccctaagctactttctcccttggagtcagtaactcatggagtgtgactct

SEQ ID NO: 163039 - DNA, 601 bp, Human
catcatgcctgtaagcattacaagagaacatgcacagccgagagttcaaaacaggacctgagacacagcctcctatgtctgtgctgaggaggcttgcaggaaatcttagtctcaaagtcatcatctcacttgctcccgtcaatgaagccttgaggttttgagtaccttagattgctaattactagaaaaatggagaaggatatatatggctacattttcaacaaatcagtcaactgctgatctctttgctgtgctattttgagcaataatctacaaatatattgccgagtaaggggaatcwgtttcttgctcttttacttggactcaattctgaaacacttagaaagattagacccatccaactctatcacttgctgagcctgcagggctgtgacagcccttcctgacgataaattgtcaaatttccttcacaactgaaactagaaaaccaagtgaggcagaaatttgcttttaacatagagccattaaatgattttatcttttgctgtgctctgaatgtttatgtcccaccccccaaatttatatgctaaaatcctaatgcccaaagtgatggtattagacagtgagaccttgtggaggt

SEQ ID NO: 163040 - DNA, 601 bp, Human
gaaatactacaaggaacagagctcaagatcatccttctcagggtcattcagtttgccctgaaatattaaccctcttgagggaaatctggaaatgaggataaattaaagcccttttgaagggcaggctatcttatatatcctttggcttaattcacaaaatgagttggaaaggtgtcaaaagagataacaaagcaaaatctgccttttgtaccatgatggacctgatttaatttcagtaactagatttattccattattgcctccatcttctttgcggtttgggtaagtactaagcatcatrcctgtaagcattacaagagaacatgcacagccgagagttcaaaacaggacctgagacacagcctcctatgtctgtgctgaggaggcttgcaggaaatcttagtctcaaagtcatcatctcacttgctcccgtcaatgaagccttgaggttttgagtaccttagattgctaattactagaaaaatggagaaggatatatatggctacattttcaacaaatcagtcaactgctgatctctttgctgtgctattttgagcaataatctacaaatatattgccgagtaaggggaatctgtttct

SEQ ID NO: 163041 - DNA, 601 bp, Human
aatatcttgattgtggtgatggtttcgcagatatatgcagatgtcaaaatttaccgcattgctcactttaatatgtgcagctcattatatgccaattacctttcaattacgatatggggggaaaaacagaataaaataaaatgataatatatcatgatgaagttgtgtgtatctcaagaatgcatggttgagttgacatttgcaaattaatttatgaaattcatcacattaacatcataaaggagaaaagctatataatcatctccacagaggcagtaaatagaaataataaatcttcagaaaaaataataagaaaacgtcacaatttgaagtcatgagcttctatgttgaaaggactcactgaggacaacataatgaaggaaaaaattcattctaaagcacattattgtaaaatttcaaatgagaaaggaaaagaacatcctaaaagcttccagaaagaaccaaaaaagtcatataataaaggagcaggaatctaaagatggagaacagagtcagcctaaaaagaaggactgggaatcggaacagatttggggtttctcaacacgacctaatgctagaagagaacaaagccctcagaatg

SEQ ID NO: 163042 - DNA, 601 bp, Human
aaattagccagtcatggtggtgtgcatctgtaatcccagctactcagaaggctaaggcaggagaatcacttgaacctgggaggcagaggttgcagtgagctgagattgcaccactgcactccagcctgggtgacagagcaagactccaactcaaagaaaaaaagaaactcttacaactcaatactaagaacacaaacaatgtactaaaaaaatgcacaaaagatttgaagaggcatttcaccaaagaaaacatacaggccgggcacagtcacgcctgtaatcccagcactttgggaggccrgggcaggtggatcacttgagctcaggaattcaagaccatcctaggcaacatggcgaaatctcatctcttctaaaaatacaaaaattagctgggtgtggaggtgtgcacctatggtcccagctacttggggagctgaggtgtgaagattgcttgagcccgggaggtggaggttgctgtgagctgagattgagccactgccctccagactgggcaacacagcaagaccctgtctcaaaaatacacacacacacacacacacacacacacacacattgtaaataatcacttgaaaagatgctc

SEQ ID NO: 163043 - DNA, 601 bp, Human
aatttttctttttgagaggggatctcactatgttgcccagtctggtctttaactcctggcctcaagcaatctgcccaccttagtctcccaaaatgctgggattacaagcttgagccaccacactcagccttcatcacatttaaaaaacatttgctcttcaaaagataatgttaagaaaattaaaaggcaacctatagactaggagaaaatatttgtaaaacatacattcaacaaataatttttatctagaatttataagaaactcttatggccaagcacggtggctcatgcctgtaatccyagcactttgggaggccaaggcaggcggatcacaaggtcaggagttcgagactagcctgaccaacatggtgaaaccccgtctctactaaaaatacaaaaattagccagtcatggtggtgtgcatctgtaatcccagctactcagaaggctaaggcaggagaatcacttgaacctgggaggcagaggttgcagtgagctgagattgcaccactgcactccagcctgggtgacagagcaagactccaactcaaagaaaaaaagaaactcttacaactcaatactaagaacacaaacaatgtac

SEQ ID NO: 163044 - DNA, 601 bp, Human
tggggaaggaataagattttcaatgaatggtactggaataattgaatagccatatgcagaaaaataaaccttgaagcccagcactgtggagtgcctcggtagtcccagcaattggggaggctgaagcaggtggatggcttgagccaaggagctcaagaccaacctgggaaacagcaacctgggaatcaaaaattttaaaaaatgagccctgacccttactccatactatatacaaaactaatttgaaggctgggcacagtggctcatacctgtaatcccagcactttgggaggccaagacrggtggatcacttgaggtcaggagttcaagaccagtctggccaaaatagtagaactctgcctctactaaaaatacaaaaattagctgggcatggttgcaggcacctgtaatcccagctactcaggaggcacagacagaagaattgcttgaacctgggaggtggaggctgcagtgagccaatattgagtcactgcactccagcctgggcaacagagcaagactccatttcaaaaaaaaaaaaaaaaacagaaagaaactgatttgagatggatcatagacctaaatacaagagctaaaatta

SEQ ID NO: 163045 - DNA, 601 bp, Human
atttccaacttattttatgacattagaacaaaataaaatttcagaaaaagaacatgatgcaaaaatctttaataaaatatcggcaaatcaaatcccacattatataaaaaagataaaatatcataactaagtggggtttattttaaaataaaatgctggtttaatatttgaaaaccaattaatgtaattcatcacattaacatgataaattgatctacatatataaattggtctgtagattctacacaatcaaagtcaaatttccagcaagattttttgcaaaaattcatctgctgattcyaagatttatatggaaatgtaaataacctaaaataactaaaacaaatttggaaagaaaaaaaaaggacacagttggagaacttatattactttatttcaagacttaccataaagctacagcaatcaatacagtgtgggattggcataaagatagacacattttaaaataaattagggatgataaaaaaagacacacacatatatatatcattgaaacagaaaaaagaattcagaagtagatccgcacatacatgatcaattgattttcaacaaagatgccaaaacaatttaatggggaagg

SEQ ID NO: 163046 - DNA, 601 bp, Human
agagtgagagagggatggagggagagagaacacaaattaacaatgtcaggaatagaaaagggaacatcactataaatcttacagacattttcaataacaaaacaaaattataaacaaatgaatgttcaatacattcaatgattaaatagataaattccttgagaaatgtaacttatcaaacctgactcagtaaaattgaatttgtaactgaaaatcttccacagagaaaaccctaggcccagatgctttcactagtatagtctatcaaacattcaaggaagaaataataccaatgtaatayaaattctttcacaaagtagagatagagaggataatttccaacttattttatgacattagaacaaaataaaatttcagaaaaagaacatgatgcaaaaatctttaataaaatatcggcaaatcaaatcccacattatataaaaaagataaaatatcataactaagtggggtttattttaaaataaaatgctggtttaatatttgaaaaccaattaatgtaattcatcacattaacatgataaattgatctacatatataaattggtctgtagattctacacaatcaaagtcaaatttccag

SEQ ID NO: 163047 - DNA, 601 bp, Human
attagaaatcaatttttaacaagatagctataaaacctcccaagcactttgaaattcagcagcaaactgccaaataacctatgggttaaagaagaaattgcaagaaaaaattagaaactatgtttttaattgaatgatgaaaacatacccaatcaaaatatgtagaattcagctaaaacagtgcttaaagggaattttatagctttaagtttttttaagtttaaaatataatcaaatttcctaccttaagaagctaaaaaaatgagggcaaattaaactcctactaagtagaaggaaggamgtaataaagctaagagagggaatcaataaactaaaaagttaacaaacaataaaggaaatcaaagaaataaaaagtggttctctgaaaagattaataaaggtgataatcccacagaccagctgacaagagagagtgagagagggatggagggagagagaacacaaattaacaatgtcaggaatagaaaagggaacatcactataaatcttacagacattttcaataacaaaacaaaattataaacaaatgaatgttcaatacattcaatgattaaatagataaattccttgagaaatgtaa

SEQ ID NO: 163048 - DNA, 601 bp, Human
tccaacagaagacataagatgcaaagccaaagaatatttgattaacccaaaagaagacaaaaagtgtggaacagaggaacaacaaaacagcaacaaaaccagatgggacaatcagaaatgaagacaatacgctccaacacaaattatcaatattatgccaaatgtcaatggactacacactatgcaaataaactaaacacaataatcaagaagcataaattgtcagactgaatataaaaacaagatccaagtatacactacctgcaaaaacacactttaaataaaaagacagagataggcrgaaactaaaaggattgagatagatacacacacacacacacacacacacacacacactttgcaaacagtatgcataagaaagcttaagtggctacattcatatcaaacaaagtagattttaagataagcattacagagaaagaatgacatttcataatgataaaagggtcaactcatcagggagatgtactcagagcttcaaaatatataaaacaaaaatcaacagaactaaagaaatagaaataaatgcacaacaatggttggagattttaataaacctttctcattaattgatagaata

SEQ ID NO: 163049 - DNA, 601 bp, Human
gtttttagagacaggggcttgctctgttgcccaggctggtgtgaaatggtgtaatcatagctcactgtagcctcaaactcctaagctcaagcgattctctagcctcagcctcccaagtagctgggactacaggtgcatgccaccaggcccagctaatgctttttttttttttttttaattttttgtagagacagggtcttactatgttggccaggctggtattgaaaattctgggctcaagtgatcctcctgccttggcctcccaagtagttgggactgcaagtgcactccatcccctggytacctttttgttttttttgtttttgttttttggtagagttgtagagatggggctggtcacaaactcctaggatcaagggatccccctgccttgtcctcccaaagtgctaggattataggagtaaaccaccatgcctggccataaagcctcacttttaaatatgaaaagatgctcaaggattgccagacatttgagaatagcccccaacatgaaagatgaaaatgtatagagaagagaaatcaaaagcaacagagagagcagaagaaacctcttctaagaaactgctatacctgccttcag

SEQ ID NO: 163050 - DNA, 601 bp, Human
agccatttttttttaaattaatgtttttagagacaggggcttgctctgttgcccaggctggtgtgaaatggtgtaatcatagctcactgtagcctcaaactcctaagctcaagcgattctctagcctcagcctcccaagtagctgggactacaggtgcatgccaccaggcccagctaatgctttttttttttttttttaattttttgtagagacagggtcttactatgttggccaggctggtattgaaaattctgggctcaagtgatcctcctgccttggcctcccaagtagttgggactrcaagtgcactccatcccctggctacctttttgttttttttgtttttgttttttggtagagttgtagagatggggctggtcacaaactcctaggatcaagggatccccctgccttgtcctcccaaagtgctaggattataggagtaaaccaccatgcctggccataaagcctcacttttaaatatgaaaagatgctcaaggattgccagacatttgagaatagcccccaacatgaaagatgaaaatgtatagagaagagaaatcaaaagcaacagagagagcagaagaaacctcttctaag

SEQ ID NO: 163051 - DNA, 601 bp, Human
tcaaactcctgagcacaagcaattcacctgcctcggcctcctaaagtgttgagattacaggcgtgagctatcaccagccatttttttttaaattaatgtttttagagacaggggcttgctctgttgcccaggctggtgtgaaatggtgtaatcatagctcactgtagcctcaaactcctaagctcaagcgattctctagcctcagcctcccaagtagctgggactacaggtgcatgccaccaggcccagctaatgctttttttttttttttttaattttttgtagagacagggtcttactrtgttggccaggctggtattgaaaattctgggctcaagtgatcctcctgccttggcctcccaagtagttgggactgcaagtgcactccatcccctggctacctttttgttttttttgtttttgttttttggtagagttgtagagatggggctggtcacaaactcctaggatcaagggatccccctgccttgtcctcccaaagtgctaggattataggagtaaaccaccatgcctggccataaagcctcacttttaaatatgaaaagatgctcaaggattgccagacatttgagaatagccc

SEQ ID NO: 163052 - DNA, 601 bp, Human
ggaacttgccatgtttcctaggctggtctcaaactcctgagcacaagcaattcacctgcctcggcctcctaaagtgttgagattacaggcgtgagctatcaccagccatttttttttaaattaatgtttttagagacaggggcttgctctgttgcccaggctggtgtgaaatggtgtaatcatagctcactgtagcctcaaactcctaagctcaagcgattctctagcctcagcctcccaagtagctgggactacaggtgcatgccaccaggcccagctaatgctttttttttttttttttaattttttgtagagacagggtcttactatgttggccaggctggtattgaaaattctgggctcaagtgatcctcctgccttggcctcccaagtagttgggactgcaagtgcactccatcccctggctacctttttgttttttttgtttttgttttttggtagagttgtagagatggggctggtcacaaactcctaggatcaagggatccccctgccttgtcctcccaaagtgctaggattataggagtaaaccaccatgcctggccataaagcctcacttttaaatatgaaaagatgctca

SEQ ID NO: 163053 - DNA, 601 bp, Human
tggctcaggaattgcagaccccgaggggcagcatggcggggctatgtaaggaagatttgctggtattcttcatcaagaataatgagacccaagtgtcttcttccaacccagataaaaagggactgcatcctctcagctcaaaaggactgtagacttcactctgagcaggttgaactggaggttctggactcagagcaccaggccacctaaaagtgagggtgagggttctcaccaaaaacagagagaggatgtaagactctacagaatgactcaccagacagacctctggcctccttccctragtaggctccaaggacactggcagctggtttattctgtccatcaagccattggagaacacctctctatggatgctataagtctacaaatacatgccaactgtcaagatctccgaacaagacgcataggtccttactggcactgtgatccagcaggaaacaagccctgaccccatagccttctagggcctcactttctttttttccaagggtttccctctgtcacctagactgaaggggagtggcttgatctcagctcactgcaacctctgcctccccggctcaagcaatcctcccacctc

SEQ ID NO: 163054 - DNA, 601 bp, Human
acagacgccggcccagcaggctcagcagggttaaacttggcgagagcaggctgcccaaggtaaagggggtcacacagcagatactgaatggctcaggaattgcagaccccgaggggcagcatggcggggctatgtaaggaagatttgctggtattcttcatcaagaataatgagacccaagtgtcttcttccaacccagataaaaagggactgcatcctctcagctcaaaaggactgtagacttcactctgagcaggttgaactggaggttctggactcagagcaccaggccacctaaaartgagggtgagggttctcaccaaaaacagagagaggatgtaagactctacagaatgactcaccagacagacctctggcctccttccctgagtaggctccaaggacactggcagctggtttattctgtccatcaagccattggagaacacctctctatggatgctataagtctacaaatacatgccaactgtcaagatctccgaacaagacgcataggtccttactggcactgtgatccagcaggaaacaagccctgaccccatagccttctagggcctcactttctttttttccaagggtt

SEQ ID NO: 163055 - DNA, 601 bp, Human
ctgcacagtgaagtattctgaatgatgattaaaattatgtggagcccttgattccaataatgactattaaccagtgtattttattaaagtgtttcaaatgaccccattcatagaaaaggtaatttttacagcatatttagccctttgcataatattttcctccccttaccactattgtttgacatgagtggttgcccccctgacaaaaattaagagaacaaagatacatttttaccttcagacaaaaagtaaaaaaaaaaaaagaaattcacaacaactgtgtcccattttttttttttttagacacaggatctcgctgtgtcacacaagctggaatgcagtggcacaatcatggctcaatgcagcctctaactcctttgctcgagtgatcctcctgcctcagcctcccaagtagctgggactacaggcaggtgccaccacacctgactaagattttttttgttttgaatttttttagagataggggtctcactgtgttgcccaggctggtctcaaactcctggcctcaagcaatcctcccacctcagcctcccgagtgggattacaggtgtgagccactgtgcctggtaactatgtccct

SEQ ID NO: 163056 - DNA, 601 bp, Human
tccttgaccaggacagtatcttgtgcacagggtggagagctggaggggaaacaatgacagaggaagaaagaaaggtttttgaaaaatgacagcccttgtgcatataaatactcttaatcctagcataagacactgacatagatatcacggtagagagttcctttagccccttgtgcagcagtggggaagatacatgtcaaaaataacttcaggccaggtcatttagggctgaatttctttgtcagctaaaactgctagttgttaccagatgtggtggcttacacctgtaatcccagcactytgggaggccgagatgagaggattgcttgagtccaggagttcgagaccaacctgggcaacatggcaagactccgtctctaaaaaaatagaaaaattagtcaggcatgatggcacacctgtagtcccaactactcaggaggctgaggtgggaggatcaattgagccatggagatggaggctgcagtgaggctgcagtgagccgtgattatgccactgcactccagcctggatgacaaagtgagatcctgtctaaaaaaaaaaacaccttgctagctgtttggatactattgacgtgaactat

SEQ ID NO: 163057 - DNA, 601 bp, Human
gaggcaggaggtgtctctaggaaatctctctgctgagtcacctctcatccaggaatgaatcctccttgcgctccagtagctggcacaccgattggccccttccctggggcttgtattctgccttttctaacaggaaacagcccagctccaatccaagcaataatgtcagaggtagtctatcctcagaaacttctcccgtcttctgtgagctttgccttggcagacatccctaacagagcacatcaccttttatctccatttgcttaaaaccaggactatgtcattaaaaaagaaaaaaaaattaagcaaatatatctcaaatgccatccgcactcaacctagatatggggtaggacagggaggtaatggaatcatctgaagggcccgggtaccagatggtgacatctatttccgctgtcaaacccatatgctcctctctctgccaagtccaccacctgcgatagcctcgtggtttccaccgctccccactatgcagaacaaaactcctggagctacgctttgttcacaactacactcatatggaagaactttcttcaggccagaaaatcctgcagtagaagttagcccaaaattaagagaa

SEQ ID NO: 163058 - DNA, 601 bp, Human
ttgtttgagtgtcttgactccgagtacaacgaatttcaataagaaggcttagcaggattgtagctactaaacactatgcctgtctctggctcctatcagagactgaccccaactatcccaagtgtcaagaatgacattcatgttcactgcaggtgggcaacctgaggcagaaagagagatgaaatcccttatcaaaaatactctgagttggacagtcaccgtggctcatgcctgtaatcccagcactttgggaggccaaggcgggtggactgcttgagtccaggagtttgagaccagcctrggcagcatggtgaaacctcatctccactaaaagtacagaaaattagctgggcatagtgatgcatgcctgtagtcccagctacttaggggcctgaggcgggaggatcgcttgagccaaggaggttgaggctatagtgaaccctgattttgccactgcactctggcctgggtgacaaagtgagaccctgtctcaaaatgaaaaaaaaaaaaggtcaggcacagtggctcatgcctataatcccagcactttgggaggttgaggtgggcagatcacttgaggttaggagtttgagaccagcct

SEQ ID NO: 163059 - DNA, 601 bp, Human
caaaaagcagaaaaattagccagttgtggtgacgtgtgtctgtagtccatgttacttgggaggttgaggtgggaggatggcttgagcccaagaggtagaggttgcagtgaaccgagactgggccactggactccagcctgggcaatagagccagatcctgtttcaacaacaacaacaaaaaaaagagtgaattactttgtacattaattatttacaaataaagaagactgctgctgaaagcaggtctttagatgagttttgtcccaaccttcacctttgtctgttctccatggatggactraagtccccgaggccagcattgtactctttgaggtggtttcttcacagtgggctggaccaaaggtaaggggtttcagggtctcctcctttagaataatttccattcttattcccaaaccttttcacctctactcacaaacttaggaaatacccagtctttgactactgaaagccattttacagaatgcaaccaaatgacacaagtccctgtcagggtcttatggctgaatgtccttttctctaagaggagttataattgagttcatatcattgaattgtagatcctcctacaagtcacaag

SEQ ID NO: 163060 - DNA, 601 bp, Human
gagaccaccttggccaacatgtgaaacctcatctctactaagaatataaaaattagccaggcgtagtggtgcatgcctgtaatcccagctactcgggaggatgaggcaggagaactgcttgaacctgggaggcggaggttgcagtgagcagagatcatgccactgcactccagcctgggcaacagagcaagactctgtctcaaaaaaaagaaggaaagaaagaaaagaaaaagaaacataatcatctctcattgttctgagcagaggggcctaactcccttccgactccaaattgcaaaasctactcaatgtaatgggttccattcatccacttagctacacaagagtgagactgctttctgtctttgcagtctcttcagagagttgtctgtgatgtggctcccatcctggtttagtgcttattcaataataaaatagttttctaggccgggcatggtggctcacacctgtaatcccagcactttgggagaccgaggcaggcggataacctgaggtcaggagtttgagaacagcctggccaacgtggagaaaccccatctctactaaaaacacaaaaagtagctgggcatggtgatgcatg

SEQ ID NO: 163061 - DNA, 601 bp, Human
tctttcatttaaaatagatttggatattttattccaaatttttctgtttacatgttatatattttcatagttgagattatacttgtatacaggtctaaatcatgctttaaaactttatacactttaggccaggagcagtggctcatgcctgtaatcccagcatattggaaggctgcgatgtgcggatcacctgaggtcaggagttcgaaaacagcctggccagcatagtgaaaccctgcctctacttaaaatacaaaattagccaggcatggtggtgcctgactataattccagctattckgcagagtgaggcaggagaaccgcttgaacctgagaggcggaggttgcagtgagcagagatcacaccactgtactctagcctgggcaacaagagcaaaactctatcttaaaataaaaataaataaataaataaataaataaaaactttataccctttaagcattttctgattaaaaattcttttaaacacttaaaaaaaaatttaggccaggtgcagtggctcacacctgtaatcccagcactttgagaggctgaggtgggtgggtcacctgaggccaggagttcgagaccagcctggcca

SEQ ID NO: 163062 - DNA, 601 bp, Human
tatccggctgctctgcaggctcagccctttctctttccgcctctttttcatcagttctcgctgctccttctgcttgttctgaacctcaataagcaccgtgataaaggagttcttcacttccttctcaaactccagctcgtcccggcgggccagctgctgcaccagctcctccgagaagtcacggatggcaccctccacctggtccagcagctcggtcagctcagacccagacatgtgcctcagccctgcaggggaagaccgtctcccgcataacacctgcatccacaccagagcccgctgsggaggctcctggggccaccaccaatcaagatgggactgcccctcagaggagatcccttccaactccttaaagatccaagaaagaccttcacaatttacgagcacgccaggaaggcgggggcctgtgtactgactgcagaagagaacacccctctcaggaaacaaaggaggaagaagaaacagcccacgaggaagtctgtggactctattctcaaaaatggggatggtttgttccttctattttctatctgtgtccataagattccttgtgtgaaatgggtcaagaattggggatggaaaa

SEQ ID NO: 163063 - DNA, 601 bp, Human
cctaccttgagaggcatctggtttcccttctctatccggctgctctgcaggctcagccctttctctttccgcctctttttcatcagttctcgctgctccttctgcttgttctgaacctcaataagcaccgtgataaaggagttcttcacttccttctcaaactccagctcgtcccggcgggccagctgctgcaccagctcctccgagaagtcacggatggcaccctccacctggtccagcagctcggtcagctcagacccagacatgtgcctcagccctgcaggggaagaccgtctcccgyataacacctgcatccacaccagagcccgctggggaggctcctggggccaccaccaatcaagatgggactgcccctcagaggagatcccttccaactccttaaagatccaagaaagaccttcacaatttacgagcacgccaggaaggcgggggcctgtgtactgactgcagaagagaacacccctctcaggaaacaaaggaggaagaagaaacagcccacgaggaagtctgtggactctattctcaaaaatggggatggtttgttccttctattttctatctgtgtccataagattccttg

SEQ ID NO: 163064 - DNA, 601 bp, Human
attgcagtgaaccgagatcgcaccactgcactccagcctgggcaacagagtgagactccatctcaccaaaaaaaaaaaaaagaaaaaaaaaatgaaccatgagaaccaggggtttgggttaaacccaaaaatagaacaatagaacaataaggcatctggggccaggcacggtggctcatgcccgtaatcccaacactttgggaggccaagatgggcaaatcacctgagatcaggagtttgagaccagcctggccaacatggtgaaaccccatctctactaaaaatacaaaaataatccagkagtggtggcatgaacctgtaatcccagctactagggaggctgagacaggagaattgcttgagcccaggaggcggaggttgcagtgagccgagatggtaccattgcactccagcctgggcaaaagagtgagactctgtctcaaaaaataataacaataataataaggcacctgatcattttcaatcactgaaacaccttagcacgccctaaagagaccagtcaggactggaacctgggacacaaggagggatttggacccagaattctgaggcccatctcaagactcccaacacgaaatac

SEQ ID NO: 163065 - DNA, 601 bp, Human
aggtgatccagtgtggtggaaagttaactaaactctaggatgggatctatcatcaaatggactccctcttaatgcatttcatccttaaaacaacttaattcttagacctacaagcagtgttgagttttaagtcttgcccatgtcctagaacactagagctcaaaaaaaaaaaaaaaaaaaagtttgccttttaaaaagatattctctgttcctccttaagaggagaaaaaagtgttaggacccctaaccccctaaataaatgctgggataattctggtgagtcactgtccccctgcgttgytggggaggccaagctgcaggagtctaggaagagagcttggagcagggagactacgcgtacctgtttgtcagttcctgaggagccaaaggtctggcggatgccactctgcagaatgttggagatgccttccatgctgaagcgctgtgggggagagagactcaagaagggcaaatgcttcttgctacactgtcaccacacccagggacctctcagctaccaggctgtcccagataacgccccagggttctgtgactagacagtaagtgtaagacactggcttacagagacaggccagaattg

SEQ ID NO: 163066 - DNA, 601 bp, Human
ttaataaccagaaatgcaagctatgtcacagggaaattactgagccaacaaaaagccacagcatgggttccaaccagagctgggaagctgcagaggcagtcttagtgggaatggcttggcaggtgatccagtgtggtggaaagttaactaaactctaggatgggatctatcatcaaatggactccctcttaatgcatttcatccttaaaacaacttaattcttagacctacaagcagtgttgagttttaagtcttgcccatgtcctagaacactagagctcaaaaaaaaaaaaaaaaaaaagtttgccttttaaaaagatattctctgttcctccttaagaggagaaaaaagtgttaggacccctaaccccctaaataaatgctgggataattctggtgagtcactgtccccctgcgttgctggggaggccaagctgcaggagtctaggaagagagcttggagcagggagactacgcgtacctgtttgtcagttcctgaggagccaaaggtctggcggatgccactctgcagaatgttggagatgccttccatgctgaagcgctgtgggggagagagactcaagaagggcaaatgcttctt

SEQ ID NO: 163067 - DNA, 601 bp, Human
gccataaaacaagaggactgggatcgatgctgctaaaatctcttccccttctctagactctctagaattctagagttctagaattctagcacttagaattcagctacaaatatgtttaaaacatatacactttcatgtacactcattccaccatctcaaactttctgttcacgtgccagccatgtctattagattatacactccatgaggacaggggtcaggacttttcacctttgcacctgagggcttaacaacagagcttagcacatagcaggcgcttgataaaagttgtgaatgctgycttaataaccagaaatgcaagctatgtcacagggaaattactgagccaacaaaaagccacagcatgggttccaaccagagctgggaagctgcagaggcagtcttagtgggaatggcttggcaggtgatccagtgtggtggaaagttaactaaactctaggatgggatctatcatcaaatggactccctcttaatgcatttcatccttaaaacaacttaattcttagacctacaagcagtgttgagttttaagtcttgcccatgtcctagaacactagagctcaaaaaaaaaaaaaaaaaa

SEQ ID NO: 163068 - DNA, 601 bp, Human
aagatatgcaagagaacctcaaccccgcccagggtctctgatgtcagatttgctccctctgctggatgtcaggtgctcctacaacaaaaccagcatcagggcctagtgggctgtcaaaggagtctcaaggaagcctgaggtggtgagtgccagagctctagatcaaagctaagaagctcacttttttttttttttttgagacagagtctcgctctgtcacccaagctggagtgcagtggcttgatctcggctcactgcaacctccacctcccgggtttaagcgattctcctgcctcagccycccaagtagctgggattacaggtgcctgccaccacacctggctagttttgtatttttagtagagatgaggtttcaccatgttggccaggctggtctcgaattcctgactttgggtgatttgcccacctcggcctcccaaagtgctgggattacaggcgtgagccaccgcgcccggccagaagctcacattttagtcttggctttgccactgacagtgtgtgtggctttggaaaaatgccttgaatctccaggccatagttctcactgccataaaacaagaggactgggatcgatgctgct

SEQ ID NO: 163069 - DNA, 601 bp, Human
gacagggtaatgaaacttgaatccaagaattaggagtgagtgaggaagaaaatccaatggtggcgtgagtcagcagccaggtccagaaaaagagactcaacctgaggccattgaggggttggtttgtttctgttttatttcttctgtatctttagacatgtattcatctcagcttaagtggattctagggggtcctggtttcttctgggtttttttttttttttgagacggagtttcactcttgtcatccaggctggagtgcagtggtgcgatctcagctcactgcaacctccgcctcccrggttcaagcgattctcctgcctcagcctcccaagtagctgggattacaggcgtgcaccaccacatctggctaattttttgtatttttagtagagatgggggtttcaccatgttggccaggctggtctcaaactcctgacctcaggtgatccacccgcctcggcctcccaaagtgctgggattacaggcgtgagccaccatactcggcctgttttatttttttctgcatttttagacatgccttcatttcagcttagttgtcaagaacactttgcaactgagcataagcagactaaatgcc

SEQ ID NO: 163070 - DNA, 601 bp, Human
tcctttgattgattaccttgactagtttcaagacagggtaatgaaacttgaatccaagaattaggagtgagtgaggaagaaaatccaatggtggcgtgagtcagcagccaggtccagaaaaagagactcaacctgaggccattgaggggttggtttgtttctgttttatttcttctgtatctttagacatgtattcatctcagcttaagtggattctagggggtcctggtttcttctgggtttttttttttttttgagacggagtttcactcttgtcatccaggctggagtgcagtggtgygatctcagctcactgcaacctccgcctcccgggttcaagcgattctcctgcctcagcctcccaagtagctgggattacaggcgtgcaccaccacatctggctaattttttgtatttttagtagagatgggggtttcaccatgttggccaggctggtctcaaactcctgacctcaggtgatccacccgcctcggcctcccaaagtgctgggattacaggcgtgagccaccatactcggcctgttttatttttttctgcatttttagacatgccttcatttcagcttagttgtcaagaacac

SEQ ID NO: 163071 - DNA, 601 bp, Human
agggtcagaaggcagctgcaacagtgggattgccacttcatttcgatatccttgtcctcctttgattgattaccttgactagtttcaagacagggtaatgaaacttgaatccaagaattaggagtgagtgaggaagaaaatccaatggtggcgtgagtcagcagccaggtccagaaaaagagactcaacctgaggccattgaggggttggtttgtttctgttttatttcttctgtatctttagacatgtattcatctcagcttaagtggattctagggggtcctggtttcttctgggtttktttttttttttgagacggagtttcactcttgtcatccaggctggagtgcagtggtgcgatctcagctcactgcaacctccgcctcccgggttcaagcgattctcctgcctcagcctcccaagtagctgggattacaggcgtgcaccaccacatctggctaattttttgtatttttagtagagatgggggtttcaccatgttggccaggctggtctcaaactcctgacctcaggtgatccacccgcctcggcctcccaaagtgctgggattacaggcgtgagccaccatactcggcctgtt

SEQ ID NO: 163072 - DNA, 601 bp, Human
gctgaggcaggagaattgcttgaatccaggaggcggaggttgtagtgagctgagatcacgccattgcactccagactgggtgacagagcgagattccatctcaaaaaaaaaaaaaaagaaagaaactcttcatttgttttagttgtgaaatggtattatggctatgttttcctcaagagttcctatgttttagaaatgcataccgaaatagttatgcatgaaaactatgacagagatttgctttaaaataacatgggaggggagaagttgggtagaggcgtaaatgaaataagcctggccsggacttaataactgttgatgccagctcatcagtacctgagagtgtattatgccatttcctctactcttgtatgtacaaccagtttccataagacaaggttaaaaagttatgaaagggtgtagtcaattatgtctccagcttcctttcaagtgcttgaaaagtattaaattatcatcaggttttgtttttcccaactaaatactaagtagcccaaactctgcagaattttcacaataagtcctttgttggtttgttgctccaaggaaagtcactggtgactcgggggtgatggaatctcct

SEQ ID NO: 163073 - DNA, 601 bp, Human
cagccattactaactacatgaccttagggaaattaacttcacctttccatgcttgtttcttcatcaatacaatagaacgtacctgcgcctaccccgcagggttgttgagaggcatgtggcaagtgctgagtaaatattaatcacttgtacaaattcagtgacaactcagtggctcgtgaggggtaaagtccagccctccgactaccaaatttatataacctgtttctataatcctcctttgagaacctcctttgagaaatgtgctgctcttttaaaatctttgagtcacaaaccctttctrtggttttttgtgttttgttgttgttgttgttgttgttttgttttgtggtttgtttgtttgtttttttgagacagggtcttgctgtgtcacccaggctggatgcagtggtgtgatcacagcccccactgcagtctcagctcctgggttcaagtgatcctctcacctcagcctcctgagtagttgggactacaggcgcgcaccactacacctggctgattttttttttaattgagacgcggtctcaccatgttgcccaggctggacaagttatttttaatgtttactctaagttcctcctgc

SEQ ID NO: 163074 - DNA, 601 bp, Human
gggaggcaccatcaccggccctgccccatcatgcatccaatgattactagcactagaagccaacggcaaaggaccccgcgcgcttgctcgtgtttaatccaggttaagctatacacgtttaaatacatgtcggaggttacatggtctcatgcagtccctgtgatggaatgactcttgctcagtgacctcctgcagcgaggctgctccaaagggcaaggttaggtagggcagagcactgcaacgagaagagaggaggggagagcggtcagaacacagttgcaggtggggacctccgagcccwggatagccctagctgagagcagtcacaccagctcctgagtggtgacagcccccacttagtgcctagaataagggagagacaatggcaggtggttgctggttataataactaagcgtgtagtctccggggcctgagttcaaatcctggatccagccattactaactacatgaccttagggaaattaacttcacctttccatgcttgtttcttcatcaatacaatagaacgtacctgcgcctaccccgcagggttgttgagaggcatgtggcaagtgctgagtaaatattaatcacttgtac

SEQ ID NO: 163075 - DNA, 601 bp, Human
cgcacctctggaggctgaggcacaactgggctgggagttgagcgcataccgagtaggggctgcgggggagcgggggcagggccggcggggcggggccagaagcccggcggggttgggggcgctctcctagtgactcaaggcgcgcagcgctgggcgcaaagcgccagtctccgccttgcgagctcagagtgtgcccgctgcgccgccgctgtccgtacctgccgccgccgccaccgccaccatgcccaacttcgccggcacctggaagatgcgcagcagcgagaatttcgacgagctgctsaaggcactgggtaagctggtgcagagggcgcgccccgacggggagatgcggcccggaggtgccctggtcccggaagtgccccggtcctggagggggtggaagttggggagcccaggcaggagggagtccccggggcaatagatcgccttgtctcccaggcgcaccgggtctcggagaagctggtagagatcccggaacccacgcgttcagcgaacgtttgctgaatgtttggcgccctcctcgatggtgcggactttatctcgtgctagatcatagcgaggagagattactggagagcaa

SEQ ID NO: 163076 - DNA, 601 bp, Human
tttctaaagttagggtatgaccagtgcccgaccggtcccgagactggcggcgaggccccgtgacccaagcctgtggtgcaccctgcgcaggtgtgaacgccatgctgaggaaagtggccgtagcggctgcgtccaagccgcacgtggagatccgccaggacggggatcagttctacatcaagacatccaccacggtgcgcaccactgagatcaacttcaaggtcggagaaggctttgaggaggagaccgtggacggacgcaagtgcagggtgaggccccagagccactacagcgtccccgkgtccccgctcggtgcccatggcccactgctgctggaggaacctgtgtctccctttgcagcctgtggcgcgccttccttgcagggtgtgtacactggctgtttgcagagggggtttgtgcatcctagttgcccctggctcaagacaaagtattaccttcattccatctcaaccccatccctacgctgcctcccggggtgctaacagccgcgcttaaagagcgggctctgggttgcgccgcgttcccagcagtggcttttgcagcggtttgcagcgccaagcgcaggcggcgcaggaggagg

SEQ ID NO: 163077 - DNA, 601 bp, Human
ctgtctctaaaaaaaaaaagtattcagacgaaaacattttaaacacctgctcctagccaaacaaaacttacctagtgaggccaaattagaaacctctataatttaagcacacacttcctcccctttttttaggtagagaacaaaggaaggctgagggcagaacaatccccctcgctctccctttgtgttacaaaactgggctgggattggtggctcacacctgtaatcccagcactttgggaggctgagcccaggagtttgagaacagcctgggcaacatagtgagacccctatctctacaaaaaaaaaaaaaaaaaattagctgagtgtggtggcacatgcttgtagtctcagctactcggaggctgaggtgggaggatcacttgagcccaggagtttgaggctgcagtgaactgtgatcatgccactgcactctagcctgggcaacagagctgagaccctgtctcaaaattaaaaacaaaaaaaaaaacaaaaaaactaattaagggttttgcaaccacccttttcttccagaccagaaaagggaaagctgttttgggtaaccaggaaattatatcctttgttctccattaggtatttt

SEQ ID NO: 163078 - DNA, 601 bp, Human; identical to SEQ ID NO: 34556

SEQ ID NO: 163079 - DNA, 601 bp, Human; identical to SEQ ID NO: 34557

SEQ ID NO: 163080 - DNA, 601 bp, Human; identical to SEQ ID NO: 34558

SEQ ID NO: 163081 - DNA, 601 bp, Human; identical to SEQ ID NO: 34559

SEQ ID NO: 163082 - DNA, 601 bp, Human; identical to SEQ ID NO: 34560

SEQ ID NO: 163083 - DNA, 601 bp, Human; identical to SEQ ID NO: 34561

SEQ ID NO: 163084 - DNA, 601 bp, Human; identical to SEQ ID NO: 34562

SEQ ID NO: 163085 - DNA, 601 bp, Human; identical to SEQ ID NO: 34563

SEQ ID NO: 163086 - DNA, 601 bp, Human; identical to SEQ ID NO: 34564

SEQ ID NO: 163087 - DNA, 601 bp, Human
atgttgttgtagttgctacataatgctcttttgttaattgttttttttttgtagagatagggtcttactatgttgtccaggctagtcttaaactcctggcctcaagcgatcctccagccttagcctcccaaactgctgggatgataggcatgaaccaccttgctccatatgattaatttttgtatttctccacaaatgtgtgaagttgggtaagtgtggaagaacagtgctataaattagattttgtggattatttctattttcaacatttttgtactgcacaatttcagagtcaaaattwtatgtattttaagacagaagggagaaaactgtgcttatagcataatattgaaattaatgctaactataattttcatatttttaatatttagtaaaataacacacctgatttttcttgttttttgtatcacccaaacattaaatcttatatgttaaatatgctaaaattttaccaagaggataaaggaaacagacaaacaaaaacctcttaatgctttttggaaagaaaaataaaaagtaaaataaaattagaaagaaaagaaaaataaaagtattattcttcagcgttccaggccttggc

SEQ ID NO: 163088 - DNA, 601 bp, Human
ccaagtccccaggtgattcatatgcactttaaagtagatgattgaaggaactactgactgtgctcttagcacattctggactctgaatggagccataccacctacaggaattctggacctgaactgctgagttaggagtaggaccagcctgtgggggtggaggtaacaaggcctcattcactgaaacattcaccccatgacctctcttaatgaatgaataaatgactagttctttaatgggcacctgaaaaaataataagaacttcctcttggctgtaaagcattgatacatcatgaattrtatgatgcattctcaaatatgtgttgatgctacaatgagctacatgtactttgtcaaacattgactgtatagtttctttctcttaggaggactagaagcattcttgggaaaagatattgaggcttctgttttgtggcgaataataaaggagataaaaatataactgttaaacctttttaaaaggtaaaatttcaattattgtgaagtatcataccttaaatagttcaaagagcatatgatggaggtgagaaggaacatacacgatgtgaattggttggtctggaaattttcctagaaaaa

SEQ ID NO: 163089 - DNA, 601 bp, Human
ttttaacatgccctgcaggcgattctaatgcatattacagtttgagaagcacaactctacaggcctgctaggcaaagtgtgcattgtggaccagcagcatcaccccttagcttattcaaaattgagaatctcaggccccactctagacttcctgaatcaaaattttcactttaaccaagtccccaggtgattcatatgcactttaaagtagatgattgaaggaactactgactgtgctcttagcacattctggactctgaatggagccataccacctacaggaattctggacctgaactgmtgagttaggagtaggaccagcctgtgggggtggaggtaacaaggcctcattcactgaaacattcaccccatgacctctcttaatgaatgaataaatgactagttctttaatgggcacctgaaaaaataataagaacttcctcttggctgtaaagcattgatacatcatgaattatatgatgcattctcaaatatgtgttgatgctacaatgagctacatgtactttgtcaaacattgactgtatagtttctttctcttaggaggactagaagcattcttgggaaaagatattgaggcttc

SEQ ID NO: 163090 - DNA, 601 bp, Human
gatttgattcttagcacctggctgcctcagaccagtaacatctgtatcctttgagagcttgttagaaatgcacattctcagacctgaagaatcaaaatctctggggtagagcccaagaatctgtgttttaacatgccctgcaggcgattctaatgcatattacagtttgagaagcacaactctacaggcctgctaggcaaagtgtgcattgtggaccagcagcatcaccccttagcttattcaaaattgagaatctcaggccccactctagacttcctgaatcaaaattttcactttaacyaagtccccaggtgattcatatgcactttaaagtagatgattgaaggaactactgactgtgctcttagcacattctggactctgaatggagccataccacctacaggaattctggacctgaactgctgagttaggagtaggaccagcctgtgggggtggaggtaacaaggcctcattcactgaaacattcaccccatgacctctcttaatgaatgaataaatgactagttctttaatgggcacctgaaaaaataataagaacttcctcttggctgtaaagcattgatacatcatgaattat

SEQ ID NO: 163091 - DNA, 601 bp, Human
aaactaaaagatgttttccgtctattggctgaatctcatacagatacagtcttggttttcttaacccattttcctttctcaccacctgtctactttctgctttctggtttttaaataatattaagttctagtcattagctggagtgaaataaagtagatcagatgtttgtagtacagtcagtacctcacagcagtaacattagaataagttaggaaacaggaagttctggaaagagttatgtcagaattagaggcagatttgtcttttttaggcttccttctctccaattcaggggactcytgggaagcatcaaaaagcttaaggtgtttttctattttttggtttaagttcaatttgatcttaatttaacttaatcttaggacgcatgaaaggatttgattcttagcacctggctgcctcagaccagtaacatctgtatcctttgagagcttgttagaaatgcacattctcagacctgaagaatcaaaatctctggggtagagcccaagaatctgtgttttaacatgccctgcaggcgattctaatgcatattacagtttgagaagcacaactctacaggcctgctaggcaaagtgtgca

SEQ ID NO: 163092 - DNA, 601 bp, Human
ttaaaaggacagtcaataattctaaattgaatttcaatttgcatttgattatcatctaacttttaccaatgatggcagaataactctatgagttgtatcattcaacttaaaaataaatcaaatcaatgaaaaagtatcctttgtcctttaacacagaacaaactaaaagatgttttccgtctattggctgaatctcatacagatacagtcttggttttcttaacccattttcctttctcaccacctgtctactttctgctttctggtttttaaataatattaagttctagtcattagctgkagtgaaataaagtagatcagatgtttgtagtacagtcagtacctcacagcagtaacattagaataagttaggaaacaggaagttctggaaagagttatgtcagaattagaggcagatttgtcttttttaggcttccttctctccaattcaggggactcctgggaagcatcaaaaagcttaaggtgtttttctattttttggtttaagttcaatttgatcttaatttaacttaatcttaggacgcatgaaaggatttgattcttagcacctggctgcctcagaccagtaacatctgtatcc

SEQ ID NO: 163093 - DNA, 601 bp, Human
gcatatatttcccacaaatctaagtaaaataaaagcacagctactctcatagatgccaaaaggagttgccttaaaaaattcacatgaacatgtcctcattctgaaactttggtaatgtattaaccttcttaggaaacaattttgcttcacttgaggcaggtagtatggcccagcttcctctttggtaagttatcatattaaataatgtacacacacccagaaagagaagagaatgaatgacctgtagtcattatttgcattaactcagtttggggaattcactccagaccatagcactcarggctataaaaggagcaatggttttagaaacaggattttgctattgaattcaagggatacctttaagtagatgatagcatctgttccatatcctgataaagagtagagattcagatctccttgaaagtacttggcatacagacgagaaattggcaagccgtaaccaaaaccagcctagagaagagagacgttatcaggtaaagaagtgtatgtgatcactgaaatacaaacaagcaggaaattactgtcctcactgatactaatgtcctagaacctaaataaatatcttctacttccaatc

SEQ ID NO: 163094 - DNA, 601 bp, Human
gctggaacattattagcatatatttcccacaaatctaagtaaaataaaagcacagctactctcatagatgccaaaaggagttgccttaaaaaattcacatgaacatgtcctcattctgaaactttggtaatgtattaaccttcttaggaaacaattttgcttcacttgaggcaggtagtatggcccagcttcctctttggtaagttatcatattaaataatgtacacacacccagaaagagaagagaatgaatgacctgtagtcattatttgcattaactcagtttggggaattcactccrgaccatagcactcaaggctataaaaggagcaatggttttagaaacaggattttgctattgaattcaagggatacctttaagtagatgatagcatctgttccatatcctgataaagagtagagattcagatctccttgaaagtacttggcatacagacgagaaattggcaagccgtaaccaaaaccagcctagagaagagagacgttatcaggtaaagaagtgtatgtgatcactgaaatacaaacaagcaggaaattactgtcctcactgatactaatgtcctagaacctaaataaatat

SEQ ID NO: 163095 - DNA, 601 bp, Human
gccatttggcaagtaattccagtgcaaaaaatgggagccttaaagtttaatgttttagttgctaatatctatattttcagttgaaatagtcggcaaatgaacagaatcaagacagtgatcttaacaaagaaattgaggctttaccagaaacaggaaaatatgcaccaaggtttttttttttttttttttttttgagacggagtctagctctgttgcccaagctggagtgcaggggcacgatctcggctcactgcaacctctgcctcccgggttcaagcgattctcttgcctcagcctcccragtagctggggttacaggcacccgccaccacacccagctaatttttgtatttttagtagagacggggtttcactgtgttggccaggctggtctagaaccactgaacttgtgatccacctgcctcggcctcccaaagtgctgggattacaagcgtgagccactgtgcccagccaacatgcaccaagtttttaagttcaaacagtgaatgtctggcaccccactgacagctttggaacagtcagctttcctttcccaggatttctaacaaggtcagcttaaggacttgagtatcttgatacc

SEQ ID NO: 163096 - DNA, 601 bp, Human
aactatttcagatggtgaaaaggccatttggcaagtaattccagtgcaaaaaatgggagccttaaagtttaatgttttagttgctaatatctatattttcagttgaaatagtcggcaaatgaacagaatcaagacagtgatcttaacaaagaaattgaggctttaccagaaacaggaaaatatgcaccaaggtttttttttttttttttttttttgagacggagtctagctctgttgcccaagctggagtgcaggggcacgatctcggctcactgcaacctctgcctcccgggttcaagcrattctcttgcctcagcctcccgagtagctggggttacaggcacccgccaccacacccagctaatttttgtatttttagtagagacggggtttcactgtgttggccaggctggtctagaaccactgaacttgtgatccacctgcctcggcctcccaaagtgctgggattacaagcgtgagccactgtgcccagccaacatgcaccaagtttttaagttcaaacagtgaatgtctggcaccccactgacagctttggaacagtcagctttcctttcccaggatttctaacaaggtcagctta

SEQ ID NO: 163097 - DNA, 601 bp, Human
gaagacttttgctcatttaagaagtgaatacattaactatttcagatggtgaaaaggccatttggcaagtaattccagtgcaaaaaatgggagccttaaagtttaatgttttagttgctaatatctatattttcagttgaaatagtcggcaaatgaacagaatcaagacagtgatcttaacaaagaaattgaggctttaccagaaacaggaaaatatgcaccaaggtttttttttttttttttttttttgagacggagtctagctctgttgcccaagctggagtgcaggggcacgatctcrgctcactgcaacctctgcctcccgggttcaagcgattctcttgcctcagcctcccgagtagctggggttacaggcacccgccaccacacccagctaatttttgtatttttagtagagacggggtttcactgtgttggccaggctggtctagaaccactgaacttgtgatccacctgcctcggcctcccaaagtgctgggattacaagcgtgagccactgtgcccagccaacatgcaccaagtttttaagttcaaacagtgaatgtctggcaccccactgacagctttggaacagtcagct

SEQ ID NO: 163098 - DNA, 601 bp, Human
gaaattatgcatggcataatttgcacttgaagttattactcaaaatacattcagaggtaagtatccaaacattcaaatacattcatttaattgacacagtaataagagcacactggtgcctgcactcagtctatggctctttcttaatagtttgaagacttttgctcatttaagaagtgaatacattaactatttcagatggtgaaaaggccatttggcaagtaattccagtgcaaaaaatgggagccttaaagtttaatgttttagttgctaatatctatattttcagttgaaatagtcrgcaaatgaacagaatcaagacagtgatcttaacaaagaaattgaggctttaccagaaacaggaaaatatgcaccaaggtttttttttttttttttttttttgagacggagtctagctctgttgcccaagctggagtgcaggggcacgatctcggctcactgcaacctctgcctcccgggttcaagcgattctcttgcctcagcctcccgagtagctggggttacaggcacccgccaccacacccagctaatttttgtatttttagtagagacggggtttcactgtgttggccaggctggt

SEQ ID NO: 163099 - DNA, 601 bp, Human
gactcagaagacaaagcctaaaagaaaaggggggaaaaacatgagaccaaagaaattatgcatggcataatttgcacttgaagttattactcaaaatacattcagaggtaagtatccaaacattcaaatacattcatttaattgacacagtaataagagcacactggtgcctgcactcagtctatggctctttcttaatagtttgaagacttttgctcatttaagaagtgaatacattaactatttcagatggtgaaaaggccatttggcaagtaattccagtgcaaaaaatgggagcctkaaagtttaatgttttagttgctaatatctatattttcagttgaaatagtcggcaaatgaacagaatcaagacagtgatcttaacaaagaaattgaggctttaccagaaacaggaaaatatgcaccaaggtttttttttttttttttttttttgagacggagtctagctctgttgcccaagctggagtgcaggggcacgatctcggctcactgcaacctctgcctcccgggttcaagcgattctcttgcctcagcctcccgagtagctggggttacaggcacccgccaccacacccagcta

SEQ ID NO: 163100 - DNA, 601 bp, Human
cagagctcatctgataatgtttgaaggctgacttgttaaaaactggaagtttttctatagactcagaagacaaagcctaaaagaaaaggggggaaaaacatgagaccaaagaaattatgcatggcataatttgcacttgaagttattactcaaaatacattcagaggtaagtatccaaacattcaaatacattcatttaattgacacagtaataagagcacactggtgcctgcactcagtctatggctctttcttaatagtttgaagacttttgctcatttaagaagtgaatacattaactatttcagatggtgaaaaggccatttggcaagtaattccagtgcaaaaaatgggagccttaaagtttaatgttttagttgctaatatctatattttcagttgaaatagtcggcaaatgaacagaatcaagacagtgatcttaacaaagaaattgaggctttaccagaaacaggaaaatatgcaccaaggtttttttttttttttttttttttgagacggagtctagctctgttgcccaagctggagtgcaggggcacgatctcggctcactgcaacctctgcctcccgggttcaagcgatt

SEQ ID NO: 163101 - DNA, 601 bp, Human
gccaggttctttggttccctgcttgggatacaccagtcatcagcctcagagctcatctgataatgtttgaaggctgacttgttaaaaactggaagtttttctatagactcagaagacaaagcctaaaagaaaaggggggaaaaacatgagaccaaagaaattatgcatggcataatttgcacttgaagttattactcaaaatacattcagaggtaagtatccaaacattcaaatacattcatttaattgacacagtaataagagcacactggtgcctgcactcagtctatggctctttctyaatagtttgaagacttttgctcatttaagaagtgaatacattaactatttcagatggtgaaaaggccatttggcaagtaattccagtgcaaaaaatgggagccttaaagtttaatgttttagttgctaatatctatattttcagttgaaatagtcggcaaatgaacagaatcaagacagtgatcttaacaaagaaattgaggctttaccagaaacaggaaaatatgcaccaaggtttttttttttttttttttttttgagacggagtctagctctgttgcccaagctggagtgcaggggc

SEQ ID NO: 163102 - DNA, 601 bp, Human
tcctgagtgtccctcttcacatggccacttcttttgccaggttctttggttccctgcttgggatacaccagtcatcagcctcagagctcatctgataatgtttgaaggctgacttgttaaaaactggaagtttttctatagactcagaagacaaagcctaaaagaaaaggggggaaaaacatgagaccaaagaaattatgcatggcataatttgcacttgaagttattactcaaaatacattcagaggtaagtatccaaacattcaaatacattcatttaattgacacagtaataagagcrcactggtgcctgcactcagtctatggctctttcttaatagtttgaagacttttgctcatttaagaagtgaatacattaactatttcagatggtgaaaaggccatttggcaagtaattccagtgcaaaaaatgggagccttaaagtttaatgttttagttgctaatatctatattttcagttgaaatagtcggcaaatgaacagaatcaagacagtgatcttaacaaagaaattgaggctttaccagaaacaggaaaatatgcaccaaggtttttttttttttttttttttttgagacgga

SEQ ID NO: 163103 - DNA, 601 bp, Human
aagcagtacagctgaagttaagagctttggtgtcaatcaggccaggtttcccagttccagttctattatttctaactagttatgagacatcagaaggtttcttaaccattccgagcttcagtttatctgaagaatggcaatactgaggcctacttcttatatttatgaaagtggaatatgctattacaagtaaagcacttagacaagttcctgaaaacaacagccactcaataaatgttagcaatttgctattatctacaatgaaaaaaccaggtctttagttttgaagctaaaaaaaaaatgtgtaaggtttaggttcttttaaaaaaatattttatttttgtagggacagggtctcgctatgttgcccaggctggtcttgaactcctgaccttatgtgatcctcctgcctcttcctcccaaactgctgcgattacaggcgtgagccaccacacccggcaagttttagggtcttataaagcattaagttaggtcacagttaagtgatcaaaatggtgaggaacaggaatgaggcaataatgtgtattaagcaccccgtatcttaccctcctatcctacttaatgaggcttcatttgtaac

SEQ ID NO: 163104 - DNA, 601 bp, Human
ttatgcaagatgggatgtagcaacgccactcccaaaagaaagacccactcccaaaagaaaatctattagtcgaaccaccagtaacgactttcatgtggcaacctctatactccaagttacccgagagtggataaaatccactttctggagcactgacactcaacaaagcgtttgaaagtaagatctgttatagactgcagagatgttcataggctgccttaacaacaccaattttaatttgtatctgttagtgaatttgtcaatggcatacttacaagaaaaataattttccaaagtacasaaagaacttgaaagtaaatcagggcattaatacttgaagtgaaaactcaaataccaaaagattgaaaataggtcactgttttaaagtaatacttttcaaactttaatgttttttcaaacatctctcttaggaatcctggtaaagcccacactgattaagtaggtctaggtttgaggaatgatgagatgctgcaattttaacaggctcccaggcaatgccaagtctgctgtttcatggatcacattttgaatagtaacagactctaaaccttgactagaccaaaacatgtcggaaatgtag

SEQ ID NO: 163105 - DNA, 601 bp, Human
gcctcacacctgtaatcccagcactttgggaggcagaggcgggtggatcacctgaggtcgggagttcaagaccagcttgaccaacatggagaaaccctgtctctaccaaaaatacaaaattagccgggcatggtggcacatgcctgtaatcccagctacacgggaggctgaggcaggagaatcgcttgaacccaggaggtggaggttgcagtcagccgagatcgcgccactgcactccagcctgggcaacaagagtgaaactccatctcaaacaaacaaacaaaaaaaaaaaaaaaaaaargagagagagaagaaacaataaaaattccctttccttaaaatgattaaatgaacatcctaccaaacatattcttatgcaagatgggatgtagcaacgccactcccaaaagaaagacccactcccaaaagaaaatctattagtcgaaccaccagtaacgactttcatgtggcaacctctatactccaagttacccgagagtggataaaatccactttctggagcactgacactcaacaaagcgtttgaaagtaagatctgttatagactgcagagatgttcataggctgccttaacaacacc

SEQ ID NO: 163106 - DNA, 601 bp, Human
agaaactatgctgacatggtgcctcacacctgtaatcccagcactttgggaggcagaggcgggtggatcacctgaggtcgggagttcaagaccagcttgaccaacatggagaaaccctgtctctaccaaaaatacaaaattagccgggcatggtggcacatgcctgtaatcccagctacacgggaggctgaggcaggagaatcgcttgaacccaggaggtggaggttgcagtcagccgagatcgcgccactgcactccagcctgggcaacaagagtgaaactccatctcaaacaaacaaamaaaaaaaaaaaaaaaaaaaagagagagagaagaaacaataaaaattccctttccttaaaatgattaaatgaacatcctaccaaacatattcttatgcaagatgggatgtagcaacgccactcccaaaagaaagacccactcccaaaagaaaatctattagtcgaaccaccagtaacgactttcatgtggcaacctctatactccaagttacccgagagtggataaaatccactttctggagcactgacactcaacaaagcgtttgaaagtaagatctgttatagactgcagagatgttca

SEQ ID NO: 163107 - DNA, 601 bp, Human
acatccaaaaacactcccttggttaagaaccactgtaagatgtcatactttttaaggcacaggtgataatgcctcatttattccagaatgctggcagcattaggggatcaccagtctgttgtctgcctcaacagacagattcccatcataacactgtcttatccagaaatttctccaggggccagagggtgggaaggtgggtagtattctgctcctgatttcttcagactatatagaaatttcacctaatacagaaaaagtatagaatacttagtataatatcactcttgtaaacgctatygctgctgcaggcaaactcaatttcattctaaatattctaaaaaagcttctctctcaaaaaaaaaaaaaaaaccctttcaattctggcacaggaagagaataaaagaatctaaaggagcacttgttctcttccctcttttactcgaatccacatctaattgtcagagaaactaataaaaatattttttaaaactctttcaataatttgatatggaaaagtagtcaacgttttaaataaattaggctgggcgcggtggctcatgcctgtaatcccagcactttgggaggccgaggcgggcgg

SEQ ID NO: 163108 - DNA, 601 bp, Human
actgatgggaagactgctgaggccattagttcagtaccagcctgggcaacataacgagaccaaatctccacaaaaaatttgaaagaacaaattaggtgagatggcacatgcctgtactcccagctactagggaggctgatagggaggctgagacagaggatcactcaatcccaggagttcaaggccgtaataatctgtgacagcgccactgtactccagcctgggtgacagagcaccagagcaagaccttgtctcttaaaaacacacacacacacacacacacacacacacacacacacayacataaaagaaccaaagaaaaaaccctaatatctatcaagaagggactagttaaatagactatttaagatgaacacaatgagggcatgaggtagatttttatattgatgcaaaaatgtacctgagatacattaaataataaaaatcaagtaggaggaaatagtatatatcgtatgtcttctgtgtatgtatttaaaggatacatacaaacaagtacaatttataaatacattctggaaggatactaaagaaaaaaacatttaacgttggttatcactgggacataaataacttttttggg

SEQ ID NO: 163109 - DNA, 601 bp, Human
cactgattcttctctcccttgacaactactacttactaagttcaaagacaaatatctatagaagtcaaatttgcttcaagacagcctctaattaactgtgaccttgggtaaattaaatttttctgatccctaggtataaaacttatacctcaaagagctatgaagactcaatgacactgtgtatgtaaagcacttagtactgataaatggcagctaataccattctctctgtacttttcagtaccagatttataggaaacactcaacaaatacatgtcaaatgaataaatcctttattacatgctaatcactggaaaggcaatttgtgggatgagagaggtgagtagagaaacatgtcctagaatataaacaatacaatttccaccaaacattacatgtacaccagagtacacaaccagacaaaggattaaggatatttggtaaattttaaatacttatgaagaagagtacactcatccctcggtatactcggggtacttgttccaggacagcccaagtatacccaaatctatgtatattcaggtcccatggttagccaagtggtagtcagccctctctacaggtgggttccatatcctgt

SEQ ID NO: 163110 - DNA, 601 bp, Human
agtggtttgctgcacccatcaacccatcacctaggttttaagtcccacacgaattaagtatttctcctaatgccatccctccccttgcttcccaccccgacaggcccaggtgtgtgatgttccccttcctgtgtctactatgtgttctcattgttcaacttccacttatgagtgagaacatgcggtgttaggttttctgttcttgtgttagtttgttgacaatgatggtttccagcttcatccatgtccctaaaaaggacaagaacccatccttttttatggctgtatagtattgcacagygtatacgtgccaccttttctttaaccagtccgtcactgatggccattgggatcggttccaagtctttgctattgtgaatagtgcttcaataaacattcatgtgcatgcgtctttatagtagaatgatttataatcctttgggtataacccagtaatgggattgctgggtcaaatggttatttctagttctagatccttgcggaatcaccacattgtcttccacaatggttgaactaatttacactcccaccaacagtgtaaaagcgttcctacttctccacatcctctccagcataaatt

SEQ ID NO: 163111 - DNA, 601 bp, Human
atcttcattacattgaatttgccaatgaattcttaaatatgacaccaaaagcacaaataacaaaagaaaaaatagattaaaatacggctataatttaaaacaaaaaagaaaaataagttttggcaaggatgtggagagactgaaaccttcacaccctgctagtacgaacgctagtgagaacataaattgttcaactgctgtagaaaacagcttggcagttcctcaaaaagttaaatatagaattaacgtatgacccaacaattccacttgtgtgtgtgtgtgtgtgtgtgtgtgtgtgtatatatatatatataaaatttcttttcaaaagaattgaaaacaggtactcaaatatatgtacacgtacgttcatagcagcactatccacaatagctaaaaggtggaaacagtctgaatgtccatcaactgatgaatgtataaaacgtggcatatccatatagtattattataaattggaatatacaatatggaacatgtatatgaatattattcagccataaaaaggaatgaagtactgatgcatggtacaacatgaatgaaccttgaaaacattatgctaagtgaaaaaaggtacgcacgc

SEQ ID NO: 163112 - DNA, 601 bp, Human
aatcttcattacattgaatttgccaatgaattcttaaatatgacaccaaaagcacaaataacaaaagaaaaaatagattaaaatacggctataatttaaaacaaaaaagaaaaataagttttggcaaggatgtggagagactgaaaccttcacaccctgctagtacgaacgctagtgagaacataaattgttcaactgctgtagaaaacagcttggcagttcctcaaaaagttaaatatagaattaacgtatgacccaacaattccacttgtgtgtgtgtgtgtgtgtgtgtgtgtgtgtrtatatatatatataaaatttcttttcaaaagaattgaaaacaggtactcaaatatatgtacacgtacgttcatagcagcactatccacaatagctaaaaggtggaaacagtctgaatgtccatcaactgatgaatgtataaaacgtggcatatccatatagtattattataaattggaatatacaatatggaacatgtatatgaatattattcagccataaaaaggaatgaagtactgatgcatggtacaacatgaatgaaccttgaaaacattatgctaagtgaaaaaaggtacgcacg

SEQ ID NO: 163113 - DNA, 601 bp, Human
aacaaatggtgctggaaagactagacatctatatgcagaagaatgagctgaagccctatttcataacatatacaaaaattaacccaaagcaaagactgacatgtaagagcaaaaactataaagctcttagaagaaaacaaagataaatcttcattacattgaatttgccaatgaattcttaaatatgacaccaaaagcacaaataacaaaagaaaaaatagattaaaatacggctataatttaaaacaaaaaagaaaaataagttttggcaaggatgtggagagactgaaaccttcacacyctgctagtacgaacgctagtgagaacataaattgttcaactgctgtagaaaacagcttggcagttcctcaaaaagttaaatatagaattaacgtatgacccaacaattccacttgtgtgtgtgtgtgtgtgtgtgtgtgtgtgtatatatatatatataaaatttcttttcaaaagaattgaaaacaggtactcaaatatatgtacacgtacgttcatagcagcactatccacaatagctaaaaggtggaaacagtctgaatgtccatcaactgatgaatgtataaaacgtggcatatcc

SEQ ID NO: 163114 - DNA, 601 bp, Human
caatgcaaacacatgaccggaataatgtatagtatttagcattcatttctcaaaactcctttgctttcctaaaatttttagttatttagaatacaaatagtgagctaatttccataaattatatcaaggccacagattgttcaaatgaatcatccttgtcttctgctatggggtggtggtataaaccctggattaggagtcaagactccagtgcaagactctgactctggcccttcctttgctaactaatttgcttcctttgggcccttcccctgcccctcaggaaactggagattatagkatctgcccttcatttataacaacttatctccattgttttgagagctaaatgagagaaagttatacaaatgtaatgtagtatacattaaaataagagtcaaggctgaaaggaaaagctaaaagattctgatgatcacagaaaactcaaatgtttcatacaaaaactcttgctgccaatcttgagggaatgtggtaactgtctttgaattttatctcatgttaaaattttataatttatttaaaataaaagtaattttacaactttcttaaaccttagttttctactctgtagaatattcac

SEQ ID NO: 163115 - DNA, 601 bp, Human
caaagtacacatcactatcaaacctttagggattttacaatgatcataacaggtattactatattactgttgtatatgcagaaagaataaacagattgctttccatattgacatatatgtattgctctaaccttatttgccacaattcaaagtttatgacaaaattagtagatggctaatccatgataaaacactgagtaaacttaaagtatgattaatatgctttacatcattacatccaataagatagacatttgttctcaagtaaatttggcttagacaccactacactattccaatrcaaacacatgaccggaataatgtatagtatttagcattcatttctcaaaactcctttgctttcctaaaatttttagttatttagaatacaaatagtgagctaatttccataaattatatcaaggccacagattgttcaaatgaatcatccttgtcttctgctatggggtggtggtataaaccctggattaggagtcaagactccagtgcaagactctgactctggcccttcctttgctaactaatttgcttcctttgggcccttcccctgcccctcaggaaactggagattatagtatct

SEQ ID NO: 163116 - DNA, 601 bp, Human
ctaggtattctttataataaacattcttttagaaacaatacaataaataaacaaataaatgagctatgcctgagacatcaatttacaataccactgaatagttttacttttgtctctgaaaaaaaaacataagaaaattggatatgagtcaatataatactataaaattttgtttttcccattatttaacttgtattttatcttccttaattttcttataagtctatttgtggaagaaatgtgagggacttactgctatccttcaaatactttccaaatgctatatgaatgttctgttccyaataaatatttaaacataagttttgagactcattaacctcaggcaaagtacacatcactatcaaacctttagggattttacaatgatcataacaggtattactatattactgttgtatatgcagaaagaataaacagattgctttccatattgacatatatgtattgctctaaccttatttgccacaattcaaagtttatgacaaaattagtagatggctaatccatgataaaacactgagtaaacttaaagtatgattaatatgctttacatcattacatccaataagatagacatttg

SEQ ID NO: 163117 - DNA, 601 bp, Human
agctctaagataaaacagaaagaacatcactaggtattctttataataaacattcttttagaaacaatacaataaataaacaaataaatgagctatgcctgagacatcaatttacaataccactgaatagttttacttttgtctctgaaaaaaaaacataagaaaattggatatgagtcaatataatactataaaattttgtttttcccattatttaacttgtattttatcttccttaattttcttataagtctatttgtggaagaaatgtgagggacttactgctatccttcaaatactytccaaatgctatatgaatgttctgttcctaataaatatttaaacataagttttgagactcattaacctcaggcaaagtacacatcactatcaaacctttagggattttacaatgatcataacaggtattactatattactgttgtatatgcagaaagaataaacagattgctttccatattgacatatatgtattgctctaaccttatttgccacaattcaaagtttatgacaaaattagtagatggctaatccatgataaaacactgagtaaacttaaagtatgattaatatgctttac

SEQ ID NO: 163118 - DNA, 601 bp, Human
tccaatcaacaaagtcatgtccctattgcctcaggacaataccgttacccccatccaccacacagaagtttgtatagtgattgacagaaaagaggcaacttttaaaaataaattctgattttttttaaagcattgtcactgattatggaacaacctacataacacaagcatggacacttttaaaaatctagtcttttagtcttctgtttaaggattagagaaaaccatccttttaagctataaatgacactaaactagtaagataaaacccaaatcaaggtgtcattcattagatagatgytgtcaacaagataccgtaaaattaagattatatatcacagtatgagttactactgtcttagtttcaacagcaaaatgtaaatgcccagtgtaaattactgtgtgccaaatggattgaatcatgaggacttcaacttattgccttaaaccatttctgtaaatttataaacaaggttccacagaatttattttttcatccaaggctttcatattactgggcatatcttcataatcaaaaatagaaaaatgcgtgttaaatgtttagttcactatgtatttcagagaattatcatgaatgtca

SEQ ID NO: 163119 - DNA, 601 bp, Human
aaaataaaaaaaaattagctgggtgtggtggcgcgtgcctgtaattccagctactcgggaggctgaggcaggagaatcgcttgaacctgggaggtggagattgcagttagccgagttcgtgccactgcactccagcctggcgacagagcgagactccgtctcaacaaaaaaaaactctggttttaagagtggtcattaacacgtgtggaaaaaattccaaacttgagcaaagcaaatgcataacatttccagtcacagtcatttagcacagtgaatactaaagtacttgataatttgacamaacttaatttcacttgtgcaggagttgatcaatctggactaaaggaactgcttgacacagaggagcttaaaaaagaatactgaactgactgctatttttaacttactttcagttatgctcacatttcataatcaaaacattagatagtatattaaaacagtatctttagagcctgaaagtttaatcactatcaaaagcagttcaaggattcttaacatggagcacatggagacctagggaatccacaaataaacttggcaagaatctgaatccccagaagtcatacgttaaaaaaaatag

SEQ ID NO: 163120 - DNA, 601 bp, Human
tctttaagagtcacaaaaaaaaaaaaacaaaacaaaacagctacttactaacattttcccgagtataagctataatcttaagaaagttacagagcaataaaaaaatcaccaatggtttcatgatataaatttgttagttctttctagtgtttccttaactacaatgccttcaatccctagaactgtaaagactttcaaaatataaattcatttgcccaaaattaaccaaactgacagagacataatgtgaaggtattgaaaactaaaaaaaaaattgaaaatctaaagacaacatagccarttgttttaatgcaaaatatgtcaaccttagattctgaaaccagtatctaaaattactttaaattacagtagaatcctaattattcagaagcatctcagttactggccaattcaaaaccaaaaatgtctgtgcctaagtactcaagaaattttagaatagcttcattcaggtttttttttttttttgagacggagtcttgctctgttgcccaggctggagtgcagtggggtgatctccgctcactgcaagctctgctgctcccgggttcacaccattctcctgcctcagcctcccgactag

SEQ ID NO: 163121 - DNA, 601 bp, Human
ttctgattaaaaaaaaccaagaaaagcggcaggctcagtggctcacgcctgtaatcccaacactgtgggaggctgagacaggaggatcacttgagcccaggagttcaaaaccagcctgagcaacatagggagaccctgtctctatgtaatatatattatatatgtatatatattttatattgtacataatatatattttatatatatataaaaaatttttttaaattagttggggatggtagtgcatgcctgtgatcccagctactcgggatgctgaggctgcagtgagccatgatcatgcctgggcaacacagtgagaccctatcttaaaaaaaaaaacacagccaagcgcagtggctcatgcctgtaatcccagcactttgggaggccaaggcgggcgaatcacaaggtcaggagttcgagaccagcctggccaacatggtgaaaccccgtctctactaaaaatacaaaaattagccgggtgtggtggcgggcacctgtaatcccagctactcggaaggctgaggcaggagaatcgcttgaacctgggaggcagagattgcagtgagccgagatcgtgccattgcactcccagcctggg

SEQ ID NO: 163122 - DNA, 601 bp, Human
tactgggtcaaattcatccacttcatgtggacagcttgagtctccgaaagaatgcgacaatacattcaaagaacataaatgctggaatcagttcttgctagcaacacgagccagcaatgttattatgtgaaactgcatccaaaaaaaaaaaaaaaaagctacaaagtcataaaaatagccctgagaataactaatttgaatagtgtaagtaaacagttttcttgaggaaggaaatcgggtggctggaacacaggtaggagacaccctgcaagtcaaacaagcttaatcaaaacaagagctaaaaaaaccctataaaacccctaatctgacaagtctgaagtcaagccacatactgccacatctcaagggcttcttacccatccctatctatcctgggctgggccaggccaggcagttttctaaaaaatctctgccttaggaaactagtaagtcagatataaagtcaatcaatgtctctcactttccttctacacttttgtgattctggaggtaggactctgccaggggctcctagtttaagtctgcagataagggagtgttaagggaaaactgcgagagacgacagtgctgtctcccctct

SEQ ID NO: 163123 - DNA, 601 bp, Human
cagtcttaagagatccagctggagtaaataactcagcagattttttactcttctgtgatttcagattatctcgtcctgcactactaagccagaagaggaaatgatccagacaactcagattttaatgtaactgaaataagcacaaacttacacactagggctgatgtattacaatagagtacgatggacaataatactgggtcaaattcatccacttcatgtggacagcttgagtctccgaaagaatgcgacaatacattcaaagaacataaatgctggaatcagttcttgctagcaacamgagccagcaatgttattatgtgaaactgcatccaaaaaaaaaaaaaaaaagctacaaagtcataaaaatagccctgagaataactaatttgaatagtgtaagtaaacagttttcttgaggaaggaaatcgggtggctggaacacaggtaggagacaccctgcaagtcaaacaagcttaatcaaaacaagagctaaaaaaaccctataaaacccctaatctgacaagtctgaagtcaagccacatactgccacatctcaagggcttcttacccatccctatctatcctgggctgggccagg

SEQ ID NO: 163124 - DNA, 601 bp, Human
ctttaatatttcacagattatcaattaggtctgaaatttgaacagtcttaagagatccagctggagtaaataactcagcagattttttactcttctgtgatttcagattatctcgtcctgcactactaagccagaagaggaaatgatccagacaactcagattttaatgtaactgaaataagcacaaacttacacactagggctgatgtattacaatagagtacgatggacaataatactgggtcaaattcatccacttcatgtggacagcttgagtctccgaaagaatgcgacaatacaytcaaagaacataaatgctggaatcagttcttgctagcaacacgagccagcaatgttattatgtgaaactgcatccaaaaaaaaaaaaaaaaagctacaaagtcataaaaatagccctgagaataactaatttgaatagtgtaagtaaacagttttcttgaggaaggaaatcgggtggctggaacacaggtaggagacaccctgcaagtcaaacaagcttaatcaaaacaagagctaaaaaaaccctataaaacccctaatctgacaagtctgaagtcaagccacatactgccacatctca

SEQ ID NO: 163125 - DNA, 601 bp, Human
tacttatgagaatctgcaagttcaccctctatatatataagtgggcatttttatttatcactttttttgtagagatgggtttctctatgttgcccaggctggtctcctgcctcaagcaatcttcccgccctggcctcccaaagcaatgggatgacagacgtgagccaccacacttggcccaataagtgagcatttaaaaaatgttaccaccagcctgggcaacatagcaagaccccatctctgcaaaccaaaaaactaaaaaaattagctgggcatgctggcatatgactatagtcctagygtacttgggaggttgaggtgggagtactgcctgagcccaggagttcaaggttacagttagctgtgatcataccactgcaccccagcctgggcgatagtgagaccttgtctcttaaaaacaaaacaaaacaaaacaaaaagttaattatcatcaatggacattttcaagtgcataccccttgcttcattttatctgtaagccctgtgaattttactacatgattttgtataacataacattcttagaaacatataatgtctcattatagtaaaactgactgcctattttctagctgggatt

SEQ ID NO: 163126 - DNA, 601 bp, Human
ttagaatattctctgaaacacaaaattgcaatatatgaccagtaatatcaactgtagatcttttagctcatctcaaacaagagctgtctgataactcagtaactgccaatttcattactgaaaaataagtgttaaaaaactgagtgatgcttcaatgatacctactctgtaaactccaacctgtcactacatctttaagcgattctaaaatattaacaaacagggttctggacaaagttgtgtgttatagaaaaaaaatttaaataaagaaaaaaattatgaaaaatttgtaagataaaamaaacgggctccttttttgggatcactaataaagcaagtcaattcttcattatgtacacaactgtaagttacttatgagaatctgcaagttcaccctctatatatataagtgggcatttttatttatcactttttttgtagagatgggtttctctatgttgcccaggctggtctcctgcctcaagcaatcttcccgccctggcctcccaaagcaatgggatgacagacgtgagccaccacacttggcccaataagtgagcatttaaaaaatgttaccaccagcctgggcaacatagcaaga

SEQ ID NO: 163127 - DNA, 601 bp, Human
ggcaggcaggggaatcacttgaggctaggagttccagaccaagctgggcaagcatagtgagaccccatcactaccaaaaaaaaaaaaaaaaaaaagttgacaaatgagatcacataggaaggccatagttgtttacagaaaaacagaataacccttaaatgaattttgtgattctattatgtttaaaagcagtccaaggattgaatcccaaacagaagtgagtttagggccatgcataatagaaagcactgtagactatgttcaggaaattagttaatgtagactatgttcaggaagttasttactaaaatagacaggtaagttggtaaaggaatagggtatggatttaaatgtccacaaaattaagtctaaaggaaggtatctcatcttatagaacgcatacaatagttaatgctacaaatatttttaaaaggaatcaaatatcacatcaaattgatctaattatcaacagatctactgggtcttgaagagcaaaccctagactcacactactgtaaactatactgtagttagtcaattataacaactgacattctgtcaacctatctctattaaccaggactcttatttttaagttgaa

SEQ ID NO: 163128 - DNA, 601 bp, Human
ccccaggtcttcatgtttttagaaagccataaattgggtgactggaaaaaaaagaaagccagggcccaagagtcccaatccaccactcaccagttacacaaagtagtagcagctctgtatctactataaaaagctacagaaaggcctccaaaagcgtatcccaaaatagcttcaaaatcactctcaatacacagtggcagagataggtatggcatttactttctcatcttcagttcaccctcaaaatcagatattctttgtaaagaatgtacatattaagcacatcatgtgacctgatcargcctagatttaattggaacacattctaaaataagctttcgtgtgtagaaaacattttgaaatagtccttataatatatgctgctctcaagttctaatggactgacacaaaaacatgcataattatttcactaaactgttggtttccctaacaaacccacagcataaactgtgggaggggaaaaaaggaataaaatccaaactaaatgaaacaagtctgaaatggcagcatctgaaaaagtctcaaccacagaaactgatgtcaacttttttcctaaaaaggcaaaaactggctaggaaat

SEQ ID NO: 163129 - DNA, 601 bp, Human
aggagttcgagaccagcctgatcaacatggagaaatcccatctctactaaaaatacaaaatcagccgggcatggtggcacgtgcctgtaatcccagctactcgggaggctgaggcaggagaatcatttgaagccaggaggcggaggttgcagtgagctgagatcgtgccattgcactccagcctgggtgacagggcgagactccatctcaaaaaaagtctgggcatggtggctcacacctgtaatcccagcattttgggaggccgaggcgggtggatcggctcaggtcaggagttcgagaycagcctgatcaacatggagaaatcccacctctactaaaaatataaaattagctaggcatggtggcgcatgcctgtaatcccagctacttgggaggctgaggcaggagaatcgcttgaaccccggaggtggaggttgcggtgagccccgatcatgccattgctctccagcctaggcaaaagagcgaagctccgtctcaaaaaaaaaaaaaaaaaaaaaaagtcatagtccttgtaatgggcccccaaaagacgctctatatgatgccctcactccacctacctctctgacttatcttcagc

SEQ ID NO: 163130 - DNA, 601 bp, Human
ccctttaaaagtcatagtcctgagccgggtgcggtggctcacgcctgtaatcccagcactttgggaggccgaggcgggtggatcacctcaggtcaggagttcgagaccagcctgatcaacatggagaaatcccatctctactaaaaatacaaaatcagccgggcatggtggcacgtgcctgtaatcccagctactcgggaggctgaggcaggagaatcatttgaagccaggaggcggaggttgcagtgagctgagatcgtgccattgcactccagcctgggtgacagggcgagactccatytcaaaaaaagtctgggcatggtggctcacacctgtaatcccagcattttgggaggccgaggcgggtggatcggctcaggtcaggagttcgagaccagcctgatcaacatggagaaatcccacctctactaaaaatataaaattagctaggcatggtggcgcatgcctgtaatcccagctacttgggaggctgaggcaggagaatcgcttgaaccccggaggtggaggttgcggtgagccccgatcatgccattgctctccagcctaggcaaaagagcgaagctccgtctcaaaaaaaaaa

SEQ ID NO: 163131 - DNA, 601 bp, Human
aaatgtcattttgctagacaccaaaagtaaaattagaaagttcatctcttagaactacgcataatagaacagctccaatctcccaacagatttagcttataaaatgcaaaattcaaaaaaataccatttaaataattacaaccagctgaatgaaactgcaagcgaatactaatgatgttatcatacattttggctacaaatgtctacaaatatgttaataaaattagcttaataaaactgattttttactcaagtaaaataaagtaacattaggattacataagtaaggcaacttgctctaaactcaaccaaaaccaagctatttaaaaagtaaaattagcttttttggtggttttttttggcttgtttgtttgtttttgagacaagatctcactttgtcactcacgctggagtgcagtggcaagatcttggctcactgcagcctcgacctccctgggcccaggtgatcctcccaactcggcctcctgagtagctgggattacaggtgtgcgccaccacacctagctaatttttgtatttttagtagagacggtatcaccctgttggccaggctggtcttgaactcctggcctcaagtgat

SEQ ID NO: 163132 - DNA, 601 bp, Human
tcctgcagttgtaggggcaggtcaaggtttccttagagcctagaacgagcctgacttattggtcagagtgaacatgtgtataggaccttgctaggcttgacccaatcagcagggctgggggtggtatcaggtgtctcagccacttggagtttggatctgctgccaaggaaaaaccgtatattttatgaggagttctgaaattctctgccagcatctcatctgccctctgctgtacagctcacctcaagattttccctgaggctgtggctctcctgtcctgtcaccagtcctgcttctttctttttttttttttttttttgagacagaatctcactctgtcgcccaggctggagtgcagtggcgcgatctcggctctctgcaagctccacctgccaggttcacaccattctcctgcttcagcctcccgagtagctgggactacaggcgcccgccaccatgcccggctaattttttgtatttttagtagagacggggtttcaccgtgttagccaggatggtctcgatctcctgacctggtgatctgcccacctcggcctcccaaagtgctgggattacaggcgtgagccccatgcctggcctc

SEQ ID NO: 163133 - DNA, 601 bp, Human
gccaaggaaaaaccgtatattttatgaggagttctgaaattctctgccagcatctcatctgccctctgctgtacagctcacctcaagattttccctgaggctgtggctctcctgtcctgtcaccagtcctgcttctttctttttttttttttttttttgagacagaatctcactctgtcgcccaggctggagtgcagtggcgcgatctcggctctctgcaagctccacctgccaggttcacaccattctcctgcttcagcctcccgagtagctgggactacaggcgcccgccaccatgccyggctaattttttgtatttttagtagagacggggtttcaccgtgttagccaggatggtctcgatctcctgacctggtgatctgcccacctcggcctcccaaagtgctgggattacaggcgtgagccccatgcctggcctccagtcctgcttctttgggttcagccctatgctataaaatctcaccttcctcaggccttttgcagacacatcagatcctctggctttgtatctgttcttggtgctttggacaccacctccaccccaatgcctttgtttttctccaggccctctttcttcatt

SEQ ID NO: 163134 - DNA, 601 bp, Human
tcagttacggtgcccactccaacctctgcatcaaccagcttgtacgcaatgggaatgaggcccagaaagagaagtatctcccgaaggtgaggaaatggaaatgtaatacacgctaatctcacagtgcaaccaccaactaaaagataccctctccccttgggggccagtcagacctgctttctgtagcatgctgccatgaaccaaatgtggttaggaaggggccatggattgctttaaaatacttgagccaaaaataataaaaataggaccagaactcttgcattgaacaacagacagacarcatttgaagagaactctaagaaatggaagagtaggactagcttcctttgcaaagggaatggaaaaaggagaggcattttcagccttgtagccattgggcttagaagagacttctaggactttaccgataccctggtctgagagcgaagtttgaaggggtttaatgtggacaggaagaggcagtaccagtgagctgctctagggtactctgaggttgtaacaaggcctgttgggggttttccttgcagctgatcagtggtgagtacatcggagccctggccatgagtgagcccaatgcagg

SEQ ID NO: 163135 - DNA, 601 bp, Human
accaccaactaaaagataccctctccccttgggggccagtcagacctgctttctgtagcatgctgccatgaaccaaatgtggttaggaaggggccatggattgctttaaaatacttgagccaaaaataataaaaataggaccagaactcttgcattgaacaacagacagacagcatttgaagagaactctaagaaatggaagagtaggactagcttcctttgcaaagggaatggaaaaaggagaggcattttcagccttgtagccattgggcttagaagagacttctaggactttaccgayaccctggtctgagagcgaagtttgaaggggtttaatgtggacaggaagaggcagtaccagtgagctgctctagggtactctgaggttgtaacaaggcctgttgggggttttccttgcagctgatcagtggtgagtacatcggagccctggccatgagtgagcccaatgcaggctctgatgttgtctctatgaagctcaaagcggaaaagaaaggtgaggccactctcaacttgggagccaaaatgggcagaggtacagacattatcagggtaatggagcaacaattgtgggtggcccctg

SEQ ID NO: 163136 - DNA, 601 bp, Human
tggagccgtcctcagcgccaggccacacaaagaggtctagaaaggggaggactaaaaggaggtcaggacatgacggtcagggtaccattggtggatctgatgaatgtggccatgggagactgaggtgtgggtgggatgcaagtggagactgcccctgcaacagccttgacaacagaagcaagaaggaagcagagcaggagttccaatgaaaagttaggagtttgggtttgtttttagaaatgagagaactgagcagattttttggtcagaaggaaaaaaaagggaagaaaaaagaaaataragggagaaattgaaaagtgtgggaatgagtgggcagaacacaatggtgagctggggcagaagagagaaggatgggttacaggtgatggtgcaggaaccacttgcctaacgatcatgaggaggaagccaggggccctgtgaaggctggggccacgagtgggggagttggcaagagtttcatgagcgagtattgtaaaggtttgcggtaccctccatagagagggggaaagtagctgtctagggttggagcagtagggacctggctgagattggaaatctcaaggttgcgtgatgccaccct

SEQ ID NO: 163137 - DNA, 601 bp, Human
ccagaggcctttcctttaccaggcccccttggggctaatctgcaaccaggaccaccttttgtttcctgtaaagggtatgcctggctttagcacctctaagaagctggacaagctggggatgaggggctctaacacctgtgagctaatctttgaagactgcaagattcctggtaagtagcaccgggaatcggggagcccctctcctgacccccttccaggctgatctggctgttctcaagttgagaaagcctctgggttagagaggcttggcattgttagcgcttcagtgacatgtggctargctgtgagctggggctgctggacagcgctccttcctggccagggccctgcagcggcatgcctaactggcatcacacactccgcatagggtctgtactcagtagccggaggagaagggtcagacctaccctttcccattgatgtccttcagtcttcctgtactttcgcccatccactgcatgtgagtaactcattaactcacgtttttgtaaaatattttaaaaatgagttattcatttttagcattaatgatgctaagaaaaaaaaacaaaacatctgaatccactgatggaatcccgac

SEQ ID NO: 163138 - DNA, 601 bp, Human
cgcccatccactgcatgtgagtaactcattaactcacgtttttgtaaaatattttaaaaatgagttattcatttttagcattaatgatgctaagaaaaaaaaacaaaacatctgaatccactgatggaatcccgactcagtagagagaaggcagttctgcttgagtatgagtattttctcccctgaggtgtaactgaaatctgacatggtggagcactgtgggagagccagcacagccatcatgtactaaccagaccaggggcatggatttgttgtttggggtttttttttgttttttttttttgtttgtttgtttgttttgagaaggagtcttggctctgtcacccaggctagagtgcagtggcgtgatctcagctcacggcagcctccacctcctgggttccagtgattctcctgcctcagcctcccgagtagctgggattacaggcatgcgccaccctgcccagctaaattttttgtttgtttttttgagatggagtgtcgctcttgttgcccagggctggagtgcaatggcgcgatcttggcttactgcaacctccgccccctgggttcaagtgattctcctgtctcagccttctga

SEQ ID NO: 163139 - DNA, 601 bp, Human
tttttttgtttgtttgtttgtttgttttgagaaggagtcttggctctgtcacccaggctagagtgcagtggcgtgatctcagctcacggcagcctccacctcctgggttccagtgattctcctgcctcagcctcccgagtagctgggattacaggcatgcgccaccctgcccagctaaattttttgtttgtttttttgagatggagtgtcgctcttgttgcccagggctggagtgcaatggcgcgatcttggcttactgcaacctccgccccctgggttcaagtgattctcctgtctcagccttctgagtagctgggatgacaggcacacaccgcccagctaattttgtatttttagtagagacagatggggtttcaccatgttggccaggctgctctcgaactcctgacctcaggtgatccacctgtctcagcctcccaaagtgccaggattataggcctgagccaccttgcctggccaggggcatggatttgatcaacagttaggtttgctgtctgcctcagccatataccacgcctatcactgacagcccaaaaaagtgtactttaattacagggagcatccagggagggggagctgt

SEQ ID NO: 163140 - DNA, 601 bp, Human
cagtggcgtgatctcagctcacggcagcctccacctcctgggttccagtgattctcctgcctcagcctcccgagtagctgggattacaggcatgcgccaccctgcccagctaaattttttgtttgtttttttgagatggagtgtcgctcttgttgcccagggctggagtgcaatggcgcgatcttggcttactgcaacctccgccccctgggttcaagtgattctcctgtctcagccttctgagtagctgggatgacaggcacacaccgcccagctaattttgtatttttagtagagacasatggggtttcaccatgttggccaggctgctctcgaactcctgacctcaggtgatccacctgtctcagcctcccaaagtgccaggattataggcctgagccaccttgcctggccaggggcatggatttgatcaacagttaggtttgctgtctgcctcagccatataccacgcctatcactgacagcccaaaaaagtgtactttaattacagggagcatccagggagggggagctgtgcagctccttctttgttgacaggaaaaaattcagctagcattaaaggcaggtcagtagtgtcaac

SEQ ID NO: 163141 - DNA, 601 bp, Human
ccacacctcccaaggccatccagtctcctggctttactgggtggagaggtgctcagcagcttctgtcactagctctgaatggcctgtctcctggacaaagaagctttcacggactactctgcagggaggtgacattggaccagagctgactccacctgggggaaagagtaattctctggtttctttataggtgcctgtgtagaaagagtcagggagggattgggtgacttctagaccaattaacttttcttctttcccatccaagggagtccagagagggaagggaaagatctaacaactstagcctttgtggttggcctcgtggatggggtgggagtcctggcagctccacttctgactggaaggggttcacttgatccttttctttcacctggaaccttagttgaataaaggtcaagtgacatattttagtgccttacttgagagccatgtttccaaatctagtacctttgataaaagtgaggaggctgtggacagctctctccctctgaccagcacttatcctggcagctgccaacatcctgggccatgagaataagggtgtctacgtgctgatgagtgggctggacctggagcggct

SEQ ID NO: 163142 - DNA, 601 bp, Human
cacctggaaccttagttgaataaaggtcaagtgacatattttagtgccttacttgagagccatgtttccaaatctagtacctttgataaaagtgaggaggctgtggacagctctctccctctgaccagcacttatcctggcagctgccaacatcctgggccatgagaataagggtgtctacgtgctgatgagtgggctggacctggagcggctggtgctggccggggggcctcttgggtaagtgtgagaggcttgagggaagctgggctctgtcggcctcctcggcaggtgacccaccatragcagcagcagccttccccttgcggggccaaagggagctgcctcttggccctgctctctcctgggagatgaaaggaacctcctcttcccatgttgaatttcttcccacagtggggaaatatcattaagtaacagacaaaaggcctgaggagcagggtggcttactcggctgtgaaacgacacctgggctgtcacgcccctgcacctctggccagtcagtgccgtaactgtggcaagactttctgaagttgcttttctcctccctgggattctggccttcccacgctagcattttgccacc

SEQ ID NO: 163143 - DNA, 601 bp, Human
agagtgaaactccgtctcggaaaaaaaaaaaaaaaaaaaggccgggcacggtggctcacacctgtaatcccagcactttgggaggccgaggcaggtggatcacctgaggtcaggagttcgagaccagcctgaccaacgtggtgaaaccccatctctactaaaaatacaaaaattagctgggtgcagtggtgcgcgcctgtaatcccagctactcaggaggctgaggcaggagaatcacttgaaccttggatgcggaggttgcagagagccaatatcatgccactgcactccagcctaggcsacagagcatgactccaaaaaaaaaaaaaaaaaagctaaatggaaatttctagaaatagttcataagtttcaaatccacaccatcctgaatagcttgaagtgttgtgccatgctgctctgtcatgtttggtacgtgaatcgtccctttgtgcagcctatctatgctatgtgggctacctgcccgttagtagtcacctagggtatccaatcagctgtcctgatatcagagtgcctgtgttcaagtaactcttattttgctcagtggccccagattgcaagagtagtgatgctggcatgtcat

SEQ ID NO: 163144 - DNA, 601 bp, Human
ctctgtcatgtttggtacgtgaatcgtccctttgtgcagcctatctatgctatgtgggctacctgcccgttagtagtcacctagggtatccaatcagctgtcctgatatcagagtgcctgtgttcaagtaactcttattttgctcagtggccccagattgcaagagtagtgatgctggcatgtcataatagttctattttagtatttgttattattgttgatctgttactatgcctagctcataaattaaactttctcataagtatgtatgtatagggaaaaaaacaacatatatatgggkttcggttctatctacggtttcaggcatccactggggtcttggaatgtatcctccaaggataaggaaggactagtgtattccccacacccctccctcttgctaccttttgctgcttttctttaatcaccctctcctcctgtggcctgtttctatatacttggcattctgtttgctttctttgttttgtcaatcacttcctttcttctctgcccaaaccctggttgcaggtggcaatggctacatcaatgactttcccatgggccgctttcttcgagatgccaagctgtatgagataggggc

SEQ ID NO: 163145 - DNA, 601 bp, Human
atgtttggtacgtgaatcgtccctttgtgcagcctatctatgctatgtgggctacctgcccgttagtagtcacctagggtatccaatcagctgtcctgatatcagagtgcctgtgttcaagtaactcttattttgctcagtggccccagattgcaagagtagtgatgctggcatgtcataatagttctattttagtatttgttattattgttgatctgttactatgcctagctcataaattaaactttctcataagtatgtatgtatagggaaaaaaacaacatatatatgggtttcggtwctatctacggtttcaggcatccactggggtcttggaatgtatcctccaaggataaggaaggactagtgtattccccacacccctccctcttgctaccttttgctgcttttctttaatcaccctctcctcctgtggcctgtttctatatacttggcattctgtttgctttctttgttttgtcaatcacttcctttcttctctgcccaaaccctggttgcaggtggcaatggctacatcaatgactttcccatgggccgctttcttcgagatgccaagctgtatgagataggggctgggacc

SEQ ID NO: 163146 - DNA, 601 bp, Human; identical to SEQ ID NO: 30732

SEQ ID NO: 163147 - DNA, 601 bp, Human; identical to SEQ ID NO: 30733

SEQ ID NO: 163148 - DNA, 601 bp, Human; identical to SEQ ID NO: 30734

SEQ ID NO: 163149 - DNA, 601 bp, Human; identical to SEQ ID NO: 30735

SEQ ID NO: 163150 - DNA, 601 bp, Human; identical to SEQ ID NO: 30736

SEQ ID NO: 163151 - DNA, 601 bp, Human; identical to SEQ ID NO: 30737

SEQ ID NO: 163152 - DNA, 601 bp, Human; identical to SEQ ID NO: 30738

SEQ ID NO: 163153 - DNA, 601 bp, Human; identical to SEQ ID NO: 30739

SEQ ID NO: 163154 - DNA, 601 bp, Human; identical to SEQ ID NO: 30740

SEQ ID NO: 163155 - DNA, 601 bp, Human; identical to SEQ ID NO: 30741

SEQ ID NO: 163156 - DNA, 601 bp, Human; identical to SEQ ID NO: 30742

SEQ ID NO: 163157 - DNA, 601 bp, Human
gagcgcctggtcagggaagggtcggcaccagaggcaagcccttctgggagcagctgatttggatggaagctctgtgcacctgagagggggagtgtggggactgcacggcctctccagtgccccgaggacaaactgatgctttgtgagtgctctgggccctcccggacttgccagacacagggagggtgcagtgggtggggtctccagccaaggaaagcccgctctgtgcacaactcctaaggatgaccaaaaagtcccctgccctggaggagcacatgtgctcagagtcaggaggaacccrtaagtgtctctcatgccagtgaattcccacacctggctcctggatgaggagaatgacccagctgtgggggtatctcatgctgcctcacaaaaggtgactctgtgcctaggagtcttccatgcatgcagagctgagcaggggctgctgcccagttggggtcagaggggcggaggctgtcgagcactaggtagacagcaggccagcagcgggcagcaggttgggccaggagggagcagagagtaggggccagggcaggctgagcaggaaaggaaaaggctgcctggggtcctgagggctcag

SEQ ID NO: 163158 - DNA, 601 bp, Human
aaagctcatcaggaggcatctggccgcctgcacctaccgggcctcaaggagagagcttatttctgggagcctccttggtagaaagaggtggactagccagcaggttggggaggagcattgcaaatggaagcttctgagggcagaatgagttctgaacttgctgaagccaaggctggccctcctgcccagggcgagcagtctgcctgggcctgggaagttgtccccttctgaggaggtgccctccaccccaccagagctcagccctaggggccaggaagggctaaagcgagaagagtgagaygtgagataaaggggaccgtgtctcttcctgggagggtgtggggtccaggcagcaccttgttctggcgcacaggctgccaagcagatgacagccatggcctgactactaggtgcaagcactggtggcaggaagagggggtggacaaagcaggacagagctcttgccctggggatgctcatagccctgcagcagagcagtggaaaggaaagctgagctgagcgtggggccaaccgcgccagaaacaagcggagccacaaagccaccatcagcccccaggtggcttcgtccttttgccaactc

SEQ ID NO: 163159 - DNA, 601 bp, Human
acaaagcaggacagagctcttgccctggggatgctcatagccctgcagcagagcagtggaaaggaaagctgagctgagcgtggggccaaccgcgccagaaacaagcggagccacaaagccaccatcagcccccaggtggcttcgtccttttgccaactctgggtccaactcatcgctgaagttggcagccatgacccatccagcccagataatttataaatttacaccaatactgggcaacggttcttaacatagaactttataaagatggacaaaaaagataagttgagaatgacaaacraaggaagaagcagcttctatctgcagttgcaggaggaggtgaaggctcggggagatagaccagggcgggaagaggcaggatggtggttggttaacatgaagtcagcagcatgagcctcaggcccggtgctgcctcttcctggtgactcgggcaagttacttcatgtctctgggtctcaatttcctctcctgtccaacagagataattatagtacctatgagttagggttgttgagaggattaaataagataataagtgaatgctctgaatggcatgactggcacatacgtacatgttcag

SEQ ID NO: 163160 - DNA, 601 bp, Human
acaataatgccaggtctatttttttcccaaatagcatattgtttgtccactgaggctttctaaggaataacttgagactcctctttctggggtctagacttggaggtcttgaggacttgaagtgggctgcccctagtgaagggatcgagagccgggctgtggccctggccctactccttttggggactggaagcttttttcacatgctggtcctaactgcatgaggaactgtgttctgctgagccccatctaaagcatacacttggtgatgtggcaggcagaggggccagacaaggccacrgcaggctcctggatcactctggcaagtagcttagaaatgcctagtaatcgtgggcaaggtgcagtggctcacgcctgtaatcccagcactttgggaggctgaggtaggcagatcacaagatcaagagatccagaccatcctggccaacatggtgaaccccgtctctactaaaaaatacaaaaaattagctggacgtggtggcgcgtgcctgtagtcccagctacccgggaggctgaggcaggggaatcgcttgaacccaggaggcggaggttgtagtcagctgggatcgtgccactgcac

SEQ ID NO: 163161 - DNA, 601 bp, Human
ggtgggattacaagcacccaccaccatgcccggctgatttttgtatttttagtagagatggggtttcactatgttggccaggctagtctcgaactcctgacctcaggtgatccgccgacctcagcctcccaaagtgctgggattacagatgtgagccaccacacccagcctgctttttctacaaaggattatctgttctatgaatttaggaaaggtaatcctaaagcttattcacctaagaaaaacaaggcaaccccagagcatgacaggctttcttgggctgggggaactcacatgtgaraaaacaggttccctcataactacatgagaggccgcaactgcctcagccccagcaaagggacacctctgctggccagcatttcctacaaaacctcatcacgacacatcaggcagggcagagacccaagtattcacatagggccagtgatgactttttttgacacctgtggattctccgtggcaacctattccccaaaagtgctgcctcggtcagccaatcccagtgtctctctgcctaggcaacaatctcttgtgctctggtctgcccacagcctccatgcactcagctccttgggcctct

SEQ ID NO: 163162 - DNA, 601 bp, Human
gcaggccaaccacccctgcagcagtcaaggggttctgtccggtgtgtgccagaatgctagggaagagaggaccctgagaaggatggcagcatggcacagacacgccatgtggcagttagacaggtcatgccttctgacccagggcacatgcagaggtccacagactctgaggccagctagttagtgttcccagggggctgcacagcccagagcctgtgagttttgtgcatctggagctaaggtgttctgcccaaagtgttggaggtgggcctcaggcaacaaataccctgcttcctcacayccccttttcttccttggagcttgggcctgggccctcacctagtcaggcacaggcctccactcccccacactcacctgtccttcctgaaagtcagccactgggctccacgcaggggtgtcacagtcagagccctgctccagcctcagacctggggcagtcactggaaactcagaagagagaagacaagacaatgaaagtttcccattcaaggaggcatccagctgttagttctgccagcaaaaatgccagccagagagctaaactgccagcaaaagatatttggatggaactttggaggcc

SEQ ID NO: 163163 - DNA, 601 bp, Human
gaggaccctgagaaggatggcagcatggcacagacacgccatgtggcagttagacaggtcatgccttctgacccagggcacatgcagaggtccacagactctgaggccagctagttagtgttcccagggggctgcacagcccagagcctgtgagttttgtgcatctggagctaaggtgttctgcccaaagtgttggaggtgggcctcaggcaacaaataccctgcttcctcacatccccttttcttccttggagcttgggcctgggccctcacctagtcaggcacaggcctccactccccsacactcacctgtccttcctgaaagtcagccactgggctccacgcaggggtgtcacagtcagagccctgctccagcctcagacctggggcagtcactggaaactcagaagagagaagacaagacaatgaaagtttcccattcaaggaggcatccagctgttagttctgccagcaaaaatgccagccagagagctaaactgccagcaaaagatatttggatggaactttggaggccattaagagcaggcactgcaaagcaattgtagcgaaaagatattaaatgaatccatcacgtctctaa

SEQ ID NO: 163164 - DNA, 601 bp, Human
tgaggccagctagttagtgttcccagggggctgcacagcccagagcctgtgagttttgtgcatctggagctaaggtgttctgcccaaagtgttggaggtgggcctcaggcaacaaataccctgcttcctcacatccccttttcttccttggagcttgggcctgggccctcacctagtcaggcacaggcctccactcccccacactcacctgtccttcctgaaagtcagccactgggctccacgcaggggtgtcacagtcagagccctgctccagcctcagacctggggcagtcactggaarctcagaagagagaagacaagacaatgaaagtttcccattcaaggaggcatccagctgttagttctgccagcaaaaatgccagccagagagctaaactgccagcaaaagatatttggatggaactttggaggccattaagagcaggcactgcaaagcaattgtagcgaaaagatattaaatgaatccatcacgtctctaaaatgagtgtccttaccacagatctggctcttgctgttccccagcccttcccagggtagcccaggatgcacctgggacgggcgccgcagcctgcaatggtcc

SEQ ID NO: 163165 - DNA, 601 bp, Human
cactcccccacactcacctgtccttcctgaaagtcagccactgggctccacgcaggggtgtcacagtcagagccctgctccagcctcagacctggggcagtcactggaaactcagaagagagaagacaagacaatgaaagtttcccattcaaggaggcatccagctgttagttctgccagcaaaaatgccagccagagagctaaactgccagcaaaagatatttggatggaactttggaggccattaagagcaggcactgcaaagcaattgtagcgaaaagatattaaatgaatccatcaygtctctaaaatgagtgtccttaccacagatctggctcttgctgttccccagcccttcccagggtagcccaggatgcacctgggacgggcgccgcagcctgcaatggtccctgcatctgaggagctcctcccaggtcaccaggctccttgggactgtcaggcaggtttagcccccagtgtcagcttgtgtttggggaggatggttttatatattctcgttggcacaggaagcctagtacagatgcagaacctgagggaaaggcaggcagagagagagaggctcgaggttctgctgaggccc

SEQ ID NO: 163166 - DNA, 601 bp, Human
cttgctgttccccagcccttcccagggtagcccaggatgcacctgggacgggcgccgcagcctgcaatggtccctgcatctgaggagctcctcccaggtcaccaggctccttgggactgtcaggcaggtttagcccccagtgtcagcttgtgtttggggaggatggttttatatattctcgttggcacaggaagcctagtacagatgcagaacctgagggaaaggcaggcagagagagagaggctcgaggttctgctgaggcccagggtatcagcagggcacatctgtacagcagccgggyggggacccatggacttttccaaaacacctaaccaggccctagacagtgctaccccctggcgctgggctctctttccggaacccggggtgaacagacctgttgggttgatttagtagcaagtggtagccttgttttctggacgaatcctgggattctactccatggcacatcaaaccaagctccagtgtgcatgcccagggtcggggaggggagctttctccttggtcccttctgcagctgtgagggctgagggttaagaacctttcaccccgtttgggggtgctgctcctccatagccct

SEQ ID NO: 163167 - DNA, 601 bp, Human
cctcgcgtgttacacagaaataggaagggacggtcctcctacccgcaccccagccctcttgtgtctcacgtgacagcctgcctgggcagtgatttttttaaaacacaaatgccttatattaaggtctgagttggtctctccccactgcccgttcaaacattccatggcaccagcagcctctaagcagcagagttgagagaaccagctttggggtcggatacacttccgttcaaattccagctcctcccctcagtaactggcttacttagtctttctggactggataacaaaatactatggrctggtggcttataaacaacagaaatttatttctcacagttctggaagctgagaagcccaagagcaaggtgctggcagatccggtgtctggtgagggcctgcttccaggttcagagctggctgtctttttgctataacctcacatgatggaaagggccagggatctctctgggggcctctttcataaaggcatgaatcccattcatgagggctctgctttcgtgacttaatcacctgccaacaaccccgcctcctaataccctcgtattagtgattaggtttcaacagatgaatcttgggg

SEQ ID NO: 163168 - DNA, 601 bp, Human
tccctatctttcctctttggccctagcccgagcactcagccctggctgttggcactcagatgttacaacaggccccgacagccacaggctgagggataaccgggaagtgcctgccccacccgatgtgcccaccttgctgccctcccagaccatactggcctgccaatgcctctgagatggcaccactccaagagccatgtccccctgtgaaatgtctgttttgggtgtctcttccagagatcctacccaatttgtagaatgggagtgcctggacaattccttcaaccagaaggtctgtgcyagcagccaaggctcctcaaaggaggatgtgcctggagccccctgtgctcagcacggcaacctgggaacaaggccagagggtggcacatggatgctgcaggagacactgtccccagactgctcctgacacttcctgtgctgttgttctgccctttcctcctgggcagggctgagctgggcacggatcagaggagaatagagaagggggagagtcacacacaggaattaatcactcaggacctaccctgaatggatgattcagtgtgtatccccagctgtctcaatgtgtggggagaggggt

SEQ ID NO: 163169 - DNA, 601 bp, Human
cggttattcttgaatacctccagtgatgggggactcattacctccttggtcagtctaacttgaccttctgcctctctcaaggccccaaacccactgtagctcccaaggggtgggaggaacccagggtttcctagagttattctctatagggtgaggatgggacttggctagtcgccattctagggtacctaagcctggattcaaaccaaattgaataccagttcatttctggtaataatctaacattcatactttattgtagttctgttcaaaagtactgcttggagctgtgatttgggtrtataaggcatttgtagtcaaagaaaataattcacatatgcattcatgaatcagtaaaaataatttagggtgtcgattctaggttagacaatataatgctttcattctagctttggttcatggttcatttcaaatcctcagcaaccaatctctgccacctccacgcagcacattctgcttctgcagccagcattcgaccagtgtacccatgtccttgggtaacgaatctgtggggggagccattctggtatcacctggtccccctcccactgccccctcatccaaggcctagcagtcagct

SEQ ID NO: 163170 - DNA, 601 bp, Human
tacctccagtgatgggggactcattacctccttggtcagtctaacttgaccttctgcctctctcaaggccccaaacccactgtagctcccaaggggtgggaggaacccagggtttcctagagttattctctatagggtgaggatgggacttggctagtcgccattctagggtacctaagcctggattcaaaccaaattgaataccagttcatttctggtaataatctaacattcatactttattgtagttctgttcaaaagtactgcttggagctgtgatttgggtatataaggcatttgyagtcaaagaaaataattcacatatgcattcatgaatcagtaaaaataatttagggtgtcgattctaggttagacaatataatgctttcattctagctttggttcatggttcatttcaaatcctcagcaaccaatctctgccacctccacgcagcacattctgcttctgcagccagcattcgaccagtgtacccatgtccttgggtaacgaatctgtggggggagccattctggtatcacctggtccccctcccactgccccctcatccaaggcctagcagtcagcttcctgggtgaccac

SEQ ID NO: 163171 - DNA, 601 bp, Human
agaaagaatccgcgtgggaaagacacaaagaggaggaggaggaggcgacagagtaaggggaggagaacagaaactaaatataaatatgtgttggggatgttggggatggcagcagggtatggttagctggctggctcccacaccactgtcccacagcacagagggccagcatctgcacctggcaccatgctttccctaggaaagccgagggcattgggcttgtggtgcagccacacagggtacagacctgtttgggactgtcaggttcccacgggttgcctgagctctattaggtgggcgmcttagagtaaattgtgtgaaaccaatacagcctataatgcaaaagattgagccgtgagtagattgatgcgtctaaagaatcagtgaacaaaaataagtggccatagtgacctcagttaatcattgaagtctgaggtgcccaacaatgatttttaaaatccctgcactgtccttggtccccgctctgtgacactggcagtcacccagccaccacttgacggcagccatttggagtccacatgtactgagtttccaagccagaacttcctcagcactcagccagaacacagcctttctctgg

SEQ ID NO: 163172 - DNA, 601 bp, Human
acttataaatggcctcatctgtaaaatgggaatgcgaatgccttcctcctcattaggcggttgtggggagtaactgcctcatcagcctccagctgctatgttgggaagggctaagccactccaagttctcccatcctggagagctttgagggcagtctggctgtttggcaagctattgtcagagggtattagagcaaagcaataggaataaagtaaaggtaggggtccttggagggcgagtagtgagagaccctaattcagggtctctggacctcgtggtgacccagggaaggggccattyctggaagaggatctggcttgggcatcagaaacagcagcgccccctgcacatcacacatgttcatgtgttcatgggtgaccctggaacctcaactgttgcctgggatagagggagcctctggcttgagcttccagtcccatctctgttctgcatagctgtgtgatccagagcaggtcacttgacttctctgggcactgggcattgtggatgagcctggagtttggagtcggagagatctgactttgaatcccagctccacacttactgtcttggacaattacttctctctgagcctcagtt

SEQ ID NO: 163173 - DNA, 601 bp, Human
gttgtggggagtaactgcctcatcagcctccagctgctatgttgggaagggctaagccactccaagttctcccatcctggagagctttgagggcagtctggctgtttggcaagctattgtcagagggtattagagcaaagcaataggaataaagtaaaggtaggggtccttggagggcgagtagtgagagaccctaattcagggtctctggacctcgtggtgacccagggaaggggccattcctggaagaggatctggcttgggcatcagaaacagcagcgccccctgcacatcacacatrttcatgtgttcatgggtgaccctggaacctcaactgttgcctgggatagagggagcctctggcttgagcttccagtcccatctctgttctgcatagctgtgtgatccagagcaggtcacttgacttctctgggcactgggcattgtggatgagcctggagtttggagtcggagagatctgactttgaatcccagctccacacttactgtcttggacaattacttctctctgagcctcagtttcttcatctgtaaaacagagctcgcggtagctacaattagccattagatgtactaataa

SEQ ID NO: 163174 - DNA, 601 bp, Human
agggctaagccactccaagttctcccatcctggagagctttgagggcagtctggctgtttggcaagctattgtcagagggtattagagcaaagcaataggaataaagtaaaggtaggggtccttggagggcgagtagtgagagaccctaattcagggtctctggacctcgtggtgacccagggaaggggccattcctggaagaggatctggcttgggcatcagaaacagcagcgccccctgcacatcacacatgttcatgtgttcatgggtgaccctggaacctcaactgttgcctgggayagagggagcctctggcttgagcttccagtcccatctctgttctgcatagctgtgtgatccagagcaggtcacttgacttctctgggcactgggcattgtggatgagcctggagtttggagtcggagagatctgactttgaatcccagctccacacttactgtcttggacaattacttctctctgagcctcagtttcttcatctgtaaaacagagctcgcggtagctacaattagccattagatgtactaataaaaagcacctagcacagtctatccatgtggtgggcactttataagcat

SEQ ID NO: 163175 - DNA, 601 bp, Human
ggagtcggagagatctgactttgaatcccagctccacacttactgtcttggacaattacttctctctgagcctcagtttcttcatctgtaaaacagagctcgcggtagctacaattagccattagatgtactaataaaaagcacctagcacagtctatccatgtggtgggcactttataagcatacctttcttttcttgcctcctccttctctctccagctccctgctgtctttaaaatgggcccaggaaagcaggttcagcccaactcacaatggtgttgtgagtgtaaagttgtgagtrttaaggaggtgaaatagaggtctggaaagttaagagctgtagaaaaaaaggcaatcttgtgattagggatgccagaggttccttctgcttagcatagggttccaatgccagaggttccaatgcttagcatagggtcctagctaggcattgaggaccctatgctaaggactcagacctctgtgtgcagaggctgttgagaatctagggtaggccgggcgcggtggctcacgcctgttgacacaagtgactgaatgagctgtattactgtattcttttaaacagcagcccattatctctccc

SEQ ID NO: 163176 - DNA, 601 bp, Human
caacctgcgtctaggaccctcctcccccgcaggtgacagctgagcagaaaagcagatgaaatttccttcccccgtgtattttgggagccaggatagggtgctggggtgccacctctcctgactctcaagtcacgtgaagaggagcagatggcagactcggaccccagtagaggctgaggtgagacagagttcagctccacacaaggatcagcgaggggacagaggggacagaaggcaggggctgcagggggagcttttcatcgctgaatgagttctagcagagtgcgggcagcctcctgtwgggaatgccagagggactgaactttgggccaaggggaaggtcagaccccgtcaggagtgccacagatcctgcactaccatctcttctggctgcagaaggttggcctagagcaacacctgtttggaagaagcaaactaaaccacacaggagtgaggatttcctctcgtttaccatggtccccagagcctggagtagagtaggtccataatagatactttctgaataaaggaatactataatttcccagctgggcacggtggtatgctcctctagtcctgaccactcaagcgactgaggtgg

SEQ ID NO: 163177 - DNA, 601 bp, Human
tcacatcaggtcctgggtcagactcgtgtctgccccttctttgcctctcggcttgaatgagtcacttagtctctccttctctgcataatggagacagtactagtgctacctcacaggcttgtggcgaggagatcacatgtgtgaaatgctcagcccagagcctgctacttccgtcttatgctaggctcttcctgagtgacgaccgtgagaaatatccaaagctcctccgtgagcaggaacagatgctccccctcactgtgcctggagaagctggcagaggtgaattaatccatcccttgtyatctacaaaaatgtcgaggcctacgtaaggcgagtaggccaaggtcacaagccgggacttaggaacaccaagcccaaggtccacgctgagccagcactcgggcttgtggcccaggacttgagccctggtaagcagaccctgagcctcactgtgagaaagcctgggcctgccgcccccctctcaccccctggcaccttgagcaacccaggagctggcccactaggcagcggcctcctctcttcccagtcgcccgcaaatggcagggaattccaccagcttcatttctaacagcttcccagc

SEQ ID NO: 163178 - DNA, 601 bp, Human
aagcctgggcctgccgcccccctctcaccccctggcaccttgagcaacccaggagctggcccactaggcagcggcctcctctcttcccagtcgcccgcaaatggcagggaattccaccagcttcatttctaacagcttcccagcaatcccagcgcttacacagccagcccaacgctgacccctccgggtggctgcaaacccctttagactcactttctggaagccagcttcccagcctcagcgcgttcttgtgaatcccttcggtgggctgtgtcctttccttgaaagggactcagtatgygcaaacagcccaaactcactctaggccaggtctggagggtcaggtgggtgaccacgtgggataccaccacttctggtgaaaagcggggtgacgggttaggaggacagctgaggtgggctcataacgtctccaaaggcagttcccaaagaggagttctggaaatgccagagcatgtttgaaacaggcaggtacattcccaagtggtctgtctcgcacagcaatgctcatttgaatgcccatgctctggcttgaggtttaacggcaggcatcctctgtagtgccaccctgcatctgtggggc

SEQ ID NO: 163179 - DNA, 601 bp, Human
tcggtgggctgtgtcctttccttgaaagggactcagtatgtgcaaacagcccaaactcactctaggccaggtctggagggtcaggtgggtgaccacgtgggataccaccacttctggtgaaaagcggggtgacgggttaggaggacagctgaggtgggctcataacgtctccaaaggcagttcccaaagaggagttctggaaatgccagagcatgtttgaaacaggcaggtacattcccaagtggtctgtctcgcacagcaatgctcatttgaatgcccatgctctggcttgaggtttaamggcaggcatcctctgtagtgccaccctgcatctgtggggccctgatggctctggtggccctggcatcccagggcctggcccatggatgtctcctctccagggaggagacgttgaggagggtggcccacccacagtgcagctgcttttctcatctgtggacactagaccagccaagcctcagtgccatgctctgggaatccccttgtctctgtggaacagtagcatccgccacaaaacttactcaccccctcctcaagccaagcctgtgggtcgcctggcttcaggctgagcccctacaga

SEQ ID NO: 163180 - DNA, 601 bp, Human
gagtggaaaaacacctggttccttgcaagataagggtcagcctgcaagttaggacagccccaggccccctggcctctgactcacaggtcagcccaggaaagaattcagcaggcttcttccctggaggggccagccctgtcctacatacctcacgcacatcttgcccgtttctgttcataaagacctccagagagggagaagaaccacagctgactcagtccggggtaagcatggtggacggagcaggggctctggaatcagatctgggttcaaacctcaactcagtcatttcctggttctstggcctcaggcaagctattgaacctctttgagcctcatctggatttgtggataacaattccttctctcagggttgctgtgagggttaaatgagctaaccctcggaaggggcttagcacataataggtgctcaagaaaagtttcttccctttctgtgtctgagattgctgctcctccaacaccactgtcccgcccctcagtgaccccaggtacatagctccttgaactgtccaccagctccgccctcaggtttactgggggtagcagcatttcctccagaaagtgtgtgccaggaaccgtc

SEQ ID NO: 163181 - DNA, 601 bp, Human
gacagccccaggccccctggcctctgactcacaggtcagcccaggaaagaattcagcaggcttcttccctggaggggccagccctgtcctacatacctcacgcacatcttgcccgtttctgttcataaagacctccagagagggagaagaaccacagctgactcagtccggggtaagcatggtggacggagcaggggctctggaatcagatctgggttcaaacctcaactcagtcatttcctggttctgtggcctcaggcaagctattgaacctctttgagcctcatctggatttgtggakaacaattccttctctcagggttgctgtgagggttaaatgagctaaccctcggaaggggcttagcacataataggtgctcaagaaaagtttcttccctttctgtgtctgagattgctgctcctccaacaccactgtcccgcccctcagtgaccccaggtacatagctccttgaactgtccaccagctccgccctcaggtttactgggggtagcagcatttcctccagaaagtgtgtgccaggaaccgtcggtccccactggccaggctccggctggaggaagccccacagcaggggagctt

SEQ ID NO: 163182 - DNA, 601 bp, Human
ggggcttagcacataataggtgctcaagaaaagtttcttccctttctgtgtctgagattgctgctcctccaacaccactgtcccgcccctcagtgaccccaggtacatagctccttgaactgtccaccagctccgccctcaggtttactgggggtagcagcatttcctccagaaagtgtgtgccaggaaccgtcggtccccactggccaggctccggctggaggaagccccacagcaggggagcttccttcttgaactggtttgggctggacccttccctcccaggccttgggcatccccygatgcagtcatgcgttagccagcaggaagatgcctgcagacatccagaagagaaaagttcaaagcagtcctcacacacggcagtgcctttccagcctgaggtggaatcttcagtgtggcctccctcccctgtgttaaggcgaagtgtcagccaggaggggctggggctgtgcccgagctggccaccccgttctgcttgtttccacttcagggtcttaggctcacatcacttctttcaagctgggcaggagaaacggcagggtctggctctctgagggggagtccccttccttcctcctcc

SEQ ID NO: 163183 - DNA, 601 bp, Human
agctccgccctcaggtttactgggggtagcagcatttcctccagaaagtgtgtgccaggaaccgtcggtccccactggccaggctccggctggaggaagccccacagcaggggagcttccttcttgaactggtttgggctggacccttccctcccaggccttgggcatcccctgatgcagtcatgcgttagccagcaggaagatgcctgcagacatccagaagagaaaagttcaaagcagtcctcacacacggcagtgcctttccagcctgaggtggaatcttcagtgtggcctccctccyctgtgttaaggcgaagtgtcagccaggaggggctggggctgtgcccgagctggccaccccgttctgcttgtttccacttcagggtcttaggctcacatcacttctttcaagctgggcaggagaaacggcagggtctggctctctgagggggagtccccttccttcctcctcctggtgtcttcttggaggaaagctcctcccctagatgaattgcgtgcagatggagatgctagaggggcgacagtaacagctggcatggcctgtttgacttaaccttggggccccatggctggtgcagca

SEQ ID NO: 163184 - DNA, 601 bp, Human
tagccccaccaggtaaatgggacaactaatatgttgatgtatttccttcaaatagccattgtattcacactgcattgacaaattaccattggcaaaatctttaaaaaccccctacccctaatctatatcatcaagaattccactttcgccaaagtaaaccttgatagtttaatttgtgtctgggacccatgactgtggacaggtttaggccccagcaggtcgtgggatccaggagagaccaccaaatcgggcccctcataatgatcacactagacctgagggaggtgagagtcaggctackggtacccgccgtcactcccaccagctttattattttacctttcacattgaggtttgtgatctgtctgcataattttggagtatgatatgagctcattcttccgggtttattttttttccatgcagatatcaaattacttcagctacatttattaaaaacatcatccattcccccagcatgttgcagggtcacctttgtcattaatcaaatgacctcataagagtgggtctatttttggattctctcttctgttccattggtctatttgtcaattccgtactaaatttgccaatttttgcc

SEQ ID NO: 163185 - DNA, 601 bp, Human
gcgtgatggcgtgcgcctgtagtcccagctactcagtaggctaaggcaggagaatcacttgaacccgggaggcagagattgcagtgagctgagatcacaccactgcactccagcccgggcaagacagcgagactccatctcaaaaaatatatatatatatattgaccttgaatcagggaccttctaaattcactcccttaatcccagttttatgtagattctcccgcattttctacttacacagttatgttgtcccacacagtgttggcctcaccacatttcagatgagtcctagctgccyccctttaggtggttgattggttgattttccagacctaagtgatggcctctggtttctaaagctctactccctagcccccaaagcctgagctcagctgattgcttctgccaactcccaccctcaccatcaccactcctggccctgggacaccctctgggctgtccttctttcttctccagcctccctgctgcctctgggaagaacttgttccggaatggctcactattagaatggactcaagagaggctcccagagtcagagaccatttgctaaagatgctctccctgtgcatccccacag

SEQ ID NO: 163186 - DNA, 601 bp, Human
ctctgcacttacaggcaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaaggtaagaggggccggcagggatgaggttcagcctctcccagtactcagacaaccatgcctggctaaacctcagaaaggmccctggaggaaccacctacttcacagctatcagttaatcagctgttttaactccctgcctgtcagcctgccattctctccctgggtaagccagggcgaaggaggctggggagaccctctctgcagggtggtggggttgccagattcagcacatgaaaatgtaagatgctcaattgcatttgtatttcagatgacaacgaatagtcttttaggacgtgtcccattcaatatttggacctgcagccccatagggactgagggctctcccagaccaggagaattttagttgtgagggtcacga

SEQ ID NO: 163187 - DNA, 601 bp, Human
gctgttttaactccctgcctgtcagcctgccattctctccctgggtaagccagggcgaaggaggctggggagaccctctctgcagggtggtggggttgccagattcagcacatgaaaatgtaagatgctcaattgcatttgtatttcagatgacaacgaatagtcttttaggacgtgtcccattcaatatttggacctgcagccccatagggactgagggctctcccagaccaggagaattttagttgtgagggtcacgactagtagacccaagagcctggtagaaggtggggtcaggggycctatcagggtttggaggctgcgaagccagtgtgtgtggaggagcccccggcctggtgtctcttcctcagagggctgggcacatctctcccagccacccgtggagctagagaatggagccccgccccctgagctccagctccctggcccagccgaccacacccctgggcatgctggatgcagccccatggcactcaccatctgctctgctgacgctgggccttctccccgcatccctgcatccagcacaggcgggacccacggtgggccctgataaattatggaaaaattaatgggtgga

SEQ ID NO: 163188 - DNA, 601 bp, Human
cccaccaggagcctcgccccccacgggcaccaataggcatggaatgaaggctgccaagcatggctctgaggaggcccggccacagtcctgcctggtgggctcagccacaggcaggccaggtggggaaggcagccctagccctaagacccgggagagcagcctgaagcgcaggctattccgaagcatgttcctgtccactgctgccacagcccctccaagcagcagcaagccaggccctccaccacagagcaaggtaagtcaggagcctggcctgcaggtgtccactggggagtgggtgtarggacacaggccttgcctagccttccccttggaggactggcaaagaggctccctggactgcttccgcctaaggcggcagaaatgtgcacggtaacctcttctctaaggagggtggctcgcctcctccttccctcccttcctttccttcttttctctgtggctgttgtgttgtttcccatttctgtcagtatttgttcccaagtgtgtggccataggaaaagctggatttgcctagtccaggggcagcaggaggccgacttgtggcatgtgtgactgcttcagacgcacatttttcttgtga

SEQ ID NO: 163189 - DNA, 601 bp, Human
ctgttgtgttgtttcccatttctgtcagtatttgttcccaagtgtgtggccataggaaaagctggatttgcctagtccaggggcagcaggaggccgacttgtggcatgtgtgactgcttcagacgcacatttttcttgtgagaaaggaaagggtgaagggagcccccgtggtgacatttcttggcaggcagagtggagcgcacctttttgcttcttccaggccctccagcatcctgttgatagtgacagtaacctcttttcccatttggcagaggaggagactgatagagagagggtgagwcacccccaggcatgatggagagtgagtcagagaaggaaggtggggagtgctctggggctgcctgtccggcccgggccctcttggctcatgactcttgcgtatgaaggctttacaagcacagcagccacttgttctttagctccttcctgggagggtcaaaggcagtcctaagaaacggctgctgacagtggcatgggtaatggagcctcccctccctcctgggagggctttaagacaagcctgggtactcccctgtcatcggtggggtgagtgtggcccagcctgcacagggtgtgggtt

SEQ ID NO: 163190 - DNA, 601 bp, Human
ccctggggagactcagccagaaaaccaacgtaagatcaggacagtgcaccctgctgggaaggtgagattcggagcttgacctccctctgtctctcaggagtcctgctgcgaggcctcagggatttggagaaaggggttgtcaacactgggctgggcactcatttgcatctttctgggctcctgccagcaccccacagcagggggagaggcctgtccatccctgcacaatgtactgagtactcaccatgggccactgctgctgggtatgctgggatgtcccccatacttgtgggagcaggcrgtagttatctcgagctcagcaacaccatacttccaaatccaggggagtggtttccttctgggcaactcagacacatctttcaagatttctactctgaagccaagcctctcaatggcaagctgagaccccccgagctgctccgggccggggcttctcagcgtcctcactgcaggcgctcaggtcagtccatcctttgtggtgggctctccttgcactgtagcagcctccctggcctctactcactagaagttggtggtaccctcggttggaataaccaaaaatgcctccagacactgccaa

SEQ ID NO: 163191 - DNA, 601 bp, Human
taaccaaaaatgcctccagacactgccaaatgtcactcgagcacacccattaagaaccactgccttaagcaaattcaataacagatggggagcatcagccttcctcctcctcctccaccaccacctaccccaggagtccccagatcaagccagcagcccttggcactggggctgactctggacacttgcagcagcttccataacagcagttaggccacagaggccatgcagtgtgccaggcatggctgcaggagggtctgagtatagactccagggctcctgtacctagccccaggcagtraggcctggagtcactctagctaaagagatcaggaagacagggcgtgggggcacagagaccaaagaggcaagacagttttttaggagcttgcagggattagacatgttccacttagagtcagaagggcaaacattggttaagcacctaccgtgtactccgatatatgtcaaggatacatggcaccagtgggattgcagcatgggagtcagcagccacgggcgtcctgcgggttccagtgcctacaggacaaccaaacaacccacagggttatgaggattacatgagatagtacgttgaagg

SEQ ID NO: 163192 - DNA, 601 bp, Human
agtgcctacaggacaaccaaacaacccacagggttatgaggattacatgagatagtacgttgaaggcacttgtcaaagtggtaagccctcaataaatggctttattagtagtatttgagatggcgtctccctctttcgcccaggctggagtgcagtggcacaatcttggctcactgcaacctccacctcctgggttcaagtgatcctcccaccttagcctcccaagtagctgggattacaggcacgctccaccatacccaactaatttttgtatttttagaagagatggggtttcaccatrttgcccaggctggtcttgaactcctgacctcaagtgatccacctgccttggcctcccaaagtgctgggattacaggcacctgagccaccatgccaggccggctttattatttttaaaaatattatgccatggcctctcccctttaggatacttaaggtatagccccctaagcccacagctggggagccatggctcagggcgggaaatgaggcattgctgtaaatgtatgcatgactcttctagtggctttcttcccaagaggtctatcacatgagtaacttcagaattaatccagagcct

SEQ ID NO: 163193 - DNA, 601 bp, Human
aagaggtctatcacatgagtaacttcagaattaatccagagcctgtaacaattaattaattctgttgtcgtgtccccctttccctttcttgtgtggcctcacaagtttcatctggtccttgcttgtgattacattgataaaagctccctccctgtggagacaggcagtgaagccaacgaaaggatgctagagaccagaccttgccaggctgaagaccaagccagctccccagactccccagcctatgtcccagactctgcttgtgctgggctcctggctgggccatccctcccccagcctycagacgcaggctccgccctgagcccagccagcacctgcagcagcagcagcagcacagggacctggcctgtggagacagggaagaaacccctacctcagcctgtccacgtggtacccacacatcctcagagtagagctggcccatgcagaagccctcaaggccaggaggggaatgatctcattttacagcctttcttaggagcttcaggatgagaggtcatcagagccacctcaggaggagctttaggtggtccccaagcttctgccccgacccacatggatgggtgcctggagagcatgt

SEQ ID NO: 163194 - DNA, 601 bp, Human
gattacattgataaaagctccctccctgtggagacaggcagtgaagccaacgaaaggatgctagagaccagaccttgccaggctgaagaccaagccagctccccagactccccagcctatgtcccagactctgcttgtgctgggctcctggctgggccatccctcccccagcctccagacgcaggctccgccctgagcccagccagcacctgcagcagcagcagcagcacagggacctggcctgtggagacagggaagaaacccctacctcagcctgtccacgtggtacccacacatcctmagagtagagctggcccatgcagaagccctcaaggccaggaggggaatgatctcattttacagcctttcttaggagcttcaggatgagaggtcatcagagccacctcaggaggagctttaggtggtccccaagcttctgccccgacccacatggatgggtgcctggagagcatgttttctgagttaagtccacactcaggccagcaggcagcttccttagagccccgagcctttctacaggttgactgtgtgatgcagtgagccctgccccacttccctccctgtccctgcctggtgacgt

SEQ ID NO: 163195 - DNA, 601 bp, Human
ggctcctggctgggccatccctcccccagcctccagacgcaggctccgccctgagcccagccagcacctgcagcagcagcagcagcacagggacctggcctgtggagacagggaagaaacccctacctcagcctgtccacgtggtacccacacatcctcagagtagagctggcccatgcagaagccctcaaggccaggaggggaatgatctcattttacagcctttcttaggagcttcaggatgagaggtcatcagagccacctcaggaggagctttaggtggtccccaagcttctgcccygacccacatggatgggtgcctggagagcatgttttctgagttaagtccacactcaggccagcaggcagcttccttagagccccgagcctttctacaggttgactgtgtgatgcagtgagccctgccccacttccctccctgtccctgcctggtgacgtctcatggaacctctgttcccaggacctggtatcacagcctcagtcatggccatgcgccctccacccccctcacagccctcccagaggctccctgaggccgtaagatcatactgcccacttatgcagagtttctcaaagtatg

SEQ ID NO: 163196 - DNA, 601 bp, Human
gctgggccatccctcccccagcctccagacgcaggctccgccctgagcccagccagcacctgcagcagcagcagcagcacagggacctggcctgtggagacagggaagaaacccctacctcagcctgtccacgtggtacccacacatcctcagagtagagctggcccatgcagaagccctcaaggccaggaggggaatgatctcattttacagcctttcttaggagcttcaggatgagaggtcatcagagccacctcaggaggagctttaggtggtccccaagcttctgccccgacccacmtggatgggtgcctggagagcatgttttctgagttaagtccacactcaggccagcaggcagcttccttagagccccgagcctttctacaggttgactgtgtgatgcagtgagccctgccccacttccctccctgtccctgcctggtgacgtctcatggaacctctgttcccaggacctggtatcacagcctcagtcatggccatgcgccctccacccccctcacagccctcccagaggctccctgaggccgtaagatcatactgcccacttatgcagagtttctcaaagtatgttccatgg

SEQ ID NO: 163197 - DNA, 601 bp, Human
tacaggttgactgtgtgatgcagtgagccctgccccacttccctccctgtccctgcctggtgacgtctcatggaacctctgttcccaggacctggtatcacagcctcagtcatggccatgcgccctccacccccctcacagccctcccagaggctccctgaggccgtaagatcatactgcccacttatgcagagtttctcaaagtatgttccatgggcctcctaggacccagggaccttgttcaaatgcagtctctgctctaggctcccaccgaatcaggctctgaggcgggaagtctgcrgtttctctagctccccagatctctgcacacgtccctgcattgtagtggagacaggctcagagaggatgacttgcctaaggctcatcacagggcagagcagcccagggctgggccccaggtcctgacagcccagtccaggggtcccactgctccactacacagtggatggtgacagtgtcacagtgtcacagtggatggtgacagtcaggtgctggcgaggacatgggagaatgtttactgtccaaatgtactcatcagggatggagtgagtccaggcagtcctgggaggattgctagctt

SEQ ID NO: 163198 - DNA, 601 bp, Human
ggagacaggctcagagaggatgacttgcctaaggctcatcacagggcagagcagcccagggctgggccccaggtcctgacagcccagtccaggggtcccactgctccactacacagtggatggtgacagtgtcacagtgtcacagtggatggtgacagtcaggtgctggcgaggacatgggagaatgtttactgtccaaatgtactcatcagggatggagtgagtccaggcagtcctgggaggattgctagcttctttcctgtgaaggtcaagcacacactcgggtgggcaggcaggtgtrggggtggcagaagtctgccccagcatggctgtcggccagcaggagtgcctattccaccctaagcaggccagggacttggctggagagtagaagccctgaagctgcggggggtcggggaaggaagggagtgagggttgccaaagacactgaaaagactctggtggggcccaaggcccagatttggggtttggggtccctgagcaagcatcccagcccaaacttactgcttgagatttcctgtaagttgtttcagctatgggatcaggaccaggacccactgggcacctaagacaatggctt

SEQ ID NO: 163199 - DNA, 601 bp, Human
tgcctattccaccctaagcaggccagggacttggctggagagtagaagccctgaagctgcggggggtcggggaaggaagggagtgagggttgccaaagacactgaaaagactctggtggggcccaaggcccagatttggggtttggggtccctgagcaagcatcccagcccaaacttactgcttgagatttcctgtaagttgtttcagctatgggatcaggaccaggacccactgggcacctaagacaatggcttacatgatgggtttggagaagttcctagaaggctttttctgcatccsctgaagcatccctctccaggtgccctttaaaaacacgtaatccctgggaggggtcatggtgcatatcaccgctccttggggagaacccaaagatgggcgggcacctttcctgtcagaaagagcagaagggcttgggctcggaaaagcaagaagcctcgcaggcttccagggctgggcctgagcagggctcactgggggcccaggctgcccctcagctccaccttcccttcctccctccctgccagagccaatgaggataggccccctaccttctcctccctcccgggggctccttagcca

SEQ ID NO: 163200 - DNA, 601 bp, Human
gctggagtgtagtggcgcgatctcggctcactgcaacctccgcctcccggattcaagcgattctcctacctcagcctcccgaggagctgggattacaggcccccaccaccacgccgccaggctgatttttgtatttttagtagagacggggtttcaccatgttggtcaggctggtctcgaacttctgacctcaggttatccacccgcctctgcctcccaaagtgctgggattacagccgtgagccacagcgcctggcccctgtttttttgtttgtttgtttgtttttaacttctaaagcgmaatgtaatatacatgtagaaaaattcacattcacaactgtatacaactccgtgaattattacaaaatatactggccgggcgtcgtgtctcacgtctgtagtcccagcactttgggaagtggaggcgggaggacgattgagcccaagagttcgagaacagcctggtcaagatagtgagacccgcatctctacaaataggaaaaattagctaggcatggtggcgtgcacctgtaggcccagctattcaggaggctgagaagggaggatctagcctgggaggtataagctgcagtgagctgtg

SEQ ID NO: 163201 - DNA, 601 bp, Human
atgatatttcaatacatatatacattgtataatgaatgatcaaatcagggtaatcagcatatccatcagttcacttaaacacttgtcatttctctttgtgatgagaacattcaaaatactcgcttctggctattttgaagtatacattacattagtgtttactgtagtcaccctactgtgaaatagaaccctagaacttattcctcctatctaactgaaactttgtgcctgttgaccaacctctctccttcctgccgccccctgcaacagctgcattctcctcagtctctggttaccactsttctatttgttccttgtatgagatgaacttttttttttttgtttttttttttgagacacagtctcactctgtcatgaggctggagtacagtggcacgatctcggctcactgcgatctctgtcttccgggttgaagccatttacctgcctcagcctcccgagtagctgggactacaggcgtgtgccaccacaccctgctaatatttgtatttttagtagggacggggtttcgcatgttggccgggatggtcttgatctcctgacctggtgatctgcccgcctcggcctcccaaagtgctgg

SEQ ID NO: 163202 - DNA, 601 bp, Human
caaatcagggtaatcagcatatccatcagttcacttaaacacttgtcatttctctttgtgatgagaacattcaaaatactcgcttctggctattttgaagtatacattacattagtgtttactgtagtcaccctactgtgaaatagaaccctagaacttattcctcctatctaactgaaactttgtgcctgttgaccaacctctctccttcctgccgccccctgcaacagctgcattctcctcagtctctggttaccactgttctatttgttccttgtatgagatgaacttttttttttttgtttttttttttgagacacagtctcactctgtcatgaggctggagtacagtggcacgatctcggctcactgcgatctctgtcttccgggttgaagccatttacctgcctcagcctcccgagtagctgggactacaggcgtgtgccaccacaccctgctaatatttgtatttttagtagggacggggtttcgcatgttggccgggatggtcttgatctcctgacctggtgatctgcccgcctcggcctcccaaagtgctgggatcacaggcatgagccaccgcgccccgccaagatcaact

SEQ ID NO: 163203 - DNA, 601 bp, Human
tttactaccaaggtcaagacccaaattagacttttcagaagtgttgtcaataatcctgtggaaaggctgcagatcattgctaaatatgtctggcagggcctcttcctttgtcaacaattctcttcctactttatcatttttatttctgagagttggactgtcagaaactaaggcctaggatcccatggtggaatctctgtgctgtttttgtttgtttgtttgtttgtttttgatggagtttcgctcttgttgcccaggctggagtgcaatggcgtgatctcggctcaccgcaacctctgcstcccaggttcaagcgattctcctgcctcagcctcccaagtagctggaattacaggcatgagccaccacacccagctaattttatatttttagtagagacagggtttctccatgttggtcaggctagtctcgaactcctgacctcaggtgatccaccctctttggcctcccaaagtgctgggattacaggcatgggccactgcgcccagcctgtgctgtttttttgtttgttttttaagaaatgggtcttaactgtgttgaccatgttgatcttgaactcctggcctcaagcagtccacct

SEQ ID NO: 163204 - DNA, 601 bp, Human
atgccaacgatgtgaagaaattggaagaagctggattccatactgtggaggctgttgcctatgcgccaaagaaggagctaataaatattaagggaattagtgaagccaaagctgataaaattctggtaagtactgcttacttaacctagggaggcattagtgggaatagtacaaaagggaatgtagtgaaagacttcttccttctatctcttattcttcggtcatctcattatcctttccaggggtgactgttacctgtttcttttcttcttttcttttcttttcttttttttttctttctttttttttttttttggagacgggttctcgctctgtcacacagggtggagtgcagtggtgccatctcagctcactgcaaccttcacctcccaagctcaagcgatcctctcacctcagcctcccaagtagctgggactacactacaggcacatgccaccatgccggggtagtctcgaactcctgagctcaggcgattcacctacctcagcctcccaaagtgctggattataggtgtgagctactgtgcctggcctatttatttttctagcttcatatagttctttaacatacatacttcccc

SEQ ID NO: 163205 - DNA, 601 bp, Human
cttacttaacctagggaggcattagtgggaatagtacaaaagggaatgtagtgaaagacttcttccttctatctcttattcttcggtcatctcattatcctttccaggggtgactgttacctgtttcttttcttcttttcttttcttttcttttttttttctttctttttttttttttttggagacgggttctcgctctgtcacacagggtggagtgcagtggtgccatctcagctcactgcaaccttcacctcccaagctcaagcgatcctctcacctcagcctcccaagtagctgggaytacactacaggcacatgccaccatgccggggtagtctcgaactcctgagctcaggcgattcacctacctcagcctcccaaagtgctggattataggtgtgagctactgtgcctggcctatttatttttctagcttcatatagttctttaacatacatacttccccatggttacattttgttttatgaacctatttcttcagtgtttatatagttacacagttttattgcctttacccttgaagttttatgtagtataaagcagatttttttttttttttttttttttttgagacggagtc

SEQ ID NO: 163206 - DNA, 601 bp, Human
aacaaatgctgaccagattttttcctttttccttgcgagattttggtttcagaaatcaagtcacttctctgtttctatgaacacaacaatgcaaacctagaatacatgatttgagatgcaatatggtatagacttacgtgtctttacttttcaatattttatgttctttgtttctggccagtaaagattatgattgtattgtttgttttctgtttttttttgaggcagagtgtcgctgtgtcacccaggctggagcacaatggtgcaattttggctctgctcactgcaacctctgccttcygggttcaagtgattgtcgtgcctcagcctcccaagtagctgggaatacaggctcccaccaccacacgtggctaatttttgtattttcagttgagacggggtttcaccatgttgcccaggctggtctcaaactcctggcctcaagcaatctgcccacctcagcctcccaaagtgctgaaattacaggcactagccactgtgcccaccttttttttttttttttaaagaaaaaaaagaaaagtctcactctgttgcccaggctggagtgcagtggcatgatcaaagctcactgcagcttcag

SEQ ID NO: 163207 - DNA, 601 bp, Human
gtttcagaaatcaagtcacttctctgtttctatgaacacaacaatgcaaacctagaatacatgatttgagatgcaatatggtatagacttacgtgtctttacttttcaatattttatgttctttgtttctggccagtaaagattatgattgtattgtttgttttctgtttttttttgaggcagagtgtcgctgtgtcacccaggctggagcacaatggtgcaattttggctctgctcactgcaacctctgccttctgggttcaagtgattgtcgtgcctcagcctcccaagtagctgggawtacaggctcccaccaccacacgtggctaatttttgtattttcagttgagacggggtttcaccatgttgcccaggctggtctcaaactcctggcctcaagcaatctgcccacctcagcctcccaaagtgctgaaattacaggcactagccactgtgcccaccttttttttttttttttaaagaaaaaaaagaaaagtctcactctgttgcccaggctggagtgcagtggcatgatcaaagctcactgcagcttcagcttcaaactcctgggctcaaggaattctcagcctgctgagtagct

SEQ ID NO: 163208 - DNA, 601 bp, Human
ttcgagacagggtctcactctgtcacccaggctggagtgcagtggcatggtctcagctcactgcaacctctgcttcctgggctcaagtgatcttctagcctcagtctccccaagctaggactatgatcatttaccacctggctaattttttttttttttttttttttttttgagtcggggcatcactcattatgttgcccaggctggtctcaaaatcctgagctcaagccatcctcctgcctcagcctcccaaagtgctgggattataggcttgagccaccttgcctggcccaatgtcagktttctttcccttttttttgagacagagtctcactctgttacccaggctggagtgcagtggcataatctcagctcactgcaacctccgcctcctgggttcaagtgattctcctgcctcagcctcccaagtagctgggactacaggcaagtgccaccatgcccagctaatttttgtatttttagtagagatgaggtttcaccacgttggctaggttggtctcgaactcctgacctcagatgatctacccgcctcagcctcccaaagtgctgggcttacaggcgtgagccatcatgcctggcc

SEQ ID NO: 163209 - DNA, 601 bp, Human
aagacagagtcttgctctgttgcccaggctagaatgcagtggcacaatctcggctcattgcaaccactgactcccaggtttgagcagttctcctgcctcagtctcctgagtagctgcaatgacaggcacccgccaccgtgcctggctaatttttgtatttttagtagagacgggatttcaccgtcttggccaggctggtctcaaagtcctgacctcctgatccatccacctcggcctcccaaagtgctgggattacaggcatgagccactgtgcccagcttttttttttttttttttttttgagatggggtcttgctatgtcaccccggctggagtgcagtggcatgatcttggctcactgccacttccgcccccaggttcaagctattcttctgcctccgcctcccgagtagctgggactacaggcatgcaccaccatgcccagctaatttttgtatttttagtagagacagggtttcaccatattgtgcccagcttttttttttttttttttgaggagtctcactttgtcacccaggctggagtgcagtggcgtgatctcggcttgctgcagcctccgcctcccaggttcaagtgattc

SEQ ID NO: 163210 - DNA, 601 bp, Human
ccagcttttttttttttttttttttttgagatggggtcttgctatgtcaccccggctggagtgcagtggcatgatcttggctcactgccacttccgcccccaggttcaagctattcttctgcctccgcctcccgagtagctgggactacaggcatgcaccaccatgcccagctaatttttgtatttttagtagagacagggtttcaccatattgtgcccagcttttttttttttttttttgaggagtctcactttgtcacccaggctggagtgcagtggcgtgatctcggcttgctgcagyctccgcctcccaggttcaagtgattctcctgcttcagcctgctagtagctgggattacaggtgcccatcaccagttccagctaagttttgtatttttagtagacatgaggtttcaccatgttggccaggctggtctcgagctcctgacctcaggtgatcagcccgcctcggccccctaaagtgctgggattacaggtgtgagccaccgcacctggccttatttgcagctatctataaatctaattatttcaaaatacttttggtttatttgtttgtttgtttgtttgttttgaaacaggg

SEQ ID NO: 163211 - DNA, 601 bp, Human
tttctttttcctttacttatgctcctattggtgggaagatttggaaatagacacagtaggttaaataattgcccaatacattgtatttaagtagcaaatactggactcaaaccagacttcagagatgatgttcttaaaacttcataagaggccagcatggtgtttcatgcctgtaatcccagtactttgggaagccaaagtgggaggattgcttgagaccaggaatttgagaccagcctgggcaacatagtgagaccctgtttctgagatgccatttctaaaaacaaacaaacaaaaacaracaattaaaaatattagcccagcatgatgatgtgtacctgtggtcctagctactcaggaggctgaggtggtagaatctcttgagcccaagaggtcgaggctccagtgactgggatcgtgccactgcatgttttctgctgtattgctagtgcctaaggcagtgtttggctctcagtaaacaataaatgcttgaatgagtggagataatagatgtccaaaaacatgcctgatatataaaatgaatgtcacagaggaaatgggttagctgtttaaggaatagaaaggggtaatttcaccctag

SEQ ID NO: 163212 - DNA, 601 bp, Human
catgagtacaggtttagagatgacaggtttgaggtgacaaaccccgagtgaaaatttctagctgtattgagagatgtggaactaagtcacacagagaagtaaaaatggaatctggaaacgaaagatccatgagaaaggaagggagtaggatatagaagagaaagctaacaaactttcatcttttctgcaacttcaggcagtgtaatggggagccgtttttccttgtctaagtgagtcttaatgttctctggctttaaggatgtgctgcataagtggccagtccacaaagtatccttgaacstggcccatgcccatggaccaactcttctgttataatcttttgaagctttattataattttagttattttgaaaaacatggcattattttaatctagatagattatacccacttctgccatgggcacaacttactgttggagatcaaaacaactgaaacaaaatctgccttatatcagtgttacagaagaggcttcctagtgtttttctatcctcgggactcaactctgttgagtttttttttcttttcttttctttttttttttttttttttgagaaagagtcttgctctgttgcccagg

SEQ ID NO: 163213 - DNA, 601 bp, Human
aaaagaatcccctgtcatgttagcacttaatattacctggaggtaggagaaaggagaacttcgttcatcttatttcctggggacttagtccccagagtgttaatatttcctcctctccaagaaactgaggcagattctgctctctgtcctcttggccactggttccaagtctttctttaggcatgaccctcttttgttgtatatgtgtcctttgctccttccatggattcccatgatgtgagagattttatctgccaaatagtaacgtaatttttcccttccaaattaacaaagccttccrtaactgtatacactaaagtcagtgccctaaaggttgggaaaatcatgtcttcagagtgtaccgtgctaaacgctttacatgaattattttatttagtttttaaaacaatcccataaggtcggttttatttacattttacagaaaaggaaacaatattctcagtcacatagtaagtggaagaaccacttatataaaagaagtatatgaaaatgcatagaaaataatctgggaaattatttctgggagatggagagtggtgaagagctttcagttttttctccgccacttcctctttttttt

SEQ ID NO: 163214 - DNA, 601 bp, Human
tacctggaggtaggagaaaggagaacttcgttcatcttatttcctggggacttagtccccagagtgttaatatttcctcctctccaagaaactgaggcagattctgctctctgtcctcttggccactggttccaagtctttctttaggcatgaccctcttttgttgtatatgtgtcctttgctccttccatggattcccatgatgtgagagattttatctgccaaatagtaacgtaatttttcccttccaaattaacaaagccttccgtaactgtatacactaaagtcagtgccctaaagrttgggaaaatcatgtcttcagagtgtaccgtgctaaacgctttacatgaattattttatttagtttttaaaacaatcccataaggtcggttttatttacattttacagaaaaggaaacaatattctcagtcacatagtaagtggaagaaccacttatataaaagaagtatatgaaaatgcatagaaaataatctgggaaattatttctgggagatggagagtggtgaagagctttcagttttttctccgccacttcctctttttttttttagacaaagtctcactctgtcacccaaactg

SEQ ID NO: 163215 - DNA, 601 bp, Human
gttcatcttatttcctggggacttagtccccagagtgttaatatttcctcctctccaagaaactgaggcagattctgctctctgtcctcttggccactggttccaagtctttctttaggcatgaccctcttttgttgtatatgtgtcctttgctccttccatggattcccatgatgtgagagattttatctgccaaatagtaacgtaatttttcccttccaaattaacaaagccttccgtaactgtatacactaaagtcagtgccctaaaggttgggaaaatcatgtcttcagagtgtacygtgctaaacgctttacatgaattattttatttagtttttaaaacaatcccataaggtcggttttatttacattttacagaaaaggaaacaatattctcagtcacatagtaagtggaagaaccacttatataaaagaagtatatgaaaatgcatagaaaataatctgggaaattatttctgggagatggagagtggtgaagagctttcagttttttctccgccacttcctctttttttttttagacaaagtctcactctgtcacccaaactggagtgcagtggcatgatatcgctgactgc

SEQ ID NO: 163216 - DNA, 601 bp, Human
tttactaaaaaatgcaaaattagccgggcgtggtggtgcatgcctgaaatcccagctacttgggaggctgagggaggagaatcccttgaacccgggaggcagaggttgtggtgaggcaagatcatgccattgcactccagcctgggcaacaagagcgaaactccgtctcagaaaaaaaagaaagaaaaaatttggttctcctaggcctttaacataaaatgttctaaaggattttcctcataatttaaatgggaattatgactccaaagtagatttctagagtagaaattaccctttagcrtcattcacttaaactttgtagaaaaattcaaaggtatctggtatggaatgggtagtctaaagcagagatttccttgagtggctcataagacagttttcatggcatttcatttacttctcttttctttcctttttgttttctctttaaaattctttctacttatttttctgttttctccaattgttcattttaaacatcttgtttatactattggagtaaatatgtttttttcttctttcttgctcacactcgaaatttgctatagacactccgagggcattgactagtccctttagtacc

SEQ ID NO: 163217 - DNA, 601 bp, Human
caatgtggcaaaaccctatctataaaaaaatttaatcgggtgtggtggtgcacacctatggtctcagctatttgggaggtgagatgggaggatctccagagcccggaaggcagaggttgcagtgagccaagattgcaccactgcactccagcctgggcggcggagtgagaccctgtctccaaaacaaaaaaaggccaggtgcagtggctcgtgcctataatcccaacactttgggaggccaaggcaggcagatcacctgaggtcaggagttcaagaccagcctagccaacttggtgaaacmctgtttctactaaaaatacaaaaattagctgggcgtggtggcatggacctttaatctcaacaactcaggaggctgaggcaggagagttgcttgaacccaggaggtggaggttgcagtgaaccgagataacgccactgcactccagcctgggcaacagtgagactatcgcaagaaaaaaaaaaaaaagaagaaaagaattttattacctactttgggctatatttctaagcagtccagttctgacaggactagctgtatgtactgagacacaatcagctttacatatttttctagctgtat

SEQ ID NO: 163218 - DNA, 601 bp, Human
ttttttttgagacaataagcctggatctgaagaaagaacatacaattgttaattatgcatgtatatgcttttgagttcaggatgtaaatgaatattcactaggtcctgtttgggaagaggaggagagaggggtctctctgttgattcagaatatatttttatacataagttttaatgctttatttgtagtttccccttaattgtagggctgctgtactgtggatattttgctctacaatctgagattgttagggtatagttactccaactattcatgtattatcctctccctgtctttttttgtgtgtgtgtgtgtgtgtgtgtgtggtttctttgtggtgtgcttatgcaaagtagaagtattccagacctttatagcttttttttcttttagtttcaaacacttcaagaaaaaaggtgggggggagactctctcaacggttataattaggcattaattaagccattattcagttaactaaatgcaagatcttttgtttgtttagatggaaaagaaacgtatctttttaatgaaggagggatattaaatgggcccttatttgatcattttgctgcagtattgtaataagtatatgcttca

SEQ ID NO: 163219 - DNA, 601 bp, Human
tcggagatatatccttaagtttctaaacttggtggctggaaaactaataaagatgttacttaagaatagggaagagctggttgtagaagaaataaaaattgtgcaaatgataaattagacttgatgtgttaaatttaaggtgcgatatctaagtcaaagtatgctacaggcaggttggagataaggtttgggaggacttgaaagctttacgttagactctctgcagtcatctgctgggtattctgagacaaccacaaagagagaaagaactggtggattgaatcttccattggagcccacrgttaggaattaatagaaggaagaggctaatttgaagtagactgcctgagaggctgtttgacatagaccaaagaagaaactggaagaaaggcatggggtcagaggagtgggaaaaccaggaagccactggaagagagattctagaagtaggtttggaggggaaaatgtacagttcagggtgaaggagaagtcgtcagataatcatgtgaatgcaatttcagagaaggctgaatacattaagaagtgagagagtcttatattgccttaagtgacttgaattttaagatagatgagacctctt

SEQ ID NO: 163220 - DNA, 601 bp, Human
ggaggacttgaaagctttacgttagactctctgcagtcatctgctgggtattctgagacaaccacaaagagagaaagaactggtggattgaatcttccattggagcccacggttaggaattaatagaaggaagaggctaatttgaagtagactgcctgagaggctgtttgacatagaccaaagaagaaactggaagaaaggcatggggtcagaggagtgggaaaaccaggaagccactggaagagagattctagaagtaggtttggaggggaaaatgtacagttcagggtgaaggagaagwcgtcagataatcatgtgaatgcaatttcagagaaggctgaatacattaagaagtgagagagtcttatattgccttaagtgacttgaattttaagatagatgagacctcttcatatttgaaggttgaggggaagaagtcagtggacagagagcaattggaggtgatggagttagccatctggagcacaagtgacaaatgttgaccgtggtaaggagggagagttgtctgagaaagaaacagaatggggtccgagtgagaagaaagcatgtggcagagctcctgtgcacttttgctgatttt

SEQ ID NO: 163221 - DNA, 601 bp, Human
gaggacttgaaagctttacgttagactctctgcagtcatctgctgggtattctgagacaaccacaaagagagaaagaactggtggattgaatcttccattggagcccacggttaggaattaatagaaggaagaggctaatttgaagtagactgcctgagaggctgtttgacatagaccaaagaagaaactggaagaaaggcatggggtcagaggagtgggaaaaccaggaagccactggaagagagattctagaagtaggtttggaggggaaaatgtacagttcagggtgaaggagaagtmgtcagataatcatgtgaatgcaatttcagagaaggctgaatacattaagaagtgagagagtcttatattgccttaagtgacttgaattttaagatagatgagacctcttcatatttgaaggttgaggggaagaagtcagtggacagagagcaattggaggtgatggagttagccatctggagcacaagtgacaaatgttgaccgtggtaaggagggagagttgtctgagaaagaaacagaatggggtccgagtgagaagaaagcatgtggcagagctcctgtgcacttttgctgattttc

SEQ ID NO: 163222 - DNA, 601 bp, Human
gacttgaattttaagatagatgagacctcttcatatttgaaggttgaggggaagaagtcagtggacagagagcaattggaggtgatggagttagccatctggagcacaagtgacaaatgttgaccgtggtaaggagggagagttgtctgagaaagaaacagaatggggtccgagtgagaagaaagcatgtggcagagctcctgtgcacttttgctgattttcctgtattgttggaggtaagtcctttcactgggatggtgaggaggaagatcagcacatggtaagggaagaagaaccaccrtaggtagtgtgccaggcaatctatagagaagtcaaattctaaacaattggggggaaacctggggtgaagtgtggtgaggctgctgtataggagactaggttaattgttactttttggtatcactttgtggcctggtaggcttagggatagcaaatgggttcagagataagactctagagtcagattgcctgggtgtaagaccaagccccaacacttacttgttttataagaagcctgatgaactaaatgaattgagaagcagtaagcaatgagaatcttggtaatgaagtagtgaaatat

SEQ ID NO: 163223 - DNA, 601 bp, Human
tgccagaaacaaggttgaagcccaaatatatattttacagtaccgcaggtttaaaagtctattcatatgctgcccataaggggatgagtctgctggttattggtaggatccttacctaactgaattacattcagccttaagtgagttcttaccttgccactagacagaatcagaatttgtctgcgtcttctgtcttaccatctcctttcttttaaatgacctgcaaacattttaaagttggataaaaaaggcttttaaatctcaccttcaggctcacaacttggcccactagcatcccctrcccatccttaagtcctttctgagtgggttgtgactgggagtacgggccctgaagtgatatgcattggtgagacttgtcactcaaactctttgagctaagtggtagagggaagagaaatgccaggaaaatcggtcttaattttatcagagacagtagtttttcatgaaagagagtaatgatacagtggatattgctgtagaaattatacagctggttgcgtatagcttgccatctcatctattacagcttcctgttttgctttttgcacattgctggctttgcagtccaacatatttaata

SEQ ID NO: 163224 - DNA, 601 bp, Human
cctgttactctgccttatgcatcaaaccaagggggggactactgtggagaagcagtagagaggttaccttggcaggttccttaactttttttgtgcctcagttttgtcatctataaaatagttcttgttctataggactcgtgtaaggattaagagacctatttaattaaatttaaagtgctcaaaacagtgcgtggtgattcataatggttgtggttgtggtgatgaggatgatataaggatgacttttgattgtttttgaatatagttgacccttgaccaatagaggttcgaaccgcakgagtccacttatactcagatttttttctcaaccaaaagtggatagaaaatacagtatttgcagaaggtgaaacctgaatatgcagaggggcagctttttgtttatgcacgagttccacagggcccactgagacctgtatgcaaggattttggtattgggtggtggggtctgggaaccagtgccccaggtataccaagggatgactatacttctgttgaaatttgatggagaccatggatgcacttttatacagtgtttcccataaaaccacctaccactttctccctttgaagttggtgg

SEQ ID NO: 163225 - DNA, 601 bp, Human
gttccttaactttttttgtgcctcagttttgtcatctataaaatagttcttgttctataggactcgtgtaaggattaagagacctatttaattaaatttaaagtgctcaaaacagtgcgtggtgattcataatggttgtggttgtggtgatgaggatgatataaggatgacttttgattgtttttgaatatagttgacccttgaccaatagaggttcgaaccgcaggagtccacttatactcagatttttttctcaaccaaaagtggatagaaaatacagtatttgcagaaggtgaaaccygaatatgcagaggggcagctttttgtttatgcacgagttccacagggcccactgagacctgtatgcaaggattttggtattgggtggtggggtctgggaaccagtgccccaggtataccaagggatgactatacttctgttgaaatttgatggagaccatggatgcacttttatacagtgtttcccataaaaccacctaccactttctccctttgaagttggtggtgatagtgataaaagtttcttgagttttcaaactagtatgtttcaggtgttctgtaaaagtctgtttttttgcct

SEQ ID NO: 163226 - DNA, 601 bp, Human
tgttttttcttattttattaacagttacatcatagtcgaatgtatcataatttatttaatcattccattattgttaggcacctgggttatttagaacacgaatatacttgaacatagatctttgtgtgtgttcatctgagggagctgtttcccctgtggctctctcaagccgtggctggtttttcccataaaccttttacctcttattgccaccttcagaccattcttctaccatcctctataaaaaacacccaacttcgactatcatgtaaaattataccactcattactcttccttgtyagtcattttctgccccattgcccatatcgttcactctaattcctacaagatttaactcctggttgttattccctttatactataggttgagcgaccctaatctgaaaattcaaaatgctccaagatccaaaactttttgaggactgatatggcaccacaagtggaaaattctgcacctaactttatctgacaggtcacagtcaaaacttttttgtgcacaaaattattaaaattattttataagattggccaggcatggtggttcatgccagtaatcccaaccctttgggaggctgaagc

SEQ ID NO: 163227 - DNA, 601 bp, Human
ccttagagactcttgtcattctgacatccataagttccttgcttccttttcatcaaggagatgctacttttgaaattgtttggctgaaatttcacagcttcagtgaacttacaagtggtaagtagtaagctggaattcagtctacatggtattccttttctttttgattcctaagatttctactcacttaacactgttgagggaccaaattgcatctcttgctggcatgtcacttaagttatactggagagactggaagacttgctgtcagtgtctgcgctttaaacgcacagtgtctgcrctttaaaggcaatagtacctgcattattgcatcactataaatagaatttcacgaactgaacctctctcctatctccaacccccaatttctccagatttagaaaatcagtctccggcaaaaataaattttcagtgggaaaaatgtcaaactagctattctgcatcatcagtcccatgtttggaagtagccagatcaaggctgaatagtaagaggctcagtaagatggaactttacttgtggtgtttgtgatggtaggactctcctgctgctgtgaactgagagcagcagagttctgtgttc

SEQ ID NO: 163228 - DNA, 601 bp, Human
caagatggcttgaaagatgcaagcaatgatggattgctctttattgttttaaaatatttattggccttaaattgctgaaataatatggtttttccaacctttgtgtttttatgcatttttaaccctacgtctttagtgtataatcttctgtgagtctgtggtttctataagtgtcaggaatttttcaggtgtctttattatcctttgaaatcatgatctatttggacaattccatctttgtttggactatacagttgacttgagtacctaagtgaaatggagcaggttagaaaaaagtagyttgttttatagtaatgagaattacattacaagtcccctggcatgttcccctttgaccttttttgatgttttaatttaagcatctcaaacaaggcaagagttgatctcaccaggccttgaatcctatccaaaattggatgttaggatagatgacacatacatttctgtaatactaattaatattgccagttaatattgatcactttctacaacatgtctctgagatatcttgcatctccatggcatctaatgaggtgtattgtgaaatagtttcatatattaaaaatactggaaaataata

SEQ ID NO: 163229 - DNA, 601 bp, Human
tctacttatgcagtgctagacctttcactagagccattatgtctccttagttctttatttttcattttttccctctctttgcattagtatgagcattttttaccagtcttcctgctcactaatcttttattctactgtatttaacctgttgttaagttcatcctatttaaagtctcattagttatatttttcagttctagaatttttatttcattcttctttatggattccagttctctgttaaaatcttcaaccttgtcttctctttccttgacatagtaaatagtaatcattaatactktaaagtctgtttctggtaactccattacctgggtcacccgttaggtctgtttctattctgttttgttttgatcatttggtcctgtttcttggtatgcttgataacttttggttcattgcatacactgtgaatttaaaattgtagtggctaaggttgatgttgtcttcctctacagagaatttgtttttcttctggcaagctgttagagagcaatacccatcacctagaccaaggctaggattaagatgattctagattggttgtaaagactgatccgtttcatttttgcccttagactgg

SEQ ID NO: 163230 - DNA, 601 bp, Human
atccgtttcatttttgcccttagactggggcatattcctccaggagcttccattgaaagcctagactatttaccagggtttctcctcagcaggccctcaactccatttgttgctgtgttgttattttggggttcctcagcgctatgaggctactagaagctctgcttagtttttagcctcttagttacctctttctgctcggctcctagaccttttgctgctcatagcatagctattggcaaatccctggaaagagtggtgacgaatattcagctcacttcattgcatttcccctctctccaggatcttggccccctcaagtcctgagtgccttggttcctctttgatgcctttaaaaagctgggcttttgtttgtttgttttctggcttgtttgtttggaaggaggttggtctgatacgtgctactccagtttagccagggtttgtacaaagttaacctccttaacctttttcacattttatgttttcatgtgctaaagagtaaacagtttaaatgaggcaacttggctaaagaatttggtacagtatgtgtccatgtgctttattccttttatgtcaataaatagcaacatttttaaag

SEQ ID NO: 163231 - DNA, 601 bp, Human
ctgccgtgtgtggcgctggcccgatcttcagagccaccatgaactaaaaccactggaatgctgtgagtttccttttggttccaagcagaaggaggtctgcatcaatccctaccactataagagagtagaaagccctggtaagtgagttattttatgttgatgtgctttgtgtgcccagtaccagatttgtgttgtttagaacatgaaaataatccctttgcttgtttttagttgtaatttaaaaatatttggggaaactgtgtgtgtgtgtgtgtgtgtgtgtgtgtgtgtgtgtgtgtggctgtgtgaatgcaagagagaaagcccctgagtgtttcatacattttaacagcttagtcatctctagttaacattatgtcttgggagcaggctatgacaattgtcattgcagtactaatacctctaatttttaataaattgttttctttctaaatttattttttatgtctcacatggttctctgcatttctctagataaaattagctatgaattgtattctaagggaagaaaattaggaaagaaatgcattattgctgtctatatgcttaagggaagtacatcatgagggtagttgccagt

SEQ ID NO: 163232 - DNA, 601 bp, Human
gatcttcagagccaccatgaactaaaaccactggaatgctgtgagtttccttttggttccaagcagaaggaggtctgcatcaatccctaccactataagagagtagaaagccctggtaagtgagttattttatgttgatgtgctttgtgtgcccagtaccagatttgtgttgtttagaacatgaaaataatccctttgcttgtttttagttgtaatttaaaaatatttggggaaactgtgtgtgtgtgtgtgtgtgtgtgtgtgtgtgtgtgtgtgtgtctgtgtgaatgcaagagagaargcccctgagtgtttcatacattttaacagcttagtcatctctagttaacattatgtcttgggagcaggctatgacaattgtcattgcagtactaatacctctaatttttaataaattgttttctttctaaatttattttttatgtctcacatggttctctgcatttctctagataaaattagctatgaattgtattctaagggaagaaaattaggaaagaaatgcattattgctgtctatatgcttaagggaagtacatcatgagggtagttgccagtgacttaaaccattctgaactta

SEQ ID NO: 163233 - DNA, 601 bp, Human
agcaggttttaaaaatggaagatcaggtttatattctgctatatcactaccctggttctaaaacagctctccaagagatgctgcttttcttagttctttattctttcgcatgagaaaagacatttttttatctaaattgtggcctggcgtggtctggcttatgtggtcgcacatcaccttcacttgactaattgcccagtggcctgtctgggatgttcagtgagaataaagtaaaagaagagtgattttataaggagcatttggacagcttattgtaaactaaaaataaacatataaatamcagagtgaaattgccttatatgtttttgcctttgtttccctgtagtttccctatcagttctagctagctagctttgtagcagattttgcagtattttttgtgtgtgacaatacctttctttgagcacctgaaaagtttacccagggtatggtggtgtgcttgacagatatttaagtaagatgatcaacttgggagaaaagttgtggataaatgtctattcacatataacttacagcttttaaataggaaaaataatagctaatcttaaaatgttatttaagagaaaactgatgggagcat

SEQ ID NO: 163234 - DNA, 601 bp, Human
catctgcccttgaagtgtttatggaggcttctgtttatttcccattgatcagtaattttttttttttttcgagacagaatcccaccctgtcaccctggctgtagtgcagtggcgcaaccttggctcactgcaacttccaccgctccccgccccggccccggccctgggttcaagttattctcctgcctcagcctcccgagtgtctgggactacaggcatgcactaccactctcggctaatttttttgtttgtacacacacacacacacacacacacacacacacatacacacacatatatwttttttttttttgaaattgagtctcactctgtcaccagggctggagtgcagtggcacgatcttggcccactgcaacctccacctcctgggtttaagtgattctcctgcctcagcctcttgagtagctgggattacaggcgcccgccactacacccagctaaatttttgtatttttaatagagtcagggattcactatgttggccaggctggtctcgaactcctaatcttgtgatttgccctcctcagcctcccaaagtgctgggattacaggcgtaagccactgcacccggcctaacttt

SEQ ID NO: 163235 - DNA, 601 bp, Human
agtgtttatggaggcttctgtttatttcccattgatcagtaattttttttttttttcgagacagaatcccaccctgtcaccctggctgtagtgcagtggcgcaaccttggctcactgcaacttccaccgctccccgccccggccccggccctgggttcaagttattctcctgcctcagcctcccgagtgtctgggactacaggcatgcactaccactctcggctaatttttttgtttgtacacacacacacacacacacacacacacacacatacacacacatatattttttttttttttkaaattgagtctcactctgtcaccagggctggagtgcagtggcacgatcttggcccactgcaacctccacctcctgggtttaagtgattctcctgcctcagcctcttgagtagctgggattacaggcgcccgccactacacccagctaaatttttgtatttttaatagagtcagggattcactatgttggccaggctggtctcgaactcctaatcttgtgatttgccctcctcagcctcccaaagtgctgggattacaggcgtaagccactgcacccggcctaacttttgtattttttagt

SEQ ID NO: 163236 - DNA, 601 bp, Human
cacattaatacttctttctagggctggcagctgttccagacctgtctctttactttcctgaatttaattagtcatcgcttatagttagtgtgaacatttattgtccaagccaggaggcttgaaattgacaagagtcacctattactaattacattggacaacaggtacaaattgggactatcccaggcaagctagaacttacagacaccctacttatacagtctccagggtgggtgtggtggctcatgcctgtaatcccagtgctttgagaggctgaggcaggaggatagcttgagactasgagtttgagaccagcctgggcaacatagcgagaccctgtctctacaaaaaataaaaactaactgcgcatggtggcaggcatctgtagtcctagctgctcaggaggctgaggcaggaggatcgcttaagcccaggagtttgaggctgaattgctctgtgatcatgcctgtgaatagccacagcactccagcctgggcaacatagcaagaccccagctctaaaaataataataaaatttgtttttaaaaaagcaaataaggaagtttttgtaagtgctgctgtggaccatgtggtagtaatt

SEQ ID NO: 163237 - DNA, 601 bp, Human
tgaatttaattagtcatcgcttatagttagtgtgaacatttattgtccaagccaggaggcttgaaattgacaagagtcacctattactaattacattggacaacaggtacaaattgggactatcccaggcaagctagaacttacagacaccctacttatacagtctccagggtgggtgtggtggctcatgcctgtaatcccagtgctttgagaggctgaggcaggaggatagcttgagactaggagtttgagaccagcctgggcaacatagcgagaccctgtctctacaaaaaataaaaaytaactgcgcatggtggcaggcatctgtagtcctagctgctcaggaggctgaggcaggaggatcgcttaagcccaggagtttgaggctgaattgctctgtgatcatgcctgtgaatagccacagcactccagcctgggcaacatagcaagaccccagctctaaaaataataataaaatttgtttttaaaaaagcaaataaggaagtttttgtaagtgctgctgtggaccatgtggtagtaattaccagttagaagatacattggagaagaagcctcatttaatctcattgaaaatagcaac

SEQ ID NO: 163238 - DNA, 601 bp, Human
tccctggaaagccctcaaaagtctgctaaattcctgttgccaccaaatattgtttctttggggaaatatattctgattcctaacaaccaacaataatcataagttttaaatctctcctctctcctctcatgcagtttatgaaacgggctgcttttctgtttgtagctgaggccacaggagctggagggattgcaaagacctttattagagcatccatctggtgaccctggcagggaaacttaggatctaaccctaggatctggctagggctctgtaactgactgttagccagccctgcctytccaggataattatatttatagtggctttgcctcaggaggtttctggaggttgatgaccatgccaattattaactccttagcttcctaatgtagaacatttaggagtgacaggagttgttttctttgcttctcaacaggtgcctacctattgggccgcctttgtaccttgagttttcagttagcaaaatgtgaattgtatgaactaattcttccttgacctcacaggtggtggtaaggattcttgaaaagtgggtaagatccttagaaaaaagatgttcataaagtgtgactcctaggac

SEQ ID NO: 163239 - DNA, 601 bp, Human
gccagccctgcctctccaggataattatatttatagtggctttgcctcaggaggtttctggaggttgatgaccatgccaattattaactccttagcttcctaatgtagaacatttaggagtgacaggagttgttttctttgcttctcaacaggtgcctacctattgggccgcctttgtaccttgagttttcagttagcaaaatgtgaattgtatgaactaattcttccttgacctcacaggtggtggtaaggattcttgaaaagtgggtaagatccttagaaaaaagatgttcataaagtrtgactcctaggacaggatacaagataaattctgtcccacaaagcacctcatattttgtataattaactatcttcatggcatttgcattttctacagttcactgattttacctcttcagctttatttactatgctgcttttttgtgttaaagtgaattagtgtgtcagcttaaaacacttgtggtgaataattcatatcattcaataagcattaactcttaaatgtgaagtcttatcagccagggctgtgaaatataattgtcaatggtgataaacaattatgctttggtttttagtgaat

SEQ ID NO: 163240 - DNA, 601 bp, Human
tgtatttgacagttgctctgagtggtctcgattacttatccaaacattcacgattccctcaggtaaaattttgtctccaaggctctgacacatatgctagatgggctcatgatagctagtgaggagcttgcttttggatggaaaaggattatttgtgagaaacctataccctttgttttatattaagaaaatgcaagacttgtgttagtgttctttgtttaaaaaatcatgtttgcctcttatttgccagaagaaacatatatgtaaattctgaaataggagatagctgtgataaactgaytcattttctgttattctgttactagagattttaaagctagtgattatttaaatgagtagggagagtgtggtcctaacagattccctaaagtcatggaaaattaacagttcaaatcagtaggctataatgaaacttggtgaattttctaaaagcccatagatttaatgcaaaagaccctgaagctccttttcttaagaagtccagtgaagctttcagaggttttccatctatcagtgaaactgaaatgcagaggtcctctcaaagcagattatattaaagtgtgcttaaaatactcttctg

SEQ ID NO: 163241 - DNA, 601 bp, Human
ttggcccattctgggaatggagagacaaaacacacctgctctgcatgacttaaagcaaatataaggaagttagcatgaaatctggatgagaaagatatgattcattctgtaagaatggccagctggcaagatttcttcctgagtttgagaactggagcaacactgtagctgtgatagttattggcaacttaatatgaggtaaagtaacttcttatcaataattagaaactgattttcatggctttgaataagcataggcatacttagtctttgccaaaagtaattcatttttatgccagtrcctttggcatattttcagtcttctattgttctcttcccacttattttttcacttgtcacttgtgtttctttagatggtgagccaaagtctgtggtaggggtgatttccatttctgcatattacagagcaattagcatattgttaatattcagcaaaagtttttgctgtgcttccttagctggtgttttggttatctgatagtaattggagaaaattgttctccaattttctccaattaggagaataaggagagtgtcatattaagaagtacctgctttaaacatcatagaaaaactgtat

SEQ ID NO: 163242 - DNA, 601 bp, Human
tgggtctcacaggaagaagtttggagcaggtgatagttcagtgagatctaattttacacacacagtatgacttttctagtttcattttcatgtttttttactggatcttatatcttacagctttcggcaatacttcttccacctgtggctttccagttcctctcttctctttctcctttcttccctttctaaaattttccaaacatcttagctgtacaataaatgcaagagcgctttatagtaaatacatagcatccaggttttattatgctatctttttagagtgaaaatatactttcartgtgtggccaaataggacattaatcacttaccaaaatgaaattgctgcatgttgttgttgttgttgttgttgttgttatttgagatggtctcactctgtcacccagtctggagtgcagtggctcaatcacagctcactgcagcctcaacctccttgcctcaagcaatcctgccacctcagcctctgtgtaactgggactacaggtgtgcacccctatgcctggctaattttttgtattttttttttttttttgtggagatggggtttcaccgtgctgcccaggctggtcttgaactgagc

SEQ ID NO: 163243 - DNA, 601 bp, Human
ctaattttacacacacagtatgacttttctagtttcattttcatgtttttttactggatcttatatcttacagctttcggcaatacttcttccacctgtggctttccagttcctctcttctctttctcctttcttccctttctaaaattttccaaacatcttagctgtacaataaatgcaagagcgctttatagtaaatacatagcatccaggttttattatgctatctttttagagtgaaaatatactttcaatgtgtggccaaataggacattaatcacttaccaaaatgaaattgctrcatgttgttgttgttgttgttgttgttgttatttgagatggtctcactctgtcacccagtctggagtgcagtggctcaatcacagctcactgcagcctcaacctccttgcctcaagcaatcctgccacctcagcctctgtgtaactgggactacaggtgtgcacccctatgcctggctaattttttgtattttttttttttttttgtggagatggggtttcaccgtgctgcccaggctggtcttgaactgagctcaagcaacctgtccaccatggcttcccaaagtgctgagattacagg

SEQ ID NO: 163244 - DNA, 601 bp, Human
tccttgcctcaagcaatcctgccacctcagcctctgtgtaactgggactacaggtgtgcacccctatgcctggctaattttttgtattttttttttttttttgtggagatggggtttcaccgtgctgcccaggctggtcttgaactgagctcaagcaacctgtccaccatggcttcccaaagtgctgagattacaggcgtgaacaactgtgcctggcctattactatttttaaaacattttgttatgttattttctagaaacctcctagatactgtattaagtaatgcggttaactaagatttttatcagtcatacatcagccatccccagtctttttggcaccagggaccagtttcatggaagacaatttttccacaggggatgggaaagggatagtttcaggatgaaactgttccacttcagatcatcaggcattagattctcataaggagcacgcaaccttgatccctcccatgcacagttcaccatagggttcatgcttctatgagaatctaatgctgccgctgatctaacaggaggtggagctcaggctgtaatgcttgctcactcacctcctgctatgtggcctggtttctaaca

SEQ ID NO: 163245 - DNA, 601 bp, Human
ttttttcttaagacagtctcgctctgtcgcccaggctggagtgcaatggtgtgatctcggctcactgcaacctctgcctcccagcttcaagcaattctcctgcctcagcctcccgagcatgctgggattacaggcgtgtggccaccgcacccagctaatttctatatttttagtagagacagagttttgccatgttgtccaggctgatctcaaactcctgaccccaagtgatcacctgcctgagacagagtctctctctgtcaccgacgccagagtgcagtggcgtgatcttgactcacarcaacttccgcctcctggattcaagtgattctcatgcctgagcctcccaagtagcagggattacagggatacaccaccacacctcgttttagtagagacggggtttcaccattttggccaggctggtttcgaactcccgacctcaggtgatctgtccatctcggcctcccaaagtgctgggattacaggtgtgagccaccgcgcctggccccagatgtatttcttaaaactacgggagtagatagatagcagaaataaatagaacccaaccttctctgatattcctcatgaaacagtgatt

SEQ ID NO: 163246 - DNA, 601 bp, Human; identical to SEQ ID NO: 36290

SEQ ID NO: 163247 - DNA, 601 bp, Human; identical to SEQ ID NO: 36291

SEQ ID NO: 163248 - DNA, 601 bp, Human; identical to SEQ ID NO: 86555

SEQ ID NO: 163249 - DNA, 601 bp, Human; identical to SEQ ID NO: 86556

SEQ ID NO: 163250 - DNA, 601 bp, Human; identical to SEQ ID NO: 86557

SEQ ID NO: 163251 - DNA, 601 bp, Human; identical to SEQ ID NO: 86558

SEQ ID NO: 163252 - DNA, 601 bp, Human; identical to SEQ ID NO: 86559

SEQ ID NO: 163253 - DNA, 601 bp, Human; identical to SEQ ID NO: 86560

SEQ ID NO: 163254 - DNA, 601 bp, Human; identical to SEQ ID NO: 86561

SEQ ID NO: 163255 - DNA, 601 bp, Human; identical to SEQ ID NO: 86562

SEQ ID NO: 163256 - DNA, 601 bp, Human; identical to SEQ ID NO: 86563

SEQ ID NO: 163257 - DNA, 601 bp, Human; identical to SEQ ID NO: 86564

SEQ ID NO: 163258 - DNA, 601 bp, Human; identical to SEQ ID NO: 86565

SEQ ID NO: 163259 - DNA, 601 bp, Human; identical to SEQ ID NO: 86566

SEQ ID NO: 163260 - DNA, 601 bp, Human; identical to SEQ ID NO: 86567

SEQ ID NO: 163261 - DNA, 601 bp, Human; identical to SEQ ID NO: 86568

SEQ ID NO: 163262 - DNA, 601 bp, Human; identical to SEQ ID NO: 36292

SEQ ID NO: 163263 - DNA, 601 bp, Human; identical to SEQ ID NO: 36293

SEQ ID NO: 163264 - DNA, 601 bp, Human; identical to SEQ ID NO: 36294

SEQ ID NO: 163265 - DNA, 601 bp, Human; identical to SEQ ID NO: 36295

SEQ ID NO: 163266 - DNA, 601 bp, Human; identical to SEQ ID NO: 36296

SEQ ID NO: 163267 - DNA, 601 bp, Human; identical to SEQ ID NO: 36297

SEQ ID NO: 163268 - DNA, 601 bp, Human; identical to SEQ ID NO: 36298

SEQ ID NO: 163269 - DNA, 601 bp, Human; identical to SEQ ID NO: 36299

SEQ ID NO: 163270 - DNA, 601 bp, Human; identical to SEQ ID NO: 36300

SEQ ID NO: 163271 - DNA, 601 bp, Human; identical to SEQ ID NO: 36301

SEQ ID NO: 163272 - DNA, 601 bp, Human; identical to SEQ ID NO: 36302

SEQ ID NO: 163273 - DNA, 601 bp, Human; identical to SEQ ID NO: 36303

SEQ ID NO: 163274 - DNA, 601 bp, Human; identical to SEQ ID NO: 36304

SEQ ID NO: 163275 - DNA, 601 bp, Human; identical to SEQ ID NO: 36305

SEQ ID NO: 163276 - DNA, 601 bp, Human; identical to SEQ ID NO: 36306

SEQ ID NO: 163277 - DNA, 601 bp, Human; identical to SEQ ID NO: 36307

SEQ ID NO: 163278 - DNA, 601 bp, Human; identical to SEQ ID NO: 36308

SEQ ID NO: 163279 - DNA, 601 bp, Human; identical to SEQ ID NO: 36309

SEQ ID NO: 163280 - DNA, 601 bp, Human; identical to SEQ ID NO: 36310

SEQ ID NO: 163281 - DNA, 601 bp, Human; identical to SEQ ID NO: 36311

SEQ ID NO: 163282 - DNA, 601 bp, Human; identical to SEQ ID NO: 36312

SEQ ID NO: 163283 - DNA, 601 bp, Human; identical to SEQ ID NO: 36313

SEQ ID NO: 163284 - DNA, 601 bp, Human; identical to SEQ ID NO: 36314

SEQ ID NO: 163285 - DNA, 601 bp, Human; identical to SEQ ID NO: 36315

SEQ ID NO: 163286 - DNA, 601 bp, Human; identical to SEQ ID NO: 36316

SEQ ID NO: 163287 - DNA, 601 bp, Human; identical to SEQ ID NO: 36317

SEQ ID NO: 163288 - DNA, 601 bp, Human; identical to SEQ ID NO: 36318

SEQ ID NO: 163289 - DNA, 601 bp, Human; identical to SEQ ID NO: 36319

SEQ ID NO: 163290 - DNA, 601 bp, Human; identical to SEQ ID NO: 36320

SEQ ID NO: 163291 - DNA, 601 bp, Human; identical to SEQ ID NO: 36321

SEQ ID NO: 163292 - DNA, 601 bp, Human; identical to SEQ ID NO: 36322

SEQ ID NO: 163293 - DNA, 601 bp, Human; identical to SEQ ID NO: 36323

SEQ ID NO: 163294 - DNA, 601 bp, Human; identical to SEQ ID NO: 36324

SEQ ID NO: 163295 - DNA, 601 bp, Human; identical to SEQ ID NO: 36325

SEQ ID NO: 163296 - DNA, 601 bp, Human; identical to SEQ ID NO: 36326

SEQ ID NO: 163297 - DNA, 601 bp, Human; identical to SEQ ID NO: 36327

SEQ ID NO: 163298 - DNA, 601 bp, Human; identical to SEQ ID NO: 36328

SEQ ID NO: 163299 - DNA, 601 bp, Human; identical to SEQ ID NO: 36329

SEQ ID NO: 163300 - DNA, 601 bp, Human; identical to SEQ ID NO: 36330

SEQ ID NO: 163301 - DNA, 601 bp, Human; identical to SEQ ID NO: 36331

SEQ ID NO: 163302 - DNA, 601 bp, Human; identical to SEQ ID NO: 36332

SEQ ID NO: 163303 - DNA, 601 bp, Human; identical to SEQ ID NO: 36333

SEQ ID NO: 163304 - DNA, 601 bp, Human; identical to SEQ ID NO: 36334

SEQ ID NO: 163305 - DNA, 601 bp, Human; identical to SEQ ID NO: 36335

SEQ ID NO: 163306 - DNA, 601 bp, Human; identical to SEQ ID NO: 36336

SEQ ID NO: 163307 - DNA, 601 bp, Human; identical to SEQ ID NO: 36337

SEQ ID NO: 163308 - DNA, 601 bp, Human; identical to SEQ ID NO: 36338

SEQ ID NO: 163309 - DNA, 601 bp, Human; identical to SEQ ID NO: 36339

SEQ ID NO: 163310 - DNA, 601 bp, Human; identical to SEQ ID NO: 36340

SEQ ID NO: 163311 - DNA, 601 bp, Human; identical to SEQ ID NO: 36341

SEQ ID NO: 163312 - DNA, 601 bp, Human; identical to SEQ ID NO: 36342

SEQ ID NO: 163313 - DNA, 601 bp, Human; identical to SEQ ID NO: 36343

SEQ ID NO: 163314 - DNA, 601 bp, Human; identical to SEQ ID NO: 36344

SEQ ID NO: 163315 - DNA, 601 bp, Human; identical to SEQ ID NO: 36345

SEQ ID NO: 163316 - DNA, 601 bp, Human; identical to SEQ ID NO: 36346

SEQ ID NO: 163317 - DNA, 601 bp, Human; identical to SEQ ID NO: 36347

SEQ ID NO: 163318 - DNA, 601 bp, Human; identical to SEQ ID NO: 36348

SEQ ID NO: 163319 - DNA, 601 bp, Human; identical to SEQ ID NO: 36349

SEQ ID NO: 163320 - DNA, 601 bp, Human; identical to SEQ ID NO: 36350

SEQ ID NO: 163321 - DNA, 601 bp, Human; identical to SEQ ID NO: 86628

SEQ ID NO: 163322 - DNA, 601 bp, Human; identical to SEQ ID NO: 86629

SEQ ID NO: 163323 - DNA, 601 bp, Human; identical to SEQ ID NO: 86630

SEQ ID NO: 163324 - DNA, 601 bp, Human; identical to SEQ ID NO: 36351

SEQ ID NO: 163325 - DNA, 601 bp, Human; identical to SEQ ID NO: 36352

SEQ ID NO: 163326 - DNA, 601 bp, Human; identical to SEQ ID NO: 36353

SEQ ID NO: 163327 - DNA, 601 bp, Human; identical to SEQ ID NO: 36354

SEQ ID NO: 163328 - DNA, 601 bp, Human; identical to SEQ ID NO: 36355

SEQ ID NO: 163329 - DNA, 601 bp, Human; identical to SEQ ID NO: 36356

SEQ ID NO: 163330 - DNA, 601 bp, Human; identical to SEQ ID NO: 36357

SEQ ID NO: 163331 - DNA, 601 bp, Human; identical to SEQ ID NO: 36358

SEQ ID NO: 163332 - DNA, 601 bp, Human; identical to SEQ ID NO: 36359

SEQ ID NO: 163333 - DNA, 601 bp, Human; identical to SEQ ID NO: 36360

SEQ ID NO: 163334 - DNA, 601 bp, Human; identical to SEQ ID NO: 36361

SEQ ID NO: 163335 - DNA, 601 bp, Human; identical to SEQ ID NO: 36362

SEQ ID NO: 163336 - DNA, 601 bp, Human; identical to SEQ ID NO: 36363

SEQ ID NO: 163337 - DNA, 601 bp, Human; identical to SEQ ID NO: 36364

SEQ ID NO: 163338 - DNA, 601 bp, Human; identical to SEQ ID NO: 36365

SEQ ID NO: 163339 - DNA, 601 bp, Human; identical to SEQ ID NO: 36366

SEQ ID NO: 163340 - DNA, 601 bp, Human; identical to SEQ ID NO: 36367

SEQ ID NO: 163341 - DNA, 601 bp, Human; identical to SEQ ID NO: 36368

SEQ ID NO: 163342 - DNA, 601 bp, Human; identical to SEQ ID NO: 36369

SEQ ID NO: 163343 - DNA, 601 bp, Human; identical to SEQ ID NO: 36370

SEQ ID NO: 163344 - DNA, 601 bp, Human; identical to SEQ ID NO: 36371

SEQ ID NO: 163345 - DNA, 601 bp, Human; identical to SEQ ID NO: 86652

SEQ ID NO: 163346 - DNA, 601 bp, Human; identical to SEQ ID NO: 86653

SEQ ID NO: 163347 - DNA, 601 bp, Human; identical to SEQ ID NO: 86654

SEQ ID NO: 163348 - DNA, 601 bp, Human; identical to SEQ ID NO: 86655

SEQ ID NO: 163349 - DNA, 601 bp, Human; identical to SEQ ID NO: 36372

SEQ ID NO: 163350 - DNA, 601 bp, Human
aggaaaggggcctggatgtcttaaactgaagtgttgcagatgtgttaccctcttactcttgctatgtgagtaatttatgacatgattcaataatgcctttgtagttaacgtcatagttagaaatttggcctttaaaaaatggctggacgtggtgggtcatgcctataatcctagcactttgggaggccaaggtaagaggatcacttgagcccaggagtttgaggccagcctgggcaacatagtgagaccccatctctatttaataaataaataagtaaataatggggtccctagccaagaycaaggaaaattttaaattttttttaattttctttctaacttttaagatagaatttatgtctctacctcaatgatttttttaagtttatatctggaatgagagccttctccaatgaatgatttttataacataatgttgacattatgctgaaagatatttggcttaagttgttcataacttactaggctgaaaagtaaattaaagtaaaaatgtattcatacttttttggttatatttttaaaaatcgatcctggcctgatccagtgtgtctatacaaacattaactcaaggctgggcatg

SEQ ID NO: 163351 - DNA, 601 bp, Human
taagttgttcataacttactaggctgaaaagtaaattaaagtaaaaatgtattcatacttttttggttatatttttaaaaatcgatcctggcctgatccagtgtgtctatacaaacattaactcaaggctgggcatggtggctcactcctgtaatcccagcactttgggaggctgaggccggcagatcacctgagatcagtagttggagaccagcctgaccaacatgatgaaaccccgtctctactaaaaatacaaaaattagccgggcatggtggtacatgtctgtaatcccagctactyaggaggctgaggcaggagaatcacttgaacccaggaggcagaggttgcaatgagccaagacagcactattgcctaggcaacaagagcaaaactccgtctcaaaaaaaaaataataataatgattaactcaagtttagtatttttctcatctcataaaaagcacatgatagtgaatatttcattacactaaagtgttaatcttatagacaatgctgcatctccttggaccatttaaacttacacagttatagtaaactagtcttattctattatcaattagccctcatattttcacaacca

SEQ ID NO: 163352 - DNA, 601 bp, Human
gttcataacttactaggctgaaaagtaaattaaagtaaaaatgtattcatacttttttggttatatttttaaaaatcgatcctggcctgatccagtgtgtctatacaaacattaactcaaggctgggcatggtggctcactcctgtaatcccagcactttgggaggctgaggccggcagatcacctgagatcagtagttggagaccagcctgaccaacatgatgaaaccccgtctctactaaaaatacaaaaattagccgggcatggtggtacatgtctgtaatcccagctacttaggagrctgaggcaggagaatcacttgaacccaggaggcagaggttgcaatgagccaagacagcactattgcctaggcaacaagagcaaaactccgtctcaaaaaaaaaataataataatgattaactcaagtttagtatttttctcatctcataaaaagcacatgatagtgaatatttcattacactaaagtgttaatcttatagacaatgctgcatctccttggaccatttaaacttacacagttatagtaaactagtcttattctattatcaattagccctcatattttcacaaccaaaaatg

SEQ ID NO: 163353 - DNA, 601 bp, Human
taaagctcccctgaaaaagttctgattagaatttcatgaaacttatgcactaatttgaggaaagtgatcatccttatagcatagaaacttcctgcctgaatattctattaatatgtctttaatgtattaaggcctcagtagacatagaagttctttatttatcattaaatgtattccaatatattttgttttgtcttcttgtgtgtgtagtaaaggtacttgatagggatattctttccactatattttctaactaattattgctggcttcttaatttcacaaatttatctttcatctagmaattttattgatccctcattttttctaaattactttaggtaattaacatgtgatgcctagacagaaaaaaatacaattatgtattatccctttttttcctcaccacattggccagaatttctggaacagtgtttaataacagagaagagagcagtcaaccttgtcttgtttctgatctcagtgggaatttccctagtggttaacattaagaatgaggttggctgttggtttgagataagtacatttatcataaaaaccaaataattgccaagtaccttgtttactagaggcttatttaaa

SEQ ID NO: 163354 - DNA, 601 bp, Human
tccatgtcatcaaatattgtgatatgaaaatgattgctttggtaataaaggtagatttatagttatgagctatgatttattgttgctccaattaaaataataaattggtagttcaaaataaaccaaccaaacctacacgtttcctctttttctctccaatccacatgcttagacacctcttctctattattttggcttcataattctgttcccaactcaaactaacagaaaaagaatgaaaacaatgtgacataagccaagtaaccctatccaggcatagcagccaaataaacaaagcagmtattcctacgctttgtgcaaaaagccttcttcctattatgacagtgctagctgcagaccgcaatttagttacaactgtggtaagcaaaatgtgtgtccaaattgattaatcttatatccaacttatattaagaaaatgtatgctaaagagaaatgtttgaaatttgctaagaatttttaatattcatattcaaaactagaaggttagtatttttgtttttatattcataagtctgtaaaaattagtctatatttttattttctagaacatatcactgataggtttcagttttaaaatgag

SEQ ID NO: 163355 - DNA, 601 bp, Human
tctcttctctaatctttattagtttcatccttgctagctttcaatttagtttgctcttccttttccagttccttgaggtataaagttagattattgatttcaaatcttcttcttcttttttttttttttttttttcttttgagatggagtcttactctgtctcccaggctggtgcaatcttggctcactgcaatctctgcctgccaggttcaagcgattctcctgcctcagcctcccaaatagccgggattacaggcacacgcataccaccacaccgagctaatttttgtatttttagtaragccaaggtttcaccatgttggccaggctggtctcaaactcctgacctcaagtgatctgcttgtctcaacctcccaaagtcctgggattacaggcgtgagccagcatgcccaactctcacatcttttttaatatgaacatttactgctattaattttcctctgagcactgtttttactgcatcccatatattttgatacattgcaattttgtttttattcttctccaagtaaatctaattttcctgtgatttatccttgtgactcattggttaagaatgtgttgcttaatttgcacatat

SEQ ID NO: 163356 - DNA, 601 bp, Human
atcagaaacaatgatttgtctttttcttgataagaaccatatatgaaaaagtaaacccccagagaaacaaacacccagttctgtctgcccaacccctttcattattagtttcctaagcttggacacagagcattacacctatccactccctttgggttattgctggtattctctaggccgtagctccaaaatgggtcatagagtggagaaactaatgggagagattagggcaaagaggtgtaaaatacttcttagccatcacacatagtagtggaattactagtaggggccgtgaggcagrtagcttccttactatccttccataccaacacctttgattgccttccaacaaaaaagtacatgtccatttcagcttcacagttcttgcaataagtccagtatcctatcaaattctggaactagggtgcttgtcaacagggttatagctgctcttatggtacttttctgtgagttagaaaaagcacctctctgagaagacacaggctgaaggaggcaaggctttgcaactgagcacagcctgctcaaccatacacagtggccctggttgtcagtctgccttccaaggccattgtgagttctc

SEQ ID NO: 163357 - DNA, 601 bp, Human
ccaaaatccagaacacttacaacaccaaatgctggcaaggatttggagcaacaggaactcttattcattcctggtgggaatgcaaaatggtagccactttggaagacaatttggcaattgcttacaaaactaaacattctcttaccttatgatccagcaatcatactacttggtatttatccaaaggagatgaaaacttatgtccgcacaaaaaaacctgcacacagatatttataacagctttttttcatcacactggggtgagggatgttgataatggggaagggctatgcttgtgtcrgggcagaaagtatatggaaaatctctggacattcctttccattttgctgtgaatctaaaactgccctcaaaaaaagtttaaataatttttttaaagcagtactgtattgtgatgtttaactcaattacttattacaagaaaactattcaactggtcaaaacgttatatataagaagtttctgtttgttaaaaacattgtttcaaatatatttaggctttgacttttaaaagtatacagcaacattcaagataactagacagaatgcactgcaacttggcaggtttttaaatccttggact

SEQ ID NO: 163358 - DNA, 601 bp, Human
ctttgtgaaatatatggcaaatattttcaagaattatcaatgctttggtttaaaatgcccaggctttttatctcaggtaagaaggtagtccccactcaaaaattcttaaaatcttctcctatattgcctgttaattctctttttatgatttactcattaaaacatctgaaaatgatttttgtatgctaagataaggatttaatttttttctttgtttttatgactaggcagccattttttcctgaaatcatttgttgaaatcatttctctcccaactgactagaaatacctccttaatatmgtaaattctcaagtgtacatgcatcttttctttagactcatctgttgctttgatctttttgtctcttcctttaaaaataccaatctgctttgatattacgttttctagtaattcataggacaagtccctcttcatttttccttttcaaaattttcttgaatataattgcattatctttgagataaaatttaacataaactgttcatgcttcattaaaatactctttttgggatttaaccattatattttcttatattttgtgactggtatgtagatgagtgtttatgtatctggccaact

SEQ ID NO: 163359 - DNA, 601 bp, Human
tatacaagcttaacatgcttatacttatttaacatgaagtgaaaatcattagcatagttcaggtatgtgcatggtatgtgcacgcacatggggcagtgctgtcatctaacagaagcccacctttttacttgactaatggtttactgttaatacctcgataatagtgtaatctttgatagacttttataaatgattatttcaaatgctttttgatcaccttcaagaatatgacctgagacaggtaatgtaatttagcagtttgcatctatgaactgtggaggatacctacagacactgaagygttactaacagtaggatgcaggcattatgtgaatgcgtgggtattttatttccatttatgggctactatagcaaaaataattggggagttgccctatgatgaaagaagactgcatgttttttaaaaccatacctttgtccaaaagcaaatggtaaataaaaatagactgttgacataaagcttcgctatttcgatgctatgcattagctgattgactgttactgtttatcctttttgttttctaacaccttataagcataaaatattactgtttaattgcagttcgtttgtgttcagtta

SEQ ID NO: 163360 - DNA, 601 bp, Human
actgagcagtgccatgtttacgttcacctcagaggagtagaacatcacatgcctgctttcccttttggtgttatactgtttagttgtgcacttaaacccataacatttgataaatagtctcagagaaagaagtattactggagaaaaaaaggaagtaaggcaaaactgagactcatgggtgtggtctttgacagtgaaatcttttagctcttgcaagatcacatagaaaatttcaccaagttctaacatccagcaaaatggagaacatgtactggggacctttgggtttaaccagtgagaytgtcttgtttatcctgttgcatttagccttccagcttatggaaaaatacaaaattcaaattctaacactgctggatttatgatatttaaggtttctattatatcagctgcctggatggagcacagaaacagcgtagtacaatatgctatgggtatattcatgaccaaagtttacaatgtggaaggagaatagaaatgcaagaggtcagttggggaattagctgcttgtgttatataactccttaaaagtggaaaatgatcacaagtaaatgtgagtagtgacagttctcttccatttcct

SEQ ID NO: 163361 - DNA, 601 bp, Human
cacgggagagtgaggtgtgactgctgtcacacacttacatttcagtgcctctctgggcctgataattaaaatgggtttgcactcctcacattaaaagtttttatttctcactatgaaataaggagggaagttcattttaaaaggagtggcagaataaggagaattggagaaccagtacagaagattcaaaacccagatagtagaagtcccagaaaggaatacaaaaggaaagaaattgccccaaaaaattttcaagaaaatttccaagaactgaaggaggaatttccagattgaaagggcmcaccaaacacctattgctatgatatagtccatggccaagtatggtcctgaaatttcagaatcctagggacaaaaagaaaaaaaatcctaattgttttcaaagagaaaaaaatcggtttaaggccaggcacagtggcttatgcctataatccaagcactttgggaggccgaggcaggcagatcacctgaggctgggagttcaagaccatcctggctaacatggtgaaaccccgtctctactaaaaatacaaaaattagctgggtgtggtggcgtgcgcctgtaatcccagctactggggag

SEQ ID NO: 163362 - DNA, 601 bp, Human
acagcatagaaaggttaacaaagcagagcattagataacatttctacatattggattaatagtctttttacataaaataacagacacaaaatgtcatacactattttatgcatttcctagttttccttctggcctccttcaaagaaataataagtgggcctgtcctcttttttggtttatatttggtaggaaaaacatgtacatcttgtgctataaggtggtacaataatgcgtattgcttttctctattgttttcttttcaaaaatgtagtttttttcggcttttttttttttttttttkgggggtaaaacgattttggcctaattggccatccaaggatgtactagtatcaggagacattaaaaacaggacttcaagaatacaaacaatagtgaaggcatagttatcttcatttttttcctatagataattatgcaggtgatgctttcttcctctttattatgatgtcttttctagcactgttgtccaaaattagattcagtatcttccctctcctcctgaaaattttctttctgtcactttatgtctggctatcaccactttctactgggtgttttgaaaaccagtggctggtgaacc

SEQ ID NO: 163363 - DNA, 601 bp, Human
tccttgcctgttttagtaaagaattgatattatttaatattaaaaacatccttatcacagtgggaaacctgtttgaaaaaggatgactgccgtttgataattaaataaaaggaatgggtaagatcattcccacctatatctcaacactctattcaaatgccacctacctctcaaagcctttcctaaacttcataaatagattaactttcctctccaaactctagccttttggatatcttaggatgctcatatactatatgcttcaagttacagttaatggtaccttcatgggaggagatgycatgtctgattcattcttactgtatcagtggtacccagcacacttctgctcatagttggcactaaatattttatcaaataagcatattgaccataacaccctgggagagcactttgcagctgactctaatgaacaatccttgaaccaagaattttaaagatttaatctagttcataacacagctttatagctatagataagtcatttaagccttctgagccttatcagtcaaagaggaatgttaatatgtaataggaaatgaagaattggtgaaaatactttgtgaaagaaacataactt

SEQ ID NO: 163364 - DNA, 601 bp, Human
gggtagatgagagtatccaggctccagaagaactgcaggggacaagattgggttggtgatttgcattgagctagccctgctaccttcagggatttcagaatttttttctcatgtaatggaaggaaaccagcaaaccaaatccagaaataaagcaaaaccctaactaggagagtgttttcaagggagagattgctatagcatcagcctcttgggtttggagaatgagcttaaccatgagatttaggtttgagcatgtttactataagtaaaaagcattttcctggagtctggcaaatattgyggaagatgtactgaaatgtaattgaaatgtagctgcctcttaattttatacttaacaaatgccaaaaataaataaataaacaagtgactttaaagttcagggtgttaatatttgaaatctgtccagtttaattagctgagtcccagagactttcctttttctctggtcagtgtcgctgatctaacacctaattatcttcttggttgtgaaataggaattaaaagtatcatttacttatttgtatcaacctggaacttatttctttagcatacattcttatttcaggaaataggatgcatc

SEQ ID NO: 163365 - DNA, 601 bp, Human
gaatgaagcagtgtctaaaatactcaaaatgatgctttttattaatgctaactgcttatgtttccatagtgtctatgtctgggccaagatcctagcaacattaattatcgtaacaggatttcaactttttcatctatcagaggtagcagtagaaactaacttcctaagtggaatgcataaagaattgccatttcttcagtttttcagaaagtaatgacattgttatccaaaaccctggaattgtttttattgagcctggtaaattacttaaaatgtatttagtatcttaaaatgaaagacyttggctgaaagattacttgcatgtgggtattaaaaaaaagttgtgatttatgatcagttgatttttggcaagggtgccagggctattcatgggaaaagaatagccctttcaacaaataatgccaggacaattggctaacctcatgcaaaagaatgaatctggacccctacctcacaccttatacaacattaactcagtatggatcaaagactttaatataaattataaactacttaaaaagaaacaattgaaaatcttcatgaccctggattaggcaacagttccttagatatgacagca

SEQ ID NO: 163366 - DNA, 601 bp, Human
agaagtgaaaaggcatctacagaatgggagaaaatacttacaaatcatatattggataagagtctagtttctagaatatataaagaacttttaaaatttaacaataaaaagagaaataacccatttattacaagtggacacaggatttgaatggataaattgccagagttacacagatggccaataagctcatggaaagatgctcgtcattagggaactgcaaatcaaaaccttgatagggtatcctttcacacccactaggatggctgtaattttttaagtggactataagaagtattgktgtggatgtggagaaattggaacccttatacaatgctagtggaaatgtagaatggtacagcttctgtggaaactggcagttcctcaaaaagttaaagatagaattaccatatgactcagcagttccacttctaggtatatatctgaaaatattgaaaacgtgttcacacaaaaatgtatacacaaatgtgcacagtagctttattcataacagccaaaaggtggaaacaactcaaatgtccattaactgaggaataaacaacatgttgcatatcttacaatggaatattatttagccata

SEQ ID NO: 163367 - DNA, 601 bp, Human
attatgtttacatagtagtgtttcagaagtctccaatttcacctacacgttctgtgattccccagaaggattcatgcaactcaacattggatcatactcatagttaagatttattacagtgacatagtaaagatatatagccagattattaatggaaaaagacatcaggaggagtctagaggaatccatgttgttcagccttcctatacacctttccttcaactttaaaattcagtaacgtgtgcagtatatcaggaactccattttagtttcagagttcagggtttttttttttttttttgaggattgatcacataggcaccctcttgtcaaccaaaattccagattctctcaaaaggaaaggtgttcattgtaaatctcattgtatagtcttaagtgggctggcacagcaggcacaacattatcatttaggaaaggttttcaaaagccaggttcccaaatgccagctgtattagtctgttctcacactgctatacactgctataaagaactacttgacggccatgcatggtggcttgcgcctgtaatcccagcactttgggaggctgaggtaggtggatcacctgagatcaggggtttg

SEQ ID NO: 163368 - DNA, 601 bp, Human
gcatgagatttgggtgggtacacagaggcaaaccacatcactagccaagggaaaacttgcacctaaacctttctgaagataacagcctcaggcctgctgtgttaaattacttctgcacaggcagttgaaagtgagagatcttatgttggttttcccaattaaaaaaaaaaattactagcctgtgaaactctgaagtctaatatgctaatattttggaaaaattctcgaaccttgtttttcctctaatctcacacaacaacaataatcaacaacatagaagaggagaacaggagaacgtcasagaattgaagtttagaatttggattttttttttccattcaggtttaaggcataaccatttttattaaaaaaaaaaatctcagagtttattcttattttgtgattaggttcattaagaagacttgacaattgtgaccaaatgtgtgtgggtttctccccacatattaagcagtggacaccagctagatgtcttccaattcagttccaacaccatctactcagagataacatcagatccgacaagtaaagggctcagtcccacaagaccaccctctcccctccccaagttgcaagtcccagc

SEQ ID NO: 163369 - DNA, 601 bp, Human
gaaggattatttgtgctttggaacagtcttcctgacagtgggatagagatagataggatacagaacaatgtgaaattgagctcaacaaatatatattaagaacctatttcatactaagcaatgttctaagagcaagcaatataaaataactggcaactatccagttgcactttatgcactttaatatatgtattgatataaaattatgtagttatatgatacataaaatatctattaatatacatactaaatgtatgcacatatatattatacctcaattttttaaaaaagtgaatggcartcatttcaagcaatcaaaatgaggacataaattaagcattagagatgagttggggaaaagatttaaggtttatttaggagataaaatggaaagcaggggtgcctgaatgcaggccacatctgaggcctggtaccctctcagatggtgtcctggtatctggaataaattactggattaatggtggtgctgatgactgaaaccaaggatggataagagggtacaaatttggggtagggaaataagatctataattaggttttagttaatagttgtagttacctgtgaggcttataggtgaaa

SEQ ID NO: 163370 - DNA, 601 bp, Human
agaagggtagttgccagaggttgagagggaggaaggaatgaggaattactgcgtaatggatacagagtttcagttaggaaggatgaaaaaagtttctggaggtagatggtggtgatggctgcacaacaatgtgaattttttatttgatatatattttaccatatttttaaaaactctattacaaaaaaaagaattggtctagcctagataatcttagtagccatgttttattgctattcaacttgtcactcatcaatttatataaactcaccagccttttaccacttagctgtctatactycacatcagttcttctctcagtgtttcttccagttcactgcaatttgagactcagaagtttttctttgagaagtcagtatgctgtatccattaaggaacattctgttcaggaaagacatctaagtattccaaattgataagggaggtaaagacaaaacagataagtgatttttaaaatattattggcttaaattacgaaagcaccacatgcttattttttttaaagtaaacaattcaagatgtacaggatataaagtgatagtcctctccctcactccccagggctatccattgttagtaa

SEQ ID NO: 163371 - DNA, 601 bp, Human
ttatattcctagtccagacctgccctctgaactgtatacccatttgtatcactgctacttggaaggcatattaaactgaatatccagacctgaacttacatattcaccattttttctcacctgtaccattgcaagagagtaatgagtttaataagctgctgcgtggaataatactaccttttattttccctaaatttacttcacataaatttcaaaggataatctctcctcttaccactactagtgtcctgctactgatcacgaagtatatttattttacctggcctctaaattgtgtttwtctcttttagttctagactaaattttccattgttatgcctaggccctcttgccaccatgctgttaaattgttttttttagaacctctagtcttaaaacatggctctttttagcttatcctctggtacagccctcattctagaccatactaaaataccagacaatttcagatacatggaagtagcgcactaatctcaaatacacagaagcagtcttcttcccttcaacatttaaattcatattacttcataaataagaaaggaaaattaacatttaatgaatgagcgtattctacaggtgt

SEQ ID NO: 163372 - DNA, 601 bp, Human
tcctcttaccactactagtgtcctgctactgatcacgaagtatatttattttacctggcctctaaattgtgtttttctcttttagttctagactaaattttccattgttatgcctaggccctcttgccaccatgctgttaaattgttttttttagaacctctagtcttaaaacatggctctttttagcttatcctctggtacagccctcattctagaccatactaaaataccagacaatttcagatacatggaagtagcgcactaatctcaaatacacagaagcagtcttcttcccttcarcatttaaattcatattacttcataaataagaaaggaaaattaacatttaatgaatgagcgtattctacaggtgtcacagccctacaaaagtagacattgttagctttattttcaaatgaagaaacctagactcagaaatgttgattttccaatctaagttgcagaatctatactgaaactaggtttatcagaccgaagaccatattcgttatactaacctagctaagtcatagctcattccaggttttcaaactgttttcttcccattgctatgaataacttaatatagtctcctctctc

SEQ ID NO: 163373 - DNA, 601 bp, Human
ttcacaccctctagccagaacttagtcacatgatcacatctagtagtgaagaaggctggtaaatatatcctctagctgggtgaccatgtgccgtgttaaaactctaagaaagaaagaaaatggatatggggaataattagcagtccttgccacatcttttggctgactacgccaaaattgcctggagagtttcaagtatcacaagactccataatatggaattaaatatttaatcagtttattactcataccaagttacttgtcatcaatttctgccactgttccatgagagaaatttctrttgcttctttgaccatctttccaagagtagaatcagtaataaaataattaaaacatctgaaactgttaaaactgatagcaatttacaagtcagattaccataatcgtaaatgattaggttatagaaaacctgcagctggcctctcctgcttgtcccaagattctttgtattatgtaattagaaaatagaaatctctttgttgagaagagaaatttgaaatggaatttttctcttcttgccccctcttgattaaaagagaaaaactgacaaagtcttacatagaaaggaagcattctcctt

SEQ ID NO: 163374 - DNA, 601 bp, Human
tatatcctctagctgggtgaccatgtgccgtgttaaaactctaagaaagaaagaaaatggatatggggaataattagcagtccttgccacatcttttggctgactacgccaaaattgcctggagagtttcaagtatcacaagactccataatatggaattaaatatttaatcagtttattactcataccaagttacttgtcatcaatttctgccactgttccatgagagaaatttctattgcttctttgaccatctttccaagagtagaatcagtaataaaataattaaaacatctgaaamtgttaaaactgatagcaatttacaagtcagattaccataatcgtaaatgattaggttatagaaaacctgcagctggcctctcctgcttgtcccaagattctttgtattatgtaattagaaaatagaaatctctttgttgagaagagaaatttgaaatggaatttttctcttcttgccccctcttgattaaaagagaaaaactgacaaagtcttacatagaaaggaagcattctccttaattctaaaattattcagatgctatgatgtattaactgctttttctttgtaccgagaagaaaa

SEQ ID NO: 163375 - DNA, 601 bp, Human
tgtaaaataaaaatagtttgtcatagtttaccatttggcatgctgagaaattggtggcagcactgtcacctaaaagtagataattagattggaaatctgatctgtcaaattgcagatcttctagataaatcttggtactggagggtgggaacgtacagggcttataacctagtaggcagaaaatggttgaagaaagacttgtgtaagccaggatctctgggttgctgatcctgtttgatctcgtactatttaaagaaaactcaaaattgaagttgattcttagcttaccaaaatttcaagrtgtattttaattagattgtgtctaattagtttctatctaaagtgctatgtattaggataattaatatttaattatcttccttcatgaactgtagagcttcctatggagagcatttgtggtagccacgcaaatcctttagtaaatctttcattctctttattaaccttggaataatttgaaaggtttttgaattgggactatttcttttttttttcaatccactcaacatttattaaattccttaataaatcattggaggaaagcagtgatatttttgagaatattgcaattaattattga

SEQ ID NO: 163376 - DNA, 601 bp, Human
ttgtgcttttttttttccattaaggaataaatgctaaattacagttttgatccttactgaaggatcaggaaatcatagattgaatccttgactgaaatgtctttaaataagttaatctttaaaacttctgcggtgctttaagtgtcttaaatcactgatgtttgtaacaattacaagtacattcctggagccagtttgtatctcataaatcacaatacctgcaaaatgacaatgtgggcaactcatatctatttatattatcaatggatggtaaatatatgttcatgtctatcagtgaatwtcaggctaactggtttttatgtcagcagactgagaactatgagcagagaatacgtgaacaacaggaacagctgtcacttcaacagactattattgacaagctaaaatctcagttacttcttgtgaattccactcaaggtatgttcatgttaattttttatgtatttctagaacctcttggtgaaaagaaaggtgtaagttgagtttttctattttattccttcgttgtttctcaatagttttgatattataactgtggtacagttatatgttatgtttatttaaatgaacacttgcagga

SEQ ID NO: 163377 - DNA, 601 bp, Human
tatctccagtttaaagtatgtagaaggtagttttgaaaataaaaccttggttagaacaaaagggatgatgtgaaaagttctaagatatagtaatagttttgttttttttaatttggataatttgttatttatgcaagttttagagtttattttcagtcaataagtatcaaaagcagaccttcaatggaaatctttttaaaaattatatttgtttaaattctgtaagctaagtattttatctgtgaaatatatatttggatacctgggatgaaattaagtttaagtaacagaaatcatttcrgagatagcctgtgtgcaaagagtgaataatattacatcaattataactatatttttgggcagacggtaagaggaaaagctccaagtaaggaataaacctaacttcagcgagttctcttaattatctttactaataggggaaaggtttatgttttagccacatttttatactttgaatagttcatcaactcaattttctttgtaaccatttaataaaaataaaaattaactgtcttgcagttcagctttctctttttttatgtatctctagccaaagtgctaatgagcactaaacgtataa

SEQ ID NO: 163378 - DNA, 601 bp, Human
ttgagaaaatgtctgaataaccatagcttgtgtgtcagtcattctttcaagcaaaaatggcattccattagaaaagtaaccagtttacttgcaactcaaatagttgcacaagtacttttccccaagacaataattgtacttcagtatgcagcagaagtccttttgtgtatacttcccattttgtcacacaaaatattaaaaatatgttgagatcaagtttcaataaaagtaatcacttttactgccttattaaggacattcttagttgaaactgcctttttttgctggtttttttttttttaactgagtgtgtgacattaaagaatacagtgacaacagtttgatatggccttagtcatactcgggcaccagcagttttattcattgtttttgcatcatcagtctaaatgccaacacagtaaaaaatgcaaatattaataatatcttaattgtgacaatagttgatttcaattatgtcaggctctgggatttcattttattctacttacaagctaataagttagttactgtttcatgggtgggtactggaggaaaacagaaaagtgaatcagagaaaaaggactttattatttacagtaaa

SEQ ID NO: 163379 - DNA, 601 bp, Human
actgagtgtgtgacattaaagaatacagtgacaacagtttgatatggccttagtcatactcgggcaccagcagttttattcattgtttttgcatcatcagtctaaatgccaacacagtaaaaaatgcaaatattaataatatcttaattgtgacaatagttgatttcaattatgtcaggctctgggatttcattttattctacttacaagctaataagttagttactgtttcatgggtgggtactggaggaaaacagaaaagtgaatcagagaaaaaggactttattatttacagtaaagytagtagcgaagaacatcttattttcattggtcctgcctaggaggtaacacagacacagatgatgcttatacatgcaatggttacattaaaggagaggcatattgagcttggggaacccaccattttatagcaggcagtaagcatgcctgctctttgtccaagagggagacattacctagtctttcaaatttgctctgcaaacacaagcctaagaaaaggctccggtaaagaacagtgagattcttgtattcctgacatgaacagcaaaaatgtgccaggatgctcaggggccatggcaga

SEQ ID NO: 163380 - DNA, 601 bp, Human
cgcctgccaaactatacacaaattatttgatctcttcaaagcaaatttaaaaatcataattaaatacgtaattcagaagattttgtggcttgccaggtgcagtggcgtgcacctgtagtcccagctacttcagaggctgcagcaggaagactgcttgagtccagaaatttgactccagtctgctcaacgttgcaagacctccatctcaaaataagcagcttttgtgatttcagttaaataagtaatacatgcaaattgcttaaataatagctattttcaagaagatagcttctgttcttcwtggtgtagtggcataacactaaatttgtagttaaaggatttttccaaatcagttcattttttcttttttgagatgagttcttgctgtgttgcccaggctggtttcaaactcctccctctcagcctccctagtagttgggattacaggagcacaccaccatgcacagcacagatcagttcattttaaatgtagtgtttggggaaagagtgaaaggagtgtgagaaatcttaattaaattgctcactgaagttatgcagtttctattttgcattaaaaaagcatgtccacaattaaatattt

SEQ ID NO: 163381 - DNA, 601 bp, Human
gcaccatctttataaatcttttaaatgcttgttgaattataaggagctgtagcttggttttctttcttcctttaatacagctgcattcttcagcaaagaatctataacaaaagacaaacacgttgatttaaatatataggccatttttactgaatatcaaaagaagtagacacatagatttttttccccctaagtttctgagcgtatgaggtgcttggtgaacagagcagcaattttgatcaatagttgaatttgagaaatttcttgaattaccagtaccggaaatagtaattgaagttaycagaaatatttcatctcttcagactttccttcttcattttcctttttccttgatttttctcatttaaagaaaaaaatcaattgtatattacatataggtctataagctgtctcaagttatttttcagtagggaaggtaaataaaatttcctttgtgttttctctttactcgacctcatttgaatttgggagcaatttaaagtagtaatagtaatcattttgtatgtttaaggtaagaagacaagaggtttcttctcctagaaaagaaacttcagcaaggagtcttggcagtcctttgctc

SEQ ID NO: 163382 - DNA, 601 bp, Human
atgcctgtaataccagcactttgggaggctgagctgggcagatcacctgaggttgggagttcgagaccaccctgaccaacatggagaaaccccgtctctactaaaaatacaaaattagccgggcgtggtgacgcatgcccgtaatcccagctactcgggaggctgaggcaggagaatcacttgaacctgggaggcagaggttgcggtgagccaagatcatgccattgcactctatccagcctgggcaacaagagcgaagctcggtctcaaaaaaaaaaaagttaatatcaccctagtgacrttgtaggtagctgttgttacattgtagcacattttgttttttttgtaaatttagtgtaacctaagtgtatagtgttcataaagtctacagtgatgtacagtaatatcctaggccttcacattcactcaccattaactcactgactcacccagagcaacctccggtcctgcaaattccattcacggtaagtgctctatacaggcatacccattttttatcttttatgccatatttttactgtaccttttcagtgtttaaatacacacataccattgtgttacctgcagtattcagtacagt

SEQ ID NO: 163383 - DNA, 601 bp, Human
tgtagcctagtatattttttaaatagtctctgcatgtgtatgatatcaaatattttatttaatgtttctaaagctcacagactaatatcccccaaaccactcctgccctcccttttagattcaaattctatcacagaatgattcttttagttaaaaaaaagtttaatgtctgaaagcaaatgaaaactatataatttttacaaaaaacagaagcttatgaaaatacagattgatgtaaatgtctatgtaacttgcaaacatttgtctgatttctctttgccttgagatatttaattttttwaaaaaagttattaatacccttttgctttaagtacacatataggttatagacttaaatcagcacgcaaagaaggcagttgtcaagctgtggtatattttagtagtgggaagaactaggcatggctgacaataagttttaattataacctcacttatgttcttgttcattgtactttatttcacatcatagtctcagttatagttgctactaaatgaaacaaattaaacaatttcatttattgcaagtagaattcctgtggagctgtgaagtgcatcagttctaatgcttgttacttttttc

SEQ ID NO: 163384 - DNA, 601 bp, Human
gtttctaaagctcacagactaatatcccccaaaccactcctgccctcccttttagattcaaattctatcacagaatgattcttttagttaaaaaaaagtttaatgtctgaaagcaaatgaaaactatataatttttacaaaaaacagaagcttatgaaaatacagattgatgtaaatgtctatgtaacttgcaaacatttgtctgatttctctttgccttgagatatttaatttttttaaaaaagttattaatacccttttgctttaagtacacatataggttatagacttaaatcagcaygcaaagaaggcagttgtcaagctgtggtatattttagtagtgggaagaactaggcatggctgacaataagttttaattataacctcacttatgttcttgttcattgtactttatttcacatcatagtctcagttatagttgctactaaatgaaacaaattaaacaatttcatttattgcaagtagaattcctgtggagctgtgaagtgcatcagttctaatgcttgttacttttttctctattatatgtcttgcttgttcttttactagtctgtgcattcatgtttcagtagatggcacc

SEQ ID NO: 163385 - DNA, 601 bp, Human
ttttattagtattaataaagctagtattatgcaagctagtataagtacaaagctagtataagtacaaaattcctgagttgggccaggtacggtggttcatgcctataatcccagcactttgggaggctgaggcaggaggattgattaagcctaggaatttgagaccagcctgggcaacatagtaagaccttgtctctacaaatacgtatagttatatagatatatgtagctgggtgtggtggcttgtgcctgtggcctccagctacttgggaagctgaggtgggaggattgcttgagctargtagttcgaggttgcagtgagctgtgatggtgccatcacactccagcctgggtgacagagcaagaccctgtctcaaaataataataataattttttttttaaaaaaatcctgagttgtttgtagatagtagcaaagacaagtgaaatttttggctacatatttcaaaattttactttctatcaatcattactactaaacatctattttatatattcagctatcataaccaagactaaagtatatcagattattattgttctatgtgattttcttttttactttgctgagtcagtgagtgg

SEQ ID NO: 163386 - DNA, 601 bp, Human
gttccctgtggaacatcatttctcaaaactgtattttggggcttgctttctcatttttcctttccatttcagatatccttactgctgtctttgggctctttaaacactgccttttttcctttttcgatcacacccaaaaacttttctcaaaaattacatgtaaatttaaaaatttacaaattaaatttaaaattgaaattttaaaaatcccgactctccctaatttcaggaagcatgcatttattatacataacaagacgtgaaagccgcaagagtttcagcctaaacactgaagaccccrcgaagtgaatccagctgctgctctacaagcagcaacaacaactgggaagccttctcagctacacttcggggcactggtccaaccccacgcaaaatccctcgtttcccttagcgtggtaagacggagcctgacctgagctccaactgtcctatctttttcaaatgtttcaaacttactgcctttgttcagcagaaccacgggcacggtgatgatggtgacaagcgcagcagcacccagcagtcccagaagaaccttccacggtgtctgcaagccgagcagatcaagtccaattagagggaa

SEQ ID NO: 163387 - DNA, 601 bp, Human
acccttgagggaaaacagtctgggttccctgtggaacatcatttctcaaaactgtattttggggcttgctttctcatttttcctttccatttcagatatccttactgctgtctttgggctctttaaacactgccttttttcctttttcgatcacacccaaaaacttttctcaaaaattacatgtaaatttaaaaatttacaaattaaatttaaaattgaaattttaaaaatcccgactctccctaatttcaggaagcatgcatttattatacataacaagacgtgaaagccgcaagagttkcagcctaaacactgaagaccccgcgaagtgaatccagctgctgctctacaagcagcaacaacaactgggaagccttctcagctacacttcggggcactggtccaaccccacgcaaaatccctcgtttcccttagcgtggtaagacggagcctgacctgagctccaactgtcctatctttttcaaatgtttcaaacttactgcctttgttcagcagaaccacgggcacggtgatgatggtgacaagcgcagcagcacccagcagtcccagaagaaccttccacggtgtctgcaagccgagc

SEQ ID NO: 163388 - DNA, 601 bp, Human
aaagtccttaaataaaagaatccaccaaaacatcactgattccagacccttcttaaatattatcgtgtataccagctttattatttagctctgcaatactgctaaattggtcaattacttccctgcctccccaccctccaactgaattctcaccacccttgagggaaaacagtctgggttccctgtggaacatcatttctcaaaactgtattttggggcttgctttctcatttttcctttccatttcagatatccttactgctgtctttgggctctttaaacactgccttttttccttttycgatcacacccaaaaacttttctcaaaaattacatgtaaatttaaaaatttacaaattaaatttaaaattgaaattttaaaaatcccgactctccctaatttcaggaagcatgcatttattatacataacaagacgtgaaagccgcaagagtttcagcctaaacactgaagaccccgcgaagtgaatccagctgctgctctacaagcagcaacaacaactgggaagccttctcagctacacttcggggcactggtccaaccccacgcaaaatccctcgtttcccttagcgtggtaagacg

SEQ ID NO: 163389 - DNA, 601 bp, Human
gaaagtccttaaataaaagaatccaccaaaacatcactgattccagacccttcttaaatattatcgtgtataccagctttattatttagctctgcaatactgctaaattggtcaattacttccctgcctccccaccctccaactgaattctcaccacccttgagggaaaacagtctgggttccctgtggaacatcatttctcaaaactgtattttggggcttgctttctcatttttcctttccatttcagatatccttactgctgtctttgggctctttaaacactgccttttttcctttktcgatcacacccaaaaacttttctcaaaaattacatgtaaatttaaaaatttacaaattaaatttaaaattgaaattttaaaaatcccgactctccctaatttcaggaagcatgcatttattatacataacaagacgtgaaagccgcaagagtttcagcctaaacactgaagaccccgcgaagtgaatccagctgctgctctacaagcagcaacaacaactgggaagccttctcagctacacttcggggcactggtccaaccccacgcaaaatccctcgtttcccttagcgtggtaagac

SEQ ID NO: 163390 - DNA, 601 bp, Human
catcctaaaatctagataagactccttgagtatgcaagcactgactatacattcctcagttgactaaatcttccagagagaatgctttaactggctgactaatttatagtgtgtaatgctgaaatgaaagcaagtgtttaaaaggaaagtaaggccaggggagactgaaactagtagttctcacttgcttgcatcctacagtgagtattccattatgtgagtgttttatacatttaggcaagctaaaaagacatgaaagtccttaaataaaagaatccaccaaaacatcactgattccagmcccttcttaaatattatcgtgtataccagctttattatttagctctgcaatactgctaaattggtcaattacttccctgcctccccaccctccaactgaattctcaccacccttgagggaaaacagtctgggttccctgtggaacatcatttctcaaaactgtattttggggcttgctttctcatttttcctttccatttcagatatccttactgctgtctttgggctctttaaacactgccttttttcctttttcgatcacacccaaaaacttttctcaaaaattacatgtaaatttaa

SEQ ID NO: 163391 - DNA, 601 bp, Human
tttccttcactctatttgtttacttgaaagcttgattgacaacatggagggcatttcttgggtgatgactttgacttttttgtaaggaatgctgacctttattatggcacagcccaggaaaggtattgctgatttagtgaaaatgctgcattcctgagcttttatctttattcctatgataaggcagaagtgttaacaagatgacttcccttttttccttaaacatacatacatacaagttaagaaatacagacaagaaattactagagtggtaaataaataaagccaccatgaaacaacmtctccacctggttgtccaagaggtatccttagccaccctctcctttacctctctctgtttaaccggttaccgaagtccagtcattcacatttctgagtagctctggagcctccaaattctgacctgtactgtaagtgtcctgggccatttccctcacttccccctccagtgttgctccattgcaactcaccttcccactgtcatggccaacagttcaggcatgctcaaaacatcattcactgcatcatctccagcttagaatcaaactcttttgcctgtttcccaccctcctctggggcc

SEQ ID NO: 163392 - DNA, 601 bp, Human
tggaacagatcctggacttcctcaggcaaacctcatagatgctatcttttctctctgattattcctgtctccttcacatttgggttttctcttattactgatggatgggtgagcagtcaaatttcctttccaccgaaagaaggtatagaagaaatttaccactaaagcagtgaaaggagcaaaagaagagatatacttcttttccataataaaattcaataataataaaactatttgacaaataaccaaatatttcaaatttcagcatataatatagtgtaaaagaaaaaataaaggaatyataaatgctgcatgtgaattttattaccactaagccatgaagagttctacaattccatacaagtatttttacgtatttctcactgattcttggggaaactgaatgcttacatatgcaatatcctcctatagtaggatgattgaaaaaaaatttaaaacatacaatcatttattatatacacagaagagggtgaacttttgattgtgcttggtgaaatgaataatatgacttcaaggagtttttattcttaaatatatgacaatagtattaagcctctctctctctctctctggctcccca

SEQ ID NO: 163393 - DNA, 601 bp, Human
gcatccacagtaggctcttcttcagaatgcttacgacacagagattagaagtcatgaaattataatataattcccacatggtggggaactggggcccacacactagggaactgaggcctctagctaacaggcacatgagtgagcttggaaggggatccttcagccccagtcaggctttcagataacatcttgattgcaacctcatgagagaccctgaggcagaaccacccagctaagccactccaaaattccttatacacagaaactatgagataataaatatttattgttttaagttctsaggtaattcattatgcaattacagataactaaagtaccctctcaaagtttctataaatcttctgtaggaatggagagggtaatagtacctctctttcaaagagttgttctaaggattaaatgaaaaatacattgaaagccctcagccccaaatttagcacttagtaaatgcatattggctattattgtagcttgcatgccttctcttcctcaagcaaggcgctcctgcatgttatttacagccacattctccatgggcctcagtaatttcttaagtcataaaatttgaaagacacgatcc

SEQ ID NO: 163394 - DNA, 601 bp, Human
ccttggccctgaagaggttttaaatctcatactgaaagagttttatgcctggaatcaaataatggaagaatataatagagaaataagagtcatccatgaaacttatggacatgagtttgagcagggtgggctttagaacaactgaggaaaacaagaaaagagggttccagcctcacagaaatggtattaggccacagaggccactaagctcagttttggggtccccagttttaagaagtcagggaaggggtggatgataagacctgcttgatactcacctctcctactccctctacctcarttatacatcctgagccaccatggctcctagagtgccatgaataaaatctctagtggctttggctctgccttacattacctcctcttctaggaccctgaactcataggtctactttcttcctcactgaaccaaataattaagaaatgtgcacattaatgcccccagttaaagaaagcacatagtttatctttaaatttgtaaaagcttcctaggaagttataattttgaagaacaatataaaacaatacaatgcttggcaaataataaaacagttagttctaatttcatggtttcaggtta

SEQ ID NO: 163395 - DNA, 601 bp, Human
tatcttcagtaatacttgacatgcagtaagcattcaatatatgttttttgaattgaaaaatattgtatttagccactgttggaccttggccctgaagaggttttaaatctcatactgaaagagttttatgcctggaatcaaataatggaagaatataatagagaaataagagtcatccatgaaacttatggacatgagtttgagcagggtgggctttagaacaactgaggaaaacaagaaaagagggttccagcctcacagaaatggtattaggccacagaggccactaagctcagttttrgggtccccagttttaagaagtcagggaaggggtggatgataagacctgcttgatactcacctctcctactccctctacctcaattatacatcctgagccaccatggctcctagagtgccatgaataaaatctctagtggctttggctctgccttacattacctcctcttctaggaccctgaactcataggtctactttcttcctcactgaaccaaataattaagaaatgtgcacattaatgcccccagttaaagaaagcacatagtttatctttaaatttgtaaaagcttcctaggaagt

SEQ ID NO: 163396 - DNA, 601 bp, Human
tgtgaatgagctgtatgagcaagtgctgggttgagctgcagaagccatgctcaaccatgagatgacatactggagatcaaaagacaaaactccaaggatggcagagctgaaaggtggaaaggccccatgttcttgatgtgttcaggccattacattaacaaacccaagaaccactttacttctgcacttccaattataaaagatgctaatgacaatacagtaataaaacgctatcattcaaataacttttggccaggtattgggttccttgaagcccaaaacatcctgatacaatcctcayacagcatcagggggctgtaagtcagtgaggatggacacggaggtgcactgcatgcctcagagccagtttgggggctgaaggattggaaggataatattaagacccattaattattaatgctttatgcttggttgtttatgtagaaacttcctggggcagcatttatcatttggtcactagtgcttccatagcactttgatcatttactagaagggcacttagctcttttgattgtagttaatgtttatgtgtcttttaatgctgtcaattatttgaggacaaaggccatatctattgtct

SEQ ID NO: 163397 - DNA, 601 bp, Human
aggacttatggaaatggttttcctccctgatacagcagaacatgaatgaggaagagcatcctcttctgccctgtgaatgagctgtatgagcaagtgctgggttgagctgcagaagccatgctcaaccatgagatgacatactggagatcaaaagacaaaactccaaggatggcagagctgaaaggtggaaaggccccatgttcttgatgtgttcaggccattacattaacaaacccaagaaccactttacttctgcacttccaattataaaagatgctaatgacaatacagtaataaaacrctatcattcaaataacttttggccaggtattgggttccttgaagcccaaaacatcctgatacaatcctcatacagcatcagggggctgtaagtcagtgaggatggacacggaggtgcactgcatgcctcagagccagtttgggggctgaaggattggaaggataatattaagacccattaattattaatgctttatgcttggttgtttatgtagaaacttcctggggcagcatttatcatttggtcactagtgcttccatagcactttgatcatttactagaagggcacttagctctttt

SEQ ID NO: 163398 - DNA, 601 bp, Human
gtctgtcctcttttgttgaaaaattaaatctttctaacgtaatgaaaagagagcaataaccaaatacacgatatgcctacataggccgtctccccgatttctgtctttcagaattttcaattcaacttaggtatttgcccttctccttccatgtgctagcaaaagaagatactttccaacctgagaaaggtgagtcttgagtagtctggttcaatcacggcaattcattctccttgccggtgattggtttggatatggacaagtgacacaaatgtcgccagtaagatctgaaagtttgcayctggtcagaggacttatggaaatggttttcctccctgatacagcagaacatgaatgaggaagagcatcctcttctgccctgtgaatgagctgtatgagcaagtgctgggttgagctgcagaagccatgctcaaccatgagatgacatactggagatcaaaagacaaaactccaaggatggcagagctgaaaggtggaaaggccccatgttcttgatgtgttcaggccattacattaacaaacccaagaaccactttacttctgcacttccaattataaaagatgctaatgacaatacagt

SEQ ID NO: 163399 - DNA, 601 bp, Human
gagatcagaaaggcagcaacaaagcacactgatttgcaataaacccagttaggaaagaaagtgaggagaaggaaaggagagaattacagctccagatttttggagatcagagctggcttgatgtctgtcctcttttgttgaaaaattaaatctttctaacgtaatgaaaagagagcaataaccaaatacacgatatgcctacataggccgtctccccgatttctgtctttcagaattttcaattcaacttaggtatttgcccttctccttccatgtgctagcaaaagaagatactttccarcctgagaaaggtgagtcttgagtagtctggttcaatcacggcaattcattctccttgccggtgattggtttggatatggacaagtgacacaaatgtcgccagtaagatctgaaagtttgcatctggtcagaggacttatggaaatggttttcctccctgatacagcagaacatgaatgaggaagagcatcctcttctgccctgtgaatgagctgtatgagcaagtgctgggttgagctgcagaagccatgctcaaccatgagatgacatactggagatcaaaagacaaaactccaaggat

SEQ ID NO: 163400 - DNA, 601 bp, Human
ccttgagatcagaaaggcagcaacaaagcacactgatttgcaataaacccagttaggaaagaaagtgaggagaaggaaaggagagaattacagctccagatttttggagatcagagctggcttgatgtctgtcctcttttgttgaaaaattaaatctttctaacgtaatgaaaagagagcaataaccaaatacacgatatgcctacataggccgtctccccgatttctgtctttcagaattttcaattcaacttaggtatttgcccttctccttccatgtgctagcaaaagaagatacttyccaacctgagaaaggtgagtcttgagtagtctggttcaatcacggcaattcattctccttgccggtgattggtttggatatggacaagtgacacaaatgtcgccagtaagatctgaaagtttgcatctggtcagaggacttatggaaatggttttcctccctgatacagcagaacatgaatgaggaagagcatcctcttctgccctgtgaatgagctgtatgagcaagtgctgggttgagctgcagaagccatgctcaaccatgagatgacatactggagatcaaaagacaaaactccaa

SEQ ID NO: 163401 - DNA, 601 bp, Human
aaagaaagaaagggctgaggtcaaaatgtccttgagatcagaaaggcagcaacaaagcacactgatttgcaataaacccagttaggaaagaaagtgaggagaaggaaaggagagaattacagctccagatttttggagatcagagctggcttgatgtctgtcctcttttgttgaaaaattaaatctttctaacgtaatgaaaagagagcaataaccaaatacacgatatgcctacataggccgtctccccgatttctgtctttcagaattttcaattcaacttaggtatttgcccttctcyttccatgtgctagcaaaagaagatactttccaacctgagaaaggtgagtcttgagtagtctggttcaatcacggcaattcattctccttgccggtgattggtttggatatggacaagtgacacaaatgtcgccagtaagatctgaaagtttgcatctggtcagaggacttatggaaatggttttcctccctgatacagcagaacatgaatgaggaagagcatcctcttctgccctgtgaatgagctgtatgagcaagtgctgggttgagctgcagaagccatgctcaaccatgagatgac

SEQ ID NO: 163402 - DNA, 601 bp, Human
aatccttctcatgcctgggattcctgactgcctgttctgtgactagccagagaaactctgcttttaaacagttcatgtgattcagtcaggcccaagcaggtaatctccctttcttaaagccaactgtgcatcataacgaaacttaactacaggaagaaaattcatcatatccacaatctcagagattagtacacaggagcggaggagagggttcttgggggtcaccttagcattctgcctaccacaatcaccttgtctgttgtgttgagaatacaccatagggaagtaagaaaaaaaaaaagagagatgttggcaataatttaggggaagggcaattgtgtctttgaccagggtagtaggagatgaggtggtgaggtagggtcaaactctgagagaatatgaagatacagatgataaaactgccgacacattggatgtgacttgtggatgaaagagaggagttgaggagaacttgcatggatattggcctcagtaactacaaaaatagaattgccatttgctgaaataagatgtactaagggaagacaaagagttttggaagatgtcagtatgagatgccaatatcacatccaaatggaga

SEQ ID NO: 163403 - DNA, 601 bp, Human
gtcagcaatggcatgttaaatccttctcatgcctgggattcctgactgcctgttctgtgactagccagagaaactctgcttttaaacagttcatgtgattcagtcaggcccaagcaggtaatctccctttcttaaagccaactgtgcatcataacgaaacttaactacaggaagaaaattcatcatatccacaatctcagagattagtacacaggagcggaggagagggttcttgggggtcaccttagcattctgcctaccacaatcaccttgtctgttgtgttgagaatacaccataggraagtaagaaaaaaaaaaagagagatgttggcaataatttaggggaagggcaattgtgtctttgaccagggtagtaggagatgaggtggtgaggtagggtcaaactctgagagaatatgaagatacagatgataaaactgccgacacattggatgtgacttgtggatgaaagagaggagttgaggagaacttgcatggatattggcctcagtaactacaaaaatagaattgccatttgctgaaataagatgtactaagggaagacaaagagttttggaagatgtcagtatgagatgccaat

SEQ ID NO: 163404 - DNA, 601 bp, Human
caagataatttctttaattcaccaaatatttacttagcacttactgtgttattcagtgttctaggcactagagacatcacagtgaataaagcatgaaaaactcctgcccttatgaagcttatattttaactgggggagacataggaacagataatgagtaagcaatgccatatgctaggtggtaacaagtgccatggagccttcacaatggaaagccaatgaacgatgttaagcagaaaaggacatgatttgacttatgtttaaatgtggtcgccagcctgggcatggtggcttacacctrtaatcccagcactttgggaggccaagacaggcaaatcacctgaggtcaggagtatgagaccagcctggccaacatggcaaaaccctgtctctactaaaaatacaaaaaaaaaaaaaaaaaattagctgggcgtggtggtgcacacctatagtgccagctatctgggaggctgaggcgggagaatcgcttgaaactgggaggcagtggttgcagtgagctgagactgcatcgctgcactccagcctgagcgacagagcaagactccatctcaaaataaataaataaataataaattaaaac

SEQ ID NO: 163405 - DNA, 601 bp, Human
gtgtgtactgatcttaaagaaatacttacctgatcctgctgcatccccaagccatctggacaaacttctcaaataaacagtctacattcatggccttcattttcccactattcctcttcatgtctcttgatctatcccttactacttagtccacattcatttctctctcctcatcttattaaaatgtttattttctgtaccacatattttgccaattaatcaagtaattttatatctatttaagtacttactttaacagtcttttcttaaccaaactattaataagccatgaggataaacrtattctatcttttttcaaacagttgctagcacttacaaattgtaggtatacatgatttagtactgagtggtttataaatataataattttattcagaattacagcaatattaataaatgttcattaaaaaaattttcttgcctgagctccaagataatttctttaattcaccaaatatttacttagcacttactgtgttattcagtgttctaggcactagagacatcacagtgaataaagcatgaaaaactcctgcccttatgaagcttatattttaactgggggagacataggaacaga

SEQ ID NO: 163406 - DNA, 601 bp, Human
gcattcttatggtgttcttctagtttgctgggttgttctaggcaatgtagactttcaacccacttattcttcttatgctcattcccattttacaaataaggagactgaggcacagataggcacagccagtaactagactaaaattctgtgattagtatgcaccaaagccacatttggaccaggcaatatggcgccaaagcctgtggttacaatcactcttctaaacctctctaaatctttggaacagtgattgcatgtggtaaatgctttcttggcatttttttgtgaattggtggagatraattaggctttatggaagtgtttaaattcatggtttgcaactattttaaataagcaggttggtagtatccttaggacttgggtcagttgaaacttaatttgttctgcttcaaagtcaaaagagtgcaaattcagaaaactctagaattttccctctggacagtaagaaggatggcaactctgtggcttcctagaaggtaacttcctagaaaggaagttttaccatctctattctcttttccatgggaatacccaataactttcatcatctttttcctgaactcattaaaaagtagtcacg

SEQ ID NO: 163407 - DNA, 601 bp, Human
ttcagcagtatggggcaaaaattactatactacctgcgtctggagctgttaaaacaaacaaacaaaaaatgttataaacatataaagaataataattacgcattcttatggtgttcttctagtttgctgggttgttctaggcaatgtagactttcaacccacttattcttcttatgctcattcccattttacaaataaggagactgaggcacagataggcacagccagtaactagactaaaattctgtgattagtatgcaccaaagccacatttggaccaggcaatatggcgccaaagccwgtggttacaatcactcttctaaacctctctaaatctttggaacagtgattgcatgtggtaaatgctttcttggcatttttttgtgaattggtggagatgaattaggctttatggaagtgtttaaattcatggtttgcaactattttaaataagcaggttggtagtatccttaggacttgggtcagttgaaacttaatttgttctgcttcaaagtcaaaagagtgcaaattcagaaaactctagaattttccctctggacagtaagaaggatggcaactctgtggcttcctagaaggtaac

SEQ ID NO: 163408 - DNA, 601 bp, Human
ttcccagtatttgccaggcaaaacattcagcagtatggggcaaaaattactatactacctgcgtctggagctgttaaaacaaacaaacaaaaaatgttataaacatataaagaataataattacgcattcttatggtgttcttctagtttgctgggttgttctaggcaatgtagactttcaacccacttattcttcttatgctcattcccattttacaaataaggagactgaggcacagataggcacagccagtaactagactaaaattctgtgattagtatgcaccaaagccacatttgsaccaggcaatatggcgccaaagcctgtggttacaatcactcttctaaacctctctaaatctttggaacagtgattgcatgtggtaaatgctttcttggcatttttttgtgaattggtggagatgaattaggctttatggaagtgtttaaattcatggtttgcaactattttaaataagcaggttggtagtatccttaggacttgggtcagttgaaacttaatttgttctgcttcaaagtcaaaagagtgcaaattcagaaaactctagaattttccctctggacagtaagaaggatggca

SEQ ID NO: 163409 - DNA, 601 bp, Human
attggaaaacaaaactgccacaggaattgccccattcccagtatttgccaggcaaaacattcagcagtatggggcaaaaattactatactacctgcgtctggagctgttaaaacaaacaaacaaaaaatgttataaacatataaagaataataattacgcattcttatggtgttcttctagtttgctgggttgttctaggcaatgtagactttcaacccacttattcttcttatgctcattcccattttacaaataaggagactgaggcacagataggcacagccagtaactagactaaaattctgtgattagtatgcaccaaagccacatttggaccaggcaatatggcgccaaagcctgtggttacaatcactcttctaaacctctctaaatctttggaacagtgattgcatgtggtaaatgctttcttggcatttttttgtgaattggtggagatgaattaggctttatggaagtgtttaaattcatggtttgcaactattttaaataagcaggttggtagtatccttaggacttgggtcagttgaaacttaatttgttctgcttcaaagtcaaaagagtgcaaattcagaaaactct

SEQ ID NO: 163410 - DNA, 601 bp, Human
atgaaaacataaaagtcagacaatctgaaaataagcaccaacagctccaagtacaatatgtgaactccaagtggctgtagtgtaggaagaggagtgagcttagccagataggactagacagagtgagcacaggagcctctgaaacggcctttgcaaaaattatgacagtgagagaaatctaaactaactgactccatcttgcctctaacctcacaaactaattacctttgctcattactgggtgcaggccaagcaaactatggaaggaatttagtttatagtttaactttgcagcaaggayggtaatagtccctcccaaaactgacccactctgaggactgagattgcctttctaagacgaagaaaaagccacacagtgaggactataggaggggcctgaattctgccaagatgtaggctagtagttaaatgataaccagccattattccagaggtcagaagatttgtaacttctccaattgttcttatagataacatcactattgtcaagttgtcaagacctaagactggtctttgagatatttttcagacttttgcattcagttggacctgctgactccacctggacctgtgactcata

SEQ ID NO: 163411 - DNA, 601 bp, Human
gcgtacgaaaagcacatgaagtttgggattcaagggtgaatgctatggtctgagtgtcccccaaaattaatgtcttgaaactaaatctttgttgtgatattaagaggtggaaccatttgaagtgattaagtcatgagggctccccactcatgaatggttaggtgccttataaaagggctggagggaactagtctaagcctttttgtctttctactcttctgccgtgtgagaatgcagcaagaaggccctcaccagaccctaaatgccaatgccttgatattaaacctcccatctccagaaytgtgagaaaataagtttctgttgcttataaattacctagtctgtggtattttgttacagcagcacaaactaacacaccttttaaagtttcattttaaaaatctataacatgagactaatagcccatggggattttcaatgattaaacaagataatgtatgtcatatgcttagctcaggacttagaacttaagaagcacctgtagatatgttacactgcacattattgttttgttccaagcatatgttaggcaaccagaatacaaaaaagaatataaaagagtctttcctctgaagcacct

SEQ ID NO: 163412 - DNA, 601 bp, Human
tagctgaataactttaaaaaaaaaaaacaaaaataactcataatgttttaagaaagtttacaaatttgtgttgggctgcattcaaagccgtccagccacatgccgtccgtaggccacaggttggacaagcttggcctaggggaaaggactatgtcaaaaaaggagccttgggcacccatgggacctcatcattgactcccctgcacctccttgtctctgctgtcagcattctggtgcagcactcttcagctgccacatatatgactcaagcaggctcagctgccactctagcatgtataasctataaaccttggcagcactcatgtggtgctaattctgcagaagcatagagtgcacaagcatggggacatggctacctccacctagatttcaaaagattcctcagaaaggctagcggcccatgaagagaactgccacagaagctactgcagagtcccagctagggcaatgcttaatggagctgcggggcaaggctacccttgaggccccacaactgtagagtcaccagcatgcaatgtcagccgggagagtcacaggcacaagacttcaacccatgagagctgcaccatgggccgtgccc

SEQ ID NO: 163413 - DNA, 601 bp, Human; identical to SEQ ID NO: 23670

SEQ ID NO: 163414 - DNA, 601 bp, Human; identical to SEQ ID NO: 23671

SEQ ID NO: 163415 - DNA, 601 bp, Human; identical to SEQ ID NO: 23672

SEQ ID NO: 163416 - DNA, 601 bp, Human; identical to SEQ ID NO: 23673

SEQ ID NO: 163417 - DNA, 601 bp, Human; identical to SEQ ID NO: 23674

SEQ ID NO: 163418 - DNA, 601 bp, Human; identical to SEQ ID NO: 23675

SEQ ID NO: 163419 - DNA, 601 bp, Human; identical to SEQ ID NO: 23676

SEQ ID NO: 163420 - DNA, 601 bp, Human; identical to SEQ ID NO: 23677

SEQ ID NO: 163421 - DNA, 601 bp, Human; identical to SEQ ID NO: 23678

SEQ ID NO: 163422 - DNA, 601 bp, Human; identical to SEQ ID NO: 23679

SEQ ID NO: 163423 - DNA, 601 bp, Human; identical to SEQ ID NO: 23680

SEQ ID NO: 163424 - DNA, 601 bp, Human; identical to SEQ ID NO: 23681

SEQ ID NO: 163425 - DNA, 601 bp, Human; identical to SEQ ID NO: 23682

SEQ ID NO: 163426 - DNA, 601 bp, Human; identical to SEQ ID NO: 23683

SEQ ID NO: 163427 - DNA, 601 bp, Human; identical to SEQ ID NO: 23684

SEQ ID NO: 163428 - DNA, 601 bp, Human; identical to SEQ ID NO: 23685

SEQ ID NO: 163429 - DNA, 601 bp, Human; identical to SEQ ID NO: 23686

SEQ ID NO: 163430 - DNA, 601 bp, Human; identical to SEQ ID NO: 23687

SEQ ID NO: 163431 - DNA, 601 bp, Human; identical to SEQ ID NO: 23688

SEQ ID NO: 163432 - DNA, 601 bp, Human; identical to SEQ ID NO: 23689

SEQ ID NO: 163433 - DNA, 601 bp, Human; identical to SEQ ID NO: 23690

SEQ ID NO: 163434 - DNA, 601 bp, Human; identical to SEQ ID NO: 23691

SEQ ID NO: 163435 - DNA, 601 bp, Human; identical to SEQ ID NO: 23692

SEQ ID NO: 163436 - DNA, 601 bp, Human; identical to SEQ ID NO: 23693

SEQ ID NO: 163437 - DNA, 601 bp, Human; identical to SEQ ID NO: 23694

SEQ ID NO: 163438 - DNA, 601 bp, Human; identical to SEQ ID NO: 23695

SEQ ID NO: 163439 - DNA, 601 bp, Human; identical to SEQ ID NO: 23696

SEQ ID NO: 163440 - DNA, 601 bp, Human; identical to SEQ ID NO: 23697

SEQ ID NO: 163441 - DNA, 601 bp, Human; identical to SEQ ID NO: 23698

SEQ ID NO: 163442 - DNA, 601 bp, Human; identical to SEQ ID NO: 23699

SEQ ID NO: 163443 - DNA, 601 bp, Human; identical to SEQ ID NO: 23700

SEQ ID NO: 163444 - DNA, 601 bp, Human; identical to SEQ ID NO: 23701

SEQ ID NO: 163445 - DNA, 601 bp, Human; identical to SEQ ID NO: 23702

SEQ ID NO: 163446 - DNA, 601 bp, Human; identical to SEQ ID NO: 23703

SEQ ID NO: 163447 - DNA, 601 bp, Human; identical to SEQ ID NO: 23704

SEQ ID NO: 163448 - DNA, 601 bp, Human
gagataggttatgtgacaatagcaatgtggttatgaagaaggaaatgagtgtctaaagcagcttatgggaggtggaggagaaagaatgggaagaattgagccctaagtattaaatgggacacttagcagaaatggggacaatctaattatgggactgttttgcaggggtagatgatttgtgcatctcactttgcagattgttacttttctatcttgactgagaaacagacatgaaaaccgtcatacagccactaacacaaaaatattgctatcacagctccctgcacacacacacacacaagcacacacacacatacaccttactcattaagtaagctgaaagtaattggtaaaactaaattgtctatacttgtcttgcaaaactagaaacttttgagttttactgtattttgatcagatgacttcagcatccatagtaatagggatgacatcttacaaaaacatatggatattgctcagagcaatgtattaatatgaagtcatgacacagatgaaaagaaattgtgttcttaagttattcttattgtttttctttctctttaattcactgtcttgtgaagaattgtgaacaatctttgaa

SEQ ID NO: 163449 - DNA, 601 bp, Human
tcaaaaaggatgtgaggaagagagaaagggagagaaggaaaaagaggaagagagagagagagagaggagagagagaggagaaaagaaaaacaacctgggaaagaaaagtaaaagatggggtccagaggggcagctggggccttggaggaaaatagaatctttgaatgtattcctgccagagacaaaagcacaggctcatttaaaaaacaaaggagggcagctttattctaaagcctgctgtgcaccaaaaataggcacttagattcagttctccacatagattcagttctccacatttcgraggaagcaacttaccacggtggagacaattcagttagtgcatttgcctcacttgtatcctgcccaccttaactatcgccctcccaaataattcctcttagtaacacattgggaacctttagctccctggtactggcagttttaatgtgtccattgccagcaatgaattttgtgccaagaaaacccgactcctggcgtggaaggattaaacagtcctcgggtgccatctgtgcagtgaagtgaaagagtgactttgtgcacccagtgtgcgtgtgttgccattggcaggaggaagtgactt

SEQ ID NO: 163450 - DNA, 601 bp, Human
tcctaaggtatagaattcctggggcttcatagtcacaatttgaaaaccacaagtctttttcacacatattggatactttgtcatattcaaattcatcttttattacctactctcttttatttctcttccaaaatactgttttttctaactgacaaagaataaacttccgaatgattaaaacgccaggcaccttgaatgggtgaatgaaagtctaccacgttaacattttttacaagtttgactaaaagacctgtgactgaccacatgagagaccattcctcactgttaggagcccactccrcaaggtgtggctacagctgctgtctgctgattgacattggttttgagggttgcctctttggatctgattcctttgctcaaatctgtcaccatttctgtctgctgggactgagacatattgcagaaaagatgtttccatagagctatactaccctttagctcagatttgtcacccctccactttggctgcccatttagagcttccggtatcagctccttgaggtgggggggatgaacatctcctttcatctttgaggtctggatatcctttaaaagtgcttctcccttgcctcttgccagt

SEQ ID NO: 163451 - DNA, 601 bp, Human
ccagcaacagcctggcaaggagaagtgggaaggatcggtccagtggcagtgccgactccacagcatctctgaggagcttttccttcagtccccaagaagaaccatctgtagctgctcgttggatcatgctggttcctcagttaccttccaacaaataaatctttgtatttttgaattaaaagagagagctgataagaggaggagagtactatgagaaacagaaggtataacaatttttaaactacccctagtgccatctaggaaccataaggacaatttgcttcctggagataataatggyggcagctgccatgttttgaaagcttccttcatggcaggcacaagcacctcatttaatgatttcaataaccctgtgaggtaggtctgattatcccattatccagatgaggaaactgagattcagtaaggttaagtagcctcctcaaactcatactgctggtaagtggttgaaacagaaattgcggacatgttggcctaaccccaaaagctcatgtccctgactatcatattctactggcacttgacatcacaaccaaacaactcatcccatttataagatcttatagaaagagcacacagt

SEQ ID NO: 163452 - DNA, 601 bp, Human
tgcaaaatatttatcaattaaatgagtaaatgaaataaatgatcaagcacttgcagtgtccactatatttggtactagttttgcagaatcaagtgttatcagctggagtgggcaaaataaaatatgctcattctgaaatgtattgagatatattttgcccactttctatccatacaccataccattcatgataatagctaacattcaattgagcatttactctgtgcctgtcgctgtgttaagcatcacatataaataagggtttataaaagcactgctatatcaaatccttgcaatattygcgtaaaataggtctagaacaattctcctttcaagatggaggcaccaagactcagaaggtgagtaacctgcacccggtcacaactacagcaagtgtcagagctggacaaagtctgacagcaagccctttttacttcctacattgcactgcgtctccactaaaattccaagctgcttatgatgtgatcttctggcaaagaaacagtgtgaaataaaatgttaattaactgtcctggaatttgaagtgcataataataatgggtatcctttgagatcctcctaagacccatgccgtctcaga

SEQ ID NO: 163453 - DNA, 601 bp, Human; identical to SEQ ID NO: 23705

SEQ ID NO: 163454 - DNA, 601 bp, Human; identical to SEQ ID NO: 23706

SEQ ID NO: 163455 - DNA, 601 bp, Human; identical to SEQ ID NO: 24132

SEQ ID NO: 163456 - DNA, 601 bp, Human; identical to SEQ ID NO: 24133

SEQ ID NO: 163457 - DNA, 601 bp, Human; identical to SEQ ID NO: 24134

SEQ ID NO: 163458 - DNA, 601 bp, Human
ttgtcttccttcagcccaaaggtttggagccagaatagtctgacttttttgtctgcttttattttcgaagtgaaagagattgcgtatgcataaagaaataataaatgagtataatttaaaacggccccttctcgactgagatttctgaaactgtgatctctgaaataaatccaatgccctggtccagaaaatggcagggaggagttgaagggaatggggtgtgtggtcctttcagacagcaggtcggtggctgtgcaacgaaagagttcctgggcctccagtccaggcagggaaaggaaasagctttgtgggcacgaatctgtaactgtgtgtgttgggagtagggagagatagtttgttttctgttttctgtagggaaaatggtcagactggctcccatctgtagactacaatttggaacgatgactcaagtttatatcaatggctctggaatttgggattctttttgcccatttaaaacatactggctcttggaagggtccccttctccagcacccagctgcacaaaggtgctgtatggaacatattttgtacctaatggaagccactagtaagcaagcagtcaagctttgccctagcc

SEQ ID NO: 163459 - DNA, 601 bp, Human
ttttccacgttttatgcctgagaagacactgattatttcagtattttttaagtaaaaaagctgttcctttaaacagccttagccccaaaataagagagttactgaacaattagcaggcgttgagtgttaagcagatgttactggtgcctagaaagcggagaaaaatcagaaaaccaaatattgtcttccttcagcccaaaggtttggagccagaatagtctgacttttttgtctgcttttattttcgaagtgaaagagattgcgtatgcataaagaaataataaatgagtataatttaaarcggccccttctcgactgagatttctgaaactgtgatctctgaaataaatccaatgccctggtccagaaaatggcagggaggagttgaagggaatggggtgtgtggtcctttcagacagcaggtcggtggctgtgcaacgaaagagttcctgggcctccagtccaggcagggaaaggaaacagctttgtgggcacgaatctgtaactgtgtgtgttgggagtagggagagatagtttgttttctgttttctgtagggaaaatggtcagactggctcccatctgtagactacaatttggaac

SEQ ID NO: 163460 - DNA, 601 bp, Human
gtgtctgcaaatgggctgggcatgtctggatgccttttccacgttttatgcctgagaagacactgattatttcagtattttttaagtaaaaaagctgttcctttaaacagccttagccccaaaataagagagttactgaacaattagcaggcgttgagtgttaagcagatgttactggtgcctagaaagcggagaaaaatcagaaaaccaaatattgtcttccttcagcccaaaggtttggagccagaatagtctgacttttttgtctgcttttattttcgaagtgaaagagattgcgtaygcataaagaaataataaatgagtataatttaaaacggccccttctcgactgagatttctgaaactgtgatctctgaaataaatccaatgccctggtccagaaaatggcagggaggagttgaagggaatggggtgtgtggtcctttcagacagcaggtcggtggctgtgcaacgaaagagttcctgggcctccagtccaggcagggaaaggaaacagctttgtgggcacgaatctgtaactgtgtgtgttgggagtagggagagatagtttgttttctgttttctgtagggaaaatggtca

SEQ ID NO: 163461 - DNA, 601 bp, Human
ttacgaggacttggaaaggttagactgttgtgtttggttggcgagctccctgtaaataatccctgcggtccccgggagaggcgagtttacccgcggccgccctcgaaaagtcaaattcaacgcaggatccgtcccaaacggagccgccgccggccctaccagggcactccaggcagggaccggccgctcagggagtaccgcgggtgtaggtccccacagctacccgcctggagcgaggggcgcccgggcaacccttaaattcgcctttgctacgaggaccccacggaggagctggccaggwgggagcggccagccgccaccagggcgaagggtttgagggcctggttggttgtgcggcgcgctcggtccccggccctcgaccccacgcacacgcgcgcccagcccgcctttctcatcagctggcaatcaggattcccaggcgcaggcggctggcgacccagccctgtgctccagcctcagaggctctaaccatgagcgctgcaagcctggttgcgctccgtgaatcccagctggggaaaaaactacaagtggcatgaatggaaggcaagttcggtttgggaaaaggcagcctcgcctaaga

SEQ ID NO: 163462 - DNA, 601 bp, Human
gatttcatgtaacaacttggtggcaccgggggggaagtacagtcacctaataagttgccggcgcccgcgcccccattggccgtgcgcgtcacgtgcccgtccagcagaacaataacgcgtaaatcactccgcacgctattaatggtccggtgttttgcagtcataatttttatagcaaaagccatatgtttttatgtaaagggatcgtgccgctctacgatggggtttgttttaattgtggccaacgacgattaaaagatcaaatctagccttgtctctgtactctcccgtctccccccccatacacacacttcttaagcggactattttatatcacaattaatcacgccatcaagaaggcgcgggtcccgcgtgcgagtgcggccagcggagcccctcacataaaattagacaataattgaagccataaaaaagcagccaaatcgcattgtcgctctactgtatttaaatctatatttatgatatttcataaggagttattgtttcagaagccacacaggctggcgggaagtcggaaacgaccaacagattcgtttgcctcgccgtggctcccagctgtaaaaatttacgaggacttgga

SEQ ID NO: 163463 - DNA, 601 bp, Human
ccggctggagggcaagcccgcgaaggagagcgcaccgggcgtgggctccagccaggagcgcatgtacctgccgtccggcgccgccgccgccacgggcgcctgggggtgcacgtaggggtggtggtgatggtggtggtacaccgcagcgggtacagcgttggcgcccgccgcgtgcactgggttccacgaggcgccaaacaccgtcgccttggactggaagctgcacgggctgaagtcggggtgctcggccagcgtcgccgcctgccggggaggctggcccagggtccccggcgcatagcgkccaacgctcagctcatccgcggcgtcggcgcccagcaggaacgagtccacgtagtagttgcccagggccccagtggtggccatcaccgtgcccagcgcctggcccgcccggcccgacccacggaaattatgaaactgcagatttcatgtaacaacttggtggcaccgggggggaagtacagtcacctaataagttgccggcgcccgcgcccccattggccgtgcgcgtcacgtgcccgtccagcagaacaataacgcgtaaatcactccgcacgctattaatggtccggtgttttgcagt

SEQ ID NO: 163464 - DNA, 601 bp, Human
ctgggttgtttttctctatcaactggaggagaaccacaagcatagtcagtcagggacaaagtgtgagtgtcaagcgtgggacagtcaccccttctggccgacagcggttcaggtttaatgccataaggccggctggagggcaagcccgcgaaggagagcgcaccgggcgtgggctccagccaggagcgcatgtacctgccgtccggcgccgccgccgccacgggcgcctgggggtgcacgtaggggtggtggtgatggtggtggtacaccgcagcgggtacagcgttggcgcccgccgcgkgcactgggttccacgaggcgccaaacaccgtcgccttggactggaagctgcacgggctgaagtcggggtgctcggccagcgtcgccgcctgccggggaggctggcccagggtccccggcgcatagcggccaacgctcagctcatccgcggcgtcggcgcccagcaggaacgagtccacgtagtagttgcccagggccccagtggtggccatcaccgtgcccagcgcctggcccgcccggcccgacccacggaaattatgaaactgcagatttcatgtaacaacttggtggcaccgggggg

SEQ ID NO: 163465 - DNA, 601 bp, Human
gggggaggcgtgtgggacgggggccctttggctggggacgagtgacgctggcgacccccgaaggaaaagcttctggtgtccaaggctaaactctggggtgactgttttgagggcagtgtgggttttaccggcgcagtaagctgagaaaacacgtaggtcgcgtccgagaaggacgctggggtttgcctttgcggagagaaacccagctgttttggtttgagtcgccggtggcgaagggggcggagactccctgcgccgcctacttttgagggccgcgggcggagttggcggttctggctgwtggcctgcttcacctggaatccattccccaccccgccccgttcgcaaggtgtggactagtcccgaccgacttgcactcctggcttagggaatctgtggctagagtttagcgtgcgcgcgcgcgcgtacaccttattagtaaaaaattgagcttagcgtgcgtctgtgtgggtgtgtgtacacaccttattggtaaaagttttgttagaaaacactggcatttgactttagacatacacagtgttagatttccggtttcacacagtggttatgaattgctattatgttaggctttagatgg

SEQ ID NO: 163466 - DNA, 601 bp, Human
acatcaagacatttcacttacagttagtttagtatctttattttttatttttatttattttttatttttgagacggagtctcgctgtcacccaggctggagtgcaatggcgtgatctcagctcactgcaggctccgccccccagggttcacgccattctcctgcctcagcctcccgagtagctgggactacaggcgcctgccacctcgcccggctaattttttgtatttttagtagagatgggttttcaccgtgttagccaggatggtctcgatctcctgaactcgtgatccgcccgcctyggcctcccaaagtgctgggattacaggcgtgagccaccgcacccggcctagtttagtatctttaaatgataaagactagaaaaacacagaatcaccataattatattatcacacataacaaaattaccttatttttgaattctaattgttaggactggcaaattatatttagtatttatctaaattaaaaagcttaatttggcttcatatgtttaatgtacagaagttcttactatggtctatttttcagtaagttcactaaggcttacatttttgggctaaagtaaaacaagtattggg

SEQ ID NO: 163467 - DNA, 601 bp, Human
caaatgtgtctggccccttaattgttgactggacgtttcatacttatccttggcttgcctacttactatactcctgtttgtagaggtgcactttagagaaggggaatcagaatttgacatggtaaagctgcttgcttctactttcctttttgtgtagggagtgtacttctctccaactgagaggaggtttgtactttttctcaggatgttagtgaagctacacttcccaggcattaccacaaggtgatgcagtgactttgcatattatttctccactcccgtgcgaccttgacattctcartgaattccaacatttttgtaagcttgcctaagtctgttatctgtaggaggagtgaaccagaggaactatgtgggaattagaaattttattatttaaaatgggttgataatgacataattatatttgattgcattcatccatgtaaactttttaaatgattagtagctatattgtaatttaataagagtaaaaaatgacaaggtactggaatgacttttgtaaaatatttctataattatagcaatgaaattttaaaaagattggagtgttggagagagattaatgaaggccattaatagg

SEQ ID NO: 163468 - DNA, 601 bp, Human
tattttaggaaatgatatgttaaattttaagaaaaaagtattatccttaatcagcttttgattaaaaacatgggacgtttattctaagctagtttatttccttcttactgaatatctttcttaaaggaagcgtgactattcactcacttcatagaaaaatattattctcttaattcagttttggtagttgtatctaatagatgttggttctgttgatttagctatagtttcttttgttggtgtcttgtaaccagtagtgagttttttttttttcttttttttttaaagaactggaattggkgtttttttttttttcctttgtgaagccagtgacttgagataatcattaatgacttcattagtatcatgacctccctgggagcccaaattagctcagacaactcaaagaaacaaaataataaaactcttcagttattttaggcagagttctccagtgtttgtaaatgctacctgttcatttttctgatggctttaggttaccaggtagagagtattcatagttaagtctttccatgaaatatggttgctggtagcaaagtccctttattagtgcagaggtaaagggggattgctactgaat

SEQ ID NO: 163469 - DNA, 601 bp, Human
gggctatgtatattcgtatacacacccacagacacacatgcacacactcccaggccccaatcccagaaagttgttgtcatctattttttttttttaaaggcccctaatgattctaatgtgtaaccagggttgagaaatgctggtccaggggattagaagggcaggaatgtaggcacagagatgttagcgtcaggtttagttataggaccccaaaacctagggagaggggaagagatgaatgggatgggctaggttagggaggagaatgatgaagcccaagggttctacataggaaggaaawgttaattgacccatagccagtaaaatactgacttttaactgttcttgtttctgtttcttagtgtttgttactaggagccagcaggtttatattggcagcgtgtgcacaaaaacacctctggttcatttgcttttgatttaaatagaagcagagggctaggctttccaggagagttaatttttggttttggttttttaacttttaaatgcccatataactttctgagccaaatgggttttagttatttttccagtttgtctgtatttttatatttaatcaatttttaagaagttccagtat

SEQ ID NO: 163470 - DNA, 601 bp, Human
tcaagcatttcggataagggatactgaatctgtataagcagaggcttagaggtaggaatgttcatgagaatgagtaagtcagtttaactagagcataagcttcagttagggaagttgtgggagatgagattggagataagtttcattctgtctatggacgaccttcagtgttagagagtttatggacttttttctgaaggacagtgggaagtctttgtatatgtataggttgtttgaaaaagtatgtttcaggaagatgaattattacctttttcctgcagactacttgtttatttcttayattttttcatttttttaaagccaaaagactgtgactttcccttcaaatccaaacaatcagttctaaccattttactgcttacatatttctaaatccttaatatcactagttcatgccttccatattttttaccaagactattgcaataggtcagctgttttacccactttcattcttgtcctctaacctttgttttttaactgctctatataagctgtaaaatggaaacctgaacatgtctttctgttgtttgaaactcttcattggttcttcatcatctgtagaataatgccaagacca

SEQ ID NO: 163471 - DNA, 601 bp, Human
aacccaggaggtggaggttgcagtgagcagagattgtaccactgcactccagcctgggcgacagagcgagactccgtctcaaataaaaaaataaaaagaactgcacctgatgccatatctttattattaaaccaacgttaattgcagtaaaatactatatgttacattatatttgagttttgttccgttttgtgtttatgaatttgatttggtcttagttgtataagtacataagcatgaggaattggtgtatgtttagatttatgcttagtacaaattaaattaccttacagttaaagayccccagtggatgcctgaaattacaggtagtactgaactctatttacactgtacttttctgatacagtcatacctatgataaagtttaatttataaattaggcacagtaagagttaacaacaataactaaaaatagaacaattgtaacatgaaattgttatattacctgatacccagcctgcatcattagcaactctgttgctaattttgaataatcagatctttcacttaaccaaacagccggagtaaaagttatgtgaatgtggtttctctcactctcaaaatattaaaatatcttatt

SEQ ID NO: 163472 - DNA, 601 bp, Human
actatactcacttattttggggtcttggttgaccttaggtaactaaaaccacacaaagtgaaaccttagataaaggatgactactgtagtaatgttaaaggtccatgagtttttgttttttaaactttagagtcttagaattctcacatctctgagatactgttctaattggaattctcacatctccgagatacttttctagttgaggaaactggaagtgcaaagtggtcatgtgacatgttcaaagtcacattgctaatgcataacatgtcctatactagacaaacaaaacctccctgtraggtactgttttcactgcatcctgctgtcaagcacatcaaaaactaagttgcctgattagaaggtggatccaaacagtgattttatgcttgaatatcctgtttcaagcttttgtttctttgttccttgtttttccttttcaaatttttttcctccttcttctcttttcctgccttggtctccccttcagtcctgtctcattccactcattttctgtttttaaaaaaagtcctctggttgtaaaaaaaaattacaattataatatatataatatataaatatttataattatacttattta

SEQ ID NO: 163473 - DNA, 601 bp, Human
tcctgacctcgtgatccccccacctcagtctcccaaagtgctgggattacaggcgtaaaccaccccacctggcttgtcttttttctaatgcatatattttgaatgttgctggcatatctcatgccttttttaatgccgtgattttttcacttaatcacttacaattagttctgtaccattttatctcattgaggaatttatgctgtttatgatatttctcttttgaatcaatgttgcatactccctgtgtatatctaggcatttttgcagtcatttttttcctaaaggaacttttctagtracatgatttttagaagctacattgtatacagaagaaggaaaatgaatgcttctacccattgtactcctaccttccccagtgatgtctgttgttgtatgtttctggattagaaaaattcataggctcatttgatacttttttgtgggcgtttttcctcacttaattatatttcttgggaatcctcctatatccatatgtaatcagctcatttattttcagtgcctttcctactccaaggcttgtctccctttattcatctccaaacatcagtcccctcttctctatttctttctttctttc

SEQ ID NO: 163474 - DNA, 601 bp, Human
cccggtgaccaggaaaataaaacagagaatcaacctttggtttggacacattatggtttattgacccttctaattagatttattattattgcagtggactcctgcataatttcctgatgttcatcttttgtgttccttccagtattatccactctagcatactttcatgtgggagcttagatataagacagttacatcccaaaggagcccattctctgtatctttccaggttgagagacttctacatttattttttatgtatgcccaacatgcccctctctaagtaacttaagaactattktttagttttagttttccttactcaaaagcaatttgaagtgtagttctatatttctgactttttactcaggattgtatcttgcccccaacttcttggtaggctcagttctcaggctgctaacaagcacttatgtgataggcactgtgctaaatacagggatgaactcacttaatacagacacaaccttttgagactgtttttgttatcagaggagaaaatagaaatgaataacttttccaaaaccatacagctagcaaattatcttttctggtattctgacctcacaccctatgctcttag

SEQ ID NO: 163475 - DNA, 601 bp, Human
cacagaacaaagtaaattgtaagatttgtcccagcatgcagatacaccagaaactaaatttcatgaaacacttacccttaatatactccagtactttctcttctatataattacaaaataaatgccagtcatgaaccactaaattggttttatcacttcttactgggtttgtaacctgtagtttcaaccattcctttggaggctaaaggtgactaaggttcgtccagcttcagtattctgttgtctacaatcaggccaatcagaatcatagaacatggataatctaaccttgtggctgatrcataaatttttgtaatattcctagcaaatggatatctagtacctgttttaaacatctccaattttcaatatttaacatggtatttagtccatctggaaaatacagattgaggtatgtatatattcatgttgtaagtagaaaatgtgttagcattaggtgagacatgggtggtctgtttgtgcatatataaacatcttggtgctaaaggtctttttacaaaatttgccaattggctgcaggcaagacttgccaaagatgagagattagtgaatttagtggatttagggggaggcagatgtc

SEQ ID NO: 163476 - DNA, 601 bp, Human
cctttgaaaataatactctgtggtcaataaaaaataaataacaagtatttaaaaactcactgtgtttagtgaaattaaattttaatcaaaacacatttttatatttgatcatatggatagttagattatccttgagaaattggatagcaaattgcattttaatatagtagaaactctactattcaatttatgtagatttttatagcattaggctgtagtttaatttagaaataatttgacatgcttgttaaaatactcatgatttgtaaacatattaaatgtatattttaactgtaaaatmcaataaataaacagtatgctgtatgagcctaatattaaactatttgcttataaatccgccttttttgttatttccctttaggttggatggagtactgctcgtgattattacacgtttttatggtcccctatgcctgaacattatgtggaaggatcaacagtcaattgtgtactagcattccaaggtaaggactgaaaactgcagaactcaatgaaactagatgtcttattgccattaaagatgttgtactccattgtaatgatttgttcaggtatctccagggtaccaaagttgaattag

SEQ ID NO: 163477 - DNA, 601 bp, Human
ctttttaggtactaatttttggagatttttttttttcaagtgagaaaacaatacaatagtaataacagatattagaataatgtaacaaaaaagaggtgaggaaaatagtccagatgcaaaccacaaacatgattaacagaacttatagttatttgaattctgtcatgtgtaagttcctttattataaaatgataaagtaatataaaattcatttttgtgttagcttggcattatttacaaaatttaaaaaatactcttattcaggtaattctgacatatgctacaatatgggtgaacactkaggatgttatgataagttaaataagccaatcacaaaaagaaaaatactgcataattccgctatatgaggtacttagagtagggatagacacagaaagtagaatggtggtctgcagggcattcaggttccctcaagggaggaatggggagttattgtttaatgagggtagagagtttcagttttaaaagatgagaacaattttggagataatggtggtggtggttgcacaacaatatgaatgtgcttaacattgaactatacactttaaaatgcttgagatagtaaattttatgtgttttt

SEQ ID NO: 163478 - DNA, 601 bp, Human
gataacattgagatacctgtaacaattgtaatgtggtattaacatataagtaattcctgttagtgacaaaaatcacaaatactgatagtaatcaaagtacatgctaaaattttagttagatgttagtaaaaataaaaatataatgtttttctccattaaagttgatggatgacctgaattttctgtatcctttaaccccaagttgaacattccctaaaactgcctctttgctattgagaactttatttgcctttatgtttaaaaaaaaaaaattctaggactttattgctttcccctgggkctggctattaataattaagactttttcctctgggtttctcatatctttaagcaatgggctctgttaagaatgttcttatgttagcagaaagaagtttacattgtatgaatcactactttaaaaaaatgtgctcaggattatgagatgaatgatttaaaataaagtttattgtctcacacattttcacatattttaatgcaattttaaaattttgtaaatcttttttttttttttttgagccggagtcacactgtgttacccaggctggagtgcaatggtgtgatctcagttcactgcaat

SEQ ID NO: 163479 - DNA, 601 bp, Human
cctgagtagctggaactacaggtgctcaccaccacgcttggctgatttttgtatttttaatggagacggggttttgccatgttggccaggctggtctcaaattcctgacctcaggtgatccacccgcctcggcctcccaaagtgctgggattacaagtgtgagccaccatgcctggccctaaatctttaaaatgaaaccccaaatcatttctcccttatctgatctggtttaccatattcagaatgttaaaaattaaatttgttttaacaaactaaaagaaaaacctttaaaaaaccaaastatactaaaatatttatttaatgaaaatactttgttagcatgcaaatacttacttcagaaaggaaccaaaaaacagtttgaatttgggataaacatttctagtattatttattttagaatttttttttttttttgagacggcttcttgctctgtctcccaggctggagtgcagtggcgcgatctcggctcattgcaagctccgcctccttagttttcgccattctcctgcctcagcctcccaagtagctgggaccggaggcgcccgccaccatgcctggctaattttttttgtattttta

SEQ ID NO: 163480 - DNA, 601 bp, Human
tcccaaagtgctgggattacaagtgtgagccaccatgcctggccctaaatctttaaaatgaaaccccaaatcatttctcccttatctgatctggtttaccatattcagaatgttaaaaattaaatttgttttaacaaactaaaagaaaaacctttaaaaaaccaaactatactaaaatatttatttaatgaaaatactttgttagcatgcaaatacttacttcagaaaggaaccaaaaaacagtttgaatttgggataaacatttctagtattatttattttagaatttttttttttttttgagacggcttcttgctctgtctcccaggctggagtgcagtggcgcgatctcggctcattgcaagctccgcctccttagttttcgccattctcctgcctcagcctcccaagtagctgggaccggaggcgcccgccaccatgcctggctaattttttttgtatttttagtagagatggggtttcaccgtgttagccagggtggtctcgatctcctgaccttgtgatccgcccgcctcggcttcccaaagtgttggaattacaggcatgagccgccgcacctggctgaaaaatttttacagtg

SEQ ID NO: 163481 - DNA, 601 bp, Human
cacttctaatgttaacattttgtgaggccaaggaggatggattgcatgagcccaggaatttgagaccagcctgggcaatttggcaaaacttcatctctacaaaaaatacccccaaaattagccaggcatggtggtgtacacctaaagtcccagctacttgagaggctgaggtggggaggatcacttgagcccaggaggctggggttgcggtgagccgagattgtaccacttcactccagacttggcgacagagtgagaacctgtctcaaaaattcatgggcactaagcctaaatgcaataygttttacaagtttctgaaaattcaacagttcatttttattttgaattttgaaattcagaaataaaagcatctccgtgcctagaacttttttgttatataaggaagtcagggaaagcttagtcattgaatattagagttatagaagggctttcaagcataatgcaaatcactttgctcattttgtggatgagtaatgagaatcctgaaatgcaaaacccaaaacatctaacaatacctaaacgtgattgttttcctaaatgaacccttatttatttattataatcttgttgaatactaaag

SEQ ID NO: 163482 - DNA, 601 bp, Human
gtggcttcattagtgatagaaatagacttgtaagaagccaaaaacagtgaaaaaacagttatctagtcattgacttgtttatttaatattttcacaagaaaagcagtttgttctgaaacttacacagactgtgatcttatatattacagtctcatgtacagtagagccggttgggcatatttatgcccatttacagtattgagctattgtttcctgagggtggggtctgttctgttatccttttgtccaacaaggcctccagcaattgcttaataattgctaaatgaaccgctagtgcagwgattctcaaacatttgtatactccagtggagtggttatatattgcacacctgggcagagatgttatacaagtaagtcttaaattctgaaaagattttccttgctttgttctatttgtttgaggattgctcttttgagttagagggtaaacataatgtcaagtactatgtacatttacaaatctccttataaatgtgaagtcttcaattctgtcttttctatcgttagcctttttagttaaaaatatgcaagtatttcccagttttactcctggggaacacttagtgtcctgcagcagact

SEQ ID NO: 163483 - DNA, 601 bp, Human
atcatatgtattaaaagtttaaagtttagaattttgagttgcgggaacttaagtcaaatggagttctttctgataaatggaattttgtggtggtagctttgtaatatgtcaccttgctaggctgaacttattttccagagttctcttctctgtaatttgtttaggatgagacacaagagagattcttgcatgagatttgaaggcagaagtgaagcagcagccatttttgtagcttatacaagttgtggcttctctcctggctcaccttgttggtatgaggtagtagtagccaggctgcaaytgccctaccttctgtggaatcctctttcagtttctccatctcttgggttaggtctgtcaggaaggaccccagcatgctcaagacatcttgagactatcagggtcagaataaaaaccaacatggacttcagttttcagtccgttctggtgggcttcatctggtgattgtggatcctattttgttcttgcttttcccactttatgatgtctttcttgattgcctgccttacacaagctagttccagcttctacagttacacaagatcaaatctcttagtgtctctctcagtctgtctgttcg

SEQ ID NO: 163484 - DNA, 601 bp, Human
ttcgcctagtcacactcttgagtagctgcttgtactttatattacgtagtttaacaaacgtggacttttatttaatatgctttttattgtactcaagaatatagataggttctgtaagattgtatccaggattattcagttgcagatataaaagaaagcaagcatccaaaagccaacctatattaacttcagttaccttgatttttaaaaaacttatacaattggccaggtgcggtggctcacgcctgtaatcccagcactttgggaggctgaggtgggtggatcacaaggtcaagagatsgagaccatcctggccaacatggtgaaacctcgtctctactaaaaatacaaaaattagctgagtgtggtggcacgcacctgtagtcctgctactcgggaggctgaggtaggagaattgcttgaacctgcgaggtggaggttgcagtgagccaagatcatgccactgcacttcagcctggcaacagagtgagactccgtttaaaaaaaaaaaaaagtatacaatttggatggttttttgtatatttatagagtcatgccaccatcaccaaaatttaattttaggatgttttttatcatcctg

SEQ ID NO: 163485 - DNA, 601 bp, Human
ggtaggagaattgcttgaacctgcgaggtggaggttgcagtgagccaagatcatgccactgcacttcagcctggcaacagagtgagactccgtttaaaaaaaaaaaaaagtatacaatttggatggttttttgtatatttatagagtcatgccaccatcaccaaaatttaattttaggatgttttttatcatcctgcaaagaaaccttgagtccattaacagtcactccttacatacccctgtctccagccctaggtaaccttgagtctactttctctgtctctatatttgcctttttttwaatatttgtttaatgattttgaggttcatccatagatcagtactttgtttctttttattgcttaataatattctatatcttgatgtaaaattttctttttaaaatatagagacaaggcctcactatgtttcccagctggcctcagactcctggactccagccatcctctcaccccagcctctcaagtaactgggactacaggtgtgcaccactgtgcttggctcatatctagatttttgatttttgaggcaaatatcttgaggcactttctgacaagtgctttgctgttttgagatcctc

SEQ ID NO: 163486 - DNA, 601 bp, Human
ttaattttaatacatggggtgatgattataacttatgtatacatagcaatatatttctttcaagccaattactttaattttgtacctgctttacaaagtaatagttttaagaaactcataatatattatttctacaatatatttatatacttttaaacccataatttttgtattgataagtacagaactgtacaatgaagcattttcatagtttatttcataagactacatcattgagtagttcccattcaatttaattaaaaggtaattttaagtaaagttatactaccctaaatttttktacttattccctaactctttaaaaatgtatatgaaacctaatgttaaaaaaaaatcactagtttgtggaataaattcatattcaggaaataatttagacactaatatatttgtagcctgtctctcttccccctcctctccactccaaccacaaaaatagtgcttggatctgttattttctgtaaaagttgaatttaagtacatttgttcatagcagatttttcagtgaattgaaggtagccctcacattttttactatagtcatgcaccacttgacaatggggatacgttcttagaaatg

SEQ ID NO: 163487 - DNA, 601 bp, Human
tatctagatatcttagaaaaggaaaggtacagtaaaaatattgtataaaatgtaaaatttgttatacctgtatagggcatttaccacaaatggagcttgcaggactgacagtgctctaggttattcagggagtgagtagtgagtgaatgtgaaggcccagggcattgctgtacactactgtagattttataaatattgtatacttagactacactaaattaattaattaattaatttttttttttgagacggagtcttactctgttgcccaggctggagtacagtgcagtggcgtgatctsggctcactgcaacctccagctcctgggttcaggtgattcttgtgcctcagcctccggagtaactgggattacaggtgcacgccaccacacctggctgatttttatgtttttagtagagacagggtttcaccatgttggccaggctctcgtacacctgacctcaggtgatctgcccgcctcggcctcccaaaatgctgtgattacagacatgagccaccgcacctggccagactatactaaatgtataaaatatttttttctccaaaaataaattaaccttagctcactgtaacattttca

SEQ ID NO: 163488 - DNA, 601 bp, Human
tctggtttcttcatatgcttttgtttataatcagaattttattttttaacatgagaataaatgtgctctgttattttaaatacttttaaaatgtgtttagccacctagatgaatgattcataatctttttatcgggttattcataagtgagagttatgacttgtgggaattggtaatagtggctcatggaaacagtgatttttttagtttaggagtgggaggaaagtccctgcatgaatctgaagtactcaaatctctttatctccctttgccccaatttttatgattgttttcatatcgrcatacaatgtagcaggcttaattatctgatggaggttttctttgttttaatattagaattatgatgtccttttggcatgatttacaaatgactaaaagtgttttagaaaaattgtcttttagattttatcttttaaagttaatttttgaaagcatgattcctagttgtttgaaatggcaaagctcttagctttttcatgctaagaacgacggagccacattgaagatgcttatgcttaactcagacgtgaaaactacaggcctgaagaataatccttactttatcgttttcatgtgtttt

SEQ ID NO: 163489 - DNA, 601 bp, Human
ctcaaatctctttatctccctttgccccaatttttatgattgttttcatatcggcatacaatgtagcaggcttaattatctgatggaggttttctttgttttaatattagaattatgatgtccttttggcatgatttacaaatgactaaaagtgttttagaaaaattgtcttttagattttatcttttaaagttaatttttgaaagcatgattcctagttgtttgaaatggcaaagctcttagctttttcatgctaagaacgacggagccacattgaagatgcttatgcttaactcagacrtgaaaactacaggcctgaagaataatccttactttatcgttttcatgtgttttgaaaggaggcttggatgctgggaagctatcaggtgcctttatgggcaccagagaaagtctaagacgcttgttgtagtcagagttaatttataattcactgtaaagttaactgactcaaagcaattagttcatgatttacattcagttgctagtgatttttttctcttttcctatgcattttgtagaatgctgtatacccgttatagggcttcattacttacaggattggaaagtaattttgtcctag

SEQ ID NO: 163490 - DNA, 601 bp, Human
aatggcaaagctcttagctttttcatgctaagaacgacggagccacattgaagatgcttatgcttaactcagacgtgaaaactacaggcctgaagaataatccttactttatcgttttcatgtgttttgaaaggaggcttggatgctgggaagctatcaggtgcctttatgggcaccagagaaagtctaagacgcttgttgtagtcagagttaatttataattcactgtaaagttaactgactcaaagcaattagttcatgatttacattcagttgctagtgatttttttctcttttcctrtgcattttgtagaatgctgtatacccgttatagggcttcattacttacaggattggaaagtaattttgtcctagggagaaatacttgggttaaatctgtagtgtatttgcagtgccaagagagcactggtggtaaaactaaaaataaaaaaaatgtgaacattatttagaaacctctctggccatctttataaatcaacaagacaaatcctgaaaatgtgcccaatttcacagcaatcattatgattgcagaggaaataaatattatttgtttttttctctggtattatggcattggaac

SEQ ID NO: 163491 - DNA, 601 bp, Human
acccctaaaagttagttttcagggaattaatttgctgctgttttagatacttaacaggtagtgtgtaataagttgaagaggtttaatggaattaagatacttgtttatcacaattcatgtaactatttttcctttttaagaacatatatatatatacacattggggagaacattaatttagtaataatcccattttagagtttgacttttagaatatcttcagagatgtcattttgtaaaaatatcctcactgctaacaaatcttgaccgcttgaagttttgaatttttttttttttttttgagatggagtctcgctctgtcgcccaggctgaagtgcagtggtgcgatctcggcccactgcaagctctgcctctcgggttcacgccattctcctgcctcagcctcccgaggacctgggactacaggtgcccgcgaccacgtccggctaattttttgtatttttttagtagagacgaggtttcaccatgttagccaggatggtctcgatctcctgacccgcctcagcctcccaaagtgctgggattacaggcgtgagccgccgtgcctggcagtttttatttatttatttttttaagcaac

SEQ ID NO: 163492 - DNA, 601 bp, Human
atttaatgagctgatgattatgaacatcaggtagcgttttaaagtgatgctgcaagggtgttggttgctgatgtcttcagagaatcaggagttaatattctatccttgtgaacaggaattagtccttcagcattctgtatatttaaagagtaaagtgcaagaagtaagttaattcatttctcctcagtactcttaacgaaagcaggatatacttgatagtgtacactacaggtctgtatttataattccagttattgaatttgatttgtatgtgtgttaggagcaaatcagcaatagcgaragtcatgggaaaatcaatatagttgggttagtcaacaaatacatttttcagcacattgaaactaaatgatatcgtacttttcgcctgcagaaaatggaattgtttgagatgttgtttttgaatgcaccccttctagttttccagagtcttgtcgtgccagatttgaatatgccaaataacataatttgtttccccaaaagaacaaccaaatctatttgcatttttaaagagaacctgaaaccattaaatcaaaggaaaagactttagagatcaggtgatgttgttagggcttagaataat

SEQ ID NO: 163493 - DNA, 601 bp, Human
gcatacctatgttataaatttgtaatataatttcatttgcttgtatttaattttaatatttgcttttattcttctgtttgatttatttttattgtttgaatatgtaaaacagttgctttgttcagaagtcaaaatgatagaaaaattttactctgaggtctcaatctcttccttgtttttttaaacccttttcttacctatgcccatagataaacattttcataagtttctagtttattcttatgtttctttttgtaaaaataagcttatatatgcatgtgtacatgtacatacatccttstttatcctcttcgttcttaaaaaaggtagcgctactatacataccattttgcacctttttctcactgaacaaaataagttgctagttactccatatcagtttgtagagatcttcctcatttgaaaaaaatggccacataatattccattatatagatttaccttgattgattcattatttcttatgatgttatttttagtaatttgctattaaaaatactcagacatagttaatgtaatacctaaaacgtcagaagcgcatgacatttagaattaatggttaatccttgttactttttaa

SEQ ID NO: 163494 - DNA, 601 bp, Human
tcttctagttctttttcttctcctttgacatatagaagttggcgatctttttataggtagatctattagtgtgatgcctccgaagattttgtccatgccaacactgcataaaatcatcatttacatttccttctaaggggctaacagtttagaaaccaatattgggttgcatttttttcctgattttacattatttttagtacagagattaaaaacaggaagttgaataaactaaatttattgtgtttataatgtttaaatgttataatgtttaaacattaatattaaaggaaataatttyaccatggcaattttagctttttaaagatacttttaggtttgtcaagcagtatgaattacttttcattttcccaatgcctcgtctttactatttgtatatcaatattttgtttttagaactaaggcctaaatctgttctgtgtttttataatgatatgaaatagatttatattatattggatgtctcttggggtagaaagtaggaaacatcttttaaccaaaatttttggtgttacaaagaagctttcggaatgatttttactggtagtcatacaaaatgagggtcagtatttctagctga

SEQ ID NO: 163495 - DNA, 601 bp, Human
gtttgtgcaagtgatttttgtttgtttttttaaatgtgctttgtgtgtttttgtgtgcattggggaggggaggggcattttttagagctatagaataaaatttacacattagcttcatgttactgtaatttaatttacagtaattatttaaaatattttgttgcttataaatagcaaaatcttttaaccaaagttaaaatgaatttttttttttgcttgagagaatcctgtggaagggttgattagaacagttttactcttgaattcagggtagttttttgtaagagtgaactacattttygttaaagatgaaacaattctggatgaatatttcaagatttttctatagaaatagtattgaaaggaagatagaataatgttcaagcaaaaaccttcctcagggtgcttttttttttttttaaacaaccatattgaggtataattgaaatccaatgaattgcacgtacctagagtatacagttggatcagttttgacatacacagttgtgaaactatcaccacagtgccatcactctcccagtttttttggtacctgtttgcaacacatccctttcgttatccttatctctaggaaattatt

SEQ ID NO: 163496 - DNA, 601 bp, Human
ttactgtaatttaatttacagtaattatttaaaatattttgttgcttataaatagcaaaatcttttaaccaaagttaaaatgaatttttttttttgcttgagagaatcctgtggaagggttgattagaacagttttactcttgaattcagggtagttttttgtaagagtgaactacattttcgttaaagatgaaacaattctggatgaatatttcaagatttttctatagaaatagtattgaaaggaagatagaataatgttcaagcaaaaaccttcctcagggtgcttttttttttttttaaacaaccatattgaggtataattgaaatccaatgaattgcacgtacctagagtatacagttggatcagttttgacatacacagttgtgaaactatcaccacagtgccatcactctcccagtttttttggtacctgtttgcaacacatccctttcgttatccttatctctaggaaattattggcctgctttctgtcactatcaattagcctaccttttagacaattttataaaatggagtcatgtaatatgtacttttttctacccactttcagcatgattatttgagatttattcatat

SEQ ID NO: 163497 - DNA, 601 bp, Human
tatttttaaagttgaaaagtgatcattatcctcctgttcattttgaaacaaacatgaatgcatatgtaaaattattttaggatggctgggcatggtgacccactcctgtaatcccagcactttgggatgccagtctgggaggattgcttgagtccagtagtttgagatcagcctgggcaacatagggagatacccacccccctaccagtctctaaaaaataaaaattaataaataaaaataattattttagggccttgactttttttggagtacaataatatgtcatcagtaattttaaamatttggctggagttttaacatttatcactaaagtatgtgactgtgatcctaaatgaaatactgtaaaagcaagtgatgtaatcttaactgatgaaaattatttttgccaatataatcttaggcaacagacaagcccaaatgataaatgatactgtaagaatgttagagaaggtcaggcatgatggctcacgccggtaatcccagcactttgggaggctgaggcgggcggatcacgaggtcaggagtttgagaccagcctggccaacatagtgaaaccctgtctctactaaaaatacaaaa

SEQ ID NO: 163498 - DNA, 601 bp, Human
aaagaatgttagagaaaaaaaaaaaaacaggctgtccagctacttaataagtagaaatatgtatttcttctaaggaataaagtataatttaatatattttaagaaatgtatgtagatataatttacatttttttttttttttactgaagaccaggaattctaaatggtttaaatatcatagctaattgtatctatgatctaattttaaagttagaattactttagttttcccttttaggggctggagatgtagcacattacaggctaagttacattagcttattatttctgtgatccttgkggatattcttttcaataactggaaccttccttaattatttattaagtgtgaatcatgaattcatatgaaaagaattttttgcatattgactaggaaaatggtttagtaaatgtctattgaagcctattttacataaagtgctatgttagatattatgtgggcgatcacataaggcacagtgctatgcttaaggagtttataatctggtagagtgctagaagtgtaatggtagtatgcacaaaattttcacaccaccctaggtaatcatctataagccatgggaagctaaacaggtaattt

SEQ ID NO: 163499 - DNA, 601 bp, Human
agaaactttggagaatactcatatttggactgggaagaaaaaaaacacaaaaaaagggcatgggatgatgaaaatattcatgcaatttcacataaaccaaaggaatagttttaagaataaggcaagttggtcaataaatgacaagtaattcagagaagtcaaagaattagctgaggaaaatacgtggatttagtaataggaattattttcgtaaaacagtataaaccagatctcaaagttgcaaggagggagtaggtaaatgaaaaaaaataaagaaatttctttctttattcagcttcarttggcagagaaagacaaagaaataagtggtctgatttcacatttggaaaacctctccagggagaaggtattgagcaatgtagttaaacaaatgtgtatcacatgaaactgaataataatagagctttatgaagagacacattttgaagttcatgtgacagtacaatgttcaaatttaggaaaacagtgaaatttctaaaaattacgtgaaatgtttatctggttttcttttgtaataggaaacatttttgaagttgtttaatgacttacagcaaaacctcacattcacatagagcaatac

SEQ ID NO: 163500 - DNA, 601 bp, Human
aagtacccctaaagttcttttgttgcctaatgaagtatgatggttaataaaggtaaagtgcttgtttgtttgagttgtgagttgaactagtctcttttttcatggaaaccatttttactttgaagaacaatttctatattcagacttgggtatttgacagatattttctcaaagtgaaatgaaatgagcctgttatatcagggaaaaacaattgataattttttttgccattgataatatttgagcttttaagcaaaaactggaattttgaaaaacttgttatcttccagtgtaagcttgmtgctttccaatgtttacaaacttttctaatgagatggttgtaatatttagactgtattttttaattgtatagcaaaatttgtcagcatttagaagatccacataactcagtgaaccagtagttttccaaatgaccagcgatgttacaaaatcatgtatcataaaagagccattctaagtgcaagttagatttcaaggttgtatgaggttactgtgatagttgtgaaattctgatttttcaactcatcactttttccacatttgtcctttggcattctactataaggacgaaccttccttt

SEQ ID NO: 163501 - DNA, 601 bp, Human
ctaaagttcttttgttgcctaatgaagtatgatggttaataaaggtaaagtgcttgtttgtttgagttgtgagttgaactagtctcttttttcatggaaaccatttttactttgaagaacaatttctatattcagacttgggtatttgacagatattttctcaaagtgaaatgaaatgagcctgttatatcagggaaaaacaattgataattttttttgccattgataatatttgagcttttaagcaaaaactggaattttgaaaaacttgttatcttccagtgtaagcttgatgctttcmaatgtttacaaacttttctaatgagatggttgtaatatttagactgtattttttaattgtatagcaaaatttgtcagcatttagaagatccacataactcagtgaaccagtagttttccaaatgaccagcgatgttacaaaatcatgtatcataaaagagccattctaagtgcaagttagatttcaaggttgtatgaggttactgtgatagttgtgaaattctgatttttcaactcatcactttttccacatttgtcctttggcattctactataaggacgaaccttcctttgtccttgt

SEQ ID NO: 163502 - DNA, 601 bp, Human
aggttaaggctcagtcccacaggactgctcccactttagatgccagttacaagtgaggtcctcaggctactgatagcagtcattttctcacacttattcacacgtaattcacacataagtacttaatagcaaaaactattatgtaccattaataacagtgaaaaaataatgtggcagatggggaattgtctacttgtggcatcatgtcagtgctcaaaaagtttcagtttggaacatttcagattttggattttttatcagggaatgctcaacctgtgtatgctttttctcagcactactrtattctgaaaaccattccatatatgaagctcatagaaatcctccatctttttttaaacagctgtgtagtacttcattatacataccataatttattcaaccaacttcctgtatttggccatttaggtagttgctaatattttacaaataatactgcaatgaatgattctatgcacatgtagttttctggtgttggggtggtaccttcaaggtaaattcctagaagcgtgattgctggtttgaagggtaaatgcatgtgtagttttgttagagattgccagatgccctttcatagaatttg

SEQ ID NO: 163503 - DNA, 601 bp, Human
tccagcctgggcaacagagtgagactctgtatcaacaacaacaacaacaacaacaaaatgcatattcttgggccctgttctggtcctgctgaatcagcagctctggaagtgatgccccaaaatttgtgtttgacaaaaaccctccaagtgtttcagatttatgctcagctttgaaaactactgatgtgttgcatttgaatttttagttttccacagaaagcattccctacacccaggttatagaggagttcacttgtgttttgttctaatactgatagagtttcagtttttttttttttttgaggtggtgtcttgctctgttgcccaggcaacagtgcagtggcactagctcgactcactacaacctttgcctctcaggttcaagcaattctcctgcttcagcctcctgagtagctgggattacaggctcccgccaccaagcctggctaatttgtatatttttagtagagacagggttttgccatgttggctaggctggtctcaaactcctgacctcaggtgatccacccgcctcagccttccaaagtgctgggattacaggtgtgagccaccatcagttttttttttttttaacattaaa

SEQ ID NO: 163504 - DNA, 601 bp, Human
tcctatttgcaaataatttattgtatctttgatggtagagtaggcatattagattaaactctctattaggttggaactctataaagttgcttgactgtaccaatgcagcctaaatcttttcatgaaacccttgactctatttcagtagtgtattatttgcttacagaagaatttaaactctacttctttaatttgcataaacttttgaataagtattttattatctctaacttcttttgtgcctttttttttttgggagacggagaatcttgctctgtcacctaggctggagtgcagtggygcgatcttggctcactgcaacctctgcctcctgggttcaagcaattctcctgctgcagcctcctgggtagctgggactacaggtgtgtgccaccacgcctggctaattttttgtatttttagtagagacaaggtttcactgtgttagccaggatggtcttgatctcctgacctcatgatccacctgcctcagcctcccgaagtgctgggattacaggcgtgagccaccacgcacagccctttttttttttttgaatcgtgtttgaaatgtttcttggatttaacctttcttttttttctg

SEQ ID NO: 163505 - DNA, 601 bp, Human
atcttttcatgaaacccttgactctatttcagtagtgtattatttgcttacagaagaatttaaactctacttctttaatttgcataaacttttgaataagtattttattatctctaacttcttttgtgcctttttttttttgggagacggagaatcttgctctgtcacctaggctggagtgcagtggcgcgatcttggctcactgcaacctctgcctcctgggttcaagcaattctcctgctgcagcctcctgggtagctgggactacaggtgtgtgccaccacgcctggctaattttttrtatttttagtagagacaaggtttcactgtgttagccaggatggtcttgatctcctgacctcatgatccacctgcctcagcctcccgaagtgctgggattacaggcgtgagccaccacgcacagccctttttttttttttgaatcgtgtttgaaatgtttcttggatttaacctttcttttttttctgtagtcacatgccagtcttgaatgactacagtagcatctctggggttttcagtcatggcaagagatgaaggatatcttttgaatgcctttcttgttctaaatgtatctcctatt

SEQ ID NO: 163506 - DNA, 601 bp, Human
gtgtatgttatgtatggacttgcttagaaagaacttttaattcctgcatctcttatcaaacctaagttgacttgcatttttcttaatgtttgcaagttttgctcttgatgatgactttcattttaaggttacttagtccatttattggatcatttatataggtaaaaatgtgttaacttagacacagtctcatctctacccccaagaaatgacaagcagcaaaaccagctcaactttccagactaaatttttcattcttatatcctttgttaataaggcctctggttgattttttttttttaacagctctgttaaggtgcagtttacatgtaatagaatctgttcatttaaatagagtttgatgacttttggcaaatgcatgtagttctgtaactaccgtttcattcaagcagtgtaacgtttccattactgcacaaagttccctcttgctcatttgcattcgtcccctcctgctacccccctgtcctagaaaacctctggtctgctttctgtccctgtcgttttatggcttctagcatttcatgtaattggaataaagcagaatttatccattcattagttgatagacattaatctacca

SEQ ID NO: 163507 - DNA, 601 bp, Human
ggcctcccaagtgccacattgtgaaaatcagtgagaaacaggaaatgaaggtggcttgtccaatctgattcaaaggcttgaggagttgtacagtggccaatagtcacacacatcccattagtaactacttatttaggaatgaaataaacacattaattttctttcaatttatgtgtagttttttttttaacggtcactaaatttgttagaagacaaatacttaatggtcagtaagtcctcacttaacatcatagagcagttcttagaaactgcaactttaagcgaaaggacttacagcagrttgaaagaaataactcctcatgatccgcccgcctcggcctcccaaagtgctgggattacaggtgtgagccaccgcacttggccttttttttttttttcttttttttgaatcgtgtttgaaatgtttcttggatttaacctttcttttttttctgtagtcacgtgccagtcttgaattactacagtagcatctctggggttttcagtcttggcaagagatgaaggacatcttttgaatgcctttcttgttctaaatatatctcctatttctcagtagccctggagttacaggcataagcca

SEQ ID NO: 163508 - DNA, 601 bp, Human
cacatattatacaatttgccatttaaagtatacaatttagtggtttttaatgtattcacagagctgtgcaaccatcaccgcattcaattttagaacattttcctcaccagcaaaaaaaaccctgtagcctgtagcggttaacctcttcccatttattcccaccagcccaggaaaccctcagtccactttgtttatagattcgtctgttctgcatagtaatataagtcaaatcataaaattgttatcttttgtgactggtttctttcacttagcatgttttcaaagttatccatgttttagyatgcatccatgtttaacatgaagaatgggttttattcttgtttgtttgggtggttagattgagcatccaaaatccgaaactgagtgctgacatgatactcaaaggaaatgcttactggagcattttggattttcaaatttgggatgttcagctggcaagcgtaatgaagtattacaaaatctgagaaagtctgaaatctgaaacacttctgttcccaagcattttggataagggggactcaacctgtcccacattttgtttacccattcatgtgttagacatttgggttatttcaccttt

SEQ ID NO: 163509 - DNA, 601 bp, Human
accatcaggccaggcaggtgactcatgtctgtaatctcatcacttttggggaggccaaggtgggaggactgcttgagcccaggagtttgagaccagcctgggtaacatagtgagatcctgtctcttaaaaaaaataccgagtgtggtggtacacgccggtagtcctagctacctgggaggctgagatgggaggattgctggagtccaggaggtcatggctgcagtgatccatgatcgtgccactgcactcctgggtgacagagcaagaccttgtctcaaaaaaaaaaaaaaaaaaaaaaamaattactgttcaaatgtccaaggtggtcgtatgcttttaataagaaaacaagaatgtttttgtacagagtatatcctgagcagataatgagaagtttttgagtttcaaattgaatgtcagtttatcgtagcttgtttcctttgcttaaaaaccagtttgtaatggaaagagtattgtgctgatgggtgtaaacatagatgaaaacaatagggcgtttagatctttaaatggattaaagtaatattaataaaagttttctgaaaaggtatttcttaaaatttggaactgttcataaatata

SEQ ID NO: 163510 - DNA, 601 bp, Human
ccatgatcgtgccactgcactcctgggtgacagagcaagaccttgtctcaaaaaaaaaaaaaaaaaaaaaaaaaattactgttcaaatgtccaaggtggtcgtatgcttttaataagaaaacaagaatgtttttgtacagagtatatcctgagcagataatgagaagtttttgagtttcaaattgaatgtcagtttatcgtagcttgtttcctttgcttaaaaaccagtttgtaatggaaagagtattgtgctgatgggtgtaaacatagatgaaaacaatagggcgtttagatctttaartggattaaagtaatattaataaaagttttctgaaaaggtatttcttaaaatttggaactgttcataaatatatttcagtacggtattctcaataaaatttgcttacaagattattttagtagtttagctaaaatactaggtggtgatattttaaaatgtgctgttaaaccctttgggtttgtaagtttcagtgctgaaactgataatttaataatttggggtagaaatatttctaaaacagaatgcatgattctctggctttccatgctttcatttaatataaccttgatgattaaggtt

SEQ ID NO: 163511 - DNA, 601 bp, Human
ctgttaaaccctttgggtttgtaagtttcagtgctgaaactgataatttaataatttggggtagaaatatttctaaaacagaatgcatgattctctggctttccatgctttcatttaatataaccttgatgattaaggtttatttaaaaaatcagtgttacatggtgtcatattcttttaagatctattactaatagtgaaatgcctaacattggatatttcaagttcttgtcttgcttttctttttcccagtagcttttttttttttttaactgtcagtcggcctgctttaaaagcttcwtttccaaattaaagtatttttaatctactgtggttttgaaactaattaaccaggcttgttgagtaaaatagaataaatgtattctcgagtgaagatttcactcatcattttgcctgtcaatatcatgagagactttattatatgtattggctccttagagtgcttactgcatactctctgatttcaacctatgctctgggtagatggttcatgttttatttcatgagaacttattgtttctcattataacatgtagaattatactcttgagcccctctccccttttattaggtaataggt

SEQ ID NO: 163512 - DNA, 601 bp, Human
tctcattataacatgtagaattatactcttgagcccctctccccttttattaggtaataggtggtagaagataacagaataatcgggttatcattgccaaattatatatgacttagaaagtataaattacttctaccttttttcccctccaggtatttaacgagcagggttaacatgtctgacagtttgtctgagtctggaaccttagctacaaactctactgttagctgattcatggaagcagtaaattggtgtaggctgttagctattataaaacaggaaaaggaggttatgagacttytggttccattacatttttggcccctagaaaattgtattctattttaaatatttgtcgttaaaaattctaaaaaatataatatcaagacctgccccattttatcttttccaattattttcttcagcatttcaatattttggatttttttttcaaagatgagtgagaaaattttgttccttatcactgttttgtagttatttaagtatactcagtgtttcaaagattgttgctgggaggcctaaatctgggagctagagtaacctggcacaaaatcagaattcactgtcctacatactaagc

SEQ ID NO: 163513 - DNA, 601 bp, Human
aacagaagtattttaccccttcttttacttttcaagaggggaaaattgtcagaaggatagtcaagtactagaaatactcattttgtcttttgtttgttcacgttgcacttcacaccatatatactttttttggtgctccttcccatgacagacttaactgacccattaatagcagctctggggcaagcatgcctacccagtaacataaaggcttcctcagtgccggctgcgcttggggatatgctgttagttcatgacatgagagcagctaacggctgctgagagataaaaaggaaatagkcaatttagatgatgtgcctggtttcagtgttaaatgagcctgtgtgtttggctgttgatgtagcacgtacagatctctaaaaactgctgggatgcagccatgggaatccaaatcagtgttttctttctgatgaaaactagatgcacaaatttttagaagtctcacttgacaacctctgaaatatttaactttggattttgttcctctatagcagagttttgaggcttgtagtttagtgcattgctttgctttaacacgtgttaatccagttggacttgcttccccaagaatatgcatata

SEQ ID NO: 163514 - DNA, 601 bp, Human; identical to SEQ ID NO: 17643

SEQ ID NO: 163515 - DNA, 601 bp, Human; identical to SEQ ID NO: 17644

SEQ ID NO: 163516 - DNA, 601 bp, Human; identical to SEQ ID NO: 17645

SEQ ID NO: 163517 - DNA, 601 bp, Human; identical to SEQ ID NO: 17646

SEQ ID NO: 163518 - DNA, 601 bp, Human; identical to SEQ ID NO: 17647

SEQ ID NO: 163519 - DNA, 601 bp, Human; identical to SEQ ID NO: 17648

SEQ ID NO: 163520 - DNA, 601 bp, Human; identical to SEQ ID NO: 17649

SEQ ID NO: 163521 - DNA, 601 bp, Human; identical to SEQ ID NO: 17650

SEQ ID NO: 163522 - DNA, 601 bp, Human; identical to SEQ ID NO: 17651

SEQ ID NO: 163523 - DNA, 601 bp, Human; identical to SEQ ID NO: 17652

SEQ ID NO: 163524 - DNA, 601 bp, Human; identical to SEQ ID NO: 17653

SEQ ID NO: 163525 - DNA, 601 bp, Human; identical to SEQ ID NO: 17654

SEQ ID NO: 163526 - DNA, 601 bp, Human; identical to SEQ ID NO: 17655

SEQ ID NO: 163527 - DNA, 601 bp, Human; identical to SEQ ID NO: 17656

SEQ ID NO: 163528 - DNA, 601 bp, Human; identical to SEQ ID NO: 17657

SEQ ID NO: 163529 - DNA, 601 bp, Human; identical to SEQ ID NO: 17658

SEQ ID NO: 163530 - DNA, 601 bp, Human; identical to SEQ ID NO: 17659

SEQ ID NO: 163531 - DNA, 601 bp, Human; identical to SEQ ID NO: 17660

SEQ ID NO: 163532 - DNA, 601 bp, Human; identical to SEQ ID NO: 17661

SEQ ID NO: 163533 - DNA, 601 bp, Human; identical to SEQ ID NO: 17662

SEQ ID NO: 163534 - DNA, 601 bp, Human; identical to SEQ ID NO: 86657

SEQ ID NO: 163535 - DNA, 601 bp, Human; identical to SEQ ID NO: 86658

SEQ ID NO: 163536 - DNA, 601 bp, Human; identical to SEQ ID NO: 86659

SEQ ID NO: 163537 - DNA, 601 bp, Human; identical to SEQ ID NO: 86660

SEQ ID NO: 163538 - DNA, 601 bp, Human; identical to SEQ ID NO: 86661

SEQ ID NO: 163539 - DNA, 601 bp, Human; identical to SEQ ID NO: 86662

SEQ ID NO: 163540 - DNA, 601 bp, Human; identical to SEQ ID NO: 86663

SEQ ID NO: 163541 - DNA, 601 bp, Human; identical to SEQ ID NO: 86664

SEQ ID NO: 163542 - DNA, 601 bp, Human; identical to SEQ ID NO: 86665

SEQ ID NO: 163543 - DNA, 601 bp, Human; identical to SEQ ID NO: 86666

SEQ ID NO: 163544 - DNA, 601 bp, Human
gttagtaggacgtggctctgcacagcccaaaaaccagcttactccttagccagggtgtgaggcctcgactatattcttcaaaatgtacttaggctctggttactgggatggccagtagatgtaatgcagatggttggagtttggggagggttaggaggcatcaagcaggacaaggtgctgctgagttcagagggcccacgttcaagggatggaggtggaacctggagaccgactcttaaaagcacagtccgtggttgggtgtggtggctcatgcctgtaagtaagtctcagccctttggargccacagcagaaggattgcttgagcccaggtactcaaaccagcctgggcaacagagtgaggccctgtcaaaaaaaaatcagccttactgtgaagcctccaaggctgctcgcaggcagctgtggctctcgggaagggaggctgctttgcccagcagggaacatttggggcagggggtaaattttgccagtttgagcatcatgaggtgtaacaagaaatgggttgaatgggccaaatgcaaggagtgcatctctgggctgcaaactgacttgagtgctgcactattgctattccgtgcaaac

SEQ ID NO: 163545 - DNA, 601 bp, Human
gcgccaaggccgcaggtaatccagggttgggggtctccggcgtgtctttcgggtcgcgtcccgcctgggtgccccggggattcccatgcagaaatggagggtgcccccagcagaggggaaaactctggcgtgggaagaggtgggggcgtgcccacagctgcgctcgcgggtcgccggctgcaccaggcacagctggaaagcaccttgcgcaagggtctcacggggtgcagactcgcgactcctcccccttcctcctccttcccgtatccgcagcgccagggcagtgctggtctgggcagtrcgcggggaagcggggacccgctgtcactgcgcctcccgctgccgacgccgcctggacggccgcactctccctgcccgagacccggtgagtgcagctcggaggctggaggacccgatcctcccaaatgctgggtgctttgataatttataagccttttaggctcccttgacttagagaaccaggaggaaaggagtgggagtgtgggttggcggagcccagagacttgtgaatggctgggactaaattcaagtttgtaacccggactctatcccatgactaaagaggtcatagcagaacacg

SEQ ID NO: 163546 - DNA, 601 bp, Human
ctcctcccccttcctcctccttcccgtatccgcagcgccagggcagtgctggtctgggcagtacgcggggaagcggggacccgctgtcactgcgcctcccgctgccgacgccgcctggacggccgcactctccctgcccgagacccggtgagtgcagctcggaggctggaggacccgatcctcccaaatgctgggtgctttgataatttataagccttttaggctcccttgacttagagaaccaggaggaaaggagtgggagtgtgggttggcggagcccagagacttgtgaatggctggractaaattcaagtttgtaacccggactctatcccatgactaaagaggtcatagcagaacacgaaggctgggcttttggtctaagaaagaatactaggagaaaaaaaaagttattttcacggaagttgttttcgagcgatagtgcatgatcaggactctgaaatttttctagctctgggcggagaaggacgcctagggattgtctccatagttaacaggggaaggccaccggctgcctgtaagagagaaacgttgcgatgcttgtctatttcacttttgggaagacaagattaaaggctgc

SEQ ID NO: 163547 - DNA, 601 bp, Human
attttctgtttggttaggaagtaggaattttatgaggacttttattgtaaactgtgtcaagggaaaaatcatcttatactaaacgtctttattgccaaactagaataccttcacaatctgaactttctctagatgggcacagatcatgaataactcagaaaccattagcatattgtgtgcttaattaaggctggaaagtgctgaggctttttgcaggcgcagttagcaggcgaactggtcagcagggtttctggggaacgtagatttgcgtgacaggggccctgtgttgctaaggaattamtgcaggcactgagaaaagtctcagcgtcagacactcctccacctcccgggtcctgcttccctccctctcccctttccaggcaactcacagtttaggggtgtggttgtgtgtgttcaagctcttgggttttacatataaatgcctgagacttttctgcagggtttaaaaactaacatcttgtcttacagctcttttaggatttgtcttttagaatctccagtcctcacaggaaaaccccccaattaaaaaaataaaagaataaagaataaaaagaataccactactactataaaaaaaaaa

SEQ ID NO: 163548 - DNA, 601 bp, Human
aaatacaaatatcgtaaactaaatatttgtgttttctttcctagactctccagaaagagcaacagtaatggagtacatgagcactggaagtgacaataaagaagagattgatttattaattaaacatttaaatgtgtctgatgtaatagacattatggaaaatctttatgcaagtgaagagccagcagtttatgaacccagtctaatgaccatgtgtcaagacagtaatcaaaacgatgagcgttctaagtctctgctgcttagtggccaagaggtaccatggttgtcatcagtcagatayggaactgtggaggatttgcttgcttttgcaaaccatatatccaacactgcaaagcatttttatggacaacgaccacaggaatctggaattttattaaacatggtacgtttctttccgatcagttgggtgctatgtgctcagctttcctgctgcagcttcatttaatgcagagtggtgtttgaatttggcttagatgggctggcaggcatgattttaaaaaatgtaatcatcagtaagaagtacttccatgttaaagatgcaaaaaaaaaagtcttcattaaaatttctatttaaagattc

SEQ ID NO: 163549 - DNA, 601 bp, Human
acattatggaaaatctttatgcaagtgaagagccagcagtttatgaacccagtctaatgaccatgtgtcaagacagtaatcaaaacgatgagcgttctaagtctctgctgcttagtggccaagaggtaccatggttgtcatcagtcagatatggaactgtggaggatttgcttgcttttgcaaaccatatatccaacactgcaaagcatttttatggacaacgaccacaggaatctggaattttattaaacatggtacgtttctttccgatcagttgggtgctatgtgctcagctttcctrctgcagcttcatttaatgcagagtggtgtttgaatttggcttagatgggctggcaggcatgattttaaaaaatgtaatcatcagtaagaagtacttccatgttaaagatgcaaaaaaaaaagtcttcattaaaatttctatttaaagattcttgatcatattttagtagtatttctacaaataggtaattaagaagaatgtattttggccgggtgcaggggctcacgcctgtaatccgtgcacttggagaggccgaggtgggtggatcacttgaggtcagcaattagagaccagtctggc

SEQ ID NO: 163550 - DNA, 601 bp, Human
tggacaacgaccacaggaatctggaattttattaaacatggtacgtttctttccgatcagttgggtgctatgtgctcagctttcctgctgcagcttcatttaatgcagagtggtgtttgaatttggcttagatgggctggcaggcatgattttaaaaaatgtaatcatcagtaagaagtacttccatgttaaagatgcaaaaaaaaaagtcttcattaaaatttctatttaaagattcttgatcatattttagtagtatttctacaaataggtaattaagaagaatgtattttggccgggygcaggggctcacgcctgtaatccgtgcacttggagaggccgaggtgggtggatcacttgaggtcagcaattagagaccagtctggccaacatggtgaaaccccgtctctactaaaaatacaaaattagcctggcatggtggcgggcgcctgtaattccagctacctgggaggctgaggcacgagaatcccttgaacctgggaggtggaggttgtgatgagccgagatcacaccactgcactccagcctgtgtgactgagtgagactctgtctcaacaacaacaaagaagaatgtatttta

SEQ ID NO: 163551 - DNA, 601 bp, Human
tgcaaaatattgtggcaacattttgttgccataatagtagatcaggtgatgtgtttaggtgtgcctgggattctgtcaggcttttagtatgtcagaggtgaacgtaggtgctggctaaaggtaacctaatatttttaaaaagaataatttgcaaaggagtaggtggtagcttgcaaaacatgcttattgatgaaagtgacgccctttcttttggtgtatctaaatggcaaaatggctaatgttgggggaaagtcggtgctgaatgagtgcggagtccagaaaaagtacttaattattttgyttttttgcataccacattcatttaattaaaaacaacagagtaatttaggtcaggtatgtagtgaattgttttgtcagaagccagtcatactcaaccatagctcacaatggagcaagataatattttgcattgttgtgtgactgctttggtctggctctatcaagctctatttaatagtcgactaagtactttaccttcagaatatttcttccttttataaatgagaaataatcatttgaactagaagccatatctgattttcccaaataaaggatagttggagaactcgggttcaaagtt

SEQ ID NO: 163552 - DNA, 601 bp, Human
taccctatcagaactttactcactgggcttcatttgctgctctctaactctcagctttaggaaaatagcagctgattggttcctaggtaaaatccatctatatgatgtatctacatagggatggggaaactttcattcaagtatttacctattcatttgctagacacagcttggacatctgcagtgcgtcgggtgctagagatagtatggaacagtctgtgcctctgggagcttgctgcctggtgcatgcaggatgcagttgaataggcagttatagcagagtatgctgcttcccagcacrtgtgcatgctgtttgctctggcagtgcacaggcaggatactttacatagccatgagtgtggtagaaggaaggagaatgtcagcacagccttccaagaaggatttatgcctaagccgaggtctgaagtgttgagttggagtcagctagatgaagtggacagggtccaggtggagaaaacagcatgtgcagaggtccagagacatggagacctgatgtattcaggcagccaacaaccacaacaccattgagttatttagacagggtagagaaccaggaattacaaaagcatcctgaagaaca

SEQ ID NO: 163553 - DNA, 601 bp, Human
catagccatgagtgtggtagaaggaaggagaatgtcagcacagccttccaagaaggatttatgcctaagccgaggtctgaagtgttgagttggagtcagctagatgaagtggacagggtccaggtggagaaaacagcatgtgcagaggtccagagacatggagacctgatgtattcaggcagccaacaaccacaacaccattgagttatttagacagggtagagaaccaggaattacaaaagcatcctgaagaacaggcatgttcagtgattgtgtgtgtgatttgactaaaaataatatytgttaaagatcccaccaacatccagcaagatctggggaagaagctttgggagactaacctgggaattgctttgggtaagagtgctgcatgttatttatcatctacgctgattcataacctggcccgggaacaaataatctaaaatgagttccaaacactcaactctttggtggttttatggggactgaaggaccccaaaaccttcaccccttttttacaactttatatctataagtgtgagagctgaagatgttccttagggcttagtcatggagtcatggcttctcagagttgaaaaag

SEQ ID NO: 163554 - DNA, 601 bp, Human
agataggaagtgtgcttataatgcctgcccttacaggtgattttggtaagttgaagaactggcagagataagcagcatagagttccctaagatggtttgatagcgctgggtgtggtggctcatgcctgtaatcccagcactttgggaggctgaggccagaggatcacttgagcccgagtttgggaccagcctgggcaacatagtgagacccccatctccacaaaaaaataaaaaagtcagccaggtgaggtggcacacacgtgtagtcccagctacttgggaggccgagatgggaggatcrcttgagtctgggaggttgaagctgcagtgagctgtgatggggccactgcactccagcctaggtgacagagcaagaccctgtcttaaaaaaaaaaaaaatttatacgggcccctagaaagaagaaaaatacccatctaaaatttaaatacagggttcgagaccagcctgaccaacatggagaaaccccatctctactaaaaatacaaaattagctgggcgtggtggcacatgcctgtaatcccagcaccttgggaggctgagacaggagaatcgcttgaactcaggaggcagaggttgcga

SEQ ID NO: 163555 - DNA, 601 bp, Human
gaccagcctgaccaacatggagaaaccccatctctactaaaaatacaaaattagctgggcgtggtggcacatgcctgtaatcccagcaccttgggaggctgagacaggagaatcgcttgaactcaggaggcagaggttgcgatgagctgagatcgccccattgcactccagcctgggcaacaagaacgaaactccatcacaataaaataaaataaaattaaattaaattaaatacaggggatctggggctaggggaagaaccaggcatttgcagaactgcaaactggtcaggacttgcacrttacactagaaattcagggcccatcatgaaaagagcctaggagaactcataggcattgaaagctggtccccagaatctgggaagttataaaataggggtgaatgggggtgaaggaacttgcattatttgatctacagaggagaaggctaaggtatgctcagaaaatatgtaaacacataaataactgagttatttttataacccggcatttaataactgggttttcatcttagctcagctttaattatggccttctggaatatacaaggctcttacccagactaggaggtatgctttgga

SEQ ID NO: 163556 - DNA, 601 bp, Human
caaaatttagccaggcgtggtggtgcgtacctataatcccagctactcaggaggctgagatgagagaatcccttgaacccaggaggcagaggttgcattgagccaagatcgtgccattgcactccagcctaggcaacagagcaagactccatctcaaaaaaaaaaaaaaaaagaagaagaagaagtttcataactcctgaattcagaatcagaagccataatattactgattacattgaggagaaactggtactgaggcgatttatcccttgaaagaacactctggacatgttacaggcaygcgttccagattgcatttcccatgaactaccatattattttgttttaattttaattattttctcttctaattttttcctctttaaaaattgaaatatattttatatatagtcaaatacacagatgttaaatgtccaattttacgagttttgacaaatgcatgtgcccttgaaacccacattgctgtcagaatagacctcttaattcttgttttattattttaaaatttatattgtgtttttatttttttctgtagaaatgaagtctcgctatgttgcctaggctggtcttgaactcctgg

SEQ ID NO: 163557 - DNA, 601 bp, Human
ttgctataatagagtatgaactgtggcaacaaacacttcatattatctcacaaccaactgaaatattgaaaatacaacctaaactcaaggtaccatagatactgttgtctaataggtgggaaattatctcttttttgattcattcataattttaaaactttggatagatttctgacttctaaatgaaaagagtaactcattattttgttttttattttcttgttctgaattttatacttaaagctgactaacatagttaaaggcagatctgaggtgaacattattgtaactgggcagtccrttttcacacagggcagagtattcttgagggcatttatttgccttttgttttttgcattgacctatattttatatttttaagatgactttggggttatttagaatctcgcttgtatttttgtgttctagatcccagtagatcaatttaagccatctgatgtggaaatccaggcttgcttccggcacgagaacatcgcagagctgtatggcgcagtcctgtggggtgaaactgtccatctctttatggaagcaggcgagggagggtctgttctggagaaactggagagctgtggaccaatga

SEQ ID NO: 163558 - DNA, 601 bp, Human
ttttgagaaacaaatacctttttcattttttataccaatgtaacaataatccattaaacacacctttactaactgttttctaggagtctgatatgatgaggaaataggtaaacctttaatagccagtactaaattagagtggcacaactttcactgggaaaaaagatgggtattttacttttctgttttagaaaagtggcttgacaacagtatgcttatgtcttagagtttgaaattcaagttcttgaacattattaatggctacaatcattcatacccacattggctgtattcttgatgratccaaagtgattttcacctcaactctgaatttcattctcctcttttgaatataatacaaccatctcactagaggaagcatttcagtcttttctgattggagattcattattgttttagataatgttttcatttgacttatgggtatataaaaaattttatcttaaaaatatttcctctcattttagctagcaacattgttttcatgtccacaaaagctgttttggtggattttggcctaagtgttcaaatgaccgaagatgtctattttcctaaggacctccgaggaacagaggtaatt

SEQ ID NO: 163559 - DNA, 601 bp, Human
cacctcagcctcccaaagtgctgggactacaggtttgagcccccgtgtctggcccacagttcagctttaataataattatagaattagagttaactttataataagtttagcacttaaaaagcagtatgttatttaatccttacaacaacccagttgttgctattgttattcttattttacaatcaaggaaataagtttgcagagattaaaataaagtgtccagagtcactcagtgacagaccctggacttgaacccagttctttctaagtctaaccctaaggtctaactgctacataacwttaaaaaattataatattacatacattattaaaatatattagtgatataactaatatcactgagttttggctcaatgacagtcttaactatggtcattaatatttatgaggactctaaaggcctctctttgagcctaggaattctataataaacctcaagtagtgagcataaatgtatcttatttaaagatgtaaaacagcactcatgtttaactcatctgtgaagcaaaaaatgacccagaaaagcctttctttcctgactctaaatgagattctgaaaaatgcgttcgcgggcttcca

SEQ ID NO: 163560 - DNA, 601 bp, Human
agcctttctttcctgactctaaatgagattctgaaaaatgcgttcgcgggcttccaagtaatgtatttaacattcacatcattaggctgactgggtgattcaattagccagtgtccactgggcatctgctatgtggcaggttcttgtgagcaccaacgaggaagcatgacacaaggcagtgaggagcaagccttagtggtactccagcgatcctcactctttggtgggaggacttactttaaattacctgaattattaaaagagcaaccgtttagggatgggcgtggtgttctcacacctrtaatcccaaccgttcgaaaggccaaggaggtgggggtggtttgcttgagcctgggggttcgagaccagcctgagcaatagagtcagacctcatctcttttgaaaaaaaaaaagaaaaaaagaaggaagggagggagggagagagagaaggaaggaaggaaggaaggaaggaaggaaggaaggagaaagaaaaaggaaggaaggaaagaaaaagaaggaaagaaagaaagaaagcatgcacaacagtttagttcacagttgattgtgatgggcacaaggttggatgcaagcaggaaggtaa

SEQ ID NO: 163561 - DNA, 601 bp, Human
actatatgtctgcaccagccatgaatacaaatcactggtcaccagtgtttgctctgttcctttttaaaaaaatgtttaattaaattaggtaactaattaatttgtaaagatggggggtctccatcttgtccagactagtctcaaactcctgggctcaagcaatcttcctgcctcggccttccaaagtgctgagattcagtggctcacgcctgtaatccccacactttgggaggccgaggcaggtggatcacgaggtcaggagttcgagaccagcctggccaacatggtgaaaccccatctytactaaaaatacaaaaattagccaggcgtggtagcacatgcctgtaatcccagctagttgggaggccgaagcaggagaatagcttgaacccgggaggcagaggttgcagtgaaccgagatcgcaccattgcattccagcctgggtgacagagggagaccccatctcgaaaaaaaaaaaaagccaaagtgctgagattatagacatgagccaccatgccccacctctctttgtttctttcttaagtttagaaataaatgctcgttagagaaactatttataaaaccagccctgtttattca

SEQ ID NO: 163562 - DNA, 601 bp, Human
gagggaggattgcttgaggccagcttgggcaatgagcaataccccatctctaaaaatcataaaataaattagccaggcatagtggtgcacacctgtagtcccagctactcgggaggctgagacgagaggattgcgtgaacccaggagtttgaggctgcagtgagctatgatcacgccattgcactccagcctgggcaacacggcaagaccccttttggaaaaagaaaaaaaggagtgcttaagtccttaaggaaaggagcaggatctttggcaagttgaaaggcctgggctccacagcctytttggtgtctgccaccctgaaggtctgtggtctctgcagccagccctctctgagaagctgccgtcatcagaagctgcagggacctggcctgtgcagggttgccccttcctggagctgagcaaggcagcctggccctgacctcagtccccatgagctgacctccctcagggtcggtcttccaagcaacatccaaaaggatatttctggcgtgtttttcctttacagccacttcctgcgtattaatggccttattgatgctgacagtctgaaaaacaagaaggggggagggaaaggaggatg

SEQ ID NO: 163563 - DNA, 601 bp, Human
gccaggtgcagtggctctcccctgtaattccagcactttggggttacagaggagggaggattgcttgaggccagcttgggcaatgagcaataccccatctctaaaaatcataaaataaattagccaggcatagtggtgcacacctgtagtcccagctactcgggaggctgagacgagaggattgcgtgaacccaggagtttgaggctgcagtgagctatgatcacgccattgcactccagcctgggcaacacggcaagaccccttttggaaaaagaaaaaaaggagtgcttaagtccttarggaaaggagcaggatctttggcaagttgaaaggcctgggctccacagcctttttggtgtctgccaccctgaaggtctgtggtctctgcagccagccctctctgagaagctgccgtcatcagaagctgcagggacctggcctgtgcagggttgccccttcctggagctgagcaaggcagcctggccctgacctcagtccccatgagctgacctccctcagggtcggtcttccaagcaacatccaaaaggatatttctggcgtgtttttcctttacagccacttcctgcgtattaatggcct

SEQ ID NO: 163564 - DNA, 601 bp, Human
gctgggcatggtggctcacgcctgtaattgcagcactttgggaggcccagcgggaggactgcttgagcctagctaggagttcaagaccagcctgggccacagtgagaccccatctctataaaaaattagccaggcatgatggcatgtgcctatagtcccagctactcaggaggctgaggtgggaggatcacttgagcctaaaagttggaggctgcagtgagcctccaactgattgtgtcactgcactccagcctgggtgacagtgcatgaccctgcctcaaaaaaaaaaaaaaaaaaaaaagctttgggatatctttaattaggcatttcaaaccctactgtatggagttgatttttcaacatttattcaccatttagaaattatgaatcagagactcatagaatgttagggctggactgttaaatctttgaaatctttttctttttgaaacagagttttgctcttgttgcccaggctggagtacagtggtacgatctcggctcactgcaacctctgcctcccaggttcaagtgattctcctgccacagcctcccaagtagctgggattacaggtacctgccaccacacctggctaatttt

SEQ ID NO: 163565 - DNA, 601 bp, Human
acggcgaaactccatctctactaaaaatacaaaattagctgggcgtggcggtgggcgcctgtaatcccagcttctcaggaggctgaggcaagagaattgcttgaatccgggaggtggaggttgcagtgagccaggatcacgccactgcactccagcctgggtgacagagcaagactccatctcaaaaaaaaaaaaaaaaaaaaaagtgagagtgtgcttctgctcctcatcaaggaccttggtccctgcagggagtcctgcaccttgaccccttggctcctcctccaggcagcatctcccrgcccctttccatttagccagccttttgcttgccttgacagcagcaatctttgtttaaaatgccctttctgtaaacctcaacaccccacttcttccgtaaacccacctggccctgttcaggggcaccttcaatctctccacaccttaaattccccatatatggaatcctggaaccgcttctccccaggcctaattccaaacacacccactccctgcagatagtcgtcagtttgcatgtaataaatgtccatcagggtggagcgcggtggctcacacctccaatcccagcactttgggaggc

SEQ ID NO: 163566 - DNA, 601 bp, Human
ccaggtgcagagactcacgcctataatcccagcactttggggggccaaggtgggtggatcacctgagctcaggagtttaagatcagcctgaccaacacggcgaaactccatctctactaaaaatacaaaattagctgggcgtggcggtgggcgcctgtaatcccagcttctcaggaggctgaggcaagagaattgcttgaatccgggaggtggaggttgcagtgagccaggatcacgccactgcactccagcctgggtgacagagcaagactccatctcaaaaaaaaaaaaaaaaaaaaaagtgagagtgtgcttctgctcctcatcaaggaccttggtccctgcagggagtcctgcaccttgaccccttggctcctcctccaggcagcatctcccggcccctttccatttagccagccttttgcttgccttgacagcagcaatctttgtttaaaatgccctttctgtaaacctcaacaccccacttcttccgtaaacccacctggccctgttcaggggcaccttcaatctctccacaccttaaattccccatatatggaatcctggaaccgcttctccccaggcctaattccaaacacac

SEQ ID NO: 163567 - DNA, 601 bp, Human
ccaggcaagactatggatatcatggtactctttgggggcatccttagtccgtctctggcacccatgggagaaatcctcaacaagctgaaggagatgaatttatttcaccctccagtccttgctctgtggcctctgaggaaggaaaggagaagcaggtggctcctgagtacatctccaaactcacccacatcctgctcatgtcactcaattcatttctgtatctcagagagtccttcaggacctgcaggggcaaaagaacagcctgtgagagaatggagaaggaaagaaagacaaagggaargaggatggagagaggcggaggtgaacctagggcagggggacaggctgatgggagggagactcacccaactctaatggggaacccaaaggccaggagaagggggcagtgtgggagaggacagcagcctctgtggcccaggcagtcactttccccacaaggatccctggctccctgccaccccatagccccaggaactcacgttcgggtgtccatctcggaggagtttgtggaacacatggcagaacttccagcagagcactgcgttgctagacagaggcaggcggttgacaacagaccaga

SEQ ID NO: 163568 - DNA, 601 bp, Human
ctgtgatattgccacctacctcccccctcatcctaaagcactgataatctctaaacaggaaagaaaaagctctggcattaagaattgggtatgctaattctaattctcaatgcactatgactccaacgggaccagtggaaggagaagagaagtaggaactgtgggctgggcacagtggctcatgtgtgtgatcccagcactttgggaggctgaggtgggaggatcacttgaggccaggagttcaagaccagcctgggcagcatagcaagaccccgtctctaccaaaaaaaaaaaaaaaaaagcaggaaacatggccatgtagctactgctgagggatcccaaccttgggcagctttgtgacatgagtttatgagttttcattggcaggagaagctcccaggccctggaactttcctgaagcgtccagagaccccaggcaagactatggatatcatggtactctttgggggcatccttagtccgtctctggcacccatgggagaaatcctcaacaagctgaaggagatgaatttatttcaccctccagtccttgctctgtggcctctgaggaaggaaaggagaagcaggtggctcctgagta

SEQ ID NO: 163569 - DNA, 601 bp, Human
actacatagttgccaacattttataggtgcagacagatacaggtaagactgtgcaaaaaggctaaagtagtagttctcaactggtagaggcaaaagaacatatcagaatcaaccagggagattttttttttttttttgagacagagtctcactctgtcacccaggctggagtgcagtggcccaatcttggctcaccacaaccttcgcctcctaggttcaagcgattctcctgcctcagcctcccgagtagctgggattacaggcacacgccaccacacccagctaatttttgtatttttartagagcccgggtttcaccatgttggccaggttagtctcaaactcctggcctcaggtgatctgcttgcctcggcctcctaaagtgctaggattacaggcgtgagccactgcgcctggccaagagagattcttcaaaatgcagattacccctctccatatacacacccacggacatcagaatctggggtgattgtggtgtgtgtacagaaatgctcttttccattgactgtgatattgccacctacctcccccctcatcctaaagcactgataatctctaaacaggaaagaaaaagctctgg

SEQ ID NO: 163570 - DNA, 601 bp, Human
gtgaactccgcctcccgggttcacgcctttctcctgcctcagcctcctgagtagctgggactacaggcacccaccaccacgcccggctaattttctgtatttttttagtagagacgggggtttcaccgtgttagccaggatggtctcaatctcctgacctcgtgatccgcccgcctcggcctcccaaagtgctgggattacaggcatgagccactgcgcctggccaaaaacgacattcttaaacaagcaaacacagtgtcagccaccagtaggctctcaattatggaagttagaaaggaartaattcaggcagaaagaaagtgatctcagatgaaaggtctatggagagcacagaataaaacaaggaaaataaaacaataacttacagaatttaaagataaacataaccaaaaccaaaatacatggttatgctaacagataaattgagggactgaatggaactaaaatattctaaagtctttgtgttatacaggaaacaaagatacgaaaggtagacctagataaaacaagcaagcattttgtaattattagagaacatgccaaaaacaaaaaaagtagatttattttttaacctcccaaa

SEQ ID NO: 163571 - DNA, 601 bp, Human
atcccagcactttgggaggccgaggagggaggattgcttgagctcaggaatttgagaccagcctggccaacatggcgaaaccccatctctacaaaaaattaaaaaattagctgggcatggtggtgtgcacctgtggtctcagctattcaggaggctgaagtgggaggatcacttgagcccaggaagttgaggctgcagtgagctgtgatcatgtcaccattcctccagccttggtgacagagcaagaaactgtctcaaaacaccaccaccaccaccaacacacacacaaaagactgcctcyttggtataggggaagtaaagataaataataaagtaacaaacgcttgtactcctgcactgaggaagtcctccctaaggactatgaagaattctaccgcctcaaatcaccgctgtgattggggaaggaaaatctgccctaaactcacaaaaccttaagctgagaatttaatttcgagtgatctcaatcgaagcaaatgccaattctctctggaggaacctgccttcattacagacttcaaagaattctccacagataaaattccaaggaagatgagcagcttagggtagaaagtaaccgaac

SEQ ID NO: 163572 - DNA, 601 bp, Human
cgctcaggtggcccttttaggaagaggaggggaaacagagtcaacaacaagaacataacagtcaagagatctgcagccaggaattctctggtaaagaatctatcttctttgttttctcccctttattttatttatttagagatggggtctagctctgttgcccaggctggagtgcagtggcatgatctcggctcactgcagcctccacctcctgggttcaagtgattctcctgcctcagcctcccgagtagctgggattacaggcacgcaccaccacgcctggtcaatttttgtatttttrctagagatatggtttcaccatgttacccaggctggtctcaaactcctggccttgagtgatccacctgctttggcctcccaaaaggctaggattacactacaggtgtgagccaccacgcccagctaatttttgtagcttttagtagagatggggtttcaccatattggccagactagtctcgaacttctgatctcaggtgatctgcccgcctctgcctcccaaagtgctgggattacaggcgtgagccaccgcacccagccatctacctttattcttaaatgtaaaatagaatcaatctat

SEQ ID NO: 163573 - DNA, 601 bp, Human
gatcctccagcctcgacctcccataatgctcagattacaggcatgagccactgtgcccagccaggaattgtttttattaacagtaaaatcaatgcttctgtaacattttcataaggcaatatagtgcctagggttactctttcttttttttgtttttttttttgagacagagtctcattttgtctcccaggctggagtgcagtggcatggttttggctcactgcaacctctgcctcctggtctcaggttcaagcgattctcctgcctcagcctcccgagtagctgggactacaggcatgcrtcaccaccatgggtaatttttgtaattttagtagagacggggttttgccatgttgtccaggccagtcttgaacccctgacctcgggtgatccatccgcctgggcctccgaaagagctaggattataggtgtgagccaccgtgcctggccaggtttctttctagctgcaaaatggggaacaaagggtgcagaagacacgggccaaaatcccagccttcgtcacaccccgtgggcctggcggtggctttcctctctcacagcttgggtacatgatgtgcacacttcctcagaagcctgggct

SEQ ID NO: 163574 - DNA, 601 bp, Human
ccagagcccggtcctccctccaatcacacgctacaagccccctcccctccacactctcagcctctccctcctgcttcttcgccttgcaatccagcccaagggcagcccgactccccgcctcagcctctgacaccctggcctggcccagcctcagttctggtttacgttgcctcctatgtgcccacccctctgcctgatccccgttgtctcccacagttgccagacccctgtacaccccgcagctgctcgcctcccccacctcacactatccattgtgtcaccttcttctctcttttttctrtgaaacagggcctcactctgttgcccaggcgggagggcagtgatgcgatcatagctcactgcatccttgacttcccaggctcaaggtatcctcccacctcagcctcccgagtagctgggactacagttgcacactaccacgcccggctaatttttaaatttttttgtagagacaggatcttgctatggcccaggctggtctcaaactcctggtcttaagcgatcctccagcctcgacctcccataatgctcagattacaggcatgagccactgtgcccagccaggaattgtttttattaa

SEQ ID NO: 163575 - DNA, 601 bp, Human
gtgcagtggcgccatctcggctcactgcaacctccgcctcctgggttcaagccattctcaagcctcagcctcctgagtagctgggattacaggtgcgtgtcaccacgcccagctaatttttgtgtttttagtagagatgggggtttcactatgttggtcaggctggtctccaactcctggcctcaagtgatcctcctgccttggccttccattgtgtggagattagaggtgtgagccaccacatccagctcaatttaacactttcaatctctactcccaaaacgtctttttttttttttttgagattgagtcttgctctgtcgcccagtctggagtgcagaggcagcatctcggctcgctgcaacctccgcctcccaggttcaagcgattctcctgcctcagcctcccgagtagctgggactacagacgtgagctaatttctttttgtatttttagtagagacggagttttgccatgttggccaggctggtcttgaactccagacctcagacgatccgcccgccttggcctcctgaaatgctgggatgacaggcgtgagccactgcgcccaaccccaaaacatcttaaatccagttctcac

SEQ ID NO: 163576 - DNA, 601 bp, Human
catcctcttcgaccccagttctccaagcccacgtgaccattcccttctgcccttccatgctattaaaagctaggggactggctattggcaccagctgcttctgatgccactgaactctgctgtcttcctatatacaaggcaaagggacccctttggcctctatcagccccgcagccccactgccccagctcccatcccagtcctcttcctccttaaccttcttcccagtcttgctttctctacaccctcctttctttccttttccacctaaaatcctaccctaggcccttcctcctcccaytttccatttaacacttttttttttttttttgagacagagtcttgctctgtcacccaggctggagtgcagtggcgccatctcggctcactgcaacctccgcctcctgggttcaagccattctcaagcctcagcctcctgagtagctgggattacaggtgcgtgtcaccacgcccagctaatttttgtgtttttagtagagatgggggtttcactatgttggtcaggctggtctccaactcctggcctcaagtgatcctcctgccttggccttccattgtgtggagattagaggtgtgagcc

SEQ ID NO: 163577 - DNA, 601 bp, Human
cgggatatttttgttgttgttttcgagacggagtctcactctgttgcccaggctggagtgcaatggcatgatctcagctcactgcaacctcagccccttgggttcaagcgattctcctgcctcagcctcctgagtagctgggattaacaggcacgcaccaccatgcccggctaatttttttgtatttttagtggagatggggtttcaccatgttgcccaggctggtcttgaactcctgacctcaggtgatccacccgcctcggcctcccagagtgctgggattacaagcgtgagccaccgygcctggccaaaaaaaattttttttaagagacagggtctcactgtgttgcccaggctggtctcacctcaagccttggcctccccaaatgctgggattgcaggtgtgagccactctgcccagcctccttccccactcttgtatcgctaattgctaaaaactggaaaagtcctttgctcctccacacttggacaataccagcttcccctttttctctgctttctaaaaccaggaaaaacaagacagcagtgagctcgagagcctctggaagcaaagccagctgcatcctcttcgaccccagtt

SEQ ID NO: 163578 - DNA, 601 bp, Human
aggcgcttcatcctgattacgttgcttacatggcagaggagggggaaaccagctctctcttgtttctctctctttttttattttttagagacatggcctcactgttgcccacgctggagtgcagtggcatgatcatcactcactgcagcctcgaattcctgggctcaagtgatcctccacctcagcctcctcagtagctggtactacaggcatacaccaccatgcgggctaatttgtgtgtgtgtgtgtgtgtgtgtgtgtgtgtgtgtgtgtgtgtgtgtgtgtttagtagagatggggyttcgccacattggccaggctggtcttgaactcctgacctcaggtgatccgcccgccttggcctcccgaagtgctgggattacaggtgtgagccaccacgcccagccagagaatgaatttttctttaatgtgtgcgggatatttttgttgttgttttcgagacggagtctcactctgttgcccaggctggagtgcaatggcatgatctcagctcactgcaacctcagccccttgggttcaagcgattctcctgcctcagcctcctgagtagctgggattaacaggcacgcaccaccatgcc

SEQ ID NO: 163579 - DNA, 601 bp, Human
acagattcggtgcctggtgaggcgcttcatcctgattacgttgcttacatggcagaggagggggaaaccagctctctcttgtttctctctctttttttattttttagagacatggcctcactgttgcccacgctggagtgcagtggcatgatcatcactcactgcagcctcgaattcctgggctcaagtgatcctccacctcagcctcctcagtagctggtactacaggcatacaccaccatgcgggctaatttgtgtgtgtgtgtgtgtgtgtgtgtgtgtgtgtgtgtgtgtgtgtgtgtgtttagtagagatggggtttcgccacattggccaggctggtcttgaactcctgacctcaggtgatccgcccgccttggcctcccgaagtgctgggattacaggtgtgagccaccacgcccagccagagaatgaatttttctttaatgtgtgcgggatatttttgttgttgttttcgagacggagtctcactctgttgcccaggctggagtgcaatggcatgatctcagctcactgcaacctcagccccttgggttcaagcgattctcctgcctcagcctcctgagtagctgggattaac

SEQ ID NO: 163580 - DNA, 601 bp, Human
tgacagattcggtgcctggtgaggcgcttcatcctgattacgttgcttacatggcagaggagggggaaaccagctctctcttgtttctctctctttttttattttttagagacatggcctcactgttgcccacgctggagtgcagtggcatgatcatcactcactgcagcctcgaattcctgggctcaagtgatcctccacctcagcctcctcagtagctggtactacaggcatacaccaccatgcgggctaatttgtgtgtgtgtgtgtgtgtgtgtgtgtgtgtgtgtgtgtgtgtgtgtgtgtttagtagagatggggtttcgccacattggccaggctggtcttgaactcctgacctcaggtgatccgcccgccttggcctcccgaagtgctgggattacaggtgtgagccaccacgcccagccagagaatgaatttttctttaatgtgtgcgggatatttttgttgttgttttcgagacggagtctcactctgttgcccaggctggagtgcaatggcatgatctcagctcactgcaacctcagccccttgggttcaagcgattctcctgcctcagcctcctgagtagctgggatta

SEQ ID NO: 163581 - DNA, 601 bp, Human
tgcattcacgctctctgtcctgaacgtccgtctcagtcagctcgggcagttataacaagataccatgcactgggtggcttaacccatagagagtgtctttcagttctcgaggccagggagttcaaagtcaaggtgttgacagattcggtgcctggtgaggcgcttcatcctgattacgttgcttacatggcagaggagggggaaaccagctctctcttgtttctctctctttttttattttttagagacatggcctcactgttgcccacgctggagtgcagtggcatgatcatcactcackgcagcctcgaattcctgggctcaagtgatcctccacctcagcctcctcagtagctggtactacaggcatacaccaccatgcgggctaatttgtgtgtgtgtgtgtgtgtgtgtgtgtgtgtgtgtgtgtgtgtgtgtgtgtttagtagagatggggtttcgccacattggccaggctggtcttgaactcctgacctcaggtgatccgcccgccttggcctcccgaagtgctgggattacaggtgtgagccaccacgcccagccagagaatgaatttttctttaatgtgtgcgggatattt

SEQ ID NO: 163582 - DNA, 601 bp, Human
gaagacctgctgagagcctgggtccttgtcatcggctctgcacctagggccggctgccgactgtccctggagaaagactcacagctggtgtcactatgcattcacgctctctgtcctgaacgtccgtctcagtcagctcgggcagttataacaagataccatgcactgggtggcttaacccatagagagtgtctttcagttctcgaggccagggagttcaaagtcaaggtgttgacagattcggtgcctggtgaggcgcttcatcctgattacgttgcttacatggcagaggagggggaarccagctctctcttgtttctctctctttttttattttttagagacatggcctcactgttgcccacgctggagtgcagtggcatgatcatcactcactgcagcctcgaattcctgggctcaagtgatcctccacctcagcctcctcagtagctggtactacaggcatacaccaccatgcgggctaatttgtgtgtgtgtgtgtgtgtgtgtgtgtgtgtgtgtgtgtgtgtgtgtgtgtttagtagagatggggtttcgccacattggccaggctggtcttgaactcctgacctcaggtgat

SEQ ID NO: 163583 - DNA, 601 bp, Human
tcagtcttgacatcatgactggtggcctggctccacttccccacaccctgcctgcctttctaccacactgcttggaagacctgctgagagcctgggtccttgtcatcggctctgcacctagggccggctgccgactgtccctggagaaagactcacagctggtgtcactatgcattcacgctctctgtcctgaacgtccgtctcagtcagctcgggcagttataacaagataccatgcactgggtggcttaacccatagagagtgtctttcagttctcgaggccagggagttcaaagtcarggtgttgacagattcggtgcctggtgaggcgcttcatcctgattacgttgcttacatggcagaggagggggaaaccagctctctcttgtttctctctctttttttattttttagagacatggcctcactgttgcccacgctggagtgcagtggcatgatcatcactcactgcagcctcgaattcctgggctcaagtgatcctccacctcagcctcctcagtagctggtactacaggcatacaccaccatgcgggctaatttgtgtgtgtgtgtgtgtgtgtgtgtgtgtgtgtgtgtgtg

SEQ ID NO: 163584 - DNA, 601 bp, Human
gcaccaccaataaataagtagccccaaggccaagtcacccaggggctttggtccccatcccagccacggcctccccccatcaggccctccatgacccttatgagaagtgtcagcattcacaaaagctttctccctccctgggctcagggcaggagccacttacaagttgttcacgtcactttctccagcctcgtccagctggcggtcactcatctgcaggttgcctgggaacctgggattctggaagggaggcagaggaagggagtcagggcagaagacatgaagagccctctctcagccrggcgtggtggcacacgcctgtggtcccagctacttgggaggccgaggtgggaggattgcttgagcccgggagttcaagtttacagttcaaggccactgcactccagcttggttacagagtgagaccctacctcaaaacaaacaaaaaagaaaaaaagaaaaatcgctggtatcatcaatcattgctgagtatctacagccagcatgatcctgtcatctgtgtggtttgtccctgtggcaaagggaaaaggccacagagatgggtggccattccatcgtggggcatctacatgtacaagtg

SEQ ID NO: 163585 - DNA, 601 bp, Human
agtgacagtgacagagggagaggataggtaccagtgttggagtcagagggcagaaagcgagacagacaggaaagctttggggtgtgaaatagccaggcaggggttctggatgaggcaccaccaataaataagtagccccaaggccaagtcacccaggggctttggtccccatcccagccacggcctccccccatcaggccctccatgacccttatgagaagtgtcagcattcacaaaagctttctccctccctgggctcagggcaggagccacttacaagttgttcacgtcactttctccrgcctcgtccagctggcggtcactcatctgcaggttgcctgggaacctgggattctggaagggaggcagaggaagggagtcagggcagaagacatgaagagccctctctcagccgggcgtggtggcacacgcctgtggtcccagctacttgggaggccgaggtgggaggattgcttgagcccgggagttcaagtttacagttcaaggccactgcactccagcttggttacagagtgagaccctacctcaaaacaaacaaaaaagaaaaaaagaaaaatcgctggtatcatcaatcattgct

SEQ ID NO: 163586 - DNA, 601 bp, Human
ccttgtgctgcacactttgcagggagaggaggactaggaattaggtagttcccatgagagcctgggttagacgggagggaagagactcacctgtttggaagaggttgagttcacactccaggtagtcaaacatctccactgttaactggaaactggacccaagaggaaagagagcttacactccacagcctgaggccggtctgttacctgtcccctcccccacgctctacgctactccagtctccaatgctcatgtgcatgcgcaaacacacacacaactccagctccaagtcttagcctygtgggtattatggccatgcagcctggtgaagtcaacagtgacagcgacaggtcgggggcggtggctcacgcctgtaatcccagcactttgggaggccgaggtgggcggatcacctgaggtcaggagttcaagaccagcctggccaacgcggcgaaaccccatctctactaaaaatataaaaattagctgggtgtgatggcgcatgcctgtaatcccagctactcgggaggctgaggcaggagaatcacttgaacctgggaggtggaggctgcagtaagccgagatcaagtcactgcactc

SEQ ID NO: 163587 - DNA, 601 bp, Human
agaccttgtctcttaaaaagaaaaatactgaagaggttcagtccctccctgcacgagggttggagagaccagagatggggtgtgaatgtctccattttcctaccccttgtgctgcacactttgcagggagaggaggactaggaattaggtagttcccatgagagcctgggttagacgggagggaagagactcacctgtttggaagaggttgagttcacactccaggtagtcaaacatctccactgttaactggaaactggacccaagaggaaagagagcttacactccacagcctgaggcyggtctgttacctgtcccctcccccacgctctacgctactccagtctccaatgctcatgtgcatgcgcaaacacacacacaactccagctccaagtcttagcctcgtgggtattatggccatgcagcctggtgaagtcaacagtgacagcgacaggtcgggggcggtggctcacgcctgtaatcccagcactttgggaggccgaggtgggcggatcacctgaggtcaggagttcaagaccagcctggccaacgcggcgaaaccccatctctactaaaaatataaaaattagctgggtgtga

SEQ ID NO: 163588 - DNA, 601 bp, Human
ctgcacctggtagcctgctgtttttcaaaaagcaagcattcttttatggttgagggcctgctattcaccaggcactggactagaacagagggaatttagagatgagtaggtcagcatctcgtggtaacaatattaatgaacaatgcatataaaaccagagcaggctgggcacggtggctcatgcctataatccaagcaccttgggaggccaaggcaggcagatcacttgaggccaggagttcgagactagcctggccaacatggtgaaaccctgtctctactaaaagtacaaaaattagcygggcgtggtggcacacacctgtaatcccagctactcaggaggctgagacaggagaattgcttgagcctgggaggcggaggttgcagcgagctgagatggtgccactgcactccagtctgggcaacagagcgagactctctcaaaacaaaacaaacaaacacacaaaaaaccagagctaggggtcatgagatgtggcacaaaaaagatggctgagctcaccacctctaccccttactcattctctcagctaaccaagtccttttggacctcatcaccatctccgcttactcatggtccacg

SEQ ID NO: 163589 - DNA, 601 bp, Human
agctacccgactataactcctggattcaagcaatcttcccaccttggcttcctaaagtgctgggtttataggcatgagccactgcacctggtagcctgctgtttttcaaaaagcaagcattcttttatggttgagggcctgctattcaccaggcactggactagaacagagggaatttagagatgagtaggtcagcatctcgtggtaacaatattaatgaacaatgcatataaaaccagagcaggctgggcacggtggctcatgcctataatccaagcaccttgggaggccaaggcaggcmgatcacttgaggccaggagttcgagactagcctggccaacatggtgaaaccctgtctctactaaaagtacaaaaattagccgggcgtggtggcacacacctgtaatcccagctactcaggaggctgagacaggagaattgcttgagcctgggaggcggaggttgcagcgagctgagatggtgccactgcactccagtctgggcaacagagcgagactctctcaaaacaaaacaaacaaacacacaaaaaaccagagctaggggtcatgagatgtggcacaaaaaagatggctgagctcac

SEQ ID NO: 163590 - DNA, 601 bp, Human
gcctggccaacatggggaaaccccatctctactaaaaatacaaaaattggccaggtgtggtagcgggcacctgtagtcccagctactcaggaggctgaggcacaagaattgcttggaggctgcagtgagccaagatcccaccactgcactccagcctgaacgacagagcaaggctccgtttcagagaaaacaaaaacaaaaaaaacgccccaggtagattctaatctgcatccagggttgaaaactgtatgtccaagctcagtggttgtcaagttttagcacacatcagaatcacccacartagtgctatccaatagaattctacaatgatgaaaatgttcatataaactttttaatatattagccatatgtggctttctgaaatatgcctgaaataggactagtgcagctgaggacctgacttttaaatgttatttaattgtaatcaagttcaatgatcacatggggctagtgagtgccctattggacagtgcacactgcgggtgcttcttaaagcacaggaggctggggttggtggctcatgcctataatcccaacactttgggaggctgaggtggaaggatcacttgagctcaggagt

SEQ ID NO: 163591 - DNA, 601 bp, Human
tgggagaaggaagatatgtcagggttcagggctgaaacttggggcacctgtcaacaaaaatagaagtcttgcctccaccctcttgagtttcagagacaaagttgctccctcaatttctcacgctggggctccctccacactaacctcctgccccccatcctagaccaagcaactggccgtctggctgcagacactcagctcacaccactggccaggctgattttctttcttgcactggccacccactgcctctgcagactctgcacgcggcgggcaatgaaatgactctccccgcggtccytctgtgagtggaactggcccagagggaagcctagcactgcctgtattccgcttcccgactgcactaatccctggtaactgggttagtctggcagctgaaaaaaaaaaaaatcccgaactgttctaattaaaaggcagcttttcttcttgacacaaattaaaagcagctgtcactgcaaggcagccatccccaagtctaccggcttcctcaggctccaactggcaggaaccacgggctgttccatttccctgcctggccccgattcctgataccttccaggaatgccctttggcatccaga

SEQ ID NO: 163592 - DNA, 601 bp, Human
gcctgagcaacatggcaaaaccttatctctactgaaaatacaaaaattagccaggcgtgatggctcacgcctgtaatcccagctacttgggaagctgaggcaggagaatcgcttgaacccaggaggtggaggctgcagtgagccaagatcccaccactgcactccagcctgggcgacagagtgagactctgtttcataaataaataaaacaaaacaagccaggcacagtggctcatgcctgtaatcccagcactttgggaggccgaggcgggtggatcgcctgaggtcagtagttcgagaycagcctggccaacatggcaaaaccctgtctctactaaaatacaaaaattagctgggtgtggtggcgtgtgcctgtaaacccagctacttgggaggctgaggcaggagaatcgcttgagcctggaaggtggaggttgcagtgagctgagacggtgccactgcactccagcctgggtgacagagtgagactccatctcaaaagaaaccaaaccaaaacaaaacaatacaaaacaagaaaaataagaaaaaggacttgggagaaggaagatatgtcagggttcagggctgaaacttggggcac

SEQ ID NO: 163593 - DNA, 601 bp, Human
ggcagggtgtggtggctcacgcctgtaatcccagcactttaggaggctgaggcgggtggatcgcctgaggtcaggagttcgagaccagcctctccaacatgggaaaaccctgtctctactaaaaatacaaaaattagctgggcatggtggcacatgcctgtaatcccagctactcgggaggctgaggcaggagaatcacttgaacccaggaggcagaggttgcagtgagccgagattgcaccactgcactccagcctgggtgacaagagtaagacaccatctcaaaaaaaaaaaaaaaaaagtggttttgttgagaggtggtgagttaacagacttgttggagagcccaagagctgatggggccaatgatggttagaccaggagcctttgctcctgagagtcagaatattcagtgcatcatgactgggtgaactaagcgctactctgtgcagagacccctgatagctcagggaagaagagatttgctcataacctgggagagctcctaccatggcggacatggaggaggagcctcatcttcatttttttcctctttacgagactgggtctcagccaggtgcagtggctcacgcctgtaatc

SEQ ID NO: 163594 - DNA, 601 bp, Human
gtcatacctgtaatcctagcactttaggaggctgaggtgggcggatcacttgaggccaggagttcgagaccagcctggccaacatggggaaaccccatctctactaaaaattcaaacaacaacaacaaaaaattagctgggtgtgccagcacagacctgtggtcccagctacttgggaggctaaggcacaagaattgcttgaacctggtaggcagaggttgcagtgagccgagatcatgccattgcactctagcctgggtgagagagtgagactctgtctcagaaaaaaaaaaaaaaaaaagtgtaagaacttctgtaagaccagaacttccaaactatatatattctgctaagggcaccccagggaactgaagctaggtaagggataggtctccatttaatgagcagctgtgttttataatttatatttctccataaaattccatttgcacaaagggattgtgtagataaatggtctggaaatcattatgttagctcatgtaggtctaggccaggtctgctgatatttgtgctgttcgtaggatgcacgacatacttgttgaatggtgacgtgctcaagctagaggcagacagagaggac

SEQ ID NO: 163595 - DNA, 601 bp, Human
agaattgcttgaacctgggagatggaggttgcagtgggatgagattgtgccactgcactccagcctgggcaacagagcgagaccctgtttcagaaaaataaataaataaataaagtaaattaaaaaactatgtattgtaaagagtatccctcctaccccttcctcagcccagaggcagtgtgggtcttgggtattgccctgccttcaaagaaggcctttaaacccaaacacttaattacctgtctcttctcataactccctcagcctccagagtaactgggactgcaggtgtgcaccaccrtgcccagcttaactccccattttacaaaaaggcagtggtgatgttctactgagcaacagaatacttggaaacaatgaaaagtttccaggggaaacaatgaaaagttcatctgtattcagcactctaagcagctggtcccttctcttgggggcccactccaccctctcagctcccttcaggcaggcctacttgccgcaaagcccttctaatccctgggcagctaattccaatctcccttccacaaaaccatcctaggttagcatctaggcgatgctacacccttcccttgtactgtctaaa

SEQ ID NO: 163596 - DNA, 601 bp, Human
ctccattcctgttacttgaaccacttactttgtaaactgctccatgaagcggtcccggtggccttgcagggtgtcagctgggaggcctggaagaaattggaaagagtgtgagaggggagggggaccagagggcagggaagccacagcggggctctcgagggggaggggccagctaccctggggcatgtggccagcactgccaggggccacgactggcctagagctgtcccgaggtctggtaaccaagggagcccagcaggaaccagcaggagtgtggagacgcttatcctccaaatccttycacttcaattagttcctgaaggacaagccatgccgggcacaatagggtggaaattgtgtcctggactagagaagaaatggtgacctgacccagtagcaggctggaccatggcaggcccaggagggagcagttctttctcagctattgcctgcatttgttttaggttgaggctcagggctgatattagtctggaagagatccgcagaacctgcccaagaggatggctgtcagaaggcaaagaacaagggattgaaggccaggtgcagtggctcacgcatgtaatcccagcactttgggagg

SEQ ID NO: 163597 - DNA, 601 bp, Human
catggtgaaatcctgtctctactaaaaatacaaaaattagtcgggcatggtggtgggcgcctgtaatcctagctactgaagaggctgaggcaggagaatcactggagatggggaggctgaggttgcagtaagccaagatcacaccaccgcactcaagcctgggtgacagagcgagactctgtctcaaaaacaaaaacaaaaacaaacaaacaaaaacagaatggagagagaaaggtttttttttgttttttttttttgagaaaacctaaagtacagtttgagatttaagtatgctatacaratgtcaaattggggacaagaggctggcattcagaagtaaggtctggctagagatgcatatttaggggttatcagtctataaatgctataagaccagaacttagggagacagaaaagagaagaggatgaagtctggggcataagcaggcaactaatgaatggatgaaatctctttcttctatatgcttctatgggatttattagataaccaatagttaccctagctataggtagatttgcctctgtctgagctattttctgtcactttatcaccttagaatgaagataacctcaggtcggg

SEQ ID NO: 163598 - DNA, 601 bp, Human
agcaatggtaaactgtcactgcacactggtaggtgtgtcttatgcagaggtgcttccgccctttccctgttttacttgtccttaatttggtccgatgcccaagccctgcctccagagtccagtctcccatcccacctcagaagcaggtcatatttgtagggtatcaaccaaacctgctagtggattggacatgggggatgaggaaaatggtgacttccagatctctggcctaaatggatgatggcagtatttgttgagatagaaaagaatggggaggggctgggcacagtgactcgcgcckgtaatcccatcactttgggaggcagatcacttgaggtcaggagttccagaccagcccggccaacatggtgaaatcctgtctctactaaaaatacaaaaattagtcgggcatggtggtgggcgcctgtaatcctagctactgaagaggctgaggcaggagaatcactggagatggggaggctgaggttgcagtaagccaagatcacaccaccgcactcaagcctgggtgacagagcgagactctgtctcaaaaacaaaaacaaaaacaaacaaacaaaaacagaatggagagagaaaggtt

SEQ ID NO: 163599 - DNA, 601 bp, Human
atggaacaggggtaccaggaggtgggtacaaccacacacttgtccttcgcttgctcctggggaaccaggcagagaagctgaaacttggcatttgggagttatggtcaagggtgaggaaattaacaggaaaaacaagagagtgcacttttacacagctaagtcaggaggcccttctcagccccctctgtcctcccaactctcactctattatccttcccttttgcctggtttcgcctcccctcccctcctttcctttttttttttttggatggagtcttgctctgttgcccaagctgtagtrcagtggcatgatctcagctcattgcaacctctgccacctgagttcaagcaattctcctgcctcagcctcctgagtagctgggattacagggctaatttttgtatttacagtagagacagggtttcatcatgttagccaggctgctctcaaactcctgacctcaagcgatccacttgcttcggcctcccaaagtgctgggattacaggtgtgagccactgcacccagcctaagtaaagatcttttgtttttgtttttgttttgagatggaatctcattctgacgcccaggcctgagtgcag

SEQ ID NO: 163600 - DNA, 601 bp, Human
gccatttatcacagaatatgtactcggcttctcaaatggaacaggggtaccaggaggtgggtacaaccacacacttgtccttcgcttgctcctggggaaccaggcagagaagctgaaacttggcatttgggagttatggtcaagggtgaggaaattaacaggaaaaacaagagagtgcacttttacacagctaagtcaggaggcccttctcagccccctctgtcctcccaactctcactctattatccttcccttttgcctggtttcgcctcccctcccctcctttcctttttttttttttggatggagtcttgctctgttgcccaagctgtagtgcagtggcatgatctcagctcattgcaacctctgccacctgagttcaagcaattctcctgcctcagcctcctgagtagctgggattacagggctaatttttgtatttacagtagagacagggtttcatcatgttagccaggctgctctcaaactcctgacctcaagcgatccacttgcttcggcctcccaaagtgctgggattacaggtgtgagccactgcacccagcctaagtaaagatcttttgtttttgtttttgttttgaga

SEQ ID NO: 163601 - DNA, 601 bp, Human
cagagctcattgcagccttgaattcctgggctcaagcagtcttctgcctcagcctcctgagtagctagaattacagggatgcaccaccatgcctggctaatttttaattttttggtagaaacaggctcttgctgtgttgcccaggctggtctcaaactcctggcttcaagcaatcctactgccttggcctcccaaagtgctgggattacaggcatgagccaccacatctggcaaaatcaacatctttttctcattctcaaatctctattttgaatctaaacactgaagaccaagaaacctragagaatccagacttatatattcttcatttttattttgtttgtttattttttgagatggagtgtcgctcttattgcccaggctggagtgcaatggcgcgatctcggctcactgcaagctccaccttccaggttcaagggattctcctgcctcagcctgctgagttgctgggattacaagcatgtgccatcatgcctgggtaattttgtatctttagtagagatggggtttctccatgttggtcaggctggtttcgaactcccgacctcaggtgatccgcccgtctcggcctcccaaaatg

SEQ ID NO: 163602 - DNA, 601 bp, Human
ttggttagtgttttgaggcagaccatggcttaacttagctcctgaaccatctgcttgaacccagcttggactcacttctcatccttgttcacaccattttgactgttgaaattgaagggatcactgctgaatgaactgccaaagatgtcatcaaacttgttgtcaaataaattctgtggttgaccaaaaaggagtgagaataagtcagagagccagagaattctgtgtgtgggtcagttgagtgatatgggagaatgccccctttctcgaattaaacggttcagacctgtttaattttttwaatttttttgagacaggttctcgctctactgcccaggctagagtacagtggtgcaatcatagctcactgcagcctccaactcctggctcaagtgatcctcctgtttcagcctcctgagtagctggaagtataggtgtgtgccaccatacctggataatttttttattttaattttatgtatttatatttttagggcctggttcttgttctcttgcctaggctggagtgcagtggcatgataacagctcactgtagccttggcctcccaggctcaagtgatcctcccatctcagcttccca

SEQ ID NO: 163603 - DNA, 601 bp, Human
aaatgctgtcctcatggcatgtaaaatggaaatgcattatgacagagaacacgggaagacctggttcttttggatttagcatttctaccagtttttatttggttttagagacacaggtctcgctatgttgcccaggctggattcaaaactcctgggcttgagtgatcctcctacctcagcctcctgagtagctgggatcacaggtgcacaccaccacgcctggcttgtttctactaattaacctaccctaaggatgtggtccaaaaactgtctaggtgatgcaatttttttttttttttttgagacagagtcttgttctatcgcccaggctggagtgcagtgacacgatctcagttcactgcaacctctgcctcccaagttcaagcaattctcatgcctcagcttcccgagtagctgggattacaggtgcctgccaacacacccggctaattattgcatttttattgaagacgggggtttcaccctgttgcccaggctggtctcgaactcccgacctcaggtaatcctcctgccttggcctcccaaagtgctaggattacaggtgtgagccactgtgcctggctagtgtgatgcaaattta

SEQ ID NO: 163604 - DNA, 601 bp, Human
cttccagctcgctgacgtggcccttcagctgcagcacaacccgctggctctgtggggggactccggtcatgaggccaaccgcccactgccacgggtcacgggcatgggccggagaagcgggtcctaccatgcttccaagtaaatacctgattcccctaagtcaactctccacgtcccaggagggttggaccatctggtcattaggagcccctcaatcaacaacaataacaggggatgatggccggggaattgtggtcctctttagagtggctgggggtagcagtggctgtccctgtgggtraagtcacctgaccagccactgtgaggggcggttgttaatatagcaccaacattgctcacagctgtctcttctcttttttttttggcggttgggggaggggagggacagggtatcactatcacctagactggagtgcagtgaggtgattatggctcactgcagcctcaacctcctaggctcaagagatcctctagcttcagcctcccaagtagctggcattacaggtatgcaccaccatgcccagctaatttttaaaaagttttttgtagagatggggtcttgctatgttgcccaagctag

SEQ ID NO: 163605 - DNA, 601 bp, Human
attacaggcatgtgccactgtgccctcagcttttatgtcaatttctttgttaggacctcaatcctctctccttctcccttagtatccactgcccagggcaagcacttcagtgctgtcttctgtatttcccatctctgtgctcagcggtgcctcgcacacagctttgtgcctgcaggactcaaacccgccctctggactgaggctaagagctggcattcctagctgtttctagaaagacagtctgggtctcccccacccagcctctgtgccgcatcctgagtccagctgggctctgctgccygcgcctgcccccggggcccgcccccgcccccacccaccgctcactttctatctcagacaggctccgctgagccttctcggtgtcctcccgctgcctcctgagctcgtccagttctgcccgcaggaattcacagtcgtcggccgcctgctgccgcaggtgctgctgctcggccagatctgcttccagctcgctgacgtggcccttcagctgcagcacaacccgctggctctgtggggggactccggtcatgaggccaaccgcccactgccacgggtcacgggcatgggccggagaagcggg

SEQ ID NO: 163606 - DNA, 601 bp, Human
gtcaggagttcaagaccagcctgaccaacatggtgaaaccccatctctactataaatacaaaaatcagctggacatggtggtgtgtgcctgtaatcccagctactcgggaggctgaggcaggacaatcccttaaacctgggaggtagaggttgcagtgagcccagatcacaccactgcattccagcctgggcgacagagtgagactccacctcaaaaaaataaaacaaataaataatcaagccagggattcatgcctcttcagcacttacatacatggcatttattctatgggggctttcrgctttttaacaaatttatttgaaattttttagagacaaggctctctgttgcagaggccggagtgcagtggtgcaatcagctcactgcagccttgaattcctgggctcaagcgatcctcctgtctcagcctcaagagtagctgggactacaggcacgtgccaccatgcccggctagtcttttttattttttctagagatggggtcttgctatgttgcccgggttggtcttgaactcctggcctcaagcagtccttccatcctggcctcccagagtgctaggattacaggcatgtgccactg

SEQ ID NO: 163607 - DNA, 601 bp, Human
gccaagcgaggtggctcatgcctataatcccagcactttgggaggccaaggtgggtggatcacctgaggtcaggagttcaagaccagcctgaccaacatggtgaaaccccatctctactataaatacaaaaatcagctggacatggtggtgtgtgcctgtaatcccagctactcgggaggctgaggcaggacaatcccttaaacctgggaggtagaggttgcagtgagcccagatcacaccactgcattccagcctgggcgacagagtgagactccacctcaaaaaaataaaacaaataartaatcaagccagggattcatgcctcttcagcacttacatacatggcatttattctatgggggctttcagctttttaacaaatttatttgaaattttttagagacaaggctctctgttgcagaggccggagtgcagtggtgcaatcagctcactgcagccttgaattcctgggctcaagcgatcctcctgtctcagcctcaagagtagctgggactacaggcacgtgccaccatgcccggctagtcttttttattttttctagagatggggtcttgctatgttgcccgggttggtcttgaa

SEQ ID NO: 163608 - DNA, 601 bp, Human
gagacggagtctcgctgttgttgcccaggctggagtgcagtggtgcagtctcagctcactgcaacctccacctccaaggttcaagagattcttgtgcctcagcctcccaagcagctgggactacgggcacacgccatcacacctggctaacttttgtatttttagtagagatggggtttcaccatattggccaggctggtctcgaactcctgacttggtgatccacacccccctcagcctcccaaagtcctgggattactgccgtctcaaaaaacaaacaaacaaaacaaacaaaaaaaamaaaacgctcatccctctctctctgccacccatgtgttttcctttcctcaaactctccaccagcctcatccttggaaagcctttgttgattaaccccaggcaacttgggtccttccattacttcgtgtatgcactggtgacggtgttttgctgttctgtgtggccaccatggtgtgctccctgctgtgtgatgccaaccgacccacagaactgcccatggagcagaaggccacaaagcccccgccaccaactcaacagccccctccctcatttcccgagtgctcctcgtcccactcacctt

SEQ ID NO: 163609 - DNA, 601 bp, Human
tttttgagacggagtctcgctgttgttgcccaggctggagtgcagtggtgcagtctcagctcactgcaacctccacctccaaggttcaagagattcttgtgcctcagcctcccaagcagctgggactacgggcacacgccatcacacctggctaacttttgtatttttagtagagatggggtttcaccatattggccaggctggtctcgaactcctgacttggtgatccacacccccctcagcctcccaaagtcctgggattactgccgtctcaaaaaacaaacaaacaaaacaaacaaamaaaaaaaaacgctcatccctctctctctgccacccatgtgttttcctttcctcaaactctccaccagcctcatccttggaaagcctttgttgattaaccccaggcaacttgggtccttccattacttcgtgtatgcactggtgacggtgttttgctgttctgtgtggccaccatggtgtgctccctgctgtgtgatgccaaccgacccacagaactgcccatggagcagaaggccacaaagcccccgccaccaactcaacagccccctccctcatttcccgagtgctcctcgtcccactc

SEQ ID NO: 163610 - DNA, 601 bp, Human
tttatttatttttgagacggagtctcgctgttgttgcccaggctggagtgcagtggtgcagtctcagctcactgcaacctccacctccaaggttcaagagattcttgtgcctcagcctcccaagcagctgggactacgggcacacgccatcacacctggctaacttttgtatttttagtagagatggggtttcaccatattggccaggctggtctcgaactcctgacttggtgatccacacccccctcagcctcccaaagtcctgggattactgccgtctcaaaaaacaaacaaacaaaamaaacaaaaaaaaaaaaacgctcatccctctctctctgccacccatgtgttttcctttcctcaaactctccaccagcctcatccttggaaagcctttgttgattaaccccaggcaacttgggtccttccattacttcgtgtatgcactggtgacggtgttttgctgttctgtgtggccaccatggtgtgctccctgctgtgtgatgccaaccgacccacagaactgcccatggagcagaaggccacaaagcccccgccaccaactcaacagccccctccctcatttcccgagtgctcctcg

SEQ ID NO: 163611 - DNA, 601 bp, Human
agtgtactgaaaatgtggaatgtcaaggaaggattttttattatttatttatttatttatttatttatttatttttgagacggagtctcgctgttgttgcccaggctggagtgcagtggtgcagtctcagctcactgcaacctccacctccaaggttcaagagattcttgtgcctcagcctcccaagcagctgggactacgggcacacgccatcacacctggctaacttttgtatttttagtagagatggggtttcaccatattggccaggctggtctcgaactcctgacttggtgatccrcacccccctcagcctcccaaagtcctgggattactgccgtctcaaaaaacaaacaaacaaaacaaacaaaaaaaaaaaaacgctcatccctctctctctgccacccatgtgttttcctttcctcaaactctccaccagcctcatccttggaaagcctttgttgattaaccccaggcaacttgggtccttccattacttcgtgtatgcactggtgacggtgttttgctgttctgtgtggccaccatggtgtgctccctgctgtgtgatgccaaccgacccacagaactgcccatggagcag

SEQ ID NO: 163612 - DNA, 601 bp, Human
aacgtcccaagcgatcaacaagagatctgtaaactctactgtatgtaagttacacccccccaaaaaagtgcagggtgtgggaggaggaggcaagaccccagagtgtactgaaaatgtggaatgtcaaggaaggattttttattatttatttatttatttatttatttatttatttttgagacggagtctcgctgttgttgcccaggctggagtgcagtggtgcagtctcagctcactgcaacctccacctccaaggttcaagagattcttgtgcctcagcctcccaagcagctgggactaygggcacacgccatcacacctggctaacttttgtatttttagtagagatggggtttcaccatattggccaggctggtctcgaactcctgacttggtgatccacacccccctcagcctcccaaagtcctgggattactgccgtctcaaaaaacaaacaaacaaaacaaacaaaaaaaaaaaaacgctcatccctctctctctgccacccatgtgttttcctttcctcaaactctccaccagcctcatccttggaaagcctttgttgattaaccccaggcaacttgggtccttccattacttc

SEQ ID NO: 163613 - DNA, 601 bp, Human
atgttggccaggctggtctcgaactcctgacctcaggtgatctgcccacctcgtcctcccaaagtgttacggcgattacaggcgtgaaccattgcatctggcccatcgtttttgtatctttagtagagatggggttttgccatgttggccaggctgttcttgaactcccgacctcaagtgatctgcccgcctcagcctcccaaagtgctggagttacaggcatgagccactgcgcccggcccaacagagacttttaaaggccccctgctcccctggtccatgaacagcccctcatgccccrgtactcacagtcggcaggctcaggtggggctctgaggcaggtggtggcaccatgagcaatggcgtcgctggtcaagtgggccagcagggttatggaatggagaagtccactgatgtctgccaggattggaaagagaagtttctcaggtctggttgatggtgacactttcataccctctcctcccgttttatgagttgcctacatgcctttcttgtatgagttgcctacatgcctttcttgatgcagagggacctgtcactatccccgcattcaggtgcttctgaaccctgtctggccatc

SEQ ID NO: 163614 - DNA, 601 bp, Human
catagagtccatgtcttctctgtccctatatatacttaacccaatttctggtatacaggacatatttatttatagcagaggcagggtctcactctgttgcctaggctggagtgcagtggcacaatcatagctcactgtggcctccaaatcctgggctcaagcgatcctcctgcctcagcctcccgagtagctgggactacaggtgcgtgacatcacacctgtctaattaaaaaaaaaattttattttgtagagacagggtctcactatgttgcctaggctgatattgaactcctggcctcragtgatcctcctgcctcggcctcccaaagtgcagggattacaggtgtgagccaccatgctcggcactacatctttagtaaatgaatgaacacagtgttatttccattttgggtattacctgcccacctagataaaaatcctcagagacaggggagctgcctatacttctttgatattgcctagtgtaatgatgacaacatagtagattctcagctaacagccagtgaattaaatatagctggaaagtccttcaggaggtttttcctttttaaatttttttttttttaatttttaaagaga

SEQ ID NO: 163615 - DNA, 601 bp, Human
cgcctggctaattttttgtatttttagtagagatggggttttgccatgttggccaggctggtctagaactcctgacctcaggtgatccacctgcctcggcctcccaaaatgttgggattacaggcgtgagccaccgtgcctggccctatccttgtatcttaaccaatatattccaattcataacactggggaaaaaatgaaaaaaaactgtactgcatagaaatggttttcttatttttcttttccatagagtccatgtcttctctgtccctatatatacttaacccaatttctggtatayaggacatatttatttatagcagaggcagggtctcactctgttgcctaggctggagtgcagtggcacaatcatagctcactgtggcctccaaatcctgggctcaagcgatcctcctgcctcagcctcccgagtagctgggactacaggtgcgtgacatcacacctgtctaattaaaaaaaaaattttattttgtagagacagggtctcactatgttgcctaggctgatattgaactcctggcctcaagtgatcctcctgcctcggcctcccaaagtgcagggattacaggtgtgagccacc

SEQ ID NO: 163616 - DNA, 601 bp, Human
cactaagttgcccaggctggtctcaaattcctggcctcaattgatccacccaccttggctggatgtggtctttttattatcttcttctggaactccaattagacagtctatcctcatggcttttattttttatttattttttgagtggagtttcgctcctgttgcccaggttggagtgcaaaggcacgatcttagctcactgcaacctcagcctcccaggttcaagtgattctcctgcctcagcctcctaagtagctgggattacaggcgcctaccatcacgcctggctaattttttgtayttttagtagagatggggttttgccatgttggccaggctggtctagaactcctgacctcaggtgatccacctgcctcggcctcccaaaatgttgggattacaggcgtgagccaccgtgcctggccctatccttgtatcttaaccaatatattccaattcataacactggggaaaaaatgaaaaaaaactgtactgcatagaaatggttttcttatttttcttttccatagagtccatgtcttctctgtccctatatatacttaacccaatttctggtatacaggacatatttatttatagc

SEQ ID NO: 163617 - DNA, 601 bp, Human
ataaaagcctgttgcccaggctagagtgcagtggtgcgatcatagctcactgcagcctcccactcctgggctcaagtgatcctccctgcctcagcctcctgagtagctgggacaacgggcacacaccactaggctctgctaacttttaaacttttttgtagagtcagagtcttgctttgtagcccaggctgtatcaaactcctggcctcaagtgatcctcccgcttcggcctcccaaagtgctgggattttcagacatgtgccactatgcctggcctgtcttattattattattttttaaytccacatagatgcatccctattaagtttgaatgtttgagtctttatataaaaggaatcctactgtatatatttttccatgacttgatttttcactcaacattctatgtgtgagattcatcctaatacctagtaattctgattctatgtatatactctagagaaactgacatgtgtgcatatatgatcataggggcaaattaataacaacccaaactggaaataacccaagtgtccatcaccaagagaacagacggatgaattaagcgatattcacacaatagataatgagagagcagtga

SEQ ID NO: 163618 - DNA, 601 bp, Human
agttatggtaacaaatggcagggcagggatttgaactaaggtctgacaaacagcaaagcctatgatttttaaaacatgatgtgttatacatactaaggtataaaatatatatgaatggttcaaaggataagaataaagacgcatgttatccaccacccaacttaaaacttaaggaatgctgtaagaaacatcaatacctttggaatcctatttgaacttgtatgtgccctgattctatctcccttactccctgccttctaccccaagagacacagaattcaagagcgtggttgttgtgtcktattttatttttattttttaaagacaaaacataaaagcctgttgcccaggctagagtgcagtggtgcgatcatagctcactgcagcctcccactcctgggctcaagtgatcctccctgcctcagcctcctgagtagctgggacaacgggcacacaccactaggctctgctaacttttaaacttttttgtagagtcagagtcttgctttgtagcccaggctgtatcaaactcctggcctcaagtgatcctcccgcttcggcctcccaaagtgctgggattttcagacatgtgccactatgc

SEQ ID NO: 163619 - DNA, 601 bp, Human
attgaattactatacctggcctacaactttttcaaatacagatgatatcttccactttgaccctgacttaactttgcttccacagtgatcatatgaggcgggtattattcctactgtgcagataggaagccagggatcagaggtagaacgtcttgaccacagttatggtaacaaatggcagggcagggatttgaactaaggtctgacaaacagcaaagcctatgatttttaaaacatgatgtgttatacatactaaggtataaaatatatatgaatggttcaaaggataagaataaagacrcatgttatccaccacccaacttaaaacttaaggaatgctgtaagaaacatcaatacctttggaatcctatttgaacttgtatgtgccctgattctatctcccttactccctgccttctaccccaagagacacagaattcaagagcgtggttgttgtgtcttattttatttttattttttaaagacaaaacataaaagcctgttgcccaggctagagtgcagtggtgcgatcatagctcactgcagcctcccactcctgggctcaagtgatcctccctgcctcagcctcctgagtagctgg

SEQ ID NO: 163620 - DNA, 601 bp, Human
aaagtgctgggattacaggtgtaagccaccacacctggccctaattttttatttttttgagacacagtcttgccctgtcaccagagatggagtgcagtggcatgatcatagctcactgcagcctcgaccttccatgctcaagcaattctcccacctctaccaccagagtagctgggagtacagaggtgcaccaccaagcccggataattgtttttttttttttttaatagagatggggtctcactatgttgcccaggctggtcttgaattcctgggctcaagtgatcctcctgtcttggcytcccaatgtgctgggattgaattactatacctggcctacaactttttcaaatacagatgatatcttccactttgaccctgacttaactttgcttccacagtgatcatatgaggcgggtattattcctactgtgcagataggaagccagggatcagaggtagaacgtcttgaccacagttatggtaacaaatggcagggcagggatttgaactaaggtctgacaaacagcaaagcctatgatttttaaaacatgatgtgttatacatactaaggtataaaatatatatgaatggttcaaag

SEQ ID NO: 163621 - DNA, 601 bp, Human
agagatgggtttcactattttgcccaggctggtctcaaactcctgacctcaggtaatcctcctgcctcagcctcccaaagtgctgggattacaggtgtaagccaccacacctggccctaattttttatttttttgagacacagtcttgccctgtcaccagagatggagtgcagtggcatgatcatagctcactgcagcctcgaccttccatgctcaagcaattctcccacctctaccaccagagtagctgggagtacagaggtgcaccaccaagcccggataattgtttttttttttttttaatagagatggggtctcactatgttgcccaggctggtcttgaattcctgggctcaagtgatcctcctgtcttggcctcccaatgtgctgggattgaattactatacctggcctacaactttttcaaatacagatgatatcttccactttgaccctgacttaactttgcttccacagtgatcatatgaggcgggtattattcctactgtgcagataggaagccagggatcagaggtagaacgtcttgaccacagttatggtaacaaatggcagggcagggatttgaactaaggtctgacaa

SEQ ID NO: 163622 - DNA, 601 bp, Human
attcctaggacttcttttcttcttttttgagacagagtcttgctctgtcgcccaggctagagtgcagaggcacgatcttggctcactgcaacctccacctcccgggttcaagtgattctcctgcctcagcctccaaagtagctgggattacatgcatgcaccaccacgcctggctaatttttgtatttttagtaaagatgacttttcaccacattgggcaggctggtctcgaactcccgacctcaggtgatcctccctcctcagcctcccaaagtgctgggattacaggcgggagctaccrcgcgggtttcttttctatagtgaaacagcaatattgctgtcatcattaatactgttattgatgattacatcaactcagcccttccccgtggctgctactgctctcctctaattccctaataagtatgcaaagtatagaccaatgtcaggaagacagatcctgctcccctaggtcccaccatgccgctcagaccgacctttcattcacctccaatttgactcctgtgtctcctgctcgggatttgctgagcatctcctgtgaaaaagaagcatggtttctaaatgtgccttgaatattaag

SEQ ID NO: 163623 - DNA, 601 bp, Human
tgagatcaagatccaagatcaatgaaaacgacggttctcttccccactcctagccaaaggcaagcttggaatgggaaagggaggtaagaagggtgctgaggttgctggaacattctgcggggaggcaccgaaggagaggctggggagtgagagagatctaattgtgggtctccatcgtaaggaatagtgaaattgtgattcctaggacttcttttcttcttttttgagacagagtcttgctctgtcgcccaggctagagtgcagaggcacgatcttggctcactgcaacctccacctcccrggttcaagtgattctcctgcctcagcctccaaagtagctgggattacatgcatgcaccaccacgcctggctaatttttgtatttttagtaaagatgacttttcaccacattgggcaggctggtctcgaactcccgacctcaggtgatcctccctcctcagcctcccaaagtgctgggattacaggcgggagctaccacgcgggtttcttttctatagtgaaacagcaatattgctgtcatcattaatactgttattgatgattacatcaactcagcccttccccgtggctgctactgctc

SEQ ID NO: 163624 - DNA, 601 bp, Human
tctccccagggcctctgctgatatctacaggagtggctgctctgtactcaggtggacacacagagtaagacggcagcatcacagagtccgttggagcgggagtctgtcaccaatgcctcctcttcctgcccagggcccacacccacgctcaccctgccgctctccacaatctctctctggaggtccttagaggccacgatgagcacctgaatagcttgcatgaggctggtacagcaaccaaggatcctgccaaacaaacaagtcgaggatacactgagatcaagatccaagatcaatgaamacgacggttctcttccccactcctagccaaaggcaagcttggaatgggaaagggaggtaagaagggtgctgaggttgctggaacattctgcggggaggcaccgaaggagaggctggggagtgagagagatctaattgtgggtctccatcgtaaggaatagtgaaattgtgattcctaggacttcttttcttcttttttgagacagagtcttgctctgtcgcccaggctagagtgcagaggcacgatcttggctcactgcaacctccacctcccgggttcaagtgattctcctgcctcagc

SEQ ID NO: 163625 - DNA, 601 bp, Human
ttccaacaatgtctgcctgtgcgaagggagctggagttgggacacatgcctggccaccctctggggaggtcctggagctctgacttctccccagggcctctgctgatatctacaggagtggctgctctgtactcaggtggacacacagagtaagacggcagcatcacagagtccgttggagcgggagtctgtcaccaatgcctcctcttcctgcccagggcccacacccacgctcaccctgccgctctccacaatctctctctggaggtccttagaggccacgatgagcacctgaatagcytgcatgaggctggtacagcaaccaaggatcctgccaaacaaacaagtcgaggatacactgagatcaagatccaagatcaatgaaaacgacggttctcttccccactcctagccaaaggcaagcttggaatgggaaagggaggtaagaagggtgctgaggttgctggaacattctgcggggaggcaccgaaggagaggctggggagtgagagagatctaattgtgggtctccatcgtaaggaatagtgaaattgtgattcctaggacttcttttcttcttttttgagacagagtcttgctc

SEQ ID NO: 163626 - DNA, 601 bp, Human
agccagtctcaagctggcattcaggatccgcttcttttgcaaaagtcctcatgtccccctcagagtacccaggtttgcaatgtaaaaagggctcccacagcaagttccaacaatgtctgcctgtgcgaagggagctggagttgggacacatgcctggccaccctctggggaggtcctggagctctgacttctccccagggcctctgctgatatctacaggagtggctgctctgtactcaggtggacacacagagtaagacggcagcatcacagagtccgttggagcgggagtctgtcaccratgcctcctcttcctgcccagggcccacacccacgctcaccctgccgctctccacaatctctctctggaggtccttagaggccacgatgagcacctgaatagcttgcatgaggctggtacagcaaccaaggatcctgccaaacaaacaagtcgaggatacactgagatcaagatccaagatcaatgaaaacgacggttctcttccccactcctagccaaaggcaagcttggaatgggaaagggaggtaagaagggtgctgaggttgctggaacattctgcggggaggcaccgaaggagag

SEQ ID NO: 163627 - DNA, 601 bp, Human
gataatcccagcaaaggtgtgagaccacgaagtggtgcgttgataagaggctgacagcagagtctatttgtaagggtgagttgactctgctgttagaaacagattaggccgaactccctgtgaaaagccagtctcaagctggcattcaggatccgcttcttttgcaaaagtcctcatgtccccctcagagtacccaggtttgcaatgtaaaaagggctcccacagcaagttccaacaatgtctgcctgtgcgaagggagctggagttgggacacatgcctggccaccctctggggaggtcytggagctctgacttctccccagggcctctgctgatatctacaggagtggctgctctgtactcaggtggacacacagagtaagacggcagcatcacagagtccgttggagcgggagtctgtcaccaatgcctcctcttcctgcccagggcccacacccacgctcaccctgccgctctccacaatctctctctggaggtccttagaggccacgatgagcacctgaatagcttgcatgaggctggtacagcaaccaaggatcctgccaaacaaacaagtcgaggatacactgagatcaagatc

SEQ ID NO: 163628 - DNA, 601 bp, Human
agaaacagaaaacatcagctctcaggaagataaaaggcaccagcaaagcaggcctggctgcttgctttatggcaccgttctcaggctcattaacccctcccctggacttacgcctcccgagctgcggcggcatatggggaaatgggaaaaaaacaagatgatgataatcccagcaaaggtgtgagaccacgaagtggtgcgttgataagaggctgacagcagagtctatttgtaagggtgagttgactctgctgttagaaacagattaggccgaactccctgtgaaaagccagtctcaagytggcattcaggatccgcttcttttgcaaaagtcctcatgtccccctcagagtacccaggtttgcaatgtaaaaagggctcccacagcaagttccaacaatgtctgcctgtgcgaagggagctggagttgggacacatgcctggccaccctctggggaggtcctggagctctgacttctccccagggcctctgctgatatctacaggagtggctgctctgtactcaggtggacacacagagtaagacggcagcatcacagagtccgttggagcgggagtctgtcaccaatgcctcctcttc

SEQ ID NO: 163629 - DNA, 601 bp, Human
agaatcacttgaacccgggaggcagaggttgcagtgagctgagatcacgccactgcactccagcctgggtgacagagcaaggctctgtctccaaaaaaaaaaaaaaaaagcctctgtaagaggatagtatgggacccttaacagggtgaatttttatttggaatcgaatccacctgagccctggatagatcatttgttctcaaggccagttccatcccatcatccaagtactatctaacctagccaagtactctctaactcctaagtagtctctaacctagccaagtaccatctaacctarccaagtaccatctaacctagccaagtactatctaacgtagccaagtattctctaatcctttagtattctctaacccagccaagtaccatctaacctagccaagtactctctaaccccttagtactctttaacctagccaagtacagtctaacctagccaagtgccatctaacctggccaagtactctctaactcagccaagtactgcctaacgcagccaagtactctttaacctagcctagtactctctaaccaggccttccagcgtcctaggaggtccagccaggtcctaccttggatg

SEQ ID NO: 163630 - DNA, 601 bp, Human
caggctggtcttgaactcccgacctcaggcctcctaaaagtgctgggattacaggagtgagccatcgtgcccggcctgattcaaatttgaacactaataaagaggggttgtagaatctcacagccaagccaggtaacctgttcatgatgccaacctattccttattcgagtgtttcttgaatgccaggactgctaatcggaagttggcattgctgggactctctaaggccacttgtaacagatgtgaggaaagccgcgagggacatgtgtggcacacctgggtacagactgggtacagacrttccttgctgtcacatgaaaggcctctaaggccaggtgtggtggctcacgcctgtaatcccagcactttgggaggctgaggtgggtggatcacaaggtcaggagatcgaggccatcctggctaacgcggtgaaaccccgtctccactaaaaatacaaaaaattagctgggcgtggtggcacgtgtctgtagtcccagctactcgggaggctgagtcaggagaatcacttgaacccgggaggcagaggttgcagtgagctgagatcacgccactgcactccagcctgggtgacagagcaag

SEQ ID NO: 163631 - DNA, 601 bp, Human
taattttttgtatttttagtagaaactggatttcaccatgttggccaggctggtcttgaactcccgacctcaggcctcctaaaagtgctgggattacaggagtgagccatcgtgcccggcctgattcaaatttgaacactaataaagaggggttgtagaatctcacagccaagccaggtaacctgttcatgatgccaacctattccttattcgagtgtttcttgaatgccaggactgctaatcggaagttggcattgctgggactctctaaggccacttgtaacagatgtgaggaaagccrcgagggacatgtgtggcacacctgggtacagactgggtacagacattccttgctgtcacatgaaaggcctctaaggccaggtgtggtggctcacgcctgtaatcccagcactttgggaggctgaggtgggtggatcacaaggtcaggagatcgaggccatcctggctaacgcggtgaaaccccgtctccactaaaaatacaaaaaattagctgggcgtggtggcacgtgtctgtagtcccagctactcgggaggctgagtcaggagaatcacttgaacccgggaggcagaggttgcagtg

SEQ ID NO: 163632 - DNA, 601 bp, Human
tgagaatcagttgggggcattgatgatattgattcaaaaaataatttttttttagacagagtttgctcttgttgctcaggctggagtgcaatggcatgatcttagctcactgcaacctccacctcccaggttcaagcaattctcctgcctcagcctcccaagcagctgggattacaagtgcccgccaccacacccggctaattttttgtatttttagtagaaactggatttcaccatgttggccaggctggtcttgaactcccgacctcaggcctcctaaaagtgctgggattacaggagygagccatcgtgcccggcctgattcaaatttgaacactaataaagaggggttgtagaatctcacagccaagccaggtaacctgttcatgatgccaacctattccttattcgagtgtttcttgaatgccaggactgctaatcggaagttggcattgctgggactctctaaggccacttgtaacagatgtgaggaaagccgcgagggacatgtgtggcacacctgggtacagactgggtacagacattccttgctgtcacatgaaaggcctctaaggccaggtgtggtggctcacgcctgtaa

SEQ ID NO: 163633 - DNA, 601 bp, Human
ctctaagcattatcacttatttggacaatgtgcccagttgtggaaaccaatttgggatgacaagaaataaggacaaataaagaacactctgggatactgtgaaactcttaaaaaggatttggggcacactttacatgagaatcagttgggggcattgatgatattgattcaaaaaataatttttttttagacagagtttgctcttgttgctcaggctggagtgcaatggcatgatcttagctcactgcaacctccacctcccaggttcaagcaattctcctgcctcagcctcccaagcagytgggattacaagtgcccgccaccacacccggctaattttttgtatttttagtagaaactggatttcaccatgttggccaggctggtcttgaactcccgacctcaggcctcctaaaagtgctgggattacaggagtgagccatcgtgcccggcctgattcaaatttgaacactaataaagaggggttgtagaatctcacagccaagccaggtaacctgttcatgatgccaacctattccttattcgagtgtttcttgaatgccaggactgctaatcggaagttggcattgctgggactctc

SEQ ID NO: 163634 - DNA, 601 bp, Human
atggtaccactgcactccagcctgggcgacagagtgagaccctgtctcaaaaacagaaataaagaaaaaataaaataaaaagatgaaaaatatgaaagaatttagacacagtcctgtgggatttggttgggatcacagggaaggatgcagagaagagctcaacagggtgggtaagaaaagggtccctttggaaaggctacctgtctcttcgatctgtgatttgccggaaatggttgaggccacaacgccggcagtggcctggttcactccccgagaggcctgctgcagctgggctaggttrgggctgtccttatcagctttcacctaccaggacaaagcagatttaggttcatacaacacctagagcaacaaggactgaatcagataattgctctgatggttcttagcaaacatatgtgggccaaacggcaatcaccaatcagcttctcaaaatctgctgactatagtcagctcctgacatatctatcatataaaaagttattcctggcttctttgcttggtggatcccaaactctaagcattatcacttatttggacaatgtgcccagttgtggaaaccaatttgggatgacaagaaata

SEQ ID NO: 163635 - DNA, 601 bp, Human
gtggtgggcgcctgtaattccagctacttgggaggctaaggcaggagaatcacttgaaccctggaggcggaggttgcagtgagccaagattgcgccattgcactccagcctgggcaacaagagaaagactccatctaaaaaaaagaaaaaaaaatggcagggcgcggtggctcacacctataatcccagcaaactttgggaggccaaggtgggcagatcacctgaggtgaggagttcgagaccagcttggctaacatagtgaaaccccgtctctactaaaaatacaaaaattagccaggcrtggtggcgggcgcctgtaatcctagctactcgggaagctgaggcaggagaatcgtgtgaaccagggaggtggaggttgcagtgagcagagatggtaccactgcactccagcctgggcgacagagtgagaccctgtctcaaaaacagaaataaagaaaaaataaaataaaaagatgaaaaatatgaaagaatttagacacagtcctgtgggatttggttgggatcacagggaaggatgcagagaagagctcaacagggtgggtaagaaaagggtccctttggaaaggctacctgtctcttc

SEQ ID NO: 163636 - DNA, 601 bp, Human
gtctcatcaaattctaccctggctgactggcacctgagaggcagccaatgccaatgctctgtggaaacgcctggcttgccatttgtcaacactgcatgaaagtaactgagggggccggacaacggtggctcactcctgtaatcctagctctttgggaggctgaggtgggtggatcatgaggtcaggagtttgagaccagcctggccaacatggtgaaaccccgtctttactaaaaatacaaaaattagctgggtgcagtggtgggcgcctgtaattccagctacttgggaggctaaggcargagaatcacttgaaccctggaggcggaggttgcagtgagccaagattgcgccattgcactccagcctgggcaacaagagaaagactccatctaaaaaaaagaaaaaaaaatggcagggcgcggtggctcacacctataatcccagcaaactttgggaggccaaggtgggcagatcacctgaggtgaggagttcgagaccagcttggctaacatagtgaaaccccgtctctactaaaaatacaaaaattagccaggcgtggtggcgggcgcctgtaatcctagctactcgggaagctgagg

SEQ ID NO: 163637 - DNA, 601 bp, Human
acctgtgttcatttccctctggcttttctccatgggaataatattcagagtccatgtctaggcaatagaggctatctagacttacagatggagctctcacctgagaatccatctcttggcgtttgatctgtgtcagcgtcatgcttgagaagtccatgttgtctgcaaggatggaaacaagaaggtctcatcaaattctaccctggctgactggcacctgagaggcagccaatgccaatgctctgtggaaacgcctggcttgccatttgtcaacactgcatgaaagtaactgagggggccrgacaacggtggctcactcctgtaatcctagctctttgggaggctgaggtgggtggatcatgaggtcaggagtttgagaccagcctggccaacatggtgaaaccccgtctttactaaaaatacaaaaattagctgggtgcagtggtgggcgcctgtaattccagctacttgggaggctaaggcaggagaatcacttgaaccctggaggcggaggttgcagtgagccaagattgcgccattgcactccagcctgggcaacaagagaaagactccatctaaaaaaaagaaaaaaaaatggcag

SEQ ID NO: 163638 - DNA, 601 bp, Human
ttagtaggtgcacctgtgttcatttccctctggcttttctccatgggaataatattcagagtccatgtctaggcaatagaggctatctagacttacagatggagctctcacctgagaatccatctcttggcgtttgatctgtgtcagcgtcatgcttgagaagtccatgttgtctgcaaggatggaaacaagaaggtctcatcaaattctaccctggctgactggcacctgagaggcagccaatgccaatgctctgtggaaacgcctggcttgccatttgtcaacactgcatgaaagtaastgagggggccggacaacggtggctcactcctgtaatcctagctctttgggaggctgaggtgggtggatcatgaggtcaggagtttgagaccagcctggccaacatggtgaaaccccgtctttactaaaaatacaaaaattagctgggtgcagtggtgggcgcctgtaattccagctacttgggaggctaaggcaggagaatcacttgaaccctggaggcggaggttgcagtgagccaagattgcgccattgcactccagcctgggcaacaagagaaagactccatctaaaaaaaagaaaa

SEQ ID NO: 163639 - DNA, 601 bp, Human
ttgggttagtaggtgcacctgtgttcatttccctctggcttttctccatgggaataatattcagagtccatgtctaggcaatagaggctatctagacttacagatggagctctcacctgagaatccatctcttggcgtttgatctgtgtcagcgtcatgcttgagaagtccatgttgtctgcaaggatggaaacaagaaggtctcatcaaattctaccctggctgactggcacctgagaggcagccaatgccaatgctctgtggaaacgcctggcttgccatttgtcaacactgcatgaargtaactgagggggccggacaacggtggctcactcctgtaatcctagctctttgggaggctgaggtgggtggatcatgaggtcaggagtttgagaccagcctggccaacatggtgaaaccccgtctttactaaaaatacaaaaattagctgggtgcagtggtgggcgcctgtaattccagctacttgggaggctaaggcaggagaatcacttgaaccctggaggcggaggttgcagtgagccaagattgcgccattgcactccagcctgggcaacaagagaaagactccatctaaaaaaaa

SEQ ID NO: 163640 - DNA, 601 bp, Human
ggagaatggcgtgaacctgagagagggagcttgcagtgagccgagatcacaccactgcactccagcctgggcgagagagcaagactccgtctcaaaaaaaaaaaaaaaattagctaggtgtggtgacgcacgtctgtaatcccagctacttgggaggttgaagtagaagaattgcttgaacctgggaggtggagagtgcggtgagccaagatcacgccactgcactccagtctgggcgacaggacgagactccgtctcaaaaaagaaaaaaaacaaaacaagacaaacaaaaaaaaaaaaacaaggtgattcactaatcaccttctctacctccactgtttcttccggcaagatttacattcagtcttgggttagtaggtgcacctgtgttcatttccctctggcttttctccatgggaataatattcagagtccatgtctaggcaatagaggctatctagacttacagatggagctctcacctgagaatccatctcttggcgtttgatctgtgtcagcgtcatgcttgagaagtccatgttgtctgcaaggatggaaacaagaaggtctcatcaaattctaccctggctgactggcacct

SEQ ID NO: 163641 - DNA, 601 bp, Human
tggtgaaaccttatctctattaaaaataaaaaattaaggccgggcacggtggctcacgcttgtaatcccagcagtttgggaggccaaggcaggcagatcacgaggtcaggagatcgagaccatcctggctaacacggtgaaaccctgtctctactaaaaatacaaaaaattagccaggcatggtggtgggcgcctgtagttccagctactcagagaggctgaggcaggagaatggcgtgaacctgagagagggagcttgcagtgagccgagatcacaccactgcactccagcctgggcgasagagcaagactccgtctcaaaaaaaaaaaaaaaattagctaggtgtggtgacgcacgtctgtaatcccagctacttgggaggttgaagtagaagaattgcttgaacctgggaggtggagagtgcggtgagccaagatcacgccactgcactccagtctgggcgacaggacgagactccgtctcaaaaaagaaaaaaaacaaaacaagacaaacaaaaaaaaaaaaacaaggtgattcactaatcaccttctctacctccactgtttcttccggcaagatttacattcagtcttgggttag

SEQ ID NO: 163642 - DNA, 601 bp, Human
aatagtgggcaagagttaagagtctgatcttggctgggtgtggtggctcacacctgtaatcccagccctttgggaggctgaggcaggagggttgtgtgaggccaggagttgagaccagcctgggcaacatagtaagaccccgtctctatcttatttaaaaaaaaaaaagggccggtggctcacgcctgtaatcccagcactttggaaggcccaggtgggcagatcacaaggtcaggagtttgagaccagcctggccagcatggtgaaaccttatctctattaaaaataaaaaattaaggcygggcacggtggctcacgcttgtaatcccagcagtttgggaggccaaggcaggcagatcacgaggtcaggagatcgagaccatcctggctaacacggtgaaaccctgtctctactaaaaatacaaaaaattagccaggcatggtggtgggcgcctgtagttccagctactcagagaggctgaggcaggagaatggcgtgaacctgagagagggagcttgcagtgagccgagatcacaccactgcactccagcctgggcgagagagcaagactccgtctcaaaaaaaaaaaaaaaattagct

SEQ ID NO: 163643 - DNA, 601 bp, Human
agctactttggaggctgaggtaggagaatcgcttgaacctggaaggcggaggttgcagtgaaccaagatcgtgccattgtactcactccagcctaggcaacagagcaagactcggtctcaaaaaaaaaaaaaaaagaaggaaaaattagctgggcatggtggtgtgtatctgtagtcccagctactcaggaggctgaggtgggaggatccgcctgagcccaggagtttgaggctgcagtgagctgtgatcacaccaatgcactccagcctggggaacagagcaaggccctgactcaaaaaragaaaaaaaaatgctgagtgacacatcttggagtactttaacaattccaatttgaaattcaccccaagactgatgaccagttattctagaaaaactatgtcaatttttttttaaaggatctcgctgatacctattttacataatatgactttatagaacaacagagagaaataatggcattgcctttgatgagttaaaaggattttctcttttaaaactaaaagtcatacgcaaataattcataccagaagtctaaaacagtgtttatagtaagactattaagtttgtggatactaagag

SEQ ID NO: 163644 - DNA, 601 bp, Human
ttttatagagatggggtcttgttctgctgcccaggctggtagtgaactcctggcctcaagagatcctcctgtcttggcctcccaaagtgctgagattacaggcatgaaacaccatgcccagcctacatctatcttattttgattactccctttctgctgcattgtgaattcctcttcttccatattattcaccgtttccatactttatctggccctcaatttcaattctcttctttgctctaatttttccattctcccattcatttatctatcccagtagctcttatgctttactcactgkgatcttctactggaagtgaatgatgctttacaaatgcctaaatggtaggtgggcttatcttctgttcctctgagaaatcactatctaaaaacaactctaatgtttagcctaactgtatggtgagtaccaatctagttgtaacccttcttcaatcccagttccctagaaacccaggtaggaagcaaatatgatggttctgatatctttcaggtatttgtgcaacttacacttattactgctacaggaaaaagcctggaaaatcttactataaaggaaagggtgatcttgtctagctctact

SEQ ID NO: 163645 - DNA, 601 bp, Human
cctccctgctgcgggttagtgcccatccttggagtcagcttaccttcttcccagccctcagcaacaccagcaagctcgtagtgctttttccgaagctctcccagtttttgacgctccttctgcaattcattttctagctctagcaccctaacctgtaagggaaagtaagtgggattttctcttaatcagctctcagagatttaatttttatttatttttttatagagatggggtcttgttctgctgcccaggctggtagtgaactcctggcctcaagagatcctcctgtcttggcctcccwaagtgctgagattacaggcatgaaacaccatgcccagcctacatctatcttattttgattactccctttctgctgcattgtgaattcctcttcttccatattattcaccgtttccatactttatctggccctcaatttcaattctcttctttgctctaatttttccattctcccattcatttatctatcccagtagctcttatgctttactcactgtgatcttctactggaagtgaatgatgctttacaaatgcctaaatggtaggtgggcttatcttctgttcctctgagaaatcacta

SEQ ID NO: 163646 - DNA, 601 bp, Human
aacggaagagaaaacaggttccatgaggagagaagagaaggaagaagccaccgatctggtgggttccttgttctgttccattctaggggaaggccctggccacacagcttcccctccctgctgcgggttagtgcccatccttggagtcagcttaccttcttcccagccctcagcaacaccagcaagctcgtagtgctttttccgaagctctcccagtttttgacgctccttctgcaattcattttctagctctagcaccctaacctgtaagggaaagtaagtgggattttctcttaatcakctctcagagatttaatttttatttatttttttatagagatggggtcttgttctgctgcccaggctggtagtgaactcctggcctcaagagatcctcctgtcttggcctcccaaagtgctgagattacaggcatgaaacaccatgcccagcctacatctatcttattttgattactccctttctgctgcattgtgaattcctcttcttccatattattcaccgtttccatactttatctggccctcaatttcaattctcttctttgctctaatttttccattctcccattcatttatctat

SEQ ID NO: 163647 - DNA, 601 bp, Human
aagttaggcttaaaggttatttacaacggaagagaaaacaggttccatgaggagagaagagaaggaagaagccaccgatctggtgggttccttgttctgttccattctaggggaaggccctggccacacagcttcccctccctgctgcgggttagtgcccatccttggagtcagcttaccttcttcccagccctcagcaacaccagcaagctcgtagtgctttttccgaagctctcccagtttttgacgctccttctgcaattcattttctagctctagcaccctaacctgtaagggaaaktaagtgggattttctcttaatcagctctcagagatttaatttttatttatttttttatagagatggggtcttgttctgctgcccaggctggtagtgaactcctggcctcaagagatcctcctgtcttggcctcccaaagtgctgagattacaggcatgaaacaccatgcccagcctacatctatcttattttgattactccctttctgctgcattgtgaattcctcttcttccatattattcaccgtttccatactttatctggccctcaatttcaattctcttctttgctctaattttt

SEQ ID NO: 163648 - DNA, 601 bp, Human
ccaggccggagtgcactggcacaatcagggctgactgcagcctcgacttcccaagctcaagcaattctcccaccttagctccccaactagctgagactacaggcatgcaccatcatgcccggctaattttgtttttgaattttagtagagatgaggtcttgctatgatgcccagcctggtctcaaactcctgagctcaagcaatcatcccgtcttggcctcccaaagttctgggattacaggcatgcgccactgtgcccggctgggcagagaatcttaatttgatccattacactagactrtttgccccatttgtaatttttttttttttttgagacggagttttgctcttgttgcccaggctggagtacaatggcgtgatctcagctcactgcaacctctgcctctggggttcaggtgattctcctgtctcagcctcctgagtagctgggattacgggcacccgtcactacgctcggctaatttttggtatttttagtagagatgggggtttcaccatgttggacaggctggtcttgaactcctgacctcaggtgatcctaccacctcagcctctcaaagtgctgggattacaggcgtga

SEQ ID NO: 163649 - DNA, 601 bp, Human
agcaaaccatcagcatctaggggaaagacgtggaatggattctccctcaggctcttgaaaggaaccaaccctgctgattccttgatctcagacatctagcctccagagaagtgaggagataaatttctgttatttaaatcacacagttttgagtatttcagtattaatatgaatttatcacttttcttctgttacggttagggcttttcttgtcctggcaaagctttgtctttctcaatattactaagatttactcttaaactttcttgtaggtcaatattatttttgaatgttatgtagscatattccatacatttttcctgcttacttggtttcatgtttgaatgtttaatgcctgaggaagctcttgtttcttgtataattcctagacttaatcacagcttttagtaacagtgtaaatatttcaagtggctctgtgcccacctcttcaagtttgacttggggcaagttttatttccaagagggcaagccccactgtccttctggttcccttgctattaagttggaaatggttttaactgatgttttcataccaattattgaatgctcagcacagtcatgcccaaatgcacttaaccat

SEQ ID NO: 163650 - DNA, 601 bp, Human
tacaagtcaagcaatgccagtgattaccagcaaaccatcagcatctaggggaaagacgtggaatggattctccctcaggctcttgaaaggaaccaaccctgctgattccttgatctcagacatctagcctccagagaagtgaggagataaatttctgttatttaaatcacacagttttgagtatttcagtattaatatgaatttatcacttttcttctgttacggttagggcttttcttgtcctggcaaagctttgtctttctcaatattactaagatttactcttaaactttcttgtagrtcaatattatttttgaatgttatgtaggcatattccatacatttttcctgcttacttggtttcatgtttgaatgtttaatgcctgaggaagctcttgtttcttgtataattcctagacttaatcacagcttttagtaacagtgtaaatatttcaagtggctctgtgcccacctcttcaagtttgacttggggcaagttttatttccaagagggcaagccccactgtccttctggttcccttgctattaagttggaaatggttttaactgatgttttcataccaattattgaatgctcagc

SEQ ID NO: 163651 - DNA, 601 bp, Human
actcgtgtggacactgatatattatggcttatatccttattaaaaggaacaacttggacacagatgcatctaggaagagggccatgtgaagatgaaggcagagatcagggtaatatatttacaagtcaagcaatgccagtgattaccagcaaaccatcagcatctaggggaaagacgtggaatggattctccctcaggctcttgaaaggaaccaaccctgctgattccttgatctcagacatctagcctccagagaagtgaggagataaatttctgttatttaaatcacacagttttgagwatttcagtattaatatgaatttatcacttttcttctgttacggttagggcttttcttgtcctggcaaagctttgtctttctcaatattactaagatttactcttaaactttcttgtaggtcaatattatttttgaatgttatgtaggcatattccatacatttttcctgcttacttggtttcatgtttgaatgtttaatgcctgaggaagctcttgtttcttgtataattcctagacttaatcacagcttttagtaacagtgtaaatatttcaagtggctctgtgcccacctcttcaagt

SEQ ID NO: 163652 - DNA, 601 bp, Human
atgagcaactcataggtgaagagttgtcatcttaaaatctcagtggaggggagacaggaaggaagcctttgttatttttcccaaacatctagcctttccaaatatgtcatggcaatggagccaggtgtgtgaggcatcgcagtggacgactatggcattgcaagaggggacgactaccctccttagaacacaacagactccaggatcttctgccactcccatccctgcaactttttcacattactcatgtgcctagaagagcctgccagtttatgctggcccagcttcccttctcttgtcyttcaggaacgggaaaggaagtaattcttgaagtgcagctgattcacaatgtattccaatacaccttgcttgcttgttttgggacctgactttttcctttggaaaattatttgaggcagcagcctgtgtgattccatcatcatcctacttcctgggccatgggtcactaagtacagatttccatatgtgtgaaggctgctacacaagtaccataccctctagcagatctatataaatatttttaataagccattggctgctattgaaaaaattaagtatagatttttgtatctaaagatca

SEQ ID NO: 163653 - DNA, 601 bp, Human
aaaaaagaatgagatcatgtcctttgcagggacatggatgaagctggaagccatcattctcagcaaactaacacaggaacagaaaaccaaatactgcatgttctctggacacagggaggagaacaatacacactggggcttgtcggggtgtgagggggaaggggagcgtgagcattaagacaaatacctaatgcatgctgggctcaaaacctagatgatgggttgataggtgcagcaaaccaccatggcacaagtatacctatgtaacaaacctgcacatcctgcacattccagaacttaragtaaattaaaattaaaattaaaaattaaaaataaataaagttatgaataattgcactgtggagtttacttggatttcactagtttttgcatgtacttatttttatgtctttgtgtatagttcggcaacattcagtcacacatatagagtcatataggtaccataacaatcaagatacagtacagctccatcaacccaaggcaactgccttctgcttcccattccttttgccactctcaccactggcaactgctggcctgttgtgcatatttacaattttgacaactcaagaatgttata

SEQ ID NO: 163654 - DNA, 601 bp, Human
tgtttttttatcttgtaaatttctttaagttccttatagattcctgatatttgatctttgtcagatgagtagattgcaaaaagtttctcccattctgtagatggcctgttcactctgatgctggtttattttgctgtgcagaagctctttagtttaattagatcccatttgtcaattttggcttttctttcaattgcttttggtgttttagtacaccacagaatactatgcagccataaaaaagaatgagatcatgtcctttgcagggacatggatgaagctggaagccatcattctcagyaaactaacacaggaacagaaaaccaaatactgcatgttctctggacacagggaggagaacaatacacactggggcttgtcggggtgtgagggggaaggggagcgtgagcattaagacaaatacctaatgcatgctgggctcaaaacctagatgatgggttgataggtgcagcaaaccaccatggcacaagtatacctatgtaacaaacctgcacatcctgcacattccagaacttaaagtaaattaaaattaaaattaaaaattaaaaataaataaagttatgaataattgcactgtgga

SEQ ID NO: 163655 - DNA, 601 bp, Human
cctgtgaaatagacaaactattctttctctgacctattttagggagctgctataaacccacttgagatgattcatgtgaaaatattttagaaacaacaaattcttatataagcatatataggaataggttgttaatggaatactagagactcattttccttgtatttctatttttttaattgtttcattggaaataattgtcgatccacaggaagttgcaaaaatggtagagataggtacccagtactatcacccatctcccccaatggtgtcatcttatgtaactaaatatatatatatrtgtgtgtgtgtgtgtgtgtgtgtgtgtgtgtgtgtgtatgcatatagtattatatataaagttgtatttataaagttgtatgtgacacattttctttatccagtctatcattgatgggcatttgggttggttccaagtctttgctattgtaaatagtgctgcaataaacatatgtgtggatgtgtctttatagtagaatgatttataatcctttaggtatataccaaataccattacccagtaatgagattgctgggtcaaatggtattcctggttccagatccttgaggaatcgccatg

SEQ ID NO: 163656 - DNA, 601 bp, Human
tccctgtgaaatagacaaactattctttctctgacctattttagggagctgctataaacccacttgagatgattcatgtgaaaatattttagaaacaacaaattcttatataagcatatataggaataggttgttaatggaatactagagactcattttccttgtatttctatttttttaattgtttcattggaaataattgtcgatccacaggaagttgcaaaaatggtagagataggtacccagtactatcacccatctcccccaatggtgtcatcttatgtaactaaatatatatatrtatgtgtgtgtgtgtgtgtgtgtgtgtgtgtgtgtgtgtatgcatatagtattatatataaagttgtatttataaagttgtatgtgacacattttctttatccagtctatcattgatgggcatttgggttggttccaagtctttgctattgtaaatagtgctgcaataaacatatgtgtggatgtgtctttatagtagaatgatttataatcctttaggtatataccaaataccattacccagtaatgagattgctgggtcaaatggtattcctggttccagatccttgaggaatcgcca

SEQ ID NO: 163657 - DNA, 601 bp, Human
cctccctgtgaaatagacaaactattctttctctgacctattttagggagctgctataaacccacttgagatgattcatgtgaaaatattttagaaacaacaaattcttatataagcatatataggaataggttgttaatggaatactagagactcattttccttgtatttctatttttttaattgtttcattggaaataattgtcgatccacaggaagttgcaaaaatggtagagataggtacccagtactatcacccatctcccccaatggtgtcatcttatgtaactaaatatatatrtatatgtgtgtgtgtgtgtgtgtgtgtgtgtgtgtgtgtgtatgcatatagtattatatataaagttgtatttataaagttgtatgtgacacattttctttatccagtctatcattgatgggcatttgggttggttccaagtctttgctattgtaaatagtgctgcaataaacatatgtgtggatgtgtctttatagtagaatgatttataatcctttaggtatataccaaataccattacccagtaatgagattgctgggtcaaatggtattcctggttccagatccttgaggaatcgc

SEQ ID NO: 163658 - DNA, 601 bp, Human
acctttccatctgtttccctccctgtgaaatagacaaactattctttctctgacctattttagggagctgctataaacccacttgagatgattcatgtgaaaatattttagaaacaacaaattcttatataagcatatataggaataggttgttaatggaatactagagactcattttccttgtatttctatttttttaattgtttcattggaaataattgtcgatccacaggaagttgcaaaaatggtagagataggtacccagtactatcacccatctcccccaatggtgtcatcttaygtaactaaatatatatatatatgtgtgtgtgtgtgtgtgtgtgtgtgtgtgtgtgtgtatgcatatagtattatatataaagttgtatttataaagttgtatgtgacacattttctttatccagtctatcattgatgggcatttgggttggttccaagtctttgctattgtaaatagtgctgcaataaacatatgtgtggatgtgtctttatagtagaatgatttataatcctttaggtatataccaaataccattacccagtaatgagattgctgggtcaaatggtattcctggttcca

SEQ ID NO: 163659 - DNA, 601 bp, Human
tctcatctcagacacctctttctcacactccagggattaattaggctctaaacatgacttcagattagaaacaaggctcctagctgccttggagagagacaaagaagtagtagcaagactggatgatgcagcaggtcaactaataggcaattcctattagtggctggaactgttacctgggatggcttagaagagaaatgacgttgggaagtctcagcaggtttattttaattgacacagaggaacaacagggacctacagcggacaatggcatgaatgtggctttgatttggaggctgtrcttttgttagaagaatactgagtggaagctagaaagagactagacataggaaggtaggtgtggacttaggaaaggcaaggcaagagtatgggtgatgttcaaagctagtgagcacccttgggtgccccagataacaagcagaatttgattcaatatatcattttacattatacctattccaacctcaagctatggaagccatctttgtataatataaagagctccagacttgaaaatcaggaactaggttcttttcataaagctaccattttagttagctgtgactcatttgtcattact

SEQ ID NO: 163660 - DNA, 601 bp, Human
taagtagaaagtgtggtcacctatcaagaaccacagcttaaagacatcataattgtttgttgtaagatgtgttaattcacctgggactttagaaagagaaccctaggtaattactacttatttcttagtgagggttttccaccttggggagggaaggtgggggtcaatgtgaaggcattatgaatctacatttctgagacttccagtgttaggttagcactctggagtttgggtcagggccatcagctgcacagtgacgcttgctgaaggcatccctctgctaggatagattgctctgccrtcctcccgcttgcacaaaagaacttcagcctcccaagaaggagattctcaggaatttatgactcaatcaactcacccaaaaggagcataaatgggattagttttaatattgttaagttgcaaaaatacaggcatatgtgcatgccaaagcgaaaatgtacgcaagcaaagggggaaaacatatgggtacccatatggcgaaaagcacattgctagaccttcacacacttctcatttacaacaagaaccaaagttagtgaacataaatttgctttgcaaaaatgtgagaggaacagcttgt

SEQ ID NO: 163661 - DNA, 601 bp, Human
tatgaaagaggtcttttcacagctggttaggccccagtcaccttgtggtaccatgtacgtgtctccccattctacacggctctcagtttagagcagggattatgttctacttggctcagttagatactgccctctacatggcatgtgaatttaatcagagctactttggctctaagtgatggaaacctaatttaaaacagcttaagcaagaaaaggtgacttataggaattttaccctagggatgtagagatttttagaaagaagtataaatggctttgaaaagggaacaccaagggtggyaggtgcacagagctggacccagaggtctttcaaatgtactatcaagggtgctcatccaggagggaaggaggaaacaaacctttctaagattccttcaacatctggccagatgaaggagctcagtgtctaaattaaagtgcattatctccagaggtggctgcagtatgttagtatggaaccaggctgcttattattttctattgaagcccacattttttgttcagcagcaagagtcactgcggacccactgctgaggccaattagatctacagaacttgtaaagtcggtctcaattttatc

SEQ ID NO: 163662 - DNA, 601 bp, Human
taaaacttaatataattaaaacgtcagcagtaagctcactcgtcatccagggctaatagttatagtgggggaaatggaagaaaaatgcttgggagataagtctgcaacttcctgcaggctcctaatacagctaggacttgaagtgccttctccaaacatccttcactctgtacatcagatttccccttcactgtacagacagagtgcttcctgcatctgggaacttgtctttgcaaatctccactgtcttccccttttttttctctggcacgctacaggatcgatatacgatggatacatrtgtgtgtacccattcaatagtcactttttgatcgcctgcaaaatgtaagtcatttgtgttcttctgaatatgtaagccccaggtaccatacctgctctcaaataacctaaggacagagagatgcaagggatactttctggccagggtggagcatatcatcccaaggaaaggttagtgaatcaattgatggaaacaaactaattgctcttcataaagtttttccagagtaatgagaggttgatcatgacagagaggctgagtttcagtcactcaaggtggtatcctcaacacctttctcat

SEQ ID NO: 163663 - DNA, 601 bp, Human
agtctgcttttctttgtggattcctgctgggttctggagggcctgggctctcgggagtataattccagctacacgcagcctctgaagcttctttactccttagacagaatcagaggtgcagtaatatcaggagagtcttaaaatatgactcaatatttttttgccaaactgcctttgttccaactgctttcatgccttctgggacagaaaatcctgccaaaaagatacaaagtgtggtaggaagtttggggctgggtcaggagtaaaaagaagaagagtgcagagtaggggagagaaagaggagtgggtagggttccaaacatcttgctgtctgacatcccagagcaccacggccctatgatgccctacaaaagtggctcagatcttcaccagcagcactggcaacgtcctgagtgcccaagggagacaaaccctttcaccacagctgtaattactgcaccaggctccagttgtgcagggacaaataagcatgggctaagtggagcaggaggaggtcctggagaggcccaggatgaaagcatttagactgcaatggtgtgaagagcagaggtgagctgagcagagcttgttgggaaaagga

SEQ ID NO: 163664 - DNA, 601 bp, Human
gtcctttggggacccctttgaagatttgaatacagattttgcttacattaatttttgtttttgttttcttagcgggtgtgatcaaacttgtttccatggaaagcagtgtcataatgggaccatcaacaaatgagttcaactttatttggattacaacaagttcatactttatgcttcaataagaaaaaatgaattttatccttctaagtataccatgcaatttcccattttcatgtctcttctcttatctccattgcctagaatatttctctttgcctctacctcacccatttcattttcyttcttttgaataactctgaatctatgtttacagccagattagcagtcacctcttccaggatgccatccctgattctttcacatttaacaactggagttaaatgatcctctcctgtgaacctacaacatgatgaatatatcactaatgcacccacttttattgtactataattaaatgctattatgtctgagcctttcactaaactttgagcttcctggagaaaactataattttatttattcttctgtttcaaacacagtacataacacgtagaaggcacccactaattcattcttgaat

SEQ ID NO: 163665 - DNA, 601 bp, Human
ctgtatcttgattaggatagtgattatatagatatataaatttgtcaaaactcaccaaaagctgcggtaatttaaattatgaccgcaagatttttttaaataaaaagcccttgttcttcccttatgttcactgtctgtttagccattcatgattcactcttcatgtacttctcaaacctcattacatatcaaggtatagatgttttcttgatttgtagccctaatgttaagcagaacaatggttagtgctgcttaatgaagaagttaagagaagaagcctatttggtttatgttagaaatstgagaaaattattatggaaagaggaaagcagataagggaagaaagtagagatctgggtagcatagaattctcatggaatgtggaagggaaagagaaaagattgccaaactgtgagtgaaatagaaagactggcaaaaaagcaacattcaactattttactacctgttatggaaaacatttgtcctttggggacccctttgaagatttgaatacagattttgcttacattaatttttgtttttgttttcttagcgggtgtgatcaaacttgtttccatggaaagcagtgtcataatgggac

SEQ ID NO: 163666 - DNA, 601 bp, Human
atatagttcatatacacatgttttaaatatatatttgtgtcatgtagattatatatacatatagaatgcatatacatattttgctaaatatatacatgtaatatatatatattaaactctaaaaaagtctaatatataacagcagaaaacatatcagtgtttgcctcaagttgaaagtggggataggttttgggaagaataagaaacagggaagcttttgaggtaatggtaatatgctgtatcttgattaggatagtgattatatagatatataaatttgtcaaaactcaccaaaagctgyggtaatttaaattatgaccgcaagatttttttaaataaaaagcccttgttcttcccttatgttcactgtctgtttagccattcatgattcactcttcatgtacttctcaaacctcattacatatcaaggtatagatgttttcttgatttgtagccctaatgttaagcagaacaatggttagtgctgcttaatgaagaagttaagagaagaagcctatttggtttatgttagaaatctgagaaaattattatggaaagaggaaagcagataagggaagaaagtagagatctgggtagcata

SEQ ID NO: 163667 - DNA, 601 bp, Human
atttttttcagagtgtagatatgtgtgtagggtgcaatatatagttcatatacacatgttttaaatatatatttgtgtcatgtagattatatatacatatagaatgcatatacatattttgctaaatatatacatgtaatatatatatattaaactctaaaaaagtctaatatataacagcagaaaacatatcagtgtttgcctcaagttgaaagtggggataggttttgggaagaataagaaacagggaagcttttgaggtaatggtaatatgctgtatcttgattaggatagtgattayatagatatataaatttgtcaaaactcaccaaaagctgcggtaatttaaattatgaccgcaagatttttttaaataaaaagcccttgttcttcccttatgttcactgtctgtttagccattcatgattcactcttcatgtacttctcaaacctcattacatatcaaggtatagatgttttcttgatttgtagccctaatgttaagcagaacaatggttagtgctgcttaatgaagaagttaagagaagaagcctatttggtttatgttagaaatctgagaaaattattatggaaagaggaa

SEQ ID NO: 163668 - DNA, 601 bp, Human
cacagtaggcaaggtcaatataaaaaagtcaattgtatctctgtgtattttcaatgaacaattgagatttttaaaatttcctttataatcattcaaaaatatgacataatttggaaccacacactgaaagccataaaacactgttgagaaaaattagccaagacttaataaagggaagaatatattttaaggcttggaaaaactcaatactattaaatgtcaactgttccaaaattaacatataatttaaatgcattcccaatcaaaatcttaacatctttttggtaaatattgtcaaacygattataaaattatatgaaaatacaaaggacatagattggccactattttgaaaaaaacaagtttggcaatctacattgtctgatttcaaaacattaacagtgattgtaatcaaaacagtatggttcaggcataagaatagacatatagatgaatagaaaataagagagattcccagaaagaaatcagtcaattgattttcaacaaagaaactaaggtaattcattagaaaaaggattatgttttccacagatgcttttggattaactgtagagctgtatggaaaaaaaatgaatctcaa

SEQ ID NO: 163669 - DNA, 601 bp, Human
gactatatttacccagtatctgtacccccatcgtatctaggaagtaactagcttgcttttgattttacaggctcataggtggaagggacttgtcttgtctcagatgagactttggactgtggacttttgggttaatgttgaaatgagttaagactttgggggactgttgggaaggcatgattggttttgaaatgtgaggacatgagatttggaggggccaggggcagagtaatattatttggctttgtccccacccaaatctcatcttgaattgtatctcccagaattcccgtatgttctrggaaagacccagggtgaggtaattgaatcatggggcccagtctttcctgtgctattattttgatagtgatattaagtctcacaagatctgatgggtttatcagggctttccacttttgcttcttcctcattttctcttgctgccaccatgtaagaaataccttttgcctcttgccatgattctgaggcttccccagccatgtggaactgttaagtccaattaaacctctttttgttcctatgtctttatcagcagcatgaaaacggactaataaacacacatacacacaaatcagctact

SEQ ID NO: 163670 - DNA, 601 bp, Human
taccctgtaaacccacagaggcagagctgcccaagaccatgggaacccacctcttgcatcagcatgacctggaaatgagacctggagtcaaaggagatcattttggagctttaaaatttgaccacaatgttggattttggacttgcatggtccctgtaatccctttgttttggccaatttctcccttttggaatgactatatttacccagtatctgtacccccatcgtatctaggaagtaactagcttgcttttgattttacaggctcataggtggaagggacttgtcttgtctcagatgrgactttggactgtggacttttgggttaatgttgaaatgagttaagactttgggggactgttgggaaggcatgattggttttgaaatgtgaggacatgagatttggaggggccaggggcagagtaatattatttggctttgtccccacccaaatctcatcttgaattgtatctcccagaattcccgtatgttctgggaaagacccagggtgaggtaattgaatcatggggcccagtctttcctgtgctattattttgatagtgatattaagtctcacaagatctgatgggtttatcagggc

SEQ ID NO: 163671 - DNA, 601 bp, Human
cgtattgtgtgcagcctagggacttggtgccctgtgtcgcagctgagccactgtggctgaaaggggcacatgtacagcgcaggctgtggcttcagagggtggaaatcccaaggcttggcagcttccatgtgatgttgagcctgcaggtgcacagaagtcaagaattaaggtttgaggactttcacctagatttcagaagatgtatggaaatgcttggatgcccaggcaaaagtttgctgcaggggtggggccctcatggagaacctctgctagggcagtgcagaagggatatgtggggtgrgagctcccacctagagtccctactggggcactgcctagttgagctgtgagaagagggctactgtccttcagactgcagaatggtagatctaccaacagcttgcactgtgtgcatggaaaaaccacagatactcaatgcctgctcgtgaaagcagttgggagggaagctgtaccctgtaaacccacagaggcagagctgcccaagaccatgggaacccacctcttgcatcagcatgacctggaaatgagacctggagtcaaaggagatcattttggagctttaaaatttgaccacaatgtt

SEQ ID NO: 163672 - DNA, 601 bp, Human
gatgtcagagaccttgatagcagcccctcccatcacaggctcagaggcccaggaggaaaaagtgattttgtgggccaggcccagggtcctcgtattgtgtgcagcctagggacttggtgccctgtgtcgcagctgagccactgtggctgaaaggggcacatgtacagcgcaggctgtggcttcagagggtggaaatcccaaggcttggcagcttccatgtgatgttgagcctgcaggtgcacagaagtcaagaattaaggtttgaggactttcacctagatttcagaagatgtatggaaaygcttggatgcccaggcaaaagtttgctgcaggggtggggccctcatggagaacctctgctagggcagtgcagaagggatatgtggggtgggagctcccacctagagtccctactggggcactgcctagttgagctgtgagaagagggctactgtccttcagactgcagaatggtagatctaccaacagcttgcactgtgtgcatggaaaaaccacagatactcaatgcctgctcgtgaaagcagttgggagggaagctgtaccctgtaaacccacagaggcagagctgcccaagaccatg

SEQ ID NO: 163673 - DNA, 601 bp, Human
atatttctgctctgtttacaaaagctatatctaaatcagactaatacaaatcttttttaaaaggctgagcaaatgtacatttagtattaacaaaatcaaagtaggaaatacaatcttaaagttagataaggttaactgtaagcctaaaacattaaattgtaaaaaaaaaaaaaattatactgataaaagaagcaattcatattaaagctctaattacttttgaattttatgtgtaaaatacaaaaataaagcaaaaagtattaaaatgcatagataagctgaaaacactttattaaaatcyggtattactcatttttgctttcataaagtttagagaagcaaacaatgcaatatggctatgcacaatctgaataacagaattctctctcagtctggatgtttatgtttaatatttatcttgtactgtagtattaatgaagtattttataccatatgaattatatataactataggtatattcaattacatatactttgtacaatgtttatataatgtatactattgtgtgctcatacattaacataaatatctataaacttgacaactatcgaacagttatcaaaattgaacctatacatt

SEQ ID NO: 163674 - DNA, 601 bp, Human
agctactagacagaacaaaaagaggaaaacaaaaagctgacgagaaacaaacacatcagttttaatacctgcaagtgggttaaactccccattataatgaaaaaaaggcttcagttggattaaaaaaaagataacagaatatatttctgctctgtttacaaaagctatatctaaatcagactaatacaaatcttttttaaaaggctgagcaaatgtacatttagtattaacaaaatcaaagtaggaaatacaatcttaaagttagataaggttaactgtaagcctaaaacattaaattgtaaaaaaaaaaaaaattatactgataaaagaagcaattcatattaaagctctaattacttttgaattttatgtgtaaaatacaaaaataaagcaaaaagtattaaaatgcatagataagctgaaaacactttattaaaatccggtattactcatttttgctttcataaagtttagagaagcaaacaatgcaatatggctatgcacaatctgaataacagaattctctctcagtctggatgtttatgtttaatatttatcttgtactgtagtattaatgaagtattttataccatatgaatta

SEQ ID NO: 163675 - DNA, 601 bp, Human
taaaacagcaacaaaatttaaatctccatcagaagtaaaacatatcagatgtgaggcttcaaaaaatcaaatcaacagagtgaatttcaaacctgagcagctctcccgggatacagaagaaaagacagaaggagattaagaaagcaagagaaagacaaaagatctgaaggaaacagaagaaagagccaacacacgtggaactaagtttccttagaacgagctacaacagaaccaaccattaaatatttaacacatgcccactttctgcgaaaaaaaaaaaaaatctatgtgtgtgcctaayaacagacttactgcatattaggagaattcagaagagacacatcacatctcccggaaagaattttcaacctcacagataaaggcatatcttcttatcttcacacagaaaatggattactcatacaattacaactatcagaaaagaagacctcagcttgctctacttcatcactaaatgccaaatataatgaaggggtaaccacaggagttttaagggtaaagattgtgacctttggattttatgctcaggaaatactccaattgcatttgacagcaacaaaaaaatcttcataggtaaaca

SEQ ID NO: 163676 - DNA, 601 bp, Human
ggtgtgaatatcaggaggcggggtcactgaggtccccctggagtctaccctcatagactttctaagcaatcacaatgggcttgcaataccaatgcagcttcaaaccagaggagtcaatgagtgccccccaagccctaaattattcaaattcttcaaccattaccatgcatcagagatctcagaggacaagaaaaaaagtaccatttcataaagagaagtataacaggtggaagctagagactgtgaaataaaccagaagctctgcagcctaataaatatttgaagagtagaattaaaacargactcaaaatttactcaaaaggcagagaataggggcaaggcaccatccacttaccacacagatcacaccaatttcgagaatgagtattgagaaaatactgtggaaaaaggaaaataaagactagtcacaaaaattccaggaagaccgtgctttaataaatgacttctattgtacagcagtgtgaatgtactcaattcatgtgatcgagccgtacacttaaaaaggttaaagtggtaagttttatgctatgtgcaccatatcacaataaaaaaatcggcttccagaaccctaattaaaatt

SEQ ID NO: 163677 - DNA, 601 bp, Human
tatggttgcactaactcctaacgtgggctatgcttctcaccttctaccattatcaagggctgattttctccatcaacatagaattttttaaataggtaacgtgtttcatgaaccaaataagcaaaggaagatacagggtaaatgattttaacaaatttctagctaattgtagacaaattcctagttagtatggtcttagcgatggggaaggggagaggaagaatagaccctcctatctgctatatcttgaagttatacaaatgctttcagatgaatctgtttctgagtcatgtttctgtgygaactataaggaagaaaagcaagatctaaaagagaggatatggggcacacctgcattgttaaatgataccataaaaccctattcaggaaagtggatagatactcaagaccaaaagacatgctttctgatgacaatctctacatgttcatgtattatagacatgttttatgaagctgtacaagaatttcccagaggatctgtcacctttacccaccaccctctgctctgctgacacgggcagtttctctcctgagccacctgcttcttaaagacacagcatcaccctcactgtgagttcta

SEQ ID NO: 163678 - DNA, 601 bp, Human
tccagtaggagccagagggcattgaagcagttgtccatatggtcctttgtcttgttttctggtgtctttacatgctgtaaatccacatggttccctttatttattatttattttgttttactttaagttctgggatacacgtgcagaaggtgcagatttgttacataggtgtacatgtgccatggtggtttgctgcacctatcaacccatgcattagctatttgtcctaatgctctctctctccttgccccccaccccctgacaggccctagtgtgtgatgttcccctctctgtgtccacrtgttctcattgttcatctcccacttatgagtgagaacatgtggtgtttggttttctgttcatgtgttagtttgatgagaatgatggtttccagcttcatctatgtccctgcaaaggacatgaacttattcttttttatggctgcatagtattccgtggtgtatatgtgccacattttctttatccagtctacaattgatgggcatttggattggttccaagtctttgctattgtgaatagtgctgcaataaacatgcatgtgcatgtgtctttatagtagaatgatttataatcctttgg

SEQ ID NO: 163679 - DNA, 601 bp, Human
tgaggaaagggtccctctgccagccctaagacagcataggaataggaacggcaccatgcaaagagcagaggagcagtctgcaaagacaatctaagctccattgacatgaggggccaagagcagcagagctgggcatggctgctcatgcctgttacgctgcctccctcagaagagctaagattgagggcttgtcagcagctggaggggtcttgcctcatcactatgccgtaggtttccttgttaggcctggcacaatatgagatatccaagagcaaaaggacatcagttgtctgcagagggsagaaccagctcaagctgaaaaccactcatttcacatagatgggaaaagcatggtgatggagcatcgcagaggaggcagagaaattccatgtttaaaagctcaaagtctggaacttgcatgcctgggattgaatcctattctgattctcactgcctctctgatcttagacaattgatttcctctctatgcctcagcatccttaactggaaaacagagatgtgcattagaactatgtcatagagttgtcctgaggatgcaaggaataattactttcaaggacatgctggcaactgaggaaga

SEQ ID NO: 163680 - DNA, 601 bp, Human
ctcaaaaaaaatgaaagccagaagaagtggtacgtgctacacaaatggatttgaattcaaatgtgggtacaattcctatggagatactattttaggctttctgcgtctcaggcaaaagccatgctctcagaattctgtgagtgtgcttccccgtgcatggtagcacaccttgaaattcagccagaaagtagatccaggctagtcaggtggagaaggaacaagaaccaaaactggacaaggcccctagggactaatggtagatatgtgatgattccaggtgcagggagctgaggaaagggtycctctgccagccctaagacagcataggaataggaacggcaccatgcaaagagcagaggagcagtctgcaaagacaatctaagctccattgacatgaggggccaagagcagcagagctgggcatggctgctcatgcctgttacgctgcctccctcagaagagctaagattgagggcttgtcagcagctggaggggtcttgcctcatcactatgccgtaggtttccttgttaggcctggcacaatatgagatatccaagagcaaaaggacatcagttgtctgcagagggcagaaccagctca

SEQ ID NO: 163681 - DNA, 601 bp, Human
aaattatttagaaaacatgatgaattatttgtctaaacatattctatatttttatagattttaactcttgactgcaaaataaagtgaccaaaggaagagaaaaacactctatttcaataattccgtttcaaatcaaaagaaaaatggtggtaacattacttaaattatggcataaagtgatgttacatagcttagaggttcaaggagaaataaaacttgaagattttacagagttaatggtccagctgaagtcctacacatcaagaacaaaggccattggtcatctgttttttcttgtgawtctcacagccctagtatatttccataggtttccatgctccctatttcattttaaatggactctgactatgcattcattatattcaaggaaacacactggtcacaactcaaatttttgccatgcagctacaggttcagtattatatctattcaatttaagacagaagaatcatacaacttttgaaggagagactgtctaaaaccaatgtctaaggatgttggcatttgtcaagattacttggctttatttatactctacgacccctccacagaggaagtttgaattttcctctacaattcc

SEQ ID NO: 163682 - DNA, 601 bp, Human
tgggaggctacactctgtacttttttaaatttttttaaaaaacactgatgcacagcagtttgacatttttgtttgcagtcaatactcatgaatagatctcttcaaaaactttcaaaatatattgactaggactccacctctttaatcgaaaacttcatggttttagacaacacgataaattatttagaaaacatgatgaattatttgtctaaacatattctatatttttatagattttaactcttgactgcaaaataaagtgaccaaaggaagagaaaaacactctatttcaataattccrtttcaaatcaaaagaaaaatggtggtaacattacttaaattatggcataaagtgatgttacatagcttagaggttcaaggagaaataaaacttgaagattttacagagttaatggtccagctgaagtcctacacatcaagaacaaaggccattggtcatctgttttttcttgtgattctcacagccctagtatatttccataggtttccatgctccctatttcattttaaatggactctgactatgcattcattatattcaaggaaacacactggtcacaactcaaatttttgccatgca

SEQ ID NO: 163683 - DNA, 601 bp, Human
taattgtcttaagactcaatttctcacaacctgtgctttgagaatgaagctcagaccctacagggaatacatttcgactacaaaggattttctctctcaacaattgtggatgactttttttttttttttcctggagtgcttttctcaaagtttacatcattgtcacctcctttgaatctctcttctttgtagcttatctggatattcattttgcacttagattattctaattcatttcatttcttccattgtaatcccttctgttccattttacccaaaaaacatttattgagccttcatmcattaggactctgtctctgacttttaggagctctcaattgaataagagtgacaagggcaatgacatttatactgaaaactgtaataagacaactacaatctcagaatattaacgttttaaaagagatgttcgaaacataccctagagataaaggggaggaggttgaaacaactatgcatttgttgggggaagacatttgctcagaaatcaaacttgaaagtgaaggtttaatccaagaactacatcaaattataatatatgcccatcagttcccttcaggatagcttaccatgattttag

SEQ ID NO: 163684 - DNA, 601 bp, Human
tatttattgtctttcagccctaccatgagggcagggactttgttttgtgttgtcctatgtgtaatttccagaagagtgcctggtgcacagtaaattgctcagtaaatattttgaatgaatgaataaatgaacgcttcagtagacagcatctagcacctgacaggtacattataaatacttgatgactgaatggatgatggccctccagagggactagcacagtacctggcatatagtagtttcacaataaatactggatggatgattgacagattcaacgtgattcaacatagaactagaytgcctgtttccaggaccagatgtgagaacaaagaagccataaaaagtaaatatttcatgtccgtctttttctgtgaggctaaattgagtgtggtggtggaatctccagcaaaccttggtggataggaagttggacctgctggtaactacacttttgctgtagaactacggtagtggtggaagatgccatgactgccctcagtagaatgagcacaaaagtagagctcgggaagagggaagagaagggctccagaaagaagcaacttccctcctcccatctggaaagctgctgagatgctct

SEQ ID NO: 163685 - DNA, 601 bp, Human
tagataaatcaagcaggcagttgaatctgtgactcaggaattcagaggagaggtttgagcatcatcagcaaatcaatagcgtttaaaagcatgatataggatttatttattgtctttcagccctaccatgagggcagggactttgttttgtgttgtcctatgtgtaatttccagaagagtgcctggtgcacagtaaattgctcagtaaatattttgaatgaatgaataaatgaacgcttcagtagacagcatctagcacctgacaggtacattataaatacttgatgactgaatggatgayggccctccagagggactagcacagtacctggcatatagtagtttcacaataaatactggatggatgattgacagattcaacgtgattcaacatagaactagattgcctgtttccaggaccagatgtgagaacaaagaagccataaaaagtaaatatttcatgtccgtctttttctgtgaggctaaattgagtgtggtggtggaatctccagcaaaccttggtggataggaagttggacctgctggtaactacacttttgctgtagaactacggtagtggtggaagatgccatgactgccc

SEQ ID NO: 163686 - DNA, 601 bp, Human
ggcgcgagagaaagagtggaatcaaggatgacaccattatttttttacttgaacaactaaaagaatggagtgttgttgttgtcattgttgttgtcgttgttgttgttgttttaactgggggagaatgaggaagaaacaggttgagaaggggccaggaaattcagtttgatttggggcatagtaagcttgagaggcccagtttggcttcctgtagataaatcaagcaggcagttgaatctgtgactcaggaattcagaggagaggtttgagcatcatcagcaaatcaatagcgtttaaaagyatgatataggatttatttattgtctttcagccctaccatgagggcagggactttgttttgtgttgtcctatgtgtaatttccagaagagtgcctggtgcacagtaaattgctcagtaaatattttgaatgaatgaataaatgaacgcttcagtagacagcatctagcacctgacaggtacattataaatacttgatgactgaatggatgatggccctccagagggactagcacagtacctggcatatagtagtttcacaataaatactggatggatgattgacagattcaacgtgattca

SEQ ID NO: 163687 - DNA, 601 bp, Human
gggtggctccaggacagccagctggtgaccaaacatgctctcaggagtgaaatgaggtaaaaggtctttttgacttttttgtaagaatatttagctcaaaacacaaacacattatacagctgtacaaaaacattttcattatatccttattccttaagctttttccaatttttaaaatgtattattattttatttttaaactctttttttaaaaattcagacataaacacacacattagcctagacctacacagggtcaggatcatcactatccctgtcttccacctccacatcccgcccygctgggaggtcttcaggggcagtaacacacatggagctgtcatctcctgtgataacaatgccttctttgggatccctcctgaaggacctgtctgaagctgttttacagttaccttttaaaaaatatataagtaaaaggagtatgatctaaaataatagtaaaaagtgtggtatagtaaatacaaagaccagtaacgatcgtttattgtcaaatattttctgctgtatgtaattatacatgctggactttcacacaactggcagtgcaaatggttgggctataccagtgtcaccaggaaca

SEQ ID NO: 163688 - DNA, 601 bp, Human
ctggagaacacctacccttctaagaggccttgtgaaaatacagtcttgtgtgaagcattctttgatcacctcctgccctatagacaaagtaatcaaataactgaaataccatactacagtacatgtcacttaatgacagggatacttctgggaaatgtgttgaaggcggtgtcattcttgtgtgaacaccctagagtgcacttacacaaacctagatggtacagcctactatacactaggctagatggcacagcctactacacactaggctagatggtatagcctattgctcctagggtayaaatctgtactgaatactgtaagcaattggaactgtaaaaatatagcctgaaagatgaaaaggtatacttgtatagggtgcttatcatgaatggagcttgtagggctggaagttcctctgggagtcagtgagtgagtggtgagtgaatgtgaaggcctgggatattaccatactccacacataggctacactaaatttatttttgtttaaattttttctttagtcatacattagtcttatcttactctaacaactattttactttaccaacataatttttttaactttttgacttagaaa

SEQ ID NO: 163689 - DNA, 601 bp, Human
ctgccatgtgcctctttgcatttgatgcctcagccaccctgggcctccccaaccgcatgcctatgcagctgcttatgctgctctctgccaggaaaacctggttcctctttacctggagaacacctacccttctaagaggccttgtgaaaatacagtcttgtgtgaagcattctttgatcacctcctgccctatagacaaagtaatcaaataactgaaataccatactacagtacatgtcacttaatgacagggatacttctgggaaatgtgttgaaggcggtgtcattcttgtgtgaacaycctagagtgcacttacacaaacctagatggtacagcctactatacactaggctagatggcacagcctactacacactaggctagatggtatagcctattgctcctagggtacaaatctgtactgaatactgtaagcaattggaactgtaaaaatatagcctgaaagatgaaaaggtatacttgtatagggtgcttatcatgaatggagcttgtagggctggaagttcctctgggagtcagtgagtgagtggtgagtgaatgtgaaggcctgggatattaccatactccacacataggcta

SEQ ID NO: 163690 - DNA, 601 bp, Human
atccaagtttttctgctggatgtgcagagatccagttggctccagcctacctttgcagccacagctcctgccatgtgcctctttgcatttgatgcctcagccaccctgggcctccccaaccgcatgcctatgcagctgcttatgctgctctctgccaggaaaacctggttcctctttacctggagaacacctacccttctaagaggccttgtgaaaatacagtcttgtgtgaagcattctttgatcacctcctgccctatagacaaagtaatcaaataactgaaataccatactacagtamatgtcacttaatgacagggatacttctgggaaatgtgttgaaggcggtgtcattcttgtgtgaacaccctagagtgcacttacacaaacctagatggtacagcctactatacactaggctagatggcacagcctactacacactaggctagatggtatagcctattgctcctagggtacaaatctgtactgaatactgtaagcaattggaactgtaaaaatatagcctgaaagatgaaaaggtatacttgtatagggtgcttatcatgaatggagcttgtagggctggaagttcctctgg

SEQ ID NO: 163691 - DNA, 601 bp, Human
cactcacgattggccatgattcttatcttactcaatcatagtattgcattactgctttctaatacgcattttagtttttccttctcaatttgattacttctatgccttgaatatttctatccatgtagataggtttaatttactctatcctctcctcactgcttacaagataaaatccaagtttttctgctggatgtgcagagatccagttggctccagcctacctttgcagccacagctcctgccatgtgcctctttgcatttgatgcctcagccaccctgggcctccccaaccgcatgmctatgcagctgcttatgctgctctctgccaggaaaacctggttcctctttacctggagaacacctacccttctaagaggccttgtgaaaatacagtcttgtgtgaagcattctttgatcacctcctgccctatagacaaagtaatcaaataactgaaataccatactacagtacatgtcacttaatgacagggatacttctgggaaatgtgttgaaggcggtgtcattcttgtgtgaacaccctagagtgcacttacacaaacctagatggtacagcctactatacactaggctagatgg

SEQ ID NO: 163692 - DNA, 601 bp, Human
gcttttctcgtgatgcttcccttagtagactctcctctcccttcctctttgctactatgaatgacactttcccgttaggacccagcttggggttttcctcctccaggaaatattccctgatcttattacctggccagatagagtcacagaaatgctttgagttggaagatatctcagcaagcttgtagctgaggacattgaagctcagggccattaagcagtgggcctatgcacatcactcacgattggccatgattcttatcttactcaatcatagtattgcattactgctttctaataygcattttagtttttccttctcaatttgattacttctatgccttgaatatttctatccatgtagataggtttaatttactctatcctctcctcactgcttacaagataaaatccaagtttttctgctggatgtgcagagatccagttggctccagcctacctttgcagccacagctcctgccatgtgcctctttgcatttgatgcctcagccaccctgggcctccccaaccgcatgcctatgcagctgcttatgctgctctctgccaggaaaacctggttcctctttacctggagaacacc

SEQ ID NO: 163693 - DNA, 601 bp, Human
tttgatgtgttttggcaagcgtgaacactcaagtagctacctcccagttaagaaatagcatgtttcctttctcccacagaactccttcaggactggtccagtcaattcccccaccatgtggctcctgccaccccatgtcaaggcagccactgatcaatttctcctactatgacttagcgttgactgctttagaactttacattaatggaatcatatactatgtaatcttttgtggctggcttcttttgcttaacctaatttgtttattttgaagtttatccatgttgtatataaaactgcrtattttctttttattgctgagtaatattccatggatgaatacagcatcatttgtgtacccaatcttccaatggtagtccatgtaccctgtttccctgtataactattataaataaaacattcttgtacaaatctttttgtggacagatccactcatttctcttaaataaatacctaggagtggaattgcagtgccacagtataggtgtgtggctagcctctgaagaaagtgtcagttttccaaagtgctcaccctgttttaaactctctgcagtgattatcaacttacaggagttccagt

SEQ ID NO: 163694 - DNA, 601 bp, Human
ttaaaaaaaattaaaaaaagtgttacttccatgaatcccattgtttgaaatattttatctactaaacaaattgcatttgttttcccaatttttaaaattgaatgcaagtgtccttttaatctgagtatccattatgctgaattaatatgatttttgtcaaaaataggtaaattgaccacttatctttgggcttttataagatttttaaacactggcaataatacatggactctcatgttcaccctgtggttcccaggtttcccaggttggagaccacagataacagagtgcaacccaatgrttttcaaatgaggactcagagccagagtgagttgcccaagatggctcttgaagccaagtccccatacacccatctcaagctccctggcccacaacacattcctggctgcacattcttttccccagttagcctgtgctgcaccaggtagttccagaagtacacagggattagagccacagagaatccactcttcctgcacagtggtacagacgtctcctttcatctcagactgagacaggtagtagcacactggggatgaggacttcaggaaagagggaagaggttatcagtccagccgaa

SEQ ID NO: 163695 - DNA, 601 bp, Human
ctaaaatttaaagtataataataaaaaaattaaaaaaaattaaaaaaagtgttacttccatgaatcccattgtttgaaatattttatctactaaacaaattgcatttgttttcccaatttttaaaattgaatgcaagtgtccttttaatctgagtatccattatgctgaattaatatgatttttgtcaaaaataggtaaattgaccacttatctttgggcttttataagatttttaaacactggcaataatacatggactctcatgttcaccctgtggttcccaggtttcccaggttggakaccacagataacagagtgcaacccaatgattttcaaatgaggactcagagccagagtgagttgcccaagatggctcttgaagccaagtccccatacacccatctcaagctccctggcccacaacacattcctggctgcacattcttttccccagttagcctgtgctgcaccaggtagttccagaagtacacagggattagagccacagagaatccactcttcctgcacagtggtacagacgtctcctttcatctcagactgagacaggtagtagcacactggggatgaggacttcaggaa

SEQ ID NO: 163696 - DNA, 601 bp, Human
cccagttttctcatctgtgaaatggagatgctaagagtatctacctcaaatggttattgtgaagatgtgtagaatccttaaaagtacttgacgctatcagcactatgtaagatacatatacacactctcatgtttttagcatgtacactatatttacatgcaaatttcaaatcaaagagccatactcttgaagttcaaaaaatcttagaaatcatatagcttttctcagcattaagccacctttaaaaaagtgctacttcccttttacactgttggtgggactgtaaactagttcaaccaytgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatataccatggaatactatgcggccataaaaaaggatgagttcatgtcctttgtagggacatggatgaagctggaaacca

SEQ ID NO: 163697 - DNA, 601 bp, Human
accagagatgcaggagcacagagaaaagaacatgtgaagaggctgcaagagggcagccatctgcaagttaaagagatatctcaaagaaaaccaggcctgcatgcgccttgcacttgaacttccagcctccagaaacgtgaaaaaaaaaaatatttctgttgtttaagctacccattatgtaatattttcttatgacagcctgcccaaactaataatacacctcctttcagcacagaaaactcatgtaacatgcagtattttgccaaacattgtatggctattgaattcaaatgtacgttayatatgaacaggtatatatacagatatttcatctgtatacatttatgatagagtgacacacagacaaatccatctgtgtgaccctgtgcaagtaacctaacctcttttcgccccagttttctcatctgtgaaatggagatgctaagagtatctacctcaaatggttattgtgaagatgtgtagaatccttaaaagtacttgacgctatcagcactatgtaagatacatatacacactctcatgtttttagcatgtacactatatttacatgcaaatttcaaatcaaagagccatactcttg

SEQ ID NO: 163698 - DNA, 601 bp, Human
ttggagacagggtctttaagggggtgattaagttacaatgaggccattagggtgggccaaatccaatctgactgatgtccttattagatgagattaggacacacaaagagacaccagagatgcaggagcacagagaaaagaacatgtgaagaggctgcaagagggcagccatctgcaagttaaagagatatctcaaagaaaaccaggcctgcatgcgccttgcacttgaacttccagcctccagaaacgtgaaaaaaaaaaatatttctgttgtttaagctacccattatgtaatattttsttatgacagcctgcccaaactaataatacacctcctttcagcacagaaaactcatgtaacatgcagtattttgccaaacattgtatggctattgaattcaaatgtacgttacatatgaacaggtatatatacagatatttcatctgtatacatttatgatagagtgacacacagacaaatccatctgtgtgaccctgtgcaagtaacctaacctcttttcgccccagttttctcatctgtgaaatggagatgctaagagtatctacctcaaatggttattgtgaagatgtgtagaatcct

SEQ ID NO: 163699 - DNA, 601 bp, Human
gcctgtgcaacatggctggattctgtctctacaaaaaatttttaaaatagtagggcatagtggtgtgcacctgtggtcccagctactcagaagaatgaggctggacaatcacttgagcccaggagatcgaggctgcagtgagccaagatcatgtcactgcactccagccttggtgacagagtgaaactctgtcacacaaaaaaatcataatccataactacgtaaaggaatggctttacataaggcccaaaagtcatggcacagatgaaaatccaaacagaacactgtatttgtagagaarttaacagcactctctacaatctaaggccaattacctgcaggagccatcagtgaacttgccaggcctcaggtatgtagctgagccatccctggaacacgtagcaggaaggatgggagagatgaaggacttcagctgatggagaggagcctgctcgggcctgtgggaggggacgactggcctacatttaccagcagacagacccaacatgcagcagcaatcatattcataaaatcataatcacagagtcagaaacattagtgatagagagagatggattgggtcaggtagcctgcctcctgc

SEQ ID NO: 163700 - DNA, 601 bp, Human
cacactcaacatgtctagaattatgctcattgcctcacctccaattatcttgccttctgtatgttattgaaagtaaccactacccaaaccagttagtaagagctctagaaatattcttggacaactgcttttgtcttttctgaattttattcattagacaaatgtgttgaacaccttctctgttctgagctgttttaagtgccaagaattcatcaatcaataaaagatgtaagatacatgtccttatgaaatttatagtctagtgagggagttggaagcaaaaagaaaataagagggaaargataggaaaataaaaacaaaatcacaatttaaaagtgaaacaaggtgatgctttagagaataactgggtgcgacatggagagaattttcgtgagactagagcagagcaagcacagggcagggctcacacatgtgtgggtgtgagagagtgtatgtgagtctggggtgtgtttgtgtgtgggggtgcgtgtgtatgtgtgtatgtgtgtgtgaatgtatgtgtgtgtgtggtgcctgtgtgcctgtgtgtgtgtggtgactgtgtgtgtatgtatgtgtgtgtatgtgtgtggggtgtgtg

SEQ ID NO: 163701 - DNA, 601 bp, Human
cctatatagagaaataaattctgatcttaagtaggccaactccccttcctaccagggccatcctccctttcagactcatgtggaatgtctcctgatagaagacaatggcacagggaggctccatgggagcaagtctgaatgattctgtatgagacataaagcttgtttaggccgcgcacggtggctcacgcctgtcatcccagcactttgggaggccgaggcgggcggatcacgaggtcaggagatcgagaccatgatgaaaccccgtctctactaaaaatacaaaaaaaaaaaaaaaaaatagccaggtgtggtggcgggcgcctgtagtcccagctactcaggaggctgaggcaggagaatggcgtgaacccgcgaggcggagcttgcagtgagccgagatcacgccactgcactccagcctgggcgacacagcgagactccgtctcggaaaaaaaaaaaaaagcttgcttcaatcctggtcaatgtttgttggaacgaaaaaacagcttttaagagaaacgcatggaaagaaccagttaatactttggactgaatcagcaagatagaaacagctagcctgggcagtccaagattttct

SEQ ID NO: 163702 - DNA, 601 bp, Human
ttatatactttttaatgctttttcatttttatgtttaactctttttggaattcactttgaagtcttccagatgcgttttaaaaataaaaccaagttctttattttgcatgattaacctatacctatctttaaagttgagaaactaaaagggatcataggctaattgacacgtattcagctcactgcttcacattcctgtctttttcattcttgtgaattaggaatcatttgatgcagagctccaccaatgcacacctatatagagaaataaattctgatcttaagtaggccaactcccctycctaccagggccatcctccctttcagactcatgtggaatgtctcctgatagaagacaatggcacagggaggctccatgggagcaagtctgaatgattctgtatgagacataaagcttgtttaggccgcgcacggtggctcacgcctgtcatcccagcactttgggaggccgaggcgggcggatcacgaggtcaggagatcgagaccatgatgaaaccccgtctctactaaaaatacaaaaaaaaaaaaaaaaaatagccaggtgtggtggcgggcgcctgtagtcccagctactcaggag

SEQ ID NO: 163703 - DNA, 601 bp, Human
ccttcatgtctctgtctggaagttatcaccagggaggctgtcgcagactgccacatggaatatcacaaatattccccaccccagcctcctaatcttgcctatgtttttatcaggggacttcacaccacgtgacattatactgtatatgtactcgtgtatttgtttattgtctgacacccaccccatcctacccaccgcctccagcctggccactagaatgtaagctccacgagagcaagaactatgcttagttcatggcttaatctctaatgtctggaatatggcctggtacaaaacagcrgctctacaattatttgttaagtaaaagaatgaataaataaaagtttccattaatcaaatatctctacttttattagttattcttgttttgatggtcctcgccttaacaaactactttttatctgggaaaatgggcaaatcattgatgctttctcggggtttttcaaattaacgccacgcagagtaagcccctctattgattaacaataaattaaacatatgacttgggatctgcaatatttttttctttacttcttttcacacaattaaaaaatgagtaaactccctgataaaagattca

SEQ ID NO: 163704 - DNA, 601 bp, Human
tcacacattcagatgaaagggctgagttctcagatctctaaacctagagtgggcgcctggacagcaataacaagctttccaggaaactctagtgtagtcctcacaccagaagcacttggtgtccttagggaactagctaaaaatgcagaatctcagatcccattgcagatgtcctgaagagcatctgtagtttaccaagattccacgtgattctcacgtgcatcatcacccttgagaagccctgctgtaccacactgcaaggattgagaggagctgagggttagggaatctgggattagarcatgctttgccacagtgaggtatatctcctgagccatttgacctttgaggacattcatcttctcacctgccaatggaggtgcacagactgctagataaatagtccccaaactttgctggtcagtcatctgtggcatttaagtagctttctaaaaatacatattattgggcccctcccctgggaattatggctccatagtgtctgaaatgctgataggtttgactattgctagtctagctactgtgcatatttctgaaattcaaagagacctaggttcaaacacagctcagacacagtaca

SEQ ID NO: 163705 - DNA, 601 bp, Human
cagctggtcaccagaaaagcaaccaagcatatggaggaaagaggggctgcaggctgagttgaccaccaatggccaattatgtaattaatcatgcctaggatatgaagcctctatgaaattgcaaaaggactgggttcgagcaggttctggaaaggggaacacatggaggttctaaatggtggtgcatccagaaaggtcaagcaagctccatgctccttccccatacctgacgctatacatctcttcaatctgacggtttatctggatccttggtaattctctttgtaatacatgggtaaasaaaaaaatggtgtttctctgatttctgtgagctgatctgcaaattaattagaccctgggagcaagtagcaagaacttggccttatagctgtgttttagtccattctcatactgctaataaagacatactcgagactggataatttataaaagaaagaggtttaattgactcacagttctgcagggctggggaggcctcaagaaatttacaatcatggcagaaagggaaggaaacatgtccttcttcacatgatggcaggaaggagaagtgccaagcgaaaggggaaaagccccttataaa

SEQ ID NO: 163706 - DNA, 601 bp, Human
atctacttcctatatatatatctacatatatataggataatatatatctatatagagaatatatatatatatatacacacatatacatatatatatagatagagagagagaaagagagagagagagagagatcctactggttctgtttctctggagaaccttgcctaatatagattccttttttgctccacatatcattttggaacattacatattggttatgtagaggatctttattcactgcgatatgcatatcttccaaatgttgacatacttcgttatacgaaagttaaaaaaaaaatcacatctgttaatattgccaccaatctcatcagaaatgtctttaggcactgggaacctgtcaagctcatgaaagcaaatacaagttttccaaagttctaattttagctcaaaagctcaaattccatttttagcaacaaatgctgtcagtggttttcgtccaagtgacaggcccacattattcattttcaagaaaagatctgctagatactcaagtgtgaataatgttgagttatatgtcagttgttttttcaaatacagtgctgttgtgggggtgggatggctacttgagctggcaacc

SEQ ID NO: 163707 - DNA, 601 bp, Human
gtctcagtgtagacactacattatatgttcactgtacatttaaatcattccagactcaaaagcagttctcttgtgtttaaatatcctaagccattacatattgatagagactaccgttgtctgtcaaaaaccttctttgtcaaattcattcattcattcattcattcattcattcattcatatgtaaggcataacttactctatagactataatctctgccctcacacagcttacattttagagagaaagcacagacatcagatgacataacagatgatatgcgttagtggttattgactrtcaaacttaagtagtggaatcctctctctctctgccaataaaatcctctattaaaattttatcgagttgcaaaatctgagctgctattttggggttggggtagaggggaggtataggaattcaaggttttgtagtctagtgctcactatctcattctcacagctgttcatattgtctctctcccaccgtctctcctcgctttctctaaccctcacagagacacctacagaggttcagaggaaacctttggcattttatgaactgcagctaaaaggataaacagtttcccattgttcagga

SEQ ID NO: 163708 - DNA, 601 bp, Human
cgagtgagatccctttgagatgccacttaggagcatgctatctcccttgctggagatagtctttgtttacatttgttcatcttctgtaatatggatgccagtcccgtcattttcaaaacggtctcagtgtagacactacattatatgttcactgtacatttaaatcattccagactcaaaagcagttctcttgtgtttaaatatcctaagccattacatattgatagagactaccgttgtctgtcaaaaaccttctttgtcaaattcattcattcattcattcattcattcattcattcacatgtaaggcataacttactctatagactataatctctgccctcacacagcttacattttagagagaaagcacagacatcagatgacataacagatgatatgcgttagtggttattgactgtcaaacttaagtagtggaatcctctctctctctgccaataaaatcctctattaaaattttatcgagttgcaaaatctgagctgctattttggggttggggtagaggggaggtataggaattcaaggttttgtagtctagtgctcactatctcattctcacagctgttcatattgtctctc

SEQ ID NO: 163709 - DNA, 601 bp, Human
tagcaagggaagatgcctactatgtgcacaacacatgctaggtttttgcgggggaaggttaagaaaccaggactggcaaatagacatcattcaacatgtatctattgcatcaaatcctgcaaagcacattgtttcttaattggtctcatttgtatggtctataattttagacttcaaaggatgagagggtcacctttagctttcgttgctagttttacagacccagcttctcccaggtcataacttgttcctgggaaatgaggtctgagaaaatcagtgtttgcatccattcctgggagakaactaatctgaaaagtgtgatggtggaagcctgatttggaagggtgaggaccgatgctcagtgagccagagcccactcttccgaggtcaggcttcagtgggctaatatctcatcaggaggcaccaggccctcactatcctgcggtaacagcccctctactgcggagatgctccactgcctcttccacacactgctcactgcgacagcctcgcagagggctcccagctgaggacagaggacagatgatgggagaagccagcacccagggccttcgggaacatggcagcagccatgttgaat

SEQ ID NO: 163710 - DNA, 601 bp, Human
agcagtaattctcaacctggtaattttgtccacaggatacatttggcagtgtctagagacagttttggtctttatggctgaggttaggaaagctgtactacattgcacaggacagtctcccttgacaaataattatctgaccccaaatatcactagcaccaaagctgagaaacctgcaccaaaatgtaaatgcgtattgaatcgctgacatctcccactagagagaaggaagctcggtgactacaaagaccatccatttcattcccaggggcatccccagggccgggtgtaattcctaacrcatgatcgggccccacaaaaggaccgcagaaaaatacaaagaacgagtgagtccattcagcaacaaaatgcagtgccagtcttatgtcatctaattgtctagtgctgagggtaagactgattactcataactaaatataagcttagcaagaaataacccaaaaaatgcatggtgattaagcccctcggcagggtttcgaggacagagcagatactatttagctggttgggcgtggggctggtacaaagaaacatagctctggctacaggcagtgctcaaagaagccttgaaatgttctca

SEQ ID NO: 163711 - DNA, 601 bp, Human
ttccttccttccttctttcagcctgcctgcctgcctgccttccttttttccttccttcctgcctgccttcctactttccttccttcctgcctgccttcctactttccttccttcttgccttccttccttcttcacctccttttttcatgtcctccctcacttcctttgttccttcactcaacaaacatttttgaactcttacacaataagcctaccactaaggactaataactaaagaccctttctcagcattctgtatactccagtgaggaaagacagtctcccaaaatatgactcagaytgaatttctcaccagccagacgggcagccccaacaaatcaaccatgaacacaaacattcttataagtgagatttcaaacatagaaataataggtgtcattcatataccacccctcctcctttcccctggacatatctgaccttgcttataagtctcctctgtatagtctccctgcaccatgcccacatcttgtaagggattgtcttattcaggctgcctagagttgctcaaagttgaagatgccatctatttcccactgggctcttgactgttatgacttccttgactttagggtctttg

SEQ ID NO: 163712 - DNA, 601 bp, Human
ttcatcttgagaagaaaacaagtgatatttacattattaaatctcaattacaaagcaaatcagctgcagaagagaagagaccatttccatcaattattactgagctgaacataatttttctatcaccagcagattgtaaatgggggctacagctcatccaggaactcttctatcataggagttattaatcgggtattaactttgtcgaattagcaaggacactgacgagatggtgagggaagcaggaagggtatagggctggggcgggggtgggggcgcagacgggaggacacagcaggtraattcctgagaccacagaggcacagaacactctagaaggcctgggatcagtcctttatgcagctggtctggcttctgtgttgaagaaaatacccagctctggggttttcagtcccaaaaagtcaacacatgaacaggtaaaaataaaaaatagcaccttcttgactggcgattccattcctgtttaggagcactgaggggatgccaggactctgcacagctctaggtgaggggtgcggctctgttgctgcccctgctgtggggcctccatctagggccctaaaagtctgagtgcctccta

SEQ ID NO: 163713 - DNA, 601 bp, Human
agcagagtagcctatttgggccaaaaaaagtcgctagcatttttattctaaaaagtataaaaaataaactgaaactaacagttcagacccaaagaatgcaggggtagaaggagaaaaatcattatttttacatagtagagcttaaacagctaagttattgacaaaatgtttaagtacacttgaaaagtttttatttattttacacattttccccttatgattatgattatttggattctaaaccaacagggttactttagtatcaacaagctaaagtgaaatgagttctgagaagtaaaartactgctttaaaaaaaaaccttcataattaaacgacagcattttttttagaaacctgatcaatgcatggaaggagacactgcctctttcatttacaatgtctaaagaaagttgccttaaccttgtctgcagcaacctactcaagcacagccagtcacccaggcccagtttcttcaagaaggctgtatttttgtagtataggagtgtcttgtgccctggcgtggtcagtggactgccaatactgtgttacctaagggcgctttggcaaagtggcttcttgagcccaaagcagacctacagg

SEQ ID NO: 163714 - DNA, 601 bp, Human
cgtaggctaagcccacagtatgtgttcacattatgcctgatggctaggtttgaaaacttaatccctgcagaactccccctctccctctcctatttaatccactctctttctgccaggctctgccccacattttctgtccccaactccgtcccccgccccaacctccaatccttgactctccttagaaccctactggcaacaagcaactctgagcccgccctccttaattaaaccaaggaatgtggacagcagtacattgcatccttgcctgctcccaacttccagatttgttacctttgcygcattggagttaatgaaaagtgtgataaacccactgtttcattttcctttaattaacacaagcaattgaattgtgctaaagtcattttggtttggaggccaagcgcctggtcaatgtctcacttgctggcggtgacagaagctctttgttttgggctcagaaacctttctcaggctgtggccaccaggacctcctctgcgggaggagtggcttgcccccatccagggcggccatgctggctgccttccctgaggctgacagtaagttggctaatcacaagatcaatgtgttactgtgaaa

SEQ ID NO: 163715 - DNA, 601 bp, Human
cagggtggaggaaagctgccctctagaaacctgtgagggttatgaataggacttctccttttatcctagagatctcctggcatccttctccatcacatacctcctgatgtgagagcccccttcttttgaaggatacacatcagaaacatgcatgaatttggaattacggtagagttttagcatttgggacccagtatggctcatataacctgagtcttgtactgtttacccttcttcctagtccattgtccaagttgcaagcaccctgagtagatgtcacatcttctacttccttaactcrttacagcagctaacgtaggctaagcccacagtatgtgttcacattatgcctgatggctaggtttgaaaacttaatccctgcagaactccccctctccctctcctatttaatccactctctttctgccaggctctgccccacattttctgtccccaactccgtcccccgccccaacctccaatccttgactctccttagaaccctactggcaacaagcaactctgagcccgccctccttaattaaaccaaggaatgtggacagcagtacattgcatccttgcctgctcccaacttccagat

SEQ ID NO: 163716 - DNA, 601 bp, Human
acagaaaaacaactcaggggagaaggaccactggctggcctgctggctctgacctcactgcacttattctgctcacatccaggatgagcgaggtgttgtgtcagacgctgtggtgagggaatgggggcagagacaatatggaaaacaaggatcttcaccttgcatagtctgcaatctcatggggccaggactcaaagcagtttatatttttctgtatcttaggctcaattttttagttctttgtcatttctagatgcctcaagtaaggtgtagtgagtcaaacagatttattagagctgaragaaacctaactatttggggatgaaaaagatcaaacaggaaatccagagcaaaatatgggggcttcctgaccgacttctcttttctttctccctttatgtccttttgtgccagcgatatctcagccatcattcttgcatccaattttcctgtttattgcctcagccaattccttagagttataaagttaaaagaaccatgaggggtcaaagattttagccttccacttttttggattatacaaagtcctgacaaaatatcttatcttctctctgaatacctctggggacaattttaggag

SEQ ID NO: 163717 - DNA, 601 bp, Human
gaactgcaagtctgctcaacagttttgctttatagcaaaatgtcctgtagtaagacaataacccagaggcattatgaacctgctctaagcactccagcatcccaatataacaaggttggaagcaacagaaagcagattctgaatcactggaagaaatatgtaaaaactgaggctgtttccatggaaagagtgcctcaaagaagatgagttcaattcactgcattagcaaaattaagatctgcaaaaatacaaatgaggccattcatccggggatgtgggggttgttgcctcagatgcaggwtgcatccttggggataggatgagcagaagcctcagggttctgtggatctaagggggctttttcagtagggacacacattccaacagcacagtcacagaatacaaagagcatgaaacatccacaagcagggtctgttctgctagaaatggaggaacagacagaaaaacaactcaggggagaaggaccactggctggcctgctggctctgacctcactgcacttattctgctcacatccaggatgagcgaggtgttgtgtcagacgctgtggtgagggaatgggggcagagacaatatggaa

SEQ ID NO: 163718 - DNA, 601 bp, Human
aagcaagatggcctgtgagccattggaaagattctgaagatgtgttcaccaaggacttttttgtttttttttttttttttttgagacggagtttcgctctgtcgcccaggctggagtgcagtggcgggatctcggctcactgcaagctccgcctcccgggttcacgccattctcctgcctcagcctcccaagtagctgggactgcaggcgcccgccactacgcccggctaatttttttgtatttttagtagagacggggtttcaccgttttagccgggatggtctcgatctcctgacctcstgatccgcccgcctcggcctcccaaagtgctgggattacaggcgtgagccaccgcgcccggcccaccaaggacttttttaaaaaggctgtaagactgcaatattttccttgtcaaacaggaactgcaagtctgctcaacagttttgctttatagcaaaatgtcctgtagtaagacaataacccagaggcattatgaacctgctctaagcactccagcatcccaatataacaaggttggaagcaacagaaagcagattctgaatcactggaagaaatatgtaaaaactgaggctgtttcca

SEQ ID NO: 163719 - DNA, 601 bp, Human
gaaagaaagacagaggtggggtaagcaagatggcctgtgagccattggaaagattctgaagatgtgttcaccaaggacttttttgtttttttttttttttttttgagacggagtttcgctctgtcgcccaggctggagtgcagtggcgggatctcggctcactgcaagctccgcctcccgggttcacgccattctcctgcctcagcctcccaagtagctgggactgcaggcgcccgccactacgcccggctaatttttttgtatttttagtagagacggggtttcaccgttttagccgggrtggtctcgatctcctgacctcgtgatccgcccgcctcggcctcccaaagtgctgggattacaggcgtgagccaccgcgcccggcccaccaaggacttttttaaaaaggctgtaagactgcaatattttccttgtcaaacaggaactgcaagtctgctcaacagttttgctttatagcaaaatgtcctgtagtaagacaataacccagaggcattatgaacctgctctaagcactccagcatcccaatataacaaggttggaagcaacagaaagcagattctgaatcactggaagaaatat

SEQ ID NO: 163720 - DNA, 601 bp, Human
tggttgcaatgtaaagttctgattccatgctgcagataatggggcagaaggcaatcaatgttttaatcctctttactagctgccaggaaaccaaattgctgactatgagttaaaggaaggaaaacgggcagggagaaacagatgagggaggaacaggataggataggaaggagagggaggaggaaggaaagaaagacagaggtggggtaagcaagatggcctgtgagccattggaaagattctgaagatgtgttcaccaaggacttttttgtttttttttttttttttttgagacggagtytcgctctgtcgcccaggctggagtgcagtggcgggatctcggctcactgcaagctccgcctcccgggttcacgccattctcctgcctcagcctcccaagtagctgggactgcaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggcccaccaaggacttttttaaaaaggctgtaa

SEQ ID NO: 163721 - DNA, 601 bp, Human
ttttttttaaatatagattctgatccagtaggtctggagtggagtctgggattccacgtttctgacacatgcccaggggctgcctccatggctgggccggggcccccaccctgagcagtgaagctgtgatgcactgtgccgcgctgttcgtgggctctctcccacccacacacgtgaagtcttctagggtcagtgtgttaggaaaatatactaagagcccctcaggctgagacccttgtggagcctgcccctccaaggactcactgttcttggagtttagggctcagtaggctggctacaytgaggctgagaatcaggatgcatggattcttcatgatcttcccacataacatgcatcctcaccaaaacatgtttcttcgttgaaaaagggaaaatgttgttgaaacttctctccatctcagactcagtgaaggtgacttacctgttattttcttaactactttgaatgctgggtgaaatttttaaagcagaatgaatctaggttgctacttgcctggagacctaggaagctgtagggctgccctctccagttctggttgcaatgtaaagttctgattccatgctgcagataatggggcag

SEQ ID NO: 163722 - DNA, 601 bp, Human
tcaatctaagcctttttaaggattaaacaacaatggaatcaaacacatcaaaatgacgttccagacacctcgccattttttttttttttcctgaaagaaataaatgtggtagaatgagaagcctggatttctactacgatgactccattattttttcaaaatgtaccacagaggattttgccatgagtaattaaattgcattgcatttaaccaaacacatgggctacctgctgagggcctggctagagtctcaggcagggtcaacgttcccctttccttagagagaagaaagacccagatmatgctgcttggtggacctcagccagatgccttaaaagcttcagataaaatgagatccatgaatgccagtagacttagaaatgttgacctacacgtagggaggggatggtttcacagaatggggaggcccgtgtgcatttacatgggtaagacaggtcctgcatccttccagtggaattaccagatgacatggcaacttctggaatgtgggatttgttttcactgtctgtgatgctgtttttatgggaccagttatgcaacagcagaaatggaaggaaggaaggaagaaaaagtgcatttc

SEQ ID NO: 163723 - DNA, 601 bp, Human
tcatagtgaaagggattctgagattactttttaaatgaaatttaacaaagaaaaattagttgatcaatctaagcctttttaaggattaaacaacaatggaatcaaacacatcaaaatgacgttccagacacctcgccattttttttttttttcctgaaagaaataaatgtggtagaatgagaagcctggatttctactacgatgactccattattttttcaaaatgtaccacagaggattttgccatgagtaattaaattgcattgcatttaaccaaacacatgggctacctgctgagggmctggctagagtctcaggcagggtcaacgttcccctttccttagagagaagaaagacccagatcatgctgcttggtggacctcagccagatgccttaaaagcttcagataaaatgagatccatgaatgccagtagacttagaaatgttgacctacacgtagggaggggatggtttcacagaatggggaggcccgtgtgcatttacatgggtaagacaggtcctgcatccttccagtggaattaccagatgacatggcaacttctggaatgtgggatttgttttcactgtctgtgatgctgt

SEQ ID NO: 163724 - DNA, 601 bp, Human
atctacaggtggtgggttgagtaggatggatggacacaggccaagcagattgcaacttcctccctcctgagtccctcaagcttccccatgtggctgagcccactgcatccaggcttccagcactcaccatacaatgtgatgctggcattggtgttcccaagcttgttcgtggccacacaagtatagttcccataatccttttctgaaacattgaagaaagtcagagtggacatgcggcctttgttttcaatcctcattccatccagaccagtggctaacctgcaagagggaagacattgcyatcaattcattctacaaagaggccctcctcctcaccaaactcttttctccaactaatctcgtccttcaaactcaaaccctaagcacttcagtgtccaacaggaggagaagggaaatgatgctcttgcccaatgggataaatgtactggcttctaattcccaacgactgacatgtctacaaccagtctcagattcagaatcatggtcagttcattttctccacttcccagcctcctccattttttttctcgttgtaaaaatagactttgttacaaaagagggcatagtatatttctgtttt

SEQ ID NO: 163725 - DNA, 601 bp, Human
acatttcagatggttggtggacaaagtttacttaatgtcagtgctgaaagcttgtgtctgaggtgcacgtggaaacgtggatacctctcttcatccttcatcctctcatcctactcatcggatgcttccctctaatcaaacctcagcaaataaacaaatacatatgcacatacagtatcacaacaagctggccctggcccatggtgtgaaatgttgcagaaggatatggatgcggcagtgtgggaaaatggagttagggagacataggggctttaaaggaggtcagtcctggctcccaagmcttctccacccatatgggagggaaagatcttcagagagggtttgctgctccagttgtggatagagcagccacctgataaggtctcagactactactccattcttccccatggatgagaatacgaaatgcaagcaacatgagaatcatgatggaagcaggtgacttggtttaaagcaacaaatatcacccccagaatcagagactccaactacagaaggcatcttaaaattacacagttgaattgacccatggttctatcttctttatacaaaaaccattctacctgattcacagtttggt

SEQ ID NO: 163726 - DNA, 601 bp, Human
ttccagttctggaagcagagctgagcagcagctactgcttcttctaaatgcctcagcgactgtgtaagagtgtgtgtgagtgcatgcatgtgtgtgcctgtttctctttgctgacgctgtgggcaaatgctccaatacctaatacagggctccatctctaggtctcatccagtatctattcattagctaagtggtcttcagtgttacccaagctctttagtcctcctttcacttacctgtaaaatggggttaataacctgccttgcacagccctgacatgatgcctagaaaccagtacacrtttggtaaatagcagatattatgattataataatgatcccaagtacttttattttaaaataaagtttttagaactaaaccattagccctgtttgccttgggctaaaagaataaaacattcatagtagggtgacgtccccactgagacagttatctattaatccagttggtctctgggctgggttgctcttggtgctgctgtgtacagaaatagcagaatgagcattcttttcaaagatgaccaaatataaggttcttgttttgggggcaaaaaccccttcccctgaaacacataaagcta

SEQ ID NO: 163727 - DNA, 601 bp, Human
gatagcatgggccatgtcacaataagtgttggcgggtaccagtagaaacacgacagtattcagtgagtcatgccgctttgatgaacattgtcttattgacaattcacagtgacactctcatgtccacaggtcagaaaatatcaccctacttagccgagtggactcaggcctgtggtttttgtttgtggtcgaatccacacatctaaatgtagcatttatgggattctgaatggacacaacctgatttaatcctgtcaccagtctcttgaagcaggcgttaatgtcccaatagcatatatgygggaaggaagactcagcaagtttaagtgaattgggatgtgaaggctgaattgggatgtaaatgtctgcctgtgctatgggctgaatcgcatccctctactaccgaatgtctatgttgatgctctaacccccagtatgtctgtatttggaggtggcacctatagggaagtaattaaggttaagtgaggtcataagggtgggaccctgatccaatatagttactgtccttatcagaagagacaccagaaagctccctctctctctttttctatgagaattcagaggagaaaccatgtgagga

SEQ ID NO: 163728 - DNA, 601 bp, Human
cagaggccatcaatcttcagtgtgcataggattccctgggagagcttcttaaaaagtacattctcaggaccttccctagagatttcgattaaatgattctggggcaaggctcacatatctgcatttttaaagcatccggaataaggctaatgcaggccaacaaatacctcaccactgggtgcctgaaggtacagaagagcccttcccctctcaccataggctgacccccgggaagactgatagggcaggtgccggaggagctagaagcagactgaggaaggtaaggagacagtcaccaccmggttatatcacataagccagaagtggggcattgtggggtgagaggggctctggcactgagacgaggtcgggtgttagagggagacagatcgtggtagctgaggcataagtaggtttgagaaaggcagatacaatgcgaattctccctcccagaggcctgtggctggagggaagaaaaggcacgggtgaggcatggaggtcgcactgaagagaagctcagtctttgtgccccctctccatgtcccagctagagccacctggggataggtgtagttgtgaagacgccctaatacagacatgg

SEQ ID NO: 163729 - DNA, 601 bp, Human
ctatattttattgtaactgtctatttacttgtttgtgcaagatcagaaattctgtttctcctggtactttagtccttagtataattcctggcatacagtaggcactaaacaaatatttgttgactagatgaatggatggagggatggatggatggatggatggatggatggatggatggatggatggagagtggcaacagcatgatgtgtaacgggatctgggacacagggggcccagcctggtggatgcagggaaggttgcaggtggagtgctggggacacttgaagctataaggctacrctgatctcacagcgagaacagccttaatgccaagctgttctgggaggcagaagttttcagcaatcgaaatgacaaggttcattctgagttttggaaatgtcacttggccctgctgtggcaaaccgacaggagttggattgccgaagaaagatgagggaaccagtgagaggatatcacaattgtccatgtgagacgtgtgccacaatgtgagtgataatggagatggagaagtcagaggaaaggccatttggtgggacttgatggctaacagatgtgaggagtgagggagaggaggaagtc

SEQ ID NO: 163730 - DNA, 601 bp, Human
tcattggctggaagatatatttattaattcaacaaacagttactgggcaacgctcactggaagatatagtgttacatcttctaagtgcagaaaatgacacaaacaaaatataagcataggggtaatctaccatgagagcccaaaagatgagggattgattcttcagcggagctcacaaatgctttacatatggggcatcattgagcagagtccagaaagtatgcactcatcaggcagagaagagggcacaagcctgcctctgagaccctccagcacactgggagacacagtatatgggttwgaaagaaacaggggattaagatcagacagacctaggtacaaaacctgctgctgtcccttgccccttccatccatggtggaatccctcctacctgggggaattcagtaacatcatttgttctttgagctctaggctcttcttctgtccaatgaaaaatgataacaatatcaatctcaaagtgttcttatgtgtctaaagccatgtgtggctgacactcgatagctggcagcttcttcattcctcaagcatggcacttcctatattttattgtaactgtctatttacttgtttgtgcaagat

SEQ ID NO: 163731 - DNA, 601 bp, Human
ggagttgaaaaataaaaatcatacacgttatcagcaggaaatggacaaatatgtgcagcttttgatgtctctgcaagaagatatcatgtgatgaacgtcttcctaaacagagaattggaatatgtggtatagcctccttcaaaagggagatctgggatgggggtccctaaattttaaattagatttggaacatacaggaggccagaacgcaagggaaagtcagaaaaatagtcatttggcttccctgaggggaggggactacaagtcctcttgggtatttggcttttctttggttagtgaraggtatgaaactgtatagaggctataactgatgccctcattggctggaagatatatttattaattcaacaaacagttactgggcaacgctcactggaagatatagtgttacatcttctaagtgcagaaaatgacacaaacaaaatataagcataggggtaatctaccatgagagcccaaaagatgagggattgattcttcagcggagctcacaaatgctttacatatggggcatcattgagcagagtccagaaagtatgcactcatcaggcagagaagagggcacaagcctgcctctgag

SEQ ID NO: 163732 - DNA, 601 bp, Human
gggggaaaatacaaatgattacgctgctgtcatcagccaaaagcaatggtgtttctctctgactcattcccttcccacctggatttaaattgtggagttgaaaaataaaaatcatacacgttatcagcaggaaatggacaaatatgtgcagcttttgatgtctctgcaagaagatatcatgtgatgaacgtcttcctaaacagagaattggaatatgtggtatagcctccttcaaaagggagatctgggatgggggtccctaaattttaaattagatttggaacatacaggaggccagaaygcaagggaaagtcagaaaaatagtcatttggcttccctgaggggaggggactacaagtcctcttgggtatttggcttttctttggttagtgaaaggtatgaaactgtatagaggctataactgatgccctcattggctggaagatatatttattaattcaacaaacagttactgggcaacgctcactggaagatatagtgttacatcttctaagtgcagaaaatgacacaaacaaaatataagcataggggtaatctaccatgagagcccaaaagatgagggattgattcttcagcggag

SEQ ID NO: 163733 - DNA, 601 bp, Human
ccttaacacaccctgttttgtgcttactacaaaaacaaaagcttaagaagttaatatcagaagttaattcaaatccgtcagctcatcacaaacctggaagagacaagacttgagtctttgttgaaccataagctctgtgtctgtgctgacatcagcacaccctgaacgctcaatgttaaattctaaatgctcaggctaatagccagatgtcaatgattcagagcgaggagggcggggtacgagcaaaccacaaggaacctcatcaagaatgaaatgggaaatgtctgcagtttttttctamtatgttgacattttgcaggttgggggaaaatacaaatgattacgctgctgtcatcagccaaaagcaatggtgtttctctctgactcattcccttcccacctggatttaaattgtggagttgaaaaataaaaatcatacacgttatcagcaggaaatggacaaatatgtgcagcttttgatgtctctgcaagaagatatcatgtgatgaacgtcttcctaaacagagaattggaatatgtggtatagcctccttcaaaagggagatctgggatgggggtccctaaattttaaattagattt

SEQ ID NO: 163734 - DNA, 601 bp, Human
atttttagaggtgctggctgatgaaggcacatcacttcccttcaaagggaacttttcctccattgagtttaattacagcggcaaacgtggcgctgtgttgtttcacaagtaagatcaaccaacgaggctctgcagcacaactgaaaccagtcgataaagaggcaaccatctttcttctgttctccttaacacaccctgttttgtgcttactacaaaaacaaaagcttaagaagttaatatcagaagttaattcaaatccgtcagctcatcacaaacctggaagagacaagacttgagtctwtgttgaaccataagctctgtgtctgtgctgacatcagcacaccctgaacgctcaatgttaaattctaaatgctcaggctaatagccagatgtcaatgattcagagcgaggagggcggggtacgagcaaaccacaaggaacctcatcaagaatgaaatgggaaatgtctgcagtttttttctactatgttgacattttgcaggttgggggaaaatacaaatgattacgctgctgtcatcagccaaaagcaatggtgtttctctctgactcattcccttcccacctggatttaaattgtgga

SEQ ID NO: 163735 - DNA, 601 bp, Human
agccatgaaggtattggaatgtgtcactggttttcctttccatgattacaatgaaaatatgacatcgatctccagcaaccataaactatatagctgaaattctactaaaatggcagatggtagggtgaccacactaaaaaagaaaagaaaaaaaaagcccctaggcaagttgagcttgttgacagcacagtgagattaatgaaatatctgaagtctaagaagatacggttttgttctgaaatctggataggttttgtaagtatgattatgaactgtgtgaccttcctaatgaggaaccaaraggataatgatgttcttggtgattaaaagaggagcaaagaaatctaattagatgatgtatgtgttacacttgttggtgaaacataaagctatttttagaggtgctggctgatgaaggcacatcacttcccttcaaagggaacttttcctccattgagtttaattacagcggcaaacgtggcgctgtgttgtttcacaagtaagatcaaccaacgaggctctgcagcacaactgaaaccagtcgataaagaggcaaccatctttcttctgttctccttaacacaccctgttttgtgcttac

SEQ ID NO: 163736 - DNA, 601 bp, Human
ggcctcccaaaatgctggaattacaggcatgagccaccacgcctggcctaaacattagattttttagaagaaaatttggttgaaggcttaaaacagaataaagccacacctaccacataagaacggggaatttcaagcctggccatcctggcactaagcttttgctgctgcattcaggggtggctcaccaccctcttgagtggcaggtgttgacaatcacagtacccaaactcagcacagagctctcagaaaaaaatatagaagcttcctgctgagatcctgcctcatgagagattttgargcttaaaaatgtagtgtatataacaagccatgaaggtattggaatgtgtcactggttttcctttccatgattacaatgaaaatatgacatcgatctccagcaaccataaactatatagctgaaattctactaaaatggcagatggtagggtgaccacactaaaaaagaaaagaaaaaaaaagcccctaggcaagttgagcttgttgacagcacagtgagattaatgaaatatctgaagtctaagaagatacggttttgttctgaaatctggataggttttgtaagtatgattatgaactg

SEQ ID NO: 163737 - DNA, 601 bp, Human
attccagcacctcctccttcaccctttttaatgttaaaaattaatggcttcttcatgcctgaagttaagcatctttaaaaatataagctgaaatgaagatgcaaagccacaaaataaactgagtgacaacacagtgacaacaacaaaatactttggggacaggtatacagacaaataagatttcctttagaatatagaaagaatagttagagaccagatatggttaagagacaagtttcagaaatgacaaagggatccatttgtgtggacattatggccagagcaggtccatgcagctacragggaagctcagcaggggtaagacacatagcaacaacaacaacaaaaatgaacaaataaaaattctacttttgagaggctacgtgtcttggtaaattgctaggtttgtgcaaaagtcatcatggtttttgccattactttttttttagagaccgagtctcactctgtcacccaggctggagcgcagtggcacgatctcggctgaatctgcctttcaggttcaagtgattctcctgcctcagcctcccaagtagcagggattatgggcatgcaccaccatgtctggctaatttttgtattt

SEQ ID NO: 163738 - DNA, 601 bp, Human
tgggcaatgaactcattctttaattgcatctttgcagtagccctgtgtaactggaaatgaggaaaagaaagtttctgggttagttctctcccactaggctgctgtatgctacagttgctcacctaacttggccaaatgcttttctgctttaatataaaagtgatgggttgctgcaatttaagtaatttggtgtggtcccatggcctcggggctcacgtttggtcccatgggttaccatgaggcttttgtaaatgttagctcaacaaagctacagagccacctgtgtgacaggggaggacayggttttgaaggaactattcaggctgagctcagcagtggtagcactgaagcttgcatacatggcttcagagtcagattgagtacagttttcttagagcatggcctcggctggtaacagctgcatggacttctccaggtacttggtacccaagatgatacaattttgaatttcaatatatagggtcagaaacccagatgtttgtatttattcatttattggtaaaaattggaagaaaggtgattcttctctaaaacctagaatactagaggcagttttttttttttttagatggagtctcgc

SEQ ID NO: 163739 - DNA, 601 bp, Human
caaaagccatgggcaatgaactcattctttaattgcatctttgcagtagccctgtgtaactggaaatgaggaaaagaaagtttctgggttagttctctcccactaggctgctgtatgctacagttgctcacctaacttggccaaatgcttttctgctttaatataaaagtgatgggttgctgcaatttaagtaatttggtgtggtcccatggcctcggggctcacgtttggtcccatgggttaccatgaggcttttgtaaatgttagctcaacaaagctacagagccacctgtgtgacagsggaggacatggttttgaaggaactattcaggctgagctcagcagtggtagcactgaagcttgcatacatggcttcagagtcagattgagtacagttttcttagagcatggcctcggctggtaacagctgcatggacttctccaggtacttggtacccaagatgatacaattttgaatttcaatatatagggtcagaaacccagatgtttgtatttattcatttattggtaaaaattggaagaaaggtgattcttctctaaaacctagaatactagaggcagttttttttttttttagatg

SEQ ID NO: 163740 - DNA, 601 bp, Human
aaagggagacttagcaggtatgtaggctgctcagcctgcttagggcaatgatgacaacacacgttcacaccgtgctctccacgtggcaagcacgattctaaatgctaaacatataatcagtcatttaatcatcacatcaaccctatgagctatgtgctactgtcattcccactttgtaaacaggaaaactgggaacagagcagttagacatcttagctatggccacgcaacttatgcaccttgagctggattagaaccaagtcactgtcctcagaatctatgcccttaattgttacaagtmtacttcctctctgtagaaaatgaccatttgtgcaggttttccagggaccacagtatcatggtgtgagagaaacaatggactgggaatgcagtgtctctgtatgaatgtgctgcaccctagctgagtgacgttccctctccgggctttgcttctcgcattgcaaattgagaagagatggggtttgatgacctgtgaggtccttcttctattagctctctgagttattacatgaatggaaattctgcatccaggtgttaggagagatagttggtgagtagccagacagccttcttcagttga

SEQ ID NO: 163741 - DNA, 601 bp, Human
cccatgggttttaaaggctggaattaggcttgtcccagcagtcagtgctgcctccctaaaggccttgaagcagatcaacatgcccaaaacagactgcccctgaagattccacccaaggggctctcccttgatttttttctagcttctctctctctctctctctggccccttcctgtatccccaataaatcattcaaggtccaccgggaaataagtccacagtatcatgagtgctgttcttttcccctcaccttccatggctcaagaagacaaatcacatgaattggtattatcctagcctrcttcaagggcaggtgtatctaacttggaccaggtgttcctccatcacctttatcagcaagcacatagggtggtacgcaagactaggagccagcagcaagtgtatcccagaaaaagcaaaatctattattaccaagggattaaaagccattacgaggcatttctataaaactagtgaagaagcaaaggagattcaaaggagacagtacacctcttctaccatctcaagccaggacttcacagcttctttgagaagcaaattggcctactggaaataagctgaggtgcagcagaacctcttt

SEQ ID NO: 163742 - DNA, 601 bp, Human
cttgaccaatgcagcctgctctgaaagactatgcttaaaaagtaaataggtgaagctcaggctagtcattgaggcccgtgggcccaaaggttaaggcaacacatggaaaggcagacctgctggctgttttctaatcagtgcctctaactgtgtgctatacttggagagtgtccagtacagacaatgatgagtcggggggcacaaggccagagaggcaaggagcagatggtggggtaggaaggggagacggatggagacataagtccaagtgttgatgtagcagacttgtcaacctcaatgmatgcaacctaggtgttgtggaggctcctcctgcagcagctaaggaaggaggaacaatcatccccatgggttttaaaggctggaattaggcttgtcccagcagtcagtgctgcctccctaaaggccttgaagcagatcaacatgcccaaaacagactgcccctgaagattccacccaaggggctctcccttgatttttttctagcttctctctctctctctctctggccccttcctgtatccccaataaatcattcaaggtccaccgggaaataagtccacagtatcatgagtgctgttct

SEQ ID NO: 163743 - DNA, 601 bp, Human
ccattccaagtctaaacaaaggaaaaagcccattgggagtatttaggaactcaaaggggcaagctgttgggatgccttgaccaatgcagcctgctctgaaagactatgcttaaaaagtaaataggtgaagctcaggctagtcattgaggcccgtgggcccaaaggttaaggcaacacatggaaaggcagacctgctggctgttttctaatcagtgcctctaactgtgtgctatacttggagagtgtccagtacagacaatgatgagtcggggggcacaaggccagagaggcaaggagcagrtggtggggtaggaaggggagacggatggagacataagtccaagtgttgatgtagcagacttgtcaacctcaatgcatgcaacctaggtgttgtggaggctcctcctgcagcagctaaggaaggaggaacaatcatccccatgggttttaaaggctggaattaggcttgtcccagcagtcagtgctgcctccctaaaggccttgaagcagatcaacatgcccaaaacagactgcccctgaagattccacccaaggggctctcccttgatttttttctagcttctctctctctctctctctg

SEQ ID NO: 163744 - DNA, 601 bp, Human; identical to SEQ ID NO: 122642

SEQ ID NO: 163745 - DNA, 601 bp, Human; identical to SEQ ID NO: 122641

SEQ ID NO: 163746 - DNA, 601 bp, Human; identical to SEQ ID NO: 122640

SEQ ID NO: 163747 - DNA, 601 bp, Human; identical to SEQ ID NO: 122639

SEQ ID NO: 163748 - DNA, 601 bp, Human
tagtgtatccgttttctcacttccatttatcagtataatatatttaaaattgccctaagctgagagttggtagatccgagtccactattttttgtgatattaaccactttggctatcaatttctatttatataaaaatcagtaggggaaccagatgatttctgaggtttctccaagtcctgtgactctttgatcgtgggaaataatatcagtagtctaccatgtgtaatgttccacagtgctttaaaatcacacaaatgaagaacatatatgtataaatatatacataaaggagatggcayagtttaaatgttagtgaattccatgaagaacctatagattgaaccaaataatttttttccacaaatcttagctattttcaacttgtttgtacttaattttcataatatttgtggaggtatttgaagatattaggttaagtttaattaatttaaatctgtagtataaggctctgaaggctgtaatagtgtgggtcccataagtctaggagtgatgtattacttaccttggtatttaattatgggaaaatgaaaaataatggaacatttattttctttaaaagttatctctctcaaaataag

SEQ ID NO: 163749 - DNA, 601 bp, Human
gtggtatagtctaaatatagagcaaaaagtatggtaatccaaaccacttctctgatacatcaaaagttaaaacatgggtcaaaaattagttaaggctctttgatttatgcagcacaacatatcaataaacagaattcttttttttccagaataagggatggtgtgaaaagggtatgcaataaataaataagcaagcatgaggacctggcagtagggttcttacatctctcccttcctttcctggtttccaagacccctctccttgctataagactttgtttttgttctaaatgcctgtgawtgctaatttggggcaaaagagaaaaacgagaagactgtctttttgcacccccttttctgttttctttgctgtctctgttgggcattactctctaggtttccttggatcctcctgctcctctgggcagcctccttcagtgaagccctcagccaatgccatgagccttttctttcattctccagtctgtgaaaacacatctgtactgccgtctttttctgcatgtgctccagttagatagttaaagaattagtggcaataaatcacttaattgtacagtcaatctactcatcccctcaccca

SEQ ID NO: 163750 - DNA, 601 bp, Human
gataatccatgtaaaatacttagaaccctgcatggcagtgtaagtgctcaataaaaatcagctgctgcttttattatcaccaccccttccagtgtctttttgtgtgtgtgtaaaaaggcagtggaagttccttgggataaagatatgttatgataaagattgtttgataattaaaacaattaaataaataaaactttctagcactattgtaaatctcagacactggcaggtactaggagttcaaatatgaacaagaagctcacaatctaatgggggtaaattgatgtgcacacaatcatartatagtaaggaaggacttaataacacaatttgtgccaaggggatagttaaagaaaggtatcacagagttactgacattagaattgagtctgtgggcccagtagagacaacgactttggcagatggagaagaagaggagcagaggttcaagcaaagtgaaaagctccgcttaaaacagagagcggctggaggggagtggtgtgaggaaggcaggtggcgccaggctttaaaggatcttctttgcatgctaagaaaagtgaaattcattgaacttattaaaaccatctagcaaggggagtgt

SEQ ID NO: 163751 - DNA, 601 bp, Human
ttaaaggatcttctttgcatgctaagaaaagtgaaattcattgaacttattaaaaccatctagcaaggggagtgttatgattatctttaggtttattaaaataattttgagaatagcaatacaacgtcatacaaaatgatcagttaggagagtgtggtctcaggatgatatgatgtgagtttgaacatgaacactcgagtgcagatgagggagcagactgtgtggtttttagaaaagagacactagaatttggagcatcgtaagcatggctagacaaggacaaggaggcctctgggccccrggttgggtgaccaagtgggtggtgacaactttgtcttcagtcttcttctcatgtatttcagccttgagtaagtgagagatgggaagtttttgtttttattagcaaagaaagagaaatgtagcagatttattaagaatgactaattgtagctcttaatcacactagttctttgtattcttacctaagaaagttggcaaactaataaaatgtgcaactatttttatatttaagtttggttttctgtgtaacctacactttttattttatttatttatttatttatttatttatttatttatt

SEQ ID NO: 163752 - DNA, 601 bp, Human
taattcctaaaatctttaattccttgtttgatgtaaaatatgttattcaggatgagacttgctttttaaggtatagttttctgagtgttgtacctattgtgctatggggctgtactatggggcaagtagtggccaaagacataaattcatgagtttttgttatttgcaatatttgtagttttctatacagttatattctgatgcttttcttttcatgataaaaagcaatcagaatataaaatatgttatgtatgtacttggaactgccatgtacatacctgggtatcatcattgactaaayataagatttgtttgaaagttatctcaacacaagtggtaagtggaattaaaagtgcaatttattgaatttttagatttgtaaagaatctaataacagattcatgatgttttctttttaacagatgggcttaggtcacgagcaaggatttggagccccttgtttaaaatgcaaagaaaaatgtgaaggattcgaactgcacttctggaggtattgttttgaaaactgcaaccacattagtaatttatactttttgcaatacttcctcagacagtggagatatcttcgagttctccagcatgg

SEQ ID NO: 163753 - DNA, 601 bp, Human
tattgtgctatggggctgtactatggggcaagtagtggccaaagacataaattcatgagtttttgttatttgcaatatttgtagttttctatacagttatattctgatgcttttcttttcatgataaaaagcaatcagaatataaaatatgttatgtatgtacttggaactgccatgtacatacctgggtatcatcattgactaaatataagatttgtttgaaagttatctcaacacaagtggtaagtggaattaaaagtgcaatttattgaatttttagatttgtaaagaatctaataayagattcatgatgttttctttttaacagatgggcttaggtcacgagcaaggatttggagccccttgtttaaaatgcaaagaaaaatgtgaaggattcgaactgcacttctggaggtattgttttgaaaactgcaaccacattagtaatttatactttttgcaatacttcctcagacagtggagatatcttcgagttctccagcatggttgctaagttgcagacctgttactgtcttttctgagaaatgaatacaacataaaaagtgttctgtcttactgtcattaagtttgacttagtgaa

SEQ ID NO: 163754 - DNA, 601 bp, Human
aatctaaaatcagtatttgaaacctgtgcttatgaatgactgtcaagtccatagtggtaattcacaagtctgctcaaagttagaattagcaggaaaaaaaaataaagataactatacagttttaggatggcagctaccttgttaggatgactctcatttgagaaacacttctgtactacagatttccacaggaaaccgtttagaatactttcatcagctcttggagatgtgtacagtgtaaattaaaggagaatataaacaaataaaattttagacattaatctcttttaaaaactagttyattgaatcagttttcagaaacaaagataattgtttaaaataggaaagtcagtagaaacctgctagaactgatacagttcttcagttttgatacaattcttcagttttagggagctaaagttttccagaatttttttttacaagacttaagcagctctcccttgtgctgtctcttcaagggacatagaagtggcagtatgtctctcatgttttaaaaaggtaaagtgacttaacacaaaatagttttcatgaattagaacatctctgctcttaatgctcacactattttctattgggccta

SEQ ID NO: 163755 - DNA, 601 bp, Human
gattttctgctggcacctcccattgtcccattgccagtgacaagggatcccacaggtgtagtccttaaggatcagccttctgggaaatagcacagagtactgaggcatggagaatgaatctggagaggtgaatggaagatgccggatcaaggtgtatcaccatagttgcaggagactaaaaattaattattaggaatttagagtgaacttgtaacttaactagtctaacctcattttacagatcaaagacctaaaccaaaggaagttaaaatgacttgtttgagcccatgagttattaatratataatttgtgaatgatttctatgtgtcacacaccagtaagcacttgtaataattttctactgctgcataacaaattactacaaactttgcaagttaaagcaacaactgttaactcaacatccatcattattattattattattattattattatttttgagatggggtttcacccttgttgcccaggctggagtgcaatggtgcgatctcggctcactgcaacctctgcctcctaggttcaagtgattctcctgcctgcctcccgagtatctgggattacaggcgcccgccaccacgc

SEQ ID NO: 163756 - DNA, 601 bp, Human
caccgtgcaaacagccccttgcacatgggtattgtgctcacccatactctgtttgtgtttttgttttaggtttgtataaaaccacgtttttaaagttcttcattttcttaagggtagaatctgggttagtttaggctgaaattgaatatgtgataaacgtcccacttattctcaggccgctcttggataacaagatcacagtggcatccttttcttctccaattccacaacaaggtttttcttttaataaatgtattggattgcttccaaatgactttgaaagtttttataggtatttctraaagtaaaatgttttagtttaaatgtgggagactcaaatataaaacactgtagattagaactctaagaaaaatatttttaaaacctaaaactaggtaagtggtaatagcacagatttccacaatagatagctcctggcacctggtgctgattttatagtatgttttcttgcagagtagtttgtagctggctcttctccttgtagaaatggagctccagtgtaaggcttctggaagggatgtggtcatcccaactgttttaatgatgacagctctagttgaagagccatcccacccttctt

SEQ ID NO: 163757 - DNA, 601 bp, Human
tcagaaatcatcaggctttatttcacttgtatcttttattatttatctttcagattctaaaatctgacccttattttgtggtattcatgttgtactggtgtagaacatagattgtaaaaatttccaaagtccagtgtttattatacggcctcgatcctttaagataccactttgctaattattgggatgcatgctgtagctcacagccatataaggatctatttagctatattaagaactaaattcccactccaccttcttcccccctcaggaaggtataattttaaacttgaaccaaaarcagtgtgatagttttataaataattacattgtttttgttaaccaaagagtaaaagtaaagaacatgctgtagtaggataacttgctgctttccactagatgggagtatgagataaccagatgttagaaagattattttatagctgaactagcatatgcaaattcttcaacaaattcttaccaaataaagatttctgactagtgtgcacaaggaaagcaatttgcctcttcaccacctatctctctctctctctctctctctctctctctgtctctgtctcggaatatacaagtcaaatct

SEQ ID NO: 163758 - DNA, 601 bp, Human
tatctttaccttgtctcacaggcatatcaaatttatcagtggtttcattttggagacttccatcaaccttccccactccatactgcaaaactgttcatcttttgaatatactatcttaataaattatattcattctactaatttactcatcccagaaacttggttttatttttcaagagactgagtgtattagtctgctctcagttagtcaagacatacccaagactgggtaatttataaaggaaagagctttaattgactcacagttcagcatggctgggaagtcctcaggaaacttacmattgtggcaaaagaggaagcaaacacatccttcttcacatggtggcagcaagaagtgcctagcaaaagggagaaaagccccttataaaaccattagctctcatgagaactcactcaccatcacgagaacagcatgagggtaacaggccccatgattcagttacctcccaccatgtccctcccacaacacgtggggattatgggaaatacaattcaagatgagatttgggtggggacacagccaaaccatatcattctgccccagcccctcccaaatctcatgtcctcacatttcaaaaca

SEQ ID NO: 163759 - DNA, 601 bp, Human
tcatcccagaaacttggttttatttttcaagagactgagtgtattagtctgctctcagttagtcaagacatacccaagactgggtaatttataaaggaaagagctttaattgactcacagttcagcatggctgggaagtcctcaggaaacttacaattgtggcaaaagaggaagcaaacacatccttcttcacatggtggcagcaagaagtgcctagcaaaagggagaaaagccccttataaaaccattagctctcatgagaactcactcaccatcacgagaacagcatgagggtaacagsccccatgattcagttacctcccaccatgtccctcccacaacacgtggggattatgggaaatacaattcaagatgagatttgggtggggacacagccaaaccatatcattctgccccagcccctcccaaatctcatgtcctcacatttcaaaacacaattatgcccttccaacagtcccccaaagtcttaactcactccagcattaactcaaaagtccaagtccaaagtctcatctgagaccaggcaagtcccttctgcctgtgagccagtaaaattaaaagcaagttagttacttcctag

SEQ ID NO: 163760 - DNA, 601 bp, Human
gaccactgaaggtattcctctttatacccaatactagagacttttctttccttttctcctccccagatacacacccacatacacagtttacacctatgtttcatacatcgtccagatctcaacctaaatatcatcttcttatggggtcccttcttcacgagtttgaagtccaaattacaccctctcaagggaccctatactttctttcctatcacaaatgaaattttctctgtgtatgtgtgtgtgtgtgattatttaatgtctatctcccaccagagagtaagttctagaaatcagagastaggccccttttttttttttttttttttaagcactatgtcctagtgtcaagtacattgcttggcacatgggcactcgtgtatgttgcatgaatgaatgaatgtctgtgtgccagaccagagtgaagaagagaacattgtccttgaactataagaaacaccatgatggcagagagcacatggtaggtggcaataagtgtttgaagaaataaaataagggaaggaaagagaaaggaaaaacaaagggaaggaaatggagggcaaaagaaattgagaaaaaaatgagaaaggctgtaaaccta

SEQ ID NO: 163761 - DNA, 601 bp, Human
caatactagagacttttctttccttttctcctccccagatacacacccacatacacagtttacacctatgtttcatacatcgtccagatctcaacctaaatatcatcttcttatggggtcccttcttcacgagtttgaagtccaaattacaccctctcaagggaccctatactttctttcctatcacaaatgaaattttctctgtgtatgtgtgtgtgtgtgattatttaatgtctatctcccaccagagagtaagttctagaaatcagagactaggccccttttttttttttttttttttaagcactatgtcctagtgtcaagtacattgcttggcacatgggcactcgtgtatgttgcatgaatgaatgaatgtctgtgtgccagaccagagtgaagaagagaacattgtccttgaactataagaaacaccatgatggcagagagcacatggtaggtggcaataagtgtttgaagaaataaaataagggaaggaaagagaaaggaaaaacaaagggaaggaaatggagggcaaaagaaattgagaaaaaaatgagaaaggctgtaaacctaaatctaggattatagtctttgatgggaa

SEQ ID NO: 163762 - DNA, 601 bp, Human; identical to SEQ ID NO: 37978

SEQ ID NO: 163763 - DNA, 601 bp, Human; identical to SEQ ID NO: 37979

SEQ ID NO: 163764 - DNA, 601 bp, Human; identical to SEQ ID NO: 37980

SEQ ID NO: 163765 - DNA, 601 bp, Human
ccttaaagcacagcccagggaaacctcctcacagttttcatccagccacgggccagcatgtctgggggcaaatacgtagactcggaggtaggcatccgtgggggggcgccggctcgggcgtgcggggagtgtccgcttctgctatctgcctctccaaatatcccgactgctgccctggccccagccctctctccacttcggagcactcctctggcgttggcaccgctgaggaatgggcctgggcggggaggtgaagagaagccaggaatgttttatgttttcctaatggagagggggcctmgggagcccctgagctaggaggacacggaaaaggggattggggtcctgagattgggtctgttgggcccaggacgcgttttctggatgggtctaggatgctcccctgtcgcgggacccccgcggtccggccctgcctgctgggggttcgaagaggtggagtgcagggtggaggtgttatttacccgagtcctggggacagtccccgggactctccgccaggcgcccagaccggcaggtcccgcaggcggcgcgcggtgtgtttgcactttccaaagttcttgaaccatctcaagaactcctt

SEQ ID NO: 163766 - DNA, 601 bp, Human
gggcgccggctcgggcgtgcggggagtgtccgcttctgctatctgcctctccaaatatcccgactgctgccctggccccagccctctctccacttcggagcactcctctggcgttggcaccgctgaggaatgggcctgggcggggaggtgaagagaagccaggaatgttttatgttttcctaatggagagggggcctcgggagcccctgagctaggaggacacggaaaaggggattggggtcctgagattgggtctgttgggcccaggacgcgttttctggatgggtctaggatgctcccytgtcgcgggacccccgcggtccggccctgcctgctgggggttcgaagaggtggagtgcagggtggaggtgttatttacccgagtcctggggacagtccccgggactctccgccaggcgcccagaccggcaggtcccgcaggcggcgcgcggtgtgtttgcactttccaaagttcttgaaccatctcaagaactccttctgcatcttggcgtctggcaggggtgttccgagagaggtagacctcccctccccaaactgccaccatcacttccaacgccctccacgcgctggagctctgccc

SEQ ID NO: 163767 - DNA, 601 bp, Human
cgcagtcggcagaaacgttacatctcccttcccccatctccccccaatagttagttcagctgaaattcagctaaagtgagttttgtagaagttcctataactacacttttatcctagcaaatgagcctattgacctcagcaacagacggcccatactccttgggacggtgagatggttcctatccattcccaggttgaaagtctagtgacaggtccccactgcacgtggcattaagacagtcagataattgtgtcaggtcttgtgctgaggatgagtcagaatacaagatgggcatgttcycccaactaaaacgatgggaagtgattttcttaaaaatactacagtggatggaaatgcctaggactaaagacaaagaaaatacgtacttattcatatacatatgaaagttactttaactagactaacaagtcacttgtgcacaactaagcaaatttacaaaaccaaaaacaatgtatgcctcttggtttcttctatctatggacacctgcacttagatgtggaaagctgcttcttttgtagctacctgggtcagcctgccctgagctaatggcacattcaggttggagttccttttcatac

SEQ ID NO: 163768 - DNA, 601 bp, Human
acagtcagataattgtgtcaggtcttgtgctgaggatgagtcagaatacaagatgggcatgttcccccaactaaaacgatgggaagtgattttcttaaaaatactacagtggatggaaatgcctaggactaaagacaaagaaaatacgtacttattcatatacatatgaaagttactttaactagactaacaagtcacttgtgcacaactaagcaaatttacaaaaccaaaaacaatgtatgcctcttggtttcttctatctatggacacctgcacttagatgtggaaagctgcttctttwgtagctacctgggtcagcctgccctgagctaatggcacattcaggttggagttccttttcatactttcaggatgtgcttggtgagattaaaaataattggactgggttattggccagacttagatctgactcagtggtcagttttaaattatcattgttattagattttgacccttttagccaatctagtgggaggaatttattgcctaaacacatctggattgggatatcatgggctagagccatccttggcaaagggttttctctgagaaatggagggctaaggaaaaatcctggctc

SEQ ID NO: 163769 - DNA, 601 bp, Human
ttattcatatacatatgaaagttactttaactagactaacaagtcacttgtgcacaactaagcaaatttacaaaaccaaaaacaatgtatgcctcttggtttcttctatctatggacacctgcacttagatgtggaaagctgcttcttttgtagctacctgggtcagcctgccctgagctaatggcacattcaggttggagttccttttcatactttcaggatgtgcttggtgagattaaaaataattggactgggttattggccagacttagatctgactcagtggtcagttttaaattrtcattgttattagattttgacccttttagccaatctagtgggaggaatttattgcctaaacacatctggattgggatatcatgggctagagccatccttggcaaagggttttctctgagaaatggagggctaaggaaaaatcctggctcagggactgcagtgtgaagatctactcctatacaacccccagcaatcaatgaggcggatgagcaatttccacccaccacgcctgctatctatggatgggaggagctatagttcacaaaccgtttacattcatgaataatatatttcaaaagg

SEQ ID NO: 163770 - DNA, 601 bp, Human
agtaaataataaatttccctaaattttactttcaacaacatagactttttttatttttatttttatttatttatttatttattttttgagacggagtctcactctgtcacccaggctggagtgcagtggcatgatctgggatcactgcaacctccacctcccaggttcaagcaattcttctgtctcagcctcctgagtagctgggactacaagtgcacgccaccatgccgggttaatatttgtatttttagtggagacggggtttcaccatgttggccaggctggtcttgaactcctgacstcaagtgatccactggtcttggcctcccaaagtgttgggattacagatgtgagccactacacctggccaacaacacagacttcttaaaaaaatcatgacaataattttgggtgcttcttaaaagcacccaaagctttactgctaatgcatggtagcttaaaacttcacataataagaaagaaccagtggccaatggaatctactgttaaaggtacccaatcaagtaaggaaaagttggtcctaaaagcaagcagccctgtaaaagctgctctgtccaatatggtaatcactagccatttg

SEQ ID NO: 163771 - DNA, 601 bp, Human
agttactgcccaaagtgaatattttgaaatgtatcattaaagaagaatagataagattatgtgattcaccatggactattgtcatgagaggaaaaatgtgtttagatgattctgttagcactgagacaaatcaggatatctgaaaggaggtctttgttgaaaaacagaaatatgcattcataacttgcttttctaaaattggaatgtaatgattcttaaatatgcacagacacaaatttttctttaacagtcaagaaaatgcacgcaggtgataatcagatcagttttggttatagtacartggtttaatgcctccgtgatccctttcaacttgaaagcattctagagcaattggtgattaatatcagtataacagtcatttataaaattattatttatttgatatacatctaatcaaagcataagatttatttttattattattattatactttaagttttagggtacatgtgcacaatgtgcaggttagttacatatgtatacatgtgccatgctggtgcgctgcacccactaactcgttgtctagcattaggtttaaaagatcagattgtctcggcaccatgttaatatctttttctg

SEQ ID NO: 163772 - DNA, 601 bp, Human
ccattaaactgcaccctaacttaaagaggatcccttatgttccaatctactcatccctcagatctttctttctctgaaacacagggttaatgagactgacatccttccatcacatattttctcagctactcagtaaaagatgtaaatgtttaaaatagtttaaactatttttcagttagtccaggaaacataaaatggcatgcttgcacataaaccattgtttagggtgggggaagtgtttttaattttgccttaaaggaaatctgcatgatccacaggctatgcaactaccaagggaatyagttggtagaacagaattacacctgcacagaatacaaatttcctgcctttcatgggaactatgttgatgtttcagatatgaaatacatcttgttttctttattgaacctcgagaagatgtctcttgttggtcattatttcatggcaggggaagtacatattcctaaagacacaaccgagtttccctttaaccatcattagttgggctggccattaagaaccagacgcttttattttcaaagagacttaagttttgatgttgtacatatgtgcctaatattctatctcatagcaatttaaa

SEQ ID NO: 163773 - DNA, 601 bp, Human
aagccagagcagcagggccttccttgtccagcaaaggcatttgtctctttgtaggccacagcgacccacagagggctttttaggccagaaaaaagccattaaggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcrtgaacccaggaagcggagcttgcagtgagccgagattgcgccattgcagtccgcagtccggcctgggcaacagagcgagactccgtctcaaaaaaaaaaaaaaaaaaaaaaagccattaaaaagggagtcatgtctcttgttggtcattatttcatggcaggggaactacatattcttaaagacacaaccatttcctcttaatcctcattagctgtgctggcaattaaaaaaccaaaagtttttactttcaagaagatttaaataacttctgagggtgtacatatgtgcttaatattctg

SEQ ID NO: 163774 - DNA, 601 bp, Human
ggtctaaagctaggaataagagtcattctcatataatgtactgtcccagaaagggcattatattagtctgttttcacgctgctgataaagacatatccgggattgggtgatgtatttaaaaaaagaggtttaatggactcacagttccacatgcctggggaggcttcacaatcatggaggaaggtgaaaggcacatcttacatggtggcagacaagacagaattgagagccaatcaaaaggggaaaccccttataaaagcatcagatttcgtgggacttatcactaccacaagaacagtaygggggaaccgccaccatgattcaattatctcccacaaaatgggaaaattatgggaactacaattcaagatgagatttgggtggggacacagccaaaccatatcaggcattcaaccaatatttgggaagcaccagccctgcaccaggcacggagcacgtcatgagtcctgccgtaccacagcctgcctgacagacctcagtcatcctctggagcttgcctctgacatctggacctcctcagaatcagcatctcttctccttgcccccgccatcctttgtttttatctctgctgtggcattc

SEQ ID NO: 163775 - DNA, 601 bp, Human
cattattgagtgtctttcttcctttgccacttttgtccctattggccatatttgaaaatcttgttggaaaaaaaaattcaagaacttaataaataaattcaaaaacatttagtctatttacttaggtgaagagaaaactcattctaatatgtgtgtatatttaaaatatttgttatttagactttttttttaagtctccaggttgaggaggacacaaatatatcctcctaaaccttccagtaagcaagctgtggcatccagatgatctcctgggtcatgggggataaggctaatctcctargtgtctggcagacaggacaggcaaattcccagaatgccaaaatataccatctgctgctgtttggcattgcccttaagtccagagtgtggaggctgggggtgggtctctggctacaggagaactcccctggcaagggaggggtgaaaggactgcctgttgaaccccccatctatccccgcactatggcaagattgagaggaatgactagatcagggaatggcccgaaagaaaaatccaaaacctcccaaccctggacaaggccacagctttgagaaaccgaagcctctgcttccttctctt

SEQ ID NO: 163776 - DNA, 601 bp, Human
ttgaaaatcttgttggaaaaaaaaattcaagaacttaataaataaattcaaaaacatttagtctatttacttaggtgaagagaaaactcattctaatatgtgtgtatatttaaaatatttgttatttagactttttttttaagtctccaggttgaggaggacacaaatatatcctcctaaaccttccagtaagcaagctgtggcatccagatgatctcctgggtcatgggggataaggctaatctcctaggtgtctggcagacaggacaggcaaattcccagaatgccaaaatataccatytgctgctgtttggcattgcccttaagtccagagtgtggaggctgggggtgggtctctggctacaggagaactcccctggcaagggaggggtgaaaggactgcctgttgaaccccccatctatccccgcactatggcaagattgagaggaatgactagatcagggaatggcccgaaagaaaaatccaaaacctcccaaccctggacaaggccacagctttgagaaaccgaagcctctgcttccttctctttggctttactgcttctagatgcaaatacacagagctctgagattttgtgtg

SEQ ID NO: 163777 - DNA, 601 bp, Human
taggtgaagagaaaactcattctaatatgtgtgtatatttaaaatatttgttatttagactttttttttaagtctccaggttgaggaggacacaaatatatcctcctaaaccttccagtaagcaagctgtggcatccagatgatctcctgggtcatgggggataaggctaatctcctaggtgtctggcagacaggacaggcaaattcccagaatgccaaaatataccatctgctgctgtttggcattgcccttaagtccagagtgtggaggctgggggtgggtctctggctacaggagaastcccctggcaagggaggggtgaaaggactgcctgttgaaccccccatctatccccgcactatggcaagattgagaggaatgactagatcagggaatggcccgaaagaaaaatccaaaacctcccaaccctggacaaggccacagctttgagaaaccgaagcctctgcttccttctctttggctttactgcttctagatgcaaatacacagagctctgagattttgtgtgctgggaggtgataactgttaaccctctattccaatagcacagaaatttctctttgcctcagaagtggtttc

SEQ ID NO: 163778 - DNA, 601 bp, Human
gtgtgtatatttaaaatatttgttatttagactttttttttaagtctccaggttgaggaggacacaaatatatcctcctaaaccttccagtaagcaagctgtggcatccagatgatctcctgggtcatgggggataaggctaatctcctaggtgtctggcagacaggacaggcaaattcccagaatgccaaaatataccatctgctgctgtttggcattgcccttaagtccagagtgtggaggctgggggtgggtctctggctacaggagaactcccctggcaagggaggggtgaaaggastgcctgttgaaccccccatctatccccgcactatggcaagattgagaggaatgactagatcagggaatggcccgaaagaaaaatccaaaacctcccaaccctggacaaggccacagctttgagaaaccgaagcctctgcttccttctctttggctttactgcttctagatgcaaatacacagagctctgagattttgtgtgctgggaggtgataactgttaaccctctattccaatagcacagaaatttctctttgcctcagaagtggtttctcatagatctcagatctcttttcaggaa

SEQ ID NO: 163779 - DNA, 601 bp, Human
ttttactgtaataatataagactcatcaatttgactccaaatagctttcctatcaacaggctaagtgtaaaataccaggatcattattcagttgagaatagatagaactaggaagtagccatcaaaaaagaatgatgaggtgcattgtggatttggggtgtaacttggtatctaacatacagccagaatcacagtcatagcacacttaatattttatcagaaacttgcgtgaacaagttaagaggactctcaacttaaaaatgacaccaattgcaatgatcttgttaacatttgtgatgamaataatagcaaagtgacttagacaaattacaatagcccataaaaataagataaagtttaatacaaagtaagatgatgttaaaagacttgaaataaaacagatatgttaagtaggcaacacataggtaagcatataaaaacaagaagataccaggatagagctgtcatttttgtgggagcctgtgatgtggaaaaccaagatgcctggtgagtataatggatatggaaaccccccttgtaataattccacagttccaaggggccaaggtctccaggttgagtcactattgtaaacacaccc

SEQ ID NO: 163780 - DNA, 601 bp, Human
tagccatcaaaaaagaatgatgaggtgcattgtggatttggggtgtaacttggtatctaacatacagccagaatcacagtcatagcacacttaatattttatcagaaacttgcgtgaacaagttaagaggactctcaacttaaaaatgacaccaattgcaatgatcttgttaacatttgtgatgaaaataatagcaaagtgacttagacaaattacaatagcccataaaaataagataaagtttaatacaaagtaagatgatgttaaaagacttgaaataaaacagatatgttaagtaggmaacacataggtaagcatataaaaacaagaagataccaggatagagctgtcatttttgtgggagcctgtgatgtggaaaaccaagatgcctggtgagtataatggatatggaaaccccccttgtaataattccacagttccaaggggccaaggtctccaggttgagtcactattgtaaacacacccatagatgaatccacatgccatacctccttgagtaagtggggactcaaactaggtctgtcaattgttccagaaaattaagcatctaaataatttaatgataatttaaaagaagcac

SEQ ID NO: 163781 - DNA, 601 bp, Human
tagacaaattacaatagcccataaaaataagataaagtttaatacaaagtaagatgatgttaaaagacttgaaataaaacagatatgttaagtaggcaacacataggtaagcatataaaaacaagaagataccaggatagagctgtcatttttgtgggagcctgtgatgtggaaaaccaagatgcctggtgagtataatggatatggaaaccccccttgtaataattccacagttccaaggggccaaggtctccaggttgagtcactattgtaaacacacccatagatgaatccacatgcyatacctccttgagtaagtggggactcaaactaggtctgtcaattgttccagaaaattaagcatctaaataatttaatgataatttaaaagaagcacaatgaaatatttcaaggaatgtcacatacaagattctgtacctcttctgctttggttagactcattcagaataggttcctgctttgatcttaagagggaggtagagattctggagaagccctagggaagagcaaaaggaaaggaataaggagccaagaggaaacccagggtaaggctgaggagggactgtttcgtgtaggtgat

SEQ ID NO: 163782 - DNA, 601 bp, Human
ttgtctatataacttctcaaatccttctgcctctacagttatagtttaactggcgcataacagccttcacacacagcctcataattaaacatagacatacatatgaacactttcccctatgccagcaggatacttggtttgtttaggggcaaagaggaattgatgtggcgttgtttcaatcagtggttgaaaatgcaagtggtaaacattgaaaaatagaacactgcaaaaggcatgcattgtatataccaaaaggtcagcatgaagcattatctgtatggcaagcctgcccatccactcsctcctacacgttgcatattcacacagttttgcagcttgtataaacccctattgtgatagaaactcatgaaagagtgtggtctctgcgaaagctggctgttctgtgaatttagaccagtggttcttcaccctggctgcaaatcatctggggaacatttaaaaacactgttttaaacaccccaaccctagaaattctgatttaattggtctgtggtggggcccagaactctgtattctttttttaaggctctcaggtgctgctaatgtatagctaaaattgggtctggtttagactctcaga

SEQ ID NO: 163783 - DNA, 601 bp, Human
tttagcgaagaatccaggcctctggatgaatccctgtaattgcatgtttggataaaataagattttcatacattaaacaaggtaggatttttctatctgggacggaactttcaacacttggaggggttgtagttatttctcctcaaagatggcaaacatgagtgccccgagttatccctcctctctgttcaagttcgctaactaatcacccagtatccatgctatcgctggcccttctgtggcctatttttatactgttcactgttcagtgtcacttgtttggtaacactcaacatcaacrtgtgctaccaaattgacaccagaggacaaaaaagaatcaagatatgtacagcctgctttgtactgagccagctgccactagatgttttttgtgataatgaacacgtgaggccatgtggacgcgagagatggctccgggttccctcagacggctcacagccagctggtctgcagtgcggttttagattccgatgtgggaaccccataaaaaagaatatgcaggccaggcgtggtggctcatgcctgtaatcccagcaatttgggagcctgaggcgggtggatcacctgaggtcaggagttc

SEQ ID NO: 163784 - DNA, 601 bp, Human
gaaatcccaaatcctatccctgaggttcattttggtgagggaatgtgtgtgcattttctagggcttccctaaaaaagtatcacaagctggatggcctaaagctacagaaatttcttggggacaaatttcatgattctggaagctagaggtccaaaatcaaggtgtcagcaaggctatgctttttctgaagcctatagggaaggccttccttgtctctcctagtttctggtggtttgctggcaatgtttggcattctgtggattgcagctacataactccactctgcctccatcattaatgrccttctgcctgagtgttttcatatgaccatcttcatataaggacaccagtcatatttgatgagggttccaccctactccagtatgacctcatcttcactaactacatctgcaatgaccctatatccaaataaagtcacattctgagtgtctggggattagaacttcaacagagcttgttgaagggggcacaattcaatgcataacaggatggaaactagaaacgggtatgtttttatcagtgtagaaagatttagcttaatttttcaaagtgtaataaaaaccccaggaaaactcatact

SEQ ID NO: 163785 - DNA, 601 bp, Human
ccaggaaaactcatactccctcctaagaagagcaaaagatggagaaacccgatggttaccttcaaacaaaaggaaaggaggaataagatgaaaaggaattaatccaaagcaaagagagtggcttatatggaatgttggtgcaactttctctgacacatctgtgcactcatcagctggggcatcatctccctggggtacatttggtcactgtgtgcctcatggtaataaactccagaagcctcattgacttgctagagatgagctcatccttcttgcttgcttaatggcaaaatacaaaatmagcagtcactgacatggaacgatttcaggaatgccaaaaggttctccttttccaaaatatctcttccatcttcccaatactgttactgacatcactaacacctctccacttccggttgagacacctgggccagagctcctgatgtggcaggcagtgccctaaacgttttgcataaattaactgatgcccagagcaacaaccctaagatataggtactatcataccgcatcttacagataagaaacttaggcacaaagaggtttagtagtttagatgagataaccctgatgagcagagatt

SEQ ID NO: 163786 - DNA, 601 bp, Human
aaaagaaaacacagtcacctgaagtcattctaaagagtatgcctgcctcttttcctgcacagacacatatacacagacacgcacatacacagaccatgcacatacacacacacgggaaaacatgaggaaaagtggagacaagaggcaccaaaggacaaagtcacttttgtcgcctgtcccttccccagcagggctgggcctgggctgcttctcctgcctcctccctgaagccccctcctcatcatattccagtgcgtgtccaccactttggggccaggtctacacaactgcagtgattcargtcacgggagaaaacccaaacaagcacaaaacatgcttcaacctatattttctaaattgtttttctttaaaggtgaagacttctgagcttgaattatccccttgtcagtgggctttccatgctgtccaagtgacctaagtgataatcaacctccatttcattttgagaatggttgtggtattttagagctatggtgaataagaaaatcatttaaaataaaatgatttttatttatttattgtttttatttattttatcttaaatgaattttaaatcatttaaaataaaataatgggataa

SEQ ID NO: 163787 - DNA, 601 bp, Human
tttcagagagagaggctctaggttccaagctggatgctcaggtcagtgactgcaggtcccctccacacccatcaccccacaccctaaccctcttcagttgctcacaaaggtagataaatacccacatttttgccctcttccatcttgaaaccctggaaacccttgcttccgccaggggaggttacttagtatctgtcaccccaagggaaccaacgtcgaagcccaagaataagagtcaatactcctaccagaggtttacatttttcccaggggtctaggtggatattcctgggaacccccrtcaacacaggcatctacagtacaatccaggcctcctgttttcagcaggggctgcaagagcactgcagccttttccccagaggtgtcagtttggcccagtaaagattgcccctgagaaaacacatgggcaattagagcaaagttcctatgttctggtaacatttaattgtgctatttctcaacctcctctgcacccacacactcacacacaacatttattccactgacttcaaaggaagctcaacgtgttaaaaatatgtgtgggaacaaagaagggagtttgaaattggtctaaactctg

SEQ ID NO: 163788 - DNA, 601 bp, Human
tttgccctcttccatcttgaaaccctggaaacccttgcttccgccaggggaggttacttagtatctgtcaccccaagggaaccaacgtcgaagcccaagaataagagtcaatactcctaccagaggtttacatttttcccaggggtctaggtggatattcctgggaacccccgtcaacacaggcatctacagtacaatccaggcctcctgttttcagcaggggctgcaagagcactgcagccttttccccagaggtgtcagtttggcccagtaaagattgcccctgagaaaacacatgggyaattagagcaaagttcctatgttctggtaacatttaattgtgctatttctcaacctcctctgcacccacacactcacacacaacatttattccactgacttcaaaggaagctcaacgtgttaaaaatatgtgtgggaacaaagaagggagtttgaaattggtctaaactctgtataactgggtttgacacgtacattaggattttacaagtatgtatttaatctttttttaaaaaaagcgtttacatagggttcagaataatgacaataaatcaacatttctattgtccatttgtgtgtt

SEQ ID NO: 163789 - DNA, 601 bp, Human
aagaataagagtcaatactcctaccagaggtttacatttttcccaggggtctaggtggatattcctgggaacccccgtcaacacaggcatctacagtacaatccaggcctcctgttttcagcaggggctgcaagagcactgcagccttttccccagaggtgtcagtttggcccagtaaagattgcccctgagaaaacacatgggcaattagagcaaagttcctatgttctggtaacatttaattgtgctatttctcaacctcctctgcacccacacactcacacacaacatttattccacygacttcaaaggaagctcaacgtgttaaaaatatgtgtgggaacaaagaagggagtttgaaattggtctaaactctgtataactgggtttgacacgtacattaggattttacaagtatgtatttaatctttttttaaaaaaagcgtttacatagggttcagaataatgacaataaatcaacatttctattgtccatttgtgtgttttcatagtaaataatgctcatttatccttaaccagtaatacatacttatgggcttaaattagcaaaagcctctcaaaaagtagctccactcattta

SEQ ID NO: 163790 - DNA, 601 bp, Human
aaatccaagccaattcaggtatatgagctgatatttcaaccgaaacactatctatagcctaaattttttctaatattctgtttggtatgaattctagaaagttgtaaatgctatatttccttctcatctatttctggactttgtcccaagaccaaatcccagggcatctgatagacattcattgcatacatttttctgtaaacatgaaaactgaattgtctaatagaaaagggcaaggaagtagaaaataagaaatcatcatcagaagtggtttgttttggaattatattgtccagctgcrtaacaaatcacccccaaaattgagtcgcttagaacaacaaacattgatcctccacagtttctgtgtgttaggaatcaaagtgatttaatttaatggttctgctcagggtctctcgggggctgcaatccaggtctcaggctgggatcctttcaaggctgagctggggaaagatccatgtctaagctcactcacatggccgatggcgggattcagttcctcttaggctgtcagactgagggcctccgtgtctcagtggttttagccagagccctctctcagttcctttccacatgggcctct

SEQ ID NO: 163791 - DNA, 601 bp, Human
tttccttctcatctatttctggactttgtcccaagaccaaatcccagggcatctgatagacattcattgcatacatttttctgtaaacatgaaaactgaattgtctaatagaaaagggcaaggaagtagaaaataagaaatcatcatcagaagtggtttgttttggaattatattgtccagctgcataacaaatcacccccaaaattgagtcgcttagaacaacaaacattgatcctccacagtttctgtgtgttaggaatcaaagtgatttaatttaatggttctgctcagggtctctcrggggctgcaatccaggtctcaggctgggatcctttcaaggctgagctggggaaagatccatgtctaagctcactcacatggccgatggcgggattcagttcctcttaggctgtcagactgagggcctccgtgtctcagtggttttagccagagccctctctcagttcctttccacatgggcctctccacagggcaactcacaacatggcagctggtttccagtagagcaagcgagtgagagaacaagaaaggcaagcaaggtgaatgtcccagtcttttgtaacctcatctcagaagtgt

SEQ ID NO: 163792 - DNA, 601 bp, Human
tgaaattgtagtatcataagccaatgctgcacaaaggtatttcatgtcatttataaaaatctagtaatgtaaactgttaactccttataaagcatctgttgacacacaaaaatatcactgaagtgcatttatgcctttcttctttaggtctgcataatacttccctccagaaggccaagttgttccataaattacagaacagaaagttggttgtgggaggaatagctcaacctcatctgaggcatcccactctaagaaactaatggcacctacacctcttgggcattgagtttttaagccmatttttaattcttgttctgctcatattctaagtgagcacataaagtgctgctccaagcaagaccagcccttgtagaagggcaagtgcagtcagtcccctaggaaacgggactggggagtgatcgtttcaatgagagataaatcaaactgatgctaaacatgaacaatgagcccattagagattgtgagaaagaggcatcatcatccactcaacaataggcctgtgggacctcttgatagcctgaggatgtttaatttcaggtgcaggtatccagaatgtagcagctagactgatcaagga

SEQ ID NO: 163793 - DNA, 601 bp, Human
gtgggacctcttgatagcctgaggatgtttaatttcaggtgcaggtatccagaatgtagcagctagactgatcaaggatgtgtgatgacagcaagcagtagtggaagagcccaggagagttcctaagcctgaattgcaatcctgtgctgccataaaatgggaagatatacttggtccagtcatctgacagctttggtcatcaatttctctatctcatatgtgactctattgctttaagaatccctttagctttaaatatctatgaatctgctgaagcagctgtgctttgattgatgtggawctctgaactcccttaaatacaaagaccaattatttagccgagctttgttggattcagtgcattctgaatacatgtcaaaatatacttggatttgtaaaaaatattccttcctgtttttttcaccatagatagatgtacaaaaatgtccgtgttcacaccgtggaaaggacatttctcataaactcacacagagatacctttcaagtcaatgccttagaaagcaatgagagatttaaaggagacctagagatatgaatggagtaggcagagaaggtatgtgaggagaatgatgtaacttcc

SEQ ID NO: 163794 - DNA, 601 bp, Human
atgggaagatatacttggtccagtcatctgacagctttggtcatcaatttctctatctcatatgtgactctattgctttaagaatccctttagctttaaatatctatgaatctgctgaagcagctgtgctttgattgatgtggatctctgaactcccttaaatacaaagaccaattatttagccgagctttgttggattcagtgcattctgaatacatgtcaaaatatacttggatttgtaaaaaatattccttcctgtttttttcaccatagatagatgtacaaaaatgtccgtgttcayaccgtggaaaggacatttctcataaactcacacagagatacctttcaagtcaatgccttagaaagcaatgagagatttaaaggagacctagagatatgaatggagtaggcagagaaggtatgtgaggagaatgatgtaacttcctagggaaaaagtatgaagcacaaggctggacatagacctgggaatcaggaaattagagttctaattgcagcttttccattgattcacttgggatcttgagaatatctgtctcattttaatcattctgggccacagtttccatatctgtcaattaga

SEQ ID NO: 163795 - DNA, 601 bp, Human
cattgattcacttgggatcttgagaatatctgtctcattttaatcattctgggccacagtttccatatctgtcaattagagtaagagtccctggctgggtgcccaggattgtgagaacataccattcagagccataaaaatgcaatcagtaccaataatgtactagtaccagtacctaggatgcaaaacatcctagatactaggtgtcctaacttaaagtggaaacattaacaagagtaattctttgaatcatcaaactgggaatattttaggaagcatatctatctgggtgaaaactaarcaaataagacaattgtaaaggcttgtgatctcaggaatacaaaggcaaaaatgcgcagacttgaaatatgacaagttctagttttgtcacttagcatctctgtgaccttggataatttcttaacccccggcagtattctcatctgtaaaatgggaataatgacatgcacttcagtggtttgtggtgaagattattacaaatagaaattagctcttttgagccactggtggggtttaaattcccagcccttatgtgctttgcagctgttagttcctcttattacaattgtctatttaaaaa

SEQ ID NO: 163796 - DNA, 601 bp, Human
agaaagaaagaaagaaagaaagaaagaaagaaagagagagagagagagagagagagagaaagaaagaaagaaagaaagaaagaaagaaagaaagaaagaaagaaagaaagaaagaaagagaaagaaagaaagaagggagggagggagggagaggagagaaagaaaaaggaaggaaggaaggaagagagagagagagagagaaagacctagtcaccaaaagcaagagattttttaaatgctactattttttgggcatttactaatcatattgctatgctctgcacccaagctaagtaatttraataaattatctcatgtactcctctaaaactaattactgctgtgtaaatggaggtagaaagaaactaagctttatttctgcctctattgtttctttaacctgccttgcttcctttttcagttgcacctaattggctgtacttttagttttctttaaaactgccttaaatttcaaagactaaagcagcaataactaactgaatatatttatataacatgttatttttgtcatgttgctttccacccctggagacctgctctaaattcacttggacgtttgaggataaatcatgctcactag

SEQ ID NO: 163797 - DNA, 601 bp, Human
ttgaaaaataatttgaatttatgcttagaaaaatagaattattattaagaaatcttacacactcatgtttttaaatatcttcactaaggaccaattgtgtatatggtgtaacactgtcctcaaagaacatgccgggagaattgttgcagttaccagagggttaaatttggcaaactcttttttattaacgtgccttttaattatgaaatagcatactcaccttagataaaatttgaaaaccatttttgtaaagtggtacaatattgaagaaagttgataactttcagaccagatttaagcctcaaatctacctctcttttacctggacaactcattagcatttctgaacctcacattttttctataaagtgagaatactatattatagagttgttgtcagttaaatgagaacagtgtctgatcacaactagtcaacaaatgttcacaactcttcccctcctaggaaaagaatctcaaggcagacctgcttcgggtctgctctgtaaagaggtaggaatcctctgctcctggtaaattgcttcctaaccttctttggtaatagactattttttaataaaggtgatggatcatttcccattat

SEQ ID NO: 163798 - DNA, 601 bp, Human
tcttacaaaacaaagacatctttaaaaaataaaattctttaggtgtcttgcagttgaatgcaggaaaaccagagccccttatttttgatagttttgggaagaatgcagtgtcagaacacaaacccataatagacaaataatttgcacagaaacttcataaaagtattgacctgatttgccatgtatttgccaccttttaaaacacacaactaaatgtttaccctgtgtctagatccaaatgggtgaagaaaaatgagtgacaatacatctacttaagctcacttacataattgtggccatrccgtttttttcacattacattattagaacattggacaataagtcaagaaacagaatgttctacaaaataaactttaaaaattggtaagcatcatgtgctttttccagaagacattttattttgttgaatcaaaggtggctctttggcactgagtagctccgtggagtcatggcagtcctcattccctaatcctgagcctgcctgagtcgctgctgtcagtcatccacttgttgggatttcaaactgcattaaatcccctcctatagctgtcactgccaagcagttgcactggctctgtcc

SEQ ID NO: 163799 - DNA, 601 bp, Human
acagagggataaaacttcctgtaattaattgtttgggtgaacatgtacctgggagagctattgggaaaggggccaaatttgcattccagctcctttcatccccacccttgagctaaccaagtcctgtggattcttcccttagcatctctggaaccttcttttcttttcttttttttatgaccacctttccagtcctggcccttcaaacttgagtgacagcaacagtctccctgccttgagtctctttcctccttctcccagtgtgcatacggttgtcaaactcatcttgataaactactgyatcgattgtggctacactcccctgctcccacatcttccatagaccccactgtctgtaaaataatattcagtctggcctcaacctgtctttccagcctcggtgacacaggtctattctgcctgagacacttactatgacacccttgcttgttcctggggctttgacacatttccaacgtcccattgttcttcctctccaaatcagccaattgcccaagccctgctcaaatctcccacctcatgaagccttcttgatgcctcccagcacaccatgatctaatttcctgaagtaattatgcta

SEQ ID NO: 163800 - DNA, 601 bp, Human
ggggccaaatttgcattccagctcctttcatccccacccttgagctaaccaagtcctgtggattcttcccttagcatctctggaaccttcttttcttttcttttttttatgaccacctttccagtcctggcccttcaaacttgagtgacagcaacagtctccctgccttgagtctctttcctccttctcccagtgtgcatacggttgtcaaactcatcttgataaactactgcatcgattgtggctacactcccctgctcccacatcttccatagaccccactgtctgtaaaataatattyagtctggcctcaacctgtctttccagcctcggtgacacaggtctattctgcctgagacacttactatgacacccttgcttgttcctggggctttgacacatttccaacgtcccattgttcttcctctccaaatcagccaattgcccaagccctgctcaaatctcccacctcatgaagccttcttgatgcctcccagcacaccatgatctaatttcctgaagtaattatgctaattgggcatttgaagaattgttaaccgattatcaactaactgccccttaacattgcatgtgtagttgt

SEQ ID NO: 163801 - DNA, 601 bp, Human
tttcatccccacccttgagctaaccaagtcctgtggattcttcccttagcatctctggaaccttcttttcttttcttttttttatgaccacctttccagtcctggcccttcaaacttgagtgacagcaacagtctccctgccttgagtctctttcctccttctcccagtgtgcatacggttgtcaaactcatcttgataaactactgcatcgattgtggctacactcccctgctcccacatcttccatagaccccactgtctgtaaaataatattcagtctggcctcaacctgtctttccrgcctcggtgacacaggtctattctgcctgagacacttactatgacacccttgcttgttcctggggctttgacacatttccaacgtcccattgttcttcctctccaaatcagccaattgcccaagccctgctcaaatctcccacctcatgaagccttcttgatgcctcccagcacaccatgatctaatttcctgaagtaattatgctaattgggcatttgaagaattgttaaccgattatcaactaactgccccttaacattgcatgtgtagttgtcttcaaaggcagttaaattatgtca

SEQ ID NO: 163802 - DNA, 601 bp, Human
acctttccagtcctggcccttcaaacttgagtgacagcaacagtctccctgccttgagtctctttcctccttctcccagtgtgcatacggttgtcaaactcatcttgataaactactgcatcgattgtggctacactcccctgctcccacatcttccatagaccccactgtctgtaaaataatattcagtctggcctcaacctgtctttccagcctcggtgacacaggtctattctgcctgagacacttactatgacacccttgcttgttcctggggctttgacacatttccaacgtcccwttgttcttcctctccaaatcagccaattgcccaagccctgctcaaatctcccacctcatgaagccttcttgatgcctcccagcacaccatgatctaatttcctgaagtaattatgctaattgggcatttgaagaattgttaaccgattatcaactaactgccccttaacattgcatgtgtagttgtcttcaaaggcagttaaattatgtcatgttccttacattgtactgagtgcctcgtatccttatccatgtttgggggttttactttaagtcaagaaatttaatcacatccatttgg

SEQ ID NO: 163803 - DNA, 601 bp, Human
ctcccagcacaccatgatctaatttcctgaagtaattatgctaattgggcatttgaagaattgttaaccgattatcaactaactgccccttaacattgcatgtgtagttgtcttcaaaggcagttaaattatgtcatgttccttacattgtactgagtgcctcgtatccttatccatgtttgggggttttactttaagtcaagaaatttaatcacatccatttggttttctctagagctgtagttctcaaccttttgtgtggtagagaaacacctagagaacatgtttaaaaatatcctgsgttccacccttgagagataataaggtccaaggggaacccaaatatctgtgtttcaggtcagcttattggctcatcctattataccaactcctcagaaggccaaggtgggtggattccttgatctcaggcgttcaagaccagcctgggcaatatcgtgagactccatctcttaaaaaaaaaaaaaaaaaggattagccaagtgtggtggcatgaacctgtggtcccagctacttaagaggctgaggcagacagattgcttgagcctgggaagtcgaagctgcagtgagccatgatcatgcc

SEQ ID NO: 163804 - DNA, 601 bp, Human
cttattggctcatcctattataccaactcctcagaaggccaaggtgggtggattccttgatctcaggcgttcaagaccagcctgggcaatatcgtgagactccatctcttaaaaaaaaaaaaaaaaaggattagccaagtgtggtggcatgaacctgtggtcccagctacttaagaggctgaggcagacagattgcttgagcctgggaagtcgaagctgcagtgagccatgatcatgccactgcactccagcctgggtgacagagcaagaccctgtctcaaaaaaataaaaatgaaaaaartctgtgttcccaagttccaagtgatgctgatgctgctggttgcctttaagcatctcacaaagaacgaactcataaatgctaatacagtatatgtctatggatactgaatagtgggttttttttctcttttcttctattctgtgctcatgttgtgtcacttcttccttttagattgactttgaagatgtgattgcagaaccagaagggacacacagttttgacggcatttggaaggccagcttcaccaccttcactgtgacgaaatactggttttaccgcttgctgtctgccctctttggc

SEQ ID NO: 163805 - DNA, 601 bp, Human
ccgcaacctccacctcctgggttcaagcaattctcctgcctcagcctccagagtagctgggattacagacatgcaccaccacgcccagctgattttgtatttttagtagagacagggtttctctatgttggtagggctggtctggaactcccgacctcaggtgatccacccacctcggcctccgaaaatgctgggattacgggcatgagccaccgcgcccggccttcactgaagtttcttatcaaatatccccgcactctggcctgggcaatggagtgagaccctgtctcaaaaaaaaaaattaagattaccattttacaattaagcaaataattccatgatgaagccaggcccagactacaggctggagcccttataaaaaaacagtgggtaagtaaaagttgataaacagcaacaaggaaatgcacacttgtgttaatcaaatatttaatttcacacatgctctaatgctttacttcccttacaattctaagtagcagtctaatgagatcacataggcctaacaacatttattcaacattcttctgagagaagctacaggcatttgctccaatttattctacctttctttctagggaaa

SEQ ID NO: 163806 - DNA, 601 bp, Human
gtccattcttaacactgaggccggcaatctcattaacaaatcagatgtgttgatcctcagttcagaagacccccatggctcccaactcaatcaaaacaatgcaaactcctaacctgcatagacaggcctattgaagtctcacagaacatggaccctaactacctctctgacttcatctcctcttcttgtcaaccgtgtaccagccacacaaggctttctttctgcaaataagtcccctgccataagcatttgcacttcttgctccctttattacgcttttcccccaggtgtgtagttcagkctttcatttcactgaggtttctttttttttttttttgagatagagtttgctcttgttgcccaggctggagtgcaatggcgcaatctcggctcacccgcaacctccacctcctgggttcaagcaattctcctgcctcagcctccagagtagctgggattacagacatgcaccaccacgcccagctgattttgtatttttagtagagacagggtttctctatgttggtagggctggtctggaactcccgacctcaggtgatccacccacctcggcctccgaaaatgctgggattacgggcat

SEQ ID NO: 163807 - DNA, 601 bp, Human
agttcgagaccagcctggccaacatggtgaaaccccgtctctactaaaaatacaaaacttagctgagcgtggtggcagtcacctgtaatcccagctactcgggaggctgaggcaggagaatcacttaaacccaggaagcagaggttgcagtgagctgagatcacaccattgcactccagcctatgggaaaagagcgagacttcgtctcaaaacaataaaataaaataaaagtcctctttattctattatcgttgctaacaatgaccccctcctctccaacagcaaagctccagaagaaccrtccacacttgccacctctactgctcctctcccctcccctgagcccatccccacctggcttttttgtctccaccacattgtcaggctcatggctgacacctactgctgccaaacccaagggtcaattccaccttccccgtacttgcatcctcagcagaatctgacaaggttgatcacatcttacacttttttcttcacttcacttccaggtttatctaccacctagtcgtcctgtctttccctccttgctgggtcagtctcatttttgccagatcaagggtctggggtgactcaagaacga

SEQ ID NO: 163808 - DNA, 601 bp, Human
acctccccttgggcactgcgtcccatcctctgtcacggagtcttcactcctgatggtcttgctgctccatcatctctcctctaatggatcacttccatccctgtgcagcctactggcatacctgctaccttaaaaaagtcctctttaggccgggcatggtggcttacacctgtaatcccagcattttgggaggccgaggtgggcggatcacctgaggtcaagagttcgagaccagcctggccaacatggtgaaaccccgtctctactaaaaatacaaaacttagctgagcgtggtggcagkcacctgtaatcccagctactcgggaggctgaggcaggagaatcacttaaacccaggaagcagaggttgcagtgagctgagatcacaccattgcactccagcctatgggaaaagagcgagacttcgtctcaaaacaataaaataaaataaaagtcctctttattctattatcgttgctaacaatgaccccctcctctccaacagcaaagctccagaagaaccgtccacacttgccacctctactgctcctctcccctcccctgagcccatccccacctggcttttttgtctccaccacatt

SEQ ID NO: 163809 - DNA, 601 bp, Human
atgcctgaaaagaaaaagaagaacctttaatttgaacaaagccacctgcttaaagtgctgttgctcgataggcagcgttacagttccccaatcaaaaggcctccacaacacaccggattttacatgttttgtccaaatgaagctaatgagggagggacaggcatgtgctttccctgcaaggccaacctccccttgggcactgcgtcccatcctctgtcacggagtcttcactcctgatggtcttgctgctccatcatctctcctctaatggatcacttccatccctgtgcagcctactggyatacctgctaccttaaaaaagtcctctttaggccgggcatggtggcttacacctgtaatcccagcattttgggaggccgaggtgggcggatcacctgaggtcaagagttcgagaccagcctggccaacatggtgaaaccccgtctctactaaaaatacaaaacttagctgagcgtggtggcagtcacctgtaatcccagctactcgggaggctgaggcaggagaatcacttaaacccaggaagcagaggttgcagtgagctgagatcacaccattgcactccagcctatgggaaaagagc

SEQ ID NO: 163810 - DNA, 601 bp, Human
gaacacgagaaaagtgactaattcatatccaggatcacagtaagggatctaaatttaaatccaaagtaaaggcggaaagaattcccgacaagaccaacctccatgtgggtttataaatgtgaatgagattacagattattcaatttagacaagaccaacctccatgtgggtttataaatgtgaatgagattacagattattcaatttaccttaacaggtcctgaaatgcagttttctttagatcggtccatgatgcctgaaaagaaaaagaagaacctttaatttgaacaaagccacctgyttaaagtgctgttgctcgataggcagcgttacagttccccaatcaaaaggcctccacaacacaccggattttacatgttttgtccaaatgaagctaatgagggagggacaggcatgtgctttccctgcaaggccaacctccccttgggcactgcgtcccatcctctgtcacggagtcttcactcctgatggtcttgctgctccatcatctctcctctaatggatcacttccatccctgtgcagcctactggcatacctgctaccttaaaaaagtcctctttaggccgggcatggtggctt

SEQ ID NO: 163811 - DNA, 601 bp, Human
tgctgggattacaggcgtgagccaccgcgcccagccttgaaatgtattatttatacgcctgtaagtactgtattacaaccttaaattgttaagttaactctaacaccctcagctaatcaaactaaaaggggtaggagggatgagatttccttcagcttcaacagctcattgtaagtgagggacaagtgctagaaatgaaagcctcaaagtccatccccagctcaacggtatgagtgctctacaaagagagggtgttaagacttccaaatacaaagtcagttactcctgaaattagcacackgtccacaacgcagcaggcattcagacaaagacaaataaaaagaaacattttaaatatagagcaattttttaaatggccgttatcataggaacttagaatcaaatacagtaattcaaggtagcctttttctaattattttatatttatggccaattttaaaagttttgaactcctgccagatgcattattactattatcctgcatacagtggagggatatagaaacttaagcagccgattataagacaaagcagaacaaaaaagctactctaagaagcagcaaaatgttactgaacacgag

SEQ ID NO: 163812 - DNA, 601 bp, Human
tcccaaagcgctgggattacaggcgtgagccactgcgcctggccttccacagtaaactttctaaaaggcagagttcccttctgagttcaaaaaagcttcagtagcttccaaatgccctagagatgaggccccattccttaacatggccagcaatgcccatggtgacctcaccgcagcctgcctcagttcacccacttctctggatttcccccacactttagatctcagtcccttcaagtcacttactgcaagcaccctacatccagactcagtaacaagcaatcaaaaggacaccaatttrtgctgtgtcctccctgggtgcccaactcttccaagagggtgagaatcaggtctgtatttttagcataggtctggcccatgggcagacactgttacttcaacccagacaccatattttctccccatcctcaacagatataaaagctaaggctccaaacaataagtgcaagtatatacactggcttttttagcaacgacgacaaagaaggactatccaatgagtctcaaaagctagtttaccaggtgccgatggcaggggctgcttgctcttttgggtgttattcagtggcctggagacagg

SEQ ID NO: 163813 - DNA, 601 bp, Human
acctgggcagtgggaggctgacattacaggagggggaggggtgcagcattggtgaacattcttttgaacatgaacctgaaaactcaccgaaggtgggactgtatttctacttctcttctgagctgatgctccactccggctttctccagctgagctttaaataacactttaagagccagaataaacttgctttgcttttctcttgccaaataaacattaccaaactttcctttacccagagggcgaccaatttcaaagtcttccaaagcccactgcctcctaggaggaatttgaacacttyagaatgtgaagaaaacaaagcttttctaacaaattttcaatgagtagcagacacattctacaaataatttcgtattccaacttcactcaatatgcatcctcagcaagaaccaaggcaataaccactatcaaagagctgccacgacatgaaaccctgacgtccctagctgccgtcaggtgtgagagtcagtgacaaggagcagtctcgggttttagacctgaagcactctatgggaaatgtcccaagcccgtactatgctcagaggaacagggccatgacaacgctgaagaccacaaaaag

SEQ ID NO: 163814 - DNA, 601 bp, Human
atttgaaaaacactgaaagaaaaaaaggaaaaacaaaaacccaccagccgtagtcaacctgcaggtagctgctcgcaattcctgcatacctcagaataaggggtgccattccccttcactgtccaccagaaagacttgcccatataaactattctattaacaaaacattaaatcctcaagtgatttttccaggatcagagcacttaagtgctctttgaaagatgacaaatttaatcattttttgtggtactatgaaaagcaggccctctaaaaaataaatttatacttaaaaaaaaaaaaaggaatacaattttattttaacatgcagagcatgggagaatcacaggagaatgcttataacccagtgcagtacagaagcttatctaatctttttcataggggagggggaggtgaggaacggggccatgcatttgaaggcagtgcctcgtaagagggagtgaagggacctgggcagtgggaggctgacattacaggagggggaggggtgcagcattggtgaacattcttttgaacatgaacctgaaaactcaccgaaggtgggactgtatttctacttctcttctgagctgatgctccactc

SEQ ID NO: 163815 - DNA, 601 bp, Human; identical to SEQ ID NO: 163805

SEQ ID NO: 163816 - DNA, 601 bp, Human; identical to SEQ ID NO: 163806

SEQ ID NO: 163817 - DNA, 601 bp, Human; identical to SEQ ID NO: 163807

SEQ ID NO: 163818 - DNA, 601 bp, Human; identical to SEQ ID NO: 163808

SEQ ID NO: 163819 - DNA, 601 bp, Human; identical to SEQ ID NO: 163809

SEQ ID NO: 163820 - DNA, 601 bp, Human; identical to SEQ ID NO: 163810

SEQ ID NO: 163821 - DNA, 601 bp, Human; identical to SEQ ID NO: 163811

SEQ ID NO: 163822 - DNA, 601 bp, Human; identical to SEQ ID NO: 163812

SEQ ID NO: 163823 - DNA, 601 bp, Human; identical to SEQ ID NO: 163813

SEQ ID NO: 163824 - DNA, 601 bp, Human; identical to SEQ ID NO: 163814

SEQ ID NO: 163825 - DNA, 601 bp, Human
cagtaagtaagatggcgagaaaagcaagagagagtgggaccgatcgatagcgcagcggtcggcttggcgccctttcagcgtgcgcagtgaacgtgcgctcggagcggtagattgggcaggattcgcgcctccatttttccaggagagagcgggataccaagagaaccggaccagctggtactgggacacggggagagtagctggtgcggtcggctggggcatttagagaaaaccacagaaacgactggggcgagactggaagagtcgagagttagcaaggtggcatgcgcctctactttgygtttcctaagttgcccggcttggcctgcaccccttcctcttctcgaagggcctcgcttccattcccacccagtccttagttcgcctctgcatccagatggtcgcggcgcatatagtgagggggcatctgtgttctagcctttccaactgcgatgtatccggtcctggatcgggttcttgtcctcgtgtgctcacctgcaaattggggataattaggcttctgtttacctggcgagtgaacgttctgtgggagttgagaagttaggagtgggccacttaaaatatatatatatatatacac

SEQ ID NO: 163826 - DNA, 601 bp, Human
gagagttagcaaggtggcatgcgcctctactttgtgtttcctaagttgcccggcttggcctgcaccccttcctcttctcgaagggcctcgcttccattcccacccagtccttagttcgcctctgcatccagatggtcgcggcgcatatagtgagggggcatctgtgttctagcctttccaactgcgatgtatccggtcctggatcgggttcttgtcctcgtgtgctcacctgcaaattggggataattaggcttctgtttacctggcgagtgaacgttctgtgggagttgagaagttaggrgtgggccacttaaaatatatatatatatatacacacacacacacatatacatatatatacacacacatatgtgtgtgtgtgtgtgtgtgtatgtacacccgggatgtgctcagcagaagtgaagagaccggatagaacagtggtgtaggggaaccaaaaatggcttccctccatccttccaggtaccttattaggactaagagttaaattcacataagacgaattaacagattactgcagggtaaacaggatgtgcatgtaaagcattgagctagcatacggaaattattcgagtcatat

SEQ ID NO: 163827 - DNA, 601 bp, Human
ctttgtgtttcctaagttgcccggcttggcctgcaccccttcctcttctcgaagggcctcgcttccattcccacccagtccttagttcgcctctgcatccagatggtcgcggcgcatatagtgagggggcatctgtgttctagcctttccaactgcgatgtatccggtcctggatcgggttcttgtcctcgtgtgctcacctgcaaattggggataattaggcttctgtttacctggcgagtgaacgttctgtgggagttgagaagttaggagtgggccacttaaaatatatatatatatttacacacacacacacatatacatatatatacacacacatatgtgtgtgtgtgtgtgtgtgtatgtacacccgggatgtgctcagcagaagtgaagagaccggatagaacagtggtgtaggggaaccaaaaatggcttccctccatccttccaggtaccttattaggactaagagttaaattcacataagacgaattaacagattactgcagggtaaacaggatgtgcatgtaaagcattgagctagcatacggaaattattcgagtcatattaacccaacgttaacagtagaatctctca

SEQ ID NO: 163828 - DNA, 601 bp, Human
gcttccattcccacccagtccttagttcgcctctgcatccagatggtcgcggcgcatatagtgagggggcatctgtgttctagcctttccaactgcgatgtatccggtcctggatcgggttcttgtcctcgtgtgctcacctgcaaattggggataattaggcttctgtttacctggcgagtgaacgttctgtgggagttgagaagttaggagtgggccacttaaaatatatatatatatatacacacacacacacatatacatatatatacacacacatatgtgtgtgtgtgtgtgtgtrtatgtacacccgggatgtgctcagcagaagtgaagagaccggatagaacagtggtgtaggggaaccaaaaatggcttccctccatccttccaggtaccttattaggactaagagttaaattcacataagacgaattaacagattactgcagggtaaacaggatgtgcatgtaaagcattgagctagcatacggaaattattcgagtcatattaacccaacgttaacagtagaatctctcatcaacttttctttgccagactacccacttgtgattttcattctttattggtacttaagaa

SEQ ID NO: 163829 - DNA, 601 bp, Human
cggaaattattcgagtcatattaacccaacgttaacagtagaatctctcatcaacttttctttgccagactacccacttgtgattttcattctttattggtacttaagaatctcccatttttttcgggtaactgaacattgtccatgggagaaaaacgatatttaattacgtacaggagtcccacaaaatacgagactaaaagttgaagtcagatgattaaagcctacatggcatcctgagctactgaaaggaatgaatagagaattgggggcggggggcgggaagcagctctaacacaakttatgggacggtgaacggaggaaatgtatggtgaatcaagtttgttatgcagacagaataggtgatcttctgggtggtgtcagcctctaatctctcatgtgatccgagttaatcttccctggtttataaggattcgtgacaattgaggtatttttggagggtcagactttaggcaggtaaggaaagcacagggaaagcctcttcccgcctgctgttctccaggtgccctcagttcaaggtaatcagcccgccaaagcatcttgttttgggctggcatttcctgaactccttcagtggtta

SEQ ID NO: 163830 - DNA, 601 bp, Human
cttggacaagtaactcagccactttttacgttgagtaggtgtcctgacctccttgaacccatttcatcatctttatttgtgtcccaggattttctactcaagcatagacctactatgttcatgtactacttcatatacttgaatacattgaatgattttattcagtgaactgatgcttacaaagtacttagcatgacggtatctggcatgcaggaagtgcttaatgttattggttattattaacaccatcagtgtcatacagtgtgtaagaaatcaggctctgggccaggcgcagtggctygcgcccgtaatcccagcactttgggaggcggaggcaggcagatcacctgaggtcaggagtttcgagaccagcctggccaatatggtgaaaccccgtctctactaaaaatacaaaaattagcctggtgtggtggcgggcgcctgtagtcttagctactcgggaggctgagacaggagaatagcttgaacccaggaggcggaggttgcagtgagccgagatcgcgccactgccctcaagcctgggcgacagagcgagactccgtctcaaaaagaaaaaagaaatcaggctctgaggtcactt

SEQ ID NO: 163831 - DNA, 601 bp, Human
tttattagccaagatacacttttgttctgcttgattaagtgaacaagtgagtcacaacatgttacacagcattgctctattactgttttgaaaaataaaacagccgtgcacggggaaggatccctaagaatttataccgatacgttaacagttattatctctgggtggtaaaattcaaggtcatttttattttcttgttcatccatagtgttaatttttcctctactaatcaacatattatttgatttgtcaagttatttataaattttaaatgcatattcttgataaaccagtttttttwaaataactttatttcaaaaacatttcactagcattcatgttaacaatgtagctaacttaacgagcatcagagctgctaatatatctcaaccctaaaaatattaaaatttggaatggaaaaaaatggataatttaactacagaactgctattttttgagtttctgtagttgtagataaagtagtaaactctggaggcaagaacctggggaaatgactttgtctattggagcctaaccttccagcaacccatgtggcctcacagcgtggtgaactttgaatagcatgggcaaaatacacagt

SEQ ID NO: 163832 - DNA, 601 bp, Human
tctctcaagtggaaaagactctgtagctaaactttgggaaatatcaacgggacgaacactggtcagatacacgggtatgtgagaagttgatgttacttaacatttctgtagtgtttacactttccagaactctcttttaagacctcacaatagagcaacacaatatctatgcattgagcaaggcagatgttaccctttcttagataagaggaaaccaagacttacaggttaagtcatttagccaaggctacacgacttggaaatagaacggtgctttctttgctcttctgagcacctcacrccgtggactagggctggattccatgcaagtaacatttgagaacctggtgatccatttgtagactggcctgccctcttcccacagaaatgtgaaagcaatccagagaaaagtttccaatagtagatctcagtattattaatatatgtattcatgaaagaatggctgagagggaagatcttatcccattcctaagagagcagacctagcccgcaaaggaaaccacgttaattctgaatgcagatataaagtaggctcagcagacagaaaaaaattgcatccactgaattctcatttatgtat

SEQ ID NO: 163833 - DNA, 601 bp, Human
atgaagccagggactgtggctcacacctattatcccagcactttgggaggccaaggtgggcagatcatctgaggtcaggagtttgagaccagcctggccaacatggtgaaaccccatctctactaaaaatacaaaaattagttgagtgtggtggcacatgcctgtaatcccagctactcaggaggctgaggcaggagaatctcttgaacccaggaggcagaggttgcagtgagccgagatcacaccattgcactccagcctgggcaacagagtaagactctatctcaaaaaaaaaaaaaaragagagaatttacaagtgagcacataacacttagatatttcgaaagagtattcaccaaagtattgactgttacctctgatgggtgcaattattaggcagtttttattttcctttttatactttatttggtacttttaaacataaaatatgtaatttatagtcataaaaaggcttccttttggaaagtagatattcatatactttgtctcagtaattctgtctctaggaatttactcctaaggaaataaagctttctgtacaaaggatgttcattacaacattacttataattgatataaa

SEQ ID NO: 163834 - DNA, 601 bp, Human
cagcactttgggaggccaaggtgggcagatcatctgaggtcaggagtttgagaccagcctggccaacatggtgaaaccccatctctactaaaaatacaaaaattagttgagtgtggtggcacatgcctgtaatcccagctactcaggaggctgaggcaggagaatctcttgaacccaggaggcagaggttgcagtgagccgagatcacaccattgcactccagcctgggcaacagagtaagactctatctcaaaaaaaaaaaaaaaagagagaatttacaagtgagcacataacacttagrtatttcgaaagagtattcaccaaagtattgactgttacctctgatgggtgcaattattaggcagtttttattttcctttttatactttatttggtacttttaaacataaaatatgtaatttatagtcataaaaaggcttccttttggaaagtagatattcatatactttgtctcagtaattctgtctctaggaatttactcctaaggaaataaagctttctgtacaaaggatgttcattacaacattacttataattgatataaactaaatgtcaggaagtaaaagaattgttaaacagg

SEQ ID NO: 163835 - DNA, 601 bp, Human
tacaaaaattagttgagtgtggtggcacatgcctgtaatcccagctactcaggaggctgaggcaggagaatctcttgaacccaggaggcagaggttgcagtgagccgagatcacaccattgcactccagcctgggcaacagagtaagactctatctcaaaaaaaaaaaaaaaagagagaatttacaagtgagcacataacacttagatatttcgaaagagtattcaccaaagtattgactgttacctctgatgggtgcaattattaggcagtttttattttcctttttatactttatttgrtacttttaaacataaaatatgtaatttatagtcataaaaaggcttccttttggaaagtagatattcatatactttgtctcagtaattctgtctctaggaatttactcctaaggaaataaagctttctgtacaaaggatgttcattacaacattacttataattgatataaactaaatgtcaggaagtaaaagaattgttaaacaggccgggcatggtggctcacacctgtaatcccagcactttgggaggccgaagcaggtggatcacaaggtcaggagataaagaccatcctggccaac

SEQ ID NO: 163836 - DNA, 601 bp, Human
cctgacctcaggtcattcgcctgcctcggccttgcaaagtgctgggattacaggtgtgagccaccacgcccagccagtatcttttcttttttaaagacaatatgatcaactcgaaacataacagaatagaatagttaaacaaaattgtatcactagggtaggctgctgattatatacattttaactgacaggcaatggtcacagtgattttattataataagaattataattcttactataattatataacctcactcagtttgtgatagctagaacactttatactatatcttcactgayggtggagagtgataatgtgttaaatgcgtatattttatattagggaatatttactaaaatacaagttttattttcatattggaagaaacctactgtgctgtaaatggggtaaccagtgcacaaaaattattttttctactattcttttgtaaagtttgttcagaagtaatcttatttggactttaattttataagtccttcaactttatagaagtataattaaattttattataatttaacaatgacaggtaataatgcatagaatttagcttatgaattgtattaatatctgaattgct

SEQ ID NO: 163837 - DNA, 601 bp, Human
tagggtccaattactggaaagactaaggttccacaggctacttctatgcctactcacatagactttaataaaggtaaaggatataatgcatcaggacaaagaaagtgcaggcagtcatcaaggcatgacccccagagtcctttctcagttgcacagatgtgctttgcctccagattatgaaccgctgagatatgtgtgaggcatcatattttctggggagcccaggcacaagtttactgaaggtatctttcctactttgctgatcatgtagctaaagtcaggctgtgtacctaactaaatyggacaaaaaccttccatttattcatctctagtcaatatagacaggctgtcaaccattgtggaagacagtatggcgattcctcaaggatctagaactagaaataccatttgacccagccatcccattactgggtatatacccaatagattataaatcatgctgctataaagacacatgcacacatatgtttattgcggcactattcacaatagcaaagacttggaaccaacccaaatgtccaacaatgacagactggattaagaaaatgtggcacatagacaccatggaatactatgcagc

SEQ ID NO: 163838 - DNA, 601 bp, Human
ccagtcctgctgcaagagaacgtgatcctcataaacatgcttgatgccactgaacctccttaacatggagtgaagatttggaaatcaggaataattgtttctttcaacaattgagacagaaatttgcctccatacttaggaggttaattcttatttatatagaactttaagaaaagagtgtaaaaaaccatttatttttctaatgtaaatatgatatactgtcaataacccagtttttacttttcctgtgagccatatctgaaaaatttagggacattatttatgttgtcttaaattttttggaactagcattttaagaccattacaaaatgtgtagcttaatattaaatattatttatgaataagtaatgtacactatttcagagttgtccgtttatgagctttttttttttctcctttttttttttttaagagacaaggtcttactctgttatccagggtggagtgcagaggcatgatcatagctcactgcagccttgaactcctgggcttaagcaatcctcccaccttagcttcctgagtagctgggactatatgtgtgtgccactatgcccagctaattttttattttttgtagtga

SEQ ID NO: 163839 - DNA, 601 bp, Human
agtcctgctgcaagagaacgtgatcctcataaacatgcttgatgccactgaacctccttaacatggagtgaagatttggaaatcaggaataattgtttctttcaacaattgagacagaaatttgcctccatacttaggaggttaattcttatttatatagaactttaagaaaagagtgtaaaaaaccatttatttttctaatgtaaatatgatatactgtcaataacccagtttttacttttcctgtgagccatatctgaaaaatttagggacattatttatgttgtcttaaattttttgsaactagcattttaagaccattacaaaatgtgtagcttaatattaaatattatttatgaataagtaatgtacactatttcagagttgtccgtttatgagctttttttttttctcctttttttttttttaagagacaaggtcttactctgttatccagggtggagtgcagaggcatgatcatagctcactgcagccttgaactcctgggcttaagcaatcctcccaccttagcttcctgagtagctgggactatatgtgtgtgccactatgcccagctaattttttattttttgtagtgaca

SEQ ID NO: 163840 - DNA, 601 bp, Human
atctctaaaagtgcacttattaaaacatttaatttgtcagtgatatttagtaaagaaaaacactcatttgatgttatgtgttctaatgttctaaattttttctgaaaataattgtttcctaaaagaggtgtggtcctctctgcatcagagaacagagtactcctggggacagagctggccagaatacccaaaataattggcagatgtcaaatttggctttctgtgtttattactagagcataaacatttctagttttgtttgagtgttttacagtcctttttggcagttaggtattatacmtttttttcttttgcaatggttttcatgagaaatctttattcccattacatgtgtatgttttatttttcttctgaactttgtaatactttgctatgttgaattgtttctgttggtagcgcacttttgcagcattcttcaaataggaggcaaaaaaatctttagtttagattaattattagtacttacaaaaaccaaggaaatgctgacttaggcctatcttctggtccactatctgatttctttatcttagtgtgttgttggtccattgtttaatagaaaattagtagaggagtttgaatt

SEQ ID NO: 163841 - DNA, 601 bp, Human
tcattatcggggctatgtggagggagttcataattcatccattgctcttagcgactgttttggactcaggtaagcaatttcctttatcttctttttttttgtttcccctatgtcttaccctctttcctgtttctgtctccaaattaaatcattttgggcacttagcaaaattggaatttactttgatgttactgaacatttttacagctgtgtttcagatatccttggcatgtttatttaagaaagtattatagttgatgagttttaatatgtaaagaggaaattttttttgagaccactmaatcatttttgctatttaaaatgaaatatactttaaatttctgtagcactttatatttataaaattttcacttgtattatttaagacttgtatttaagtcttattatgactgtgaataagagctcattatctctgtatttaggtgagcaaactgaagttcagataaattatattacaattcaaattaagttattatagtattaacattacattccttgaggtcatggcaacatggcactgtgctggttggttgactgcatgattgcttgaactaaaacatattagttctatataagatga

SEQ ID NO: 163842 - DNA, 601 bp, Human
cttcgcatgaatttctgtaaaatgacaaaactagtcattttttaaaatggcaacccttattctaacttctgctctgggatattagtggatatgttttctttatctctcagcatagtaatggggtttttcattaaaatatgtgtgtgtttgcatgtgtgtgtgtgtgtagttttgattttagaaaattggtaattctgctttgtaaacttaaacccattttatctgtaactaacatttttctcatattagtgcagatagcagataacacttcaaaaacatttttttcccctcagacatagtytatcatcacttaaagtcattagcagaactggacaaagttttcatcactaagaagcagataacacttcaaaaaacatatttttcactttcttgatataggatatgttaagtaaaataattttatgatgttcttagcagacatgaaataagtgatgagagattaggatgtgatcatagccttataacttccttttgcctttatgatgtttgtgtttttgacagagaagaagagctgtcttgccacagacccggtatgtggagctgttcattgtcgtagacaaggaaagggtaagattggtga

SEQ ID NO: 163843 - DNA, 601 bp, Human
gttggctaataaaattgctttgctttctagaatttgagataacctatattgcactttgagagatggaaaacctccaggtcctggcatgctttagaagggaatagtattaatttccgtgtataggatcacatgagggcattttccttatttatacttaagaaactgaactaagtgctttgctttaactaagagaagtaatgtgtccctattttggcatttacaggattatcagttttagagataatggctgtataatttattttcatgttgctttttttattgatatataatacttcacatrtttagggggtacaggtgagtatttgttacaacagctgtgtaatttaaaaaagagagtatttttagtgttttgtttgacttttacttccaactttgttgtcagtgtgaaaaagttatttgtggaaacttactatgattggcagttcctttcttgtaagctgtagagacagttttgaggttttttttggttttaaaaaaattccttgttgtatgtaggttggaaaataacaagccaccccaaataactaatttggagaaaatattaagagatagacttggatttgtacattataggttcatt

SEQ ID NO: 163844 - DNA, 601 bp, Human
tacaacagctgtgtaatttaaaaaagagagtatttttagtgttttgtttgacttttacttccaactttgttgtcagtgtgaaaaagttatttgtggaaacttactatgattggcagttcctttcttgtaagctgtagagacagttttgaggttttttttggttttaaaaaaattccttgttgtatgtaggttggaaaataacaagccaccccaaataactaatttggagaaaatattaagagatagacttggatttgtacattataggttcattgccctcaagtggcagaaggaaaagcayatggaatatgaacaagtgtgaactctgccccaaacagtgggcaaaaagcttctgtagaagaatgttttggacaagtcacaaaagtcaagattcaaaatgttttccttggctgggcgcagtggctcacgcctgtaatcccagcactttgggaggccgaggcgggcggatcacgagatcaggagattgataccatcctggctaacacggtgaaatcccatctctcctaaaaatacaaaaaattagccgggcgtggtggcgggcgcctgtgatcccagaacccgggaggcggagcttgcagtg

SEQ ID NO: 163845 - DNA, 601 bp, Human
cacaaaagtcaagattcaaaatgttttccttggctgggcgcagtggctcacgcctgtaatcccagcactttgggaggccgaggcgggcggatcacgagatcaggagattgataccatcctggctaacacggtgaaatcccatctctcctaaaaatacaaaaaattagccgggcgtggtggcgggcgcctgtgatcccagaacccgggaggcggagcttgcagtgagctgagatggcgccactgcactgcagcctgggtgacagagggagacttcatctcaaaaaaacaaaacaaaacaaarcacacacaaaatgttcttcttcattgctgtctccagatgtatttgttatatacagatagaaaatggttaaaaaaaaggttcaatttcaatcaagccctatcaaatatattaaattaattttttttcttgtttaggaggatcatgattagatccctaactgataaaatctgatatattctgatactaatgcttttagcatagagcaaaatcataaatccttttaaaatttttcttctgctaaattggttatataaattaatgttaaaaatagacatttcagtttagccaggtgtcaaagaa

SEQ ID NO: 163846 - DNA, 601 bp, Human
gttaaacttttatatattttcatctacatatgattttttaactagtgattattggttaatctctcatttttaattcagcccagcatttagaaatggtttattggtgctgatctgtaaccaatctggctgtttctgtctcagttctattttctgtatgtcacttcgtttttctgtccataaatcttcttccactatgtggctgcacagagtctctctgaacctgttctggtttggaagccacacaattcttgaatcagtcattctttgctcaactaaattctgttaaattaaaaaaaaaaaagtttattgattacatcattagcttaagaggtgaaagggtcaggaagttctttagattgtcttttattcttttatctatgcattttgattgcttaaaactctacctttgtgaaatgcttgaaaatatttttgcattaaaataaaaggaacattaagaagataattcgttttaaagttctactaatttggataaaatgaagtcttcagtgctctttcattattattcactttacccttttacctgtttttcttttattcctgtcactacaatgtaacctttaaatttcttaatttgaaatgt

SEQ ID NO: 163847 - DNA, 601 bp, Human
gtggtaaggagaaaaataaaacgggagggtagatataaaagcattggaggttgtgattaaaattttagataaaagtttagaaaaacagtgttattcactgttgaattttgaggtgacatggtctagccagggagatgccttctgagtaaagacctgaaggaggtgagggaatgagtctgggttatattaatattagggaagagaggtccaggcggagggaacaggtgctgaggtacaggtgtgtggggtgtgactggggaggcacacagggcccatcctgaattcttttttttttattttkgagacagagtctcattctatcacccaggctggagtgcagcggtgcagtcttggctcactgtggcctccgcctcccaggttcaaatgattcttctgcctcagcctcccgagttgctaggattacagatgtgcgccaccatggctggctaattttcgtatttgtttttttagtagagatggggtttcatgatgttggccaggcttgtctcaaactcctgacctcaggtgatctgcccacctcggcctcccaaagtactgggattacaggcatgagccaccacgtctggcccatccttactcc

SEQ ID NO: 163848 - DNA, 601 bp, Human
cggtttgctgaaattaattgcatgacataccaatgagaagtctttttttttttttttccagccttttagatttagggggtacatgtggagtttgttacctgatgtattgctgaagtctattttttaattaaatgattccagagagctttaagaaggcaatacttatgtaggcacaagtatgtaactacactcttctgtaaaccagttatagactgaaagtataagaacatggcaaagtttattatctgaattagaaattaagagggagtttctgctaggttcagtgtggattggattacaytgaaggactgcataagaagtttcttcacaaacctctttttgagaaagtgctgcattgtcactgtaggtagaagagatcctgatatatttctattaacaaaccctgttttatagagataaaggtgggaggcaagacagagaagaggagagagaatggttaacatttgttaagctctttttatgtacaggcactattgtagccatttaaaacgtatccactcacttactactcatcagtgaaatgaggtgcacatactttatctccatttgcagatgaggaaactgaggtcacacatccaaa

SEQ ID NO: 163849 - DNA, 601 bp, Human
catttgcagatgaggaaactgaggtcacacatccaaattgctgactgggattcaaagtcaggaagtcaaagcctgtgatctgagaaccctttcctgtcccagagctaaaaaataattataatagaagatcccatggtggttgggcatcagaaatatagatttctaatgcagattcgttgtaatgccaacgaggttccttcctaatttagaaggcaggagtcctaagcagagagctgaatgtaactgtagttcgtacgtgtgtagatgttgagcctgagtgaaaattagatatgagaggtgrtatctttaacaaatacaggacggacctggtggctcatgcctataatctcagcaattagggaggattgcttgagaccaggagttcaagaccaacctgggcaacacggtgagaccctgtctctaaaaaaaaataaataaataaataaaaaataaaatattaactgggtgtgttggtgcgtgcctgtagtcccagctactcaggaggttgaggcaggaggatcacttgagcccaggagttcaaggctgcagtgagctatgattgtgccactgcactccagcctgggcaacagagcaagaccct

SEQ ID NO: 163850 - DNA, 601 bp, Human
catgccacttcccacctccctcaggctcctgaagcactgacagagtaataaaaacttctgtcaaccagcctttcagctgaagttctgagtggacaagacaatttcaatcacatgctagtataaagggaagcactcaagcagaatttacagtttttgaacaaatactaggctcaaaaatagatatggaagagttaaaatagtacttacaaaaagccatgcttcataaaaaaaaaattaggtatgtaaggaacgtcatatgtttgtaaaagatttcctgtaggagagggaagtaaatttaggrtttgctttggccagcagtgaagttgagaaagacgtgagttcagggaaacaagaaatgtgtaatgagcaatgagataagtcatagattaaaataaaaaagaagcattcagaggtaaggagggaatgttatgaaacagtgccatagtggaatttaatatggtataggaagcaatgaagagtggacccatactttattcaccaacttgtcaaacatttattgagcactgaccacctgccagactttgttctcagcacttggaatacctcagtgagttagatcgactcacccttcaaggagttt

SEQ ID NO: 163851 - DNA, 601 bp, Human
gagagggttccaggtgaattattcagccttattctcccagtgacttcttatctcttgaatagaagtggccaaagtgagtacctatgtcttgtccagcttagtgggaaagcttttgatttttcactgtggagtatgatgttgtctgtgggcttttcatatatggcctttattatattgaagtgatttccctcttcctagtttgttgagatcttttgttgtgaaagaatgttgaattttatcaaatgcctttttggcacctgttgagatgattatgtgactttgatccttgattctgttaacrtggtgttaatacatttttgtgtgttgaaccgtccttgtgtcccaggtacaaatctcatttggtcggagggcctgatgtttctggtgtgttgttgagttctgtttgctagtatttgttttgaggatttttacatttatgttgctagggatattgacttacaattttcttttctggttgtcccttgtctgactttgatattagggtgatgctgggctcataaaatgagtttggaagtgttccttcctcttcaatattttgagaagacttttttttcttttaagcagttttaggttcacagaa

SEQ ID NO: 163852 - DNA, 601 bp, Human
tccatagtttcgtgttttccagaatatcatatatttagaatcatgcagtatgttgccttttcatattggcttctttcacttagcaatatgcatttaaggctcctcatgtcttttcatgtcttgatagctcatttatttgtagtgctgaataataacccattgtttggatgtaccacagtttaaccatttacctactgaaggacatattggttgcttctaagctttggcaattatgaaaaaagctgccataagtgtccgtgtgcagggttttgtgtgatcatgttttcagctcctttgggtraataccaagggatgcgattgctggatcatatgttaagagagtatgtttagttttgtaagaaactgccaaattgtcttccaaagtagctataccattttgtattcccaccaacagtgaatgagaattgctgttgctctacatctttgtcagaatttggtgttgtcagtgttctggattttggccattcctataggcatgtagtggtatctcattgtttcaatttacatttccctgatgacataggatgtagatgatctttttccttctttatgtcttctttgtggcatctgtgaaggtctt

SEQ ID NO: 163853 - DNA, 601 bp, Human
tttggatgtaccacagtttaaccatttacctactgaaggacatattggttgcttctaagctttggcaattatgaaaaaagctgccataagtgtccgtgtgcagggttttgtgtgatcatgttttcagctcctttgggtaaataccaagggatgcgattgctggatcatatgttaagagagtatgtttagttttgtaagaaactgccaaattgtcttccaaagtagctataccattttgtattcccaccaacagtgaatgagaattgctgttgctctacatctttgtcagaatttggtgttrtcagtgttctggattttggccattcctataggcatgtagtggtatctcattgtttcaatttacatttccctgatgacataggatgtagatgatctttttccttctttatgtcttctttgtggcatctgtgaaggtctttggcccattgtttaatcagattgtttcttttcttattttttagttttaagagttgcttgcatactttggataagagtcttttatcaaatatgtcttttgcaaatattttctactagtctgcagcttatcttctcattcttttaatattgtctttcacagagc

SEQ ID NO: 163854 - DNA, 601 bp, Human
catatccaagatgatctaggttttctcccatgttatctcccaggagttttagagttttgaattttacacttagacctttgatccacatggagttaattgtggaggatgtaagatctgtgtctagatttatttatttattttttgcatatgaatatctaattgtagcagcaccatttgttgaaaagattatcttttattgtattgcctttgctcctttgtcagagatcagttagctgtatttatgtaggactctttttgggctctctatcttgttctctttatctatctgtcaccttttgcyaataacacagtcttgaagcttgtgcatgcgtcacatagttctcgtgccatggttttcagctccatcaggccatttaaggtcctttctaccctgtttattctagttagccatttgtctaatcttttttcaaagtttttagcttccttgcgatgggttcgaatatcctcctttagcttggagaagtttgttattaccaaccttctaaagcctatttctgtcagcctgtcaaagtcattctctgtccagctttgttccgttgctggcgaggagctgtgatcctttggaggagaaggggcgctc

SEQ ID NO: 163855 - DNA, 601 bp, Human
agtaagtcttgaagtcaggtagcaccagtcctccaactttgttcttcttctttactattatattggctattctgggtcttttgccaccccatgtaaactttaaaatcagttttatctatatccacaaactaatttgctgggattttgattaggatcgcattgaatgtatagatcaagttggggaactgacatcttaatattgagtctgcctgtatgtgagcatgaaatatctctccatttatttagttctttgattctttcatcagatagtgttatagtttccccatagagatcttatacrtattttgttagatttatacctaactctcatttttgggggtcctaatgtacatgatattatgtttttaatttcaaattctacttgttcattgctggcatataggaaagtaattgacttttgtatattaaccctgtatcctataaccttactgtaattgctttttagttccaggagtctttttcaattctttttgattttctacatagatgatcatattatctctgtacaaagacagtttttctttctttccagtcagtataccttttactttgttttcttttctcactgcagtagctagga

SEQ ID NO: 163856 - DNA, 601 bp, Human
attttcagaggactcaaataaatatgttttgaatgatagttgaaatttttttttttgtcatttccatgtaaaacattttcattattgtcgatctccttttgaagccattttgggaaaatcacctagatgtgagaaaagagaggaggagaggctataaatcattaatattgtagagtctagaggtgatagagagtagaaatacttgagttgctcttcaagccccgtatcaggagaaagatcattctttttgttgccataggtgccagccagtgatggctagtggaagggtattttcactgtrgcctctaaagcattttaaagtctcactgaaggccaacacaggggatgttgttactatctcccatctgttaaaaagcaccacaagtgtctatgattttgttatgctttttagttctatagtcaattcatgtgggtgaatttttttttttttttggtagattgctgaaggatcaagcatttgaaacattgtttataagaaaatatccttcaactaccagataatgagcttatttaaaaaataacttgtttagaggtggtagactttatgtaggttgaaattagggactaaaatataggacta

SEQ ID NO: 163857 - DNA, 601 bp, Human
gtcgatctccttttgaagccattttgggaaaatcacctagatgtgagaaaagagaggaggagaggctataaatcattaatattgtagagtctagaggtgatagagagtagaaatacttgagttgctcttcaagccccgtatcaggagaaagatcattctttttgttgccataggtgccagccagtgatggctagtggaagggtattttcactgtagcctctaaagcattttaaagtctcactgaaggccaacacaggggatgttgttactatctcccatctgttaaaaagcaccacaagtrtctatgattttgttatgctttttagttctatagtcaattcatgtgggtgaatttttttttttttttggtagattgctgaaggatcaagcatttgaaacattgtttataagaaaatatccttcaactaccagataatgagcttatttaaaaaataacttgtttagaggtggtagactttatgtaggttgaaattagggactaaaatataggactatacatatgcctgcgcaagttctttttttttttttttttttttttgagacggatctcgctctgtcacccaggctggagtgcagtggc

SEQ ID NO: 163858 - DNA, 601 bp, Human
agaaactttagcagttgcagtgcagaggactttgagaagttaactttaaataaaggaggaaactgccttcttaatattccaaagcctgatgaagcctatagtgctccctcctgtggtaataagttggtggacgctggggaagagtgtgactgtggtactccaaaggtcagtttaatttttgacttttgccttgtaaaattgccatgatatttgcaagaaataaaatggcttgctttgggcaactctgacataggagctaaagtaaaatttagtggcacagtgaggattgttattttgtttrtatggctgtgttccagggattggtcatctccttcttctcagagtatgactaacggtgccatctgttttgaagtcagggaatgtgccatgtttattctctacttttttaatgctattttctatgatttatggttattagcttatttgctttaaagaatgaatttcacctggctctttatttgtaagctttcaccattctggcactgccattgcaggaatatttatttagctggactcattttaaaaatgaattggagctggcctgtcctccagcgtccttcagtattcaaagttcttgcta

SEQ ID NO: 163859 - DNA, 601 bp, Human
acaagcccctgaccaccactattctgttcactgcttttatgaacttgactattttagatacctaatataagtggaatcaaatggtattatgtcctttgtggctgccttatttctcttagcatggtattgtatactcaagtttcatctacgttattgcaatgacaagatttccttcttttttgggaaatagtattccattgtatgtgtgtatatgtatgtatgtatgtacattttctttatccattcaactgttgacagacatttaggtggtttctacatcttggctactgtgaataatgcygcagtgaacataggaatgctaatatctcttcaagatcttgattttattttagataagtacccagaagtgggattgctagatcacatggtagttatatttttaatttttaaaagaaccttcgtactattttccatagtggctgcaccattttgcattcttcccaacagtgcacaagggttccagtttctccacattcttgccgacacttgttgtcttttgtttttttccgtgatagcaatcctaacaggtatgaaattatatttcattgtgattttgatttgcatttccatgatgatgagt

SEQ ID NO: 163860 - DNA, 601 bp, Human
ttttttccgtgatagcaatcctaacaggtatgaaattatatttcattgtgattttgatttgcatttccatgatgatgagtgacattgagcatcttttcatatacctgttggctatttgtgtgtcttcatggagcaatgtctattaagtctcaggcctgttttaattatttttttgtttcttttaacatttttatatatttaggggatgtaaatgcagatttcttgcatgtatatattgcatattggtaaagtgagggcttttcatgtacctgtcattcaaatagtgaacattgtacccaawaggtaatttttcagccctcacacccctcccatgctcccactttttggggtctccagtgtctgttattccactctgtacatccatgaatactgattgcttagctcccacttataagtgagaacatgcagtatttgactttctgcttctgagttacttcaattaggaaaattaacccattttaaatcaggttattagtttttcattttttgctattgagctgtagctcttcctgtatattttgaaagtttaccccttatggtttgcagatatttccccctattccataacttggcttttcac

SEQ ID NO: 163861 - DNA, 601 bp, Human
ataaggttccaatttcattcttttgcatgttgatatccagttttccacgggggaagggactaccttttcaccattctttttcttagcatccttgttgaagatcaggtgatctcatatgtgtgggtttttatttctgcattctttattctgttccattggtctatatgtctgaattttattttattttagattcagggggtacatatgtatgtttgttacatgggtatattgtatcctggtggggattgggcttctggtgtacccattacccaaacaatgaacattgtaccttataaataatttgtcagccctcactctcctcctaccctctccagccctcactctcctcctaccctctcctcttttggagttacccagtgtccatcacctccatctttatgtccatgtgcgcgcattgtttagcccatgcttataagtgagaatatgcagtgtttgattttgtgtttctgagttagttcacttaggataatggcctccagctccatccatgttgctgcagaggacatgatttcattcttttttatggctacatatagtattccgtggggtgtgtgtatgtgtgtgtgtgtatacatacata

SEQ ID NO: 163862 - DNA, 601 bp, Human
aggttccaatttcattcttttgcatgttgatatccagttttccacgggggaagggactaccttttcaccattctttttcttagcatccttgttgaagatcaggtgatctcatatgtgtgggtttttatttctgcattctttattctgttccattggtctatatgtctgaattttattttattttagattcagggggtacatatgtatgtttgttacatgggtatattgtatcctggtggggattgggcttctggtgtacccattacccaaacaatgaacattgtaccttataaataatttgtcagccctcactctcctcctaccctctccagccctcactctcctcctaccctctcctcttttggagttacccagtgtccatcacctccatctttatgtccatgtgcgcgcattgtttagcccatgcttataagtgagaatatgcagtgtttgattttgtgtttctgagttagttcacttaggataatggcctccagctccatccatgttgctgcagaggacatgatttcattcttttttatggctacatatagtattccgtggggtgtgtgtatgtgtgtgtgtgtatacatacatatat

SEQ ID NO: 163863 - DNA, 601 bp, Human
gatatccagttttccacgggggaagggactaccttttcaccattctttttcttagcatccttgttgaagatcaggtgatctcatatgtgtgggtttttatttctgcattctttattctgttccattggtctatatgtctgaattttattttattttagattcagggggtacatatgtatgtttgttacatgggtatattgtatcctggtggggattgggcttctggtgtacccattacccaaacaatgaacattgtaccttataaataatttgtcagccctcactctcctcctaccctctccagccctcactctcctcctaccctctcctcttttggagttacccagtgtccatcacctccatctttatgtccatgtgcgcgcattgtttagcccatgcttataagtgagaatatgcagtgtttgattttgtgtttctgagttagttcacttaggataatggcctccagctccatccatgttgctgcagaggacatgatttcattcttttttatggctacatatagtattccgtggggtgtgtgtatgtgtgtgtgtgtatacatacatatatatgtatatatatgtgtgtgcacacatac

SEQ ID NO: 163864 - DNA, 601 bp, Human
tctcctcctaccctctcctcttttggagttacccagtgtccatcacctccatctttatgtccatgtgcgcgcattgtttagcccatgcttataagtgagaatatgcagtgtttgattttgtgtttctgagttagttcacttaggataatggcctccagctccatccatgttgctgcagaggacatgatttcattcttttttatggctacatatagtattccgtggggtgtgtgtatgtgtgtgtgtgtatacatacatatatatgtatatatatgtgtgtgcacacatacatatgtatgtrtatatgtgtgtgcacacatacctatgtatgtgtatatgtgtgtgcacacatacctatgtatgtgtatatgtgtgtgcacacatacctatgtatgtgtatgtgtgtgtgcatacatacatatgtatgtgtatgtgtgtgtgcatacatacatatgtatgtgtatgtgtgtgtgcatacatacatatgtatgtgtatgtgtgtgtgcatacatacatatgtgtgtgtgcatacatacatatgtgtgtgtgcatacatacatatgtgtgtgtgtatacatacatatatgtgtatatatgtgta

SEQ ID NO: 163865 - DNA, 407 bp, Human
ctatatgtgcgtgtgtacacacacctatatgtgcgcgtgtgtacacacacctatatgtgcgtgtgtgtacacacacctatatgtgcgtgtgtatacatatgtgtgtrtacatacatatatatgtgcatatgtgtgtatatatgtgtgtgtgtatatgtgtgtgtgtgtatatatatatatatataaaagatttttctcatccagtcgactgttgatggacacttacattagtttcatgactttggtattgtgaatagtgctgcaatgagcatatgagtgcagataccttttttacataacgatttattttcctctgggtagatacccagtagtggaattgctgggtcaaatggtagttctagttttagttctttgaaaaatctttatactgttttccatagaggttg

SEQ ID NO: 163866 - DNA, 601 bp, Human
gcaacctccacctcctggtttctagtgattcttgtgcctcagcctcctcagtagctaggattacaggcgcgcaccaccatgcctagctaatttttgtatttttagtagagatggggtttcgccatgttggccaggctggtctcgatctcctgatctcaggtgatctacccgccttggtctgggattacaggcgtgagccaccacatctgtcctccttttagtattatttttgttttatttcataagtttttacatattgtgttttttgtttgtccaaaagtattttttaatcttgtgtttratttcctttttgacccaatggttgttccacagtgtgttgtttaatttccacatattggtgaattttccattttcctttctgcttttattgttgtctttttctattctaattgctagtttcatccattttggtcagaaaatatatttggtatgatttcagtcttcttaaatttctgaagacctgttttgtgacctaaaatgtgagcctggagagagttccatgtgtgcctgagaatagtatgtattctgccactgttgggtagaatgttctgtatatgtctattagtttgatttggtctgt

SEQ ID NO: 163867 - DNA, 601 bp, Human
gcatgtacattttaacttatatcagaagctaatgaatttcctataaatagtgtgggtcagtttgcatttctgacaacagtatattatgccattgtgtacccatagtcttaccagcacaggataatatgttttcttaattttggcaagctgatgggtaaaaaataagaagatactgttttagtttacagtttttcatgtgattgtagattataggcatcattttcttctatgaattattattttatgtattccttatcagttctgttggttcattaaatcttcttttaaattgatttttagrcctctttctataagatggacataactcctttgttatatatgttctaatattctttatttatagcttatttaacttttcataggttacattttatgttgaaatttaaaatttaaatgaaggcaaacttactaatttttttcctgtaatggtttcagaaatttgtatcttgacctggtttttagtattcctatatatagatcatcatcatagcccctctacaaattattttagttttttttaaatttaaaatttttatgttaactcttttaattgaggagggggcatgtggagtaagcttgg

SEQ ID NO: 163868 - DNA, 601 bp, Human
atgttaactcttttaattgaggagggggcatgtggagtaagcttggaaattaaacttatccactaatgatcagttgttgtggaaccatttaaaatggttcttttacgataacctaagttcctatatacattatctatttcctgattccctattctttcatgaagccaactgtcctgcagtgtttttgaactggccagcattcaccttcaaatctttatgtgaacttatgtttttaatactgttgggtaaatgtcccggagtagaatgacttggttagatggtagaggtatttaacttttcragaaactctcaaactgttttctaaagtgattgttccatttttcatttccatccttagtgtatgggagttctaattgtttcatatcctgaccaatacttcgtgtggtcagtgtttttaattttagccattctattgagtgtgaggtggtgcctcattgaggttttaatttgcatttccttagtaactaatgatgcattgagcatgttttcatgtgcttttttgccatcaggctatcttatggtgatatgactgttcaactcttttccctcatttaaaaattttgattacttattgttgagt

SEQ ID NO: 163869 - DNA, 601 bp, Human
aacttttcaagaaactctcaaactgttttctaaagtgattgttccatttttcatttccatccttagtgtatgggagttctaattgtttcatatcctgaccaatacttcgtgtggtcagtgtttttaattttagccattctattgagtgtgaggtggtgcctcattgaggttttaatttgcatttccttagtaactaatgatgcattgagcatgttttcatgtgcttttttgccatcaggctatcttatggtgatatgactgttcaactcttttccctcatttaaaaattttgattacttaytgttgagttttgagaatactttgtgtattctgtatacaagttctctatcagattgtcaatattttttccaagttgtagcttgcctttaattaacttagcagtatattttgaagagcagaactttttcatgttgatgaagtttattttataaacttgtaattttatcggttgttcttttggtgtcctatctaaggacttcttgcctgctccacagttgcaaaggttttctcctagaagttttatagttttaggttttacatttagttccatgatgcattttgactttttttgggtatattt

SEQ ID NO: 163870 - DNA, 601 bp, Human
taaatgcctttatggacactgacctctctgtgatcatcaaacatactgttatgaactgaatgtttgtgcttccccaaaactcatgtgttggagccagccaccagcatggctacatttggagatggggcctttaaggaagtaattaaggttaaacgaggtcataaggatggggccctgatccactaggatcagtgtccttgtaagaagagacaccaaacatctcacttgccgtctctctgcacacatgcactgaggaagggctatgtcagcacacagcaagaaggcagccctctgcaagccrggaagagaatcctcactagaaactgaactagtaggaaccttgatcttggatttctagcctcaagaactgtgagaaaataaatttctgcagtttaaacctgtggtattttgttatggcattctgagcagactaagtaaggcacatactatatgatttctgtcctttgaaatatgttgagacttatacttgcagctgaagagacattgttaaatccagaaacagtaagcaactgtttctggagggtaactgctacaatcatgttagaatgaagtagattttaggtgtaagatgagaatttta

SEQ ID NO: 163871 - DNA, 601 bp, Human
ggccctgatccactaggatcagtgtccttgtaagaagagacaccaaacatctcacttgccgtctctctgcacacatgcactgaggaagggctatgtcagcacacagcaagaaggcagccctctgcaagccaggaagagaatcctcactagaaactgaactagtaggaaccttgatcttggatttctagcctcaagaactgtgagaaaataaatttctgcagtttaaacctgtggtattttgttatggcattctgagcagactaagtaaggcacatactatatgatttctgtcctttgaaayatgttgagacttatacttgcagctgaagagacattgttaaatccagaaacagtaagcaactgtttctggagggtaactgctacaatcatgttagaatgaagtagattttaggtgtaagatgagaattttattaatgagtattaatgtcaattactaatttctttattgacagtcattttatgttcacaggaatgtgaattggacccttgctgcgaaggaagtacctgtaagcttaaatcatttgctgagtgtgcatatggtgactgttgtaaagactgtcgggtaaggaattcctccctt

SEQ ID NO: 163872 - DNA, 601 bp, Human
tcactagaaactgaactagtaggaaccttgatcttggatttctagcctcaagaactgtgagaaaataaatttctgcagtttaaacctgtggtattttgttatggcattctgagcagactaagtaaggcacatactatatgatttctgtcctttgaaatatgttgagacttatacttgcagctgaagagacattgttaaatccagaaacagtaagcaactgtttctggagggtaactgctacaatcatgttagaatgaagtagattttaggtgtaagatgagaattttattaatgagtattmatgtcaattactaatttctttattgacagtcattttatgttcacaggaatgtgaattggacccttgctgcgaaggaagtacctgtaagcttaaatcatttgctgagtgtgcatatggtgactgttgtaaagactgtcgggtaaggaattcctcccttttggaaacaggaaaaaaaaaaaaaaaaaaaagaaaacctgtgtatatcaaaatttgttttttgagatttctgagtcagcactatttttattttatggtcatgggaaaaattttatgccacttgtgtataattttaaagcacac

SEQ ID NO: 163873 - DNA, 601 bp, Human
tcatgggaaaaattttatgccacttgtgtataattttaaagcacactcttttacgttaagtggtctgttgatattgttttctaagtagaaacattttttttctgatttttagagtaacatatgcctgttagaaataattaaataacatgaaaccatagaaagtagagaatgaaagatcctctattattttatactcttcaggtaaccactgttgataatttgttaatataatcacgttttttctatacaaatgtgagtgtatgtgtgtatgtgtgtttttaagtgggtaagcacagatacmtatatttttactacctgcttttttcaatatgacaccatggacttttttcccattcatgtagttctataatacatggttatttaagtaatattacttgtatagttgtaccataatttctttagtcaactaatgatggacattttgattacttccagttattgcttataagagaaatcactggtgcagaatattcatactaagtttttgatatacattttatatatctttcacacatatgccaatctatacttctaccaacagtattatcaaatacttgtttccttatgccaatattggtta

SEQ ID NO: 163874 - DNA, 562 bp, Human
aagtagagaatgaaagatcctctattattttatactcttcaggtaaccactgttgataatttgttaatataatcacgttttttctatacaaatgtgagtgtatgtgtgtatgtgtgtttttaagtgggtaagcacagatacatatatttttactacctgcttttttcaatatgacaccatggacttttttcccattcatgtagttctataatacatggttatttaagtaatattacttgtatagttgtaccataatttctttagtcaactaatgatggacattttgattacttccagttaytgcttataagagaaatcactggtgcagaatattcatactaagtttttgatatacattttatatatctttcacacatatgccaatctatacttctaccaacagtattatcaaatacttgtttccttatgccaatattggttactagcaggcactatactcctagttaattcaataggtgtaaagggttcttgtatttttatttagtttgcatttctttttggttacaaatgaggtcatgtttctttactttccatagttagg

SEQ ID NO: 163875 - DNA, 601 bp, Human
gtaataaatcctgcgtaatagcatgagcccatatatgaattggcttgtgtgattgtggaagctgctaagtgtcagatctgcagggagagtcagcaatctggagaccctgtagagctgatggtatagttccagttagaagtctggcaggctcatgaccatggaagagctagtgtttcagttcaattccaaaggcaggaaaaaagctgatgtctcattccaaaggccttcaggaagacttttctcttacttgagggaggactggccttttcgttcaagtttaaaattgattggatggggcccrcctccaatagggagggcagtctgctttactcatcctactgatttcaatgttaatctcatccaaaatcacccttacagagacatccgtaattatgtttgattaaatatctggggattctgtggctcagtcaaattaactctactaaaaagggtaaaattaaccctcatcaaaaatccactccttgtcagcttgaaacccatagacaccttaaaccataccaaatctccaaatgtggaccttgttaagggcataattccacctagcatgatataataacactatcctgcatgcaactaaaac

SEQ ID NO: 163876 - DNA, 601 bp, Human
cagttcaattccaaaggcaggaaaaaagctgatgtctcattccaaaggccttcaggaagacttttctcttacttgagggaggactggccttttcgttcaagtttaaaattgattggatggggcccacctccaatagggagggcagtctgctttactcatcctactgatttcaatgttaatctcatccaaaatcacccttacagagacatccgtaattatgtttgattaaatatctggggattctgtggctcagtcaaattaactctactaaaaagggtaaaattaaccctcatcaaaaatscactccttgtcagcttgaaacccatagacaccttaaaccataccaaatctccaaatgtggaccttgttaagggcataattccacctagcatgatataataacactatcctgcatgcaactaaaacctcactaacctcttttccagaaaaggaggtaaagtgatgtttattcttcttcttgatatcccataacttaaatactgggatataaaattaacaatacttaaatgctataatatcaagtcaatatgtcttatgctgcatgataaaggtataaggaatgagaacatatttgctcagt

SEQ ID NO: 163877 - DNA, 601 bp, Human
tactgatttcaatgttaatctcatccaaaatcacccttacagagacatccgtaattatgtttgattaaatatctggggattctgtggctcagtcaaattaactctactaaaaagggtaaaattaaccctcatcaaaaatccactccttgtcagcttgaaacccatagacaccttaaaccataccaaatctccaaatgtggaccttgttaagggcataattccacctagcatgatataataacactatcctgcatgcaactaaaacctcactaacctcttttccagaaaaggaggtaaagtkatgtttattcttcttcttgatatcccataacttaaatactgggatataaaattaacaatacttaaatgctataatatcaagtcaatatgtcttatgctgcatgataaaggtataaggaatgagaacatatttgctcagtacgtgtgtgtgaatgcacacacacatacacacatgcagctattcttaatgaaacagtcttcgtttctgcaactggtcatgtggttgtagctggtatttataactaacttccacccattctgtattccctttgccttcagcaagcacgttagctgtttgtgg

SEQ ID NO: 163878 - DNA, 601 bp, Human
gctgattgagagcatatacagccttttggagaaccttgccccagcactgtaaggtattgctacctagtggcactgtaactgagtctccaaaaggcatttccaccatgctgtcagccagctgcttcaggatggtggggaaggaacatggtaaggccagtgaattccatgtgcatgggcccattgcctcatttcatttgctatcaagtgaattctttggtttgaagcagtgctgtgtagaatattatgatggtgggggaggaattctgtatgtccacagaaggtagttttggtagttcacagragtgttgctacagagatggcaaatctatatcaagagtacgtgtgtctgtcccagtaagaacaaagcactgcttctttcatcatggaaagggaaaaatgtaatcaacctgccaccaggcagctgactgactaacctagggaatggtgtcatactggggactcaggattggactttgctactggagaatttgggcacttagcagcaacaatagccaggtcagttgttgagaggaagtccatgatgctgagcccacgcatcgcctccaaccctgccactgtgagtacgtggttcctgagccca

SEQ ID NO: 163879 - DNA, 601 bp, Human
gtcacctgatgggtaggaagttccccgtgaggtcatagttgctggctaggagagaaaatgtagtgtagcaggagtggggagcaggggcatgtggggcacttctttatgtaacttgtgccttccaggccttggtttggctcaattacatacgtagcacttccatttcatgatggggtgctgctgcatatgcccagctttatagcttggtgagtcagatgacatccagtttatcatgggcaactcaggttgaatggtaacttggtgggtggcccatggttaaatgttcaatttctactttaasgcccagtagcaggccaatagttttttctcaaaaggagagtagttattcgcagaggatcacaaggctttgctccaaaatcctaaatgcctgcactgcacctgacctatagggaactgtcggaggcgctaaacagcatttctgtctgtaactgctgcttcaagcactgtttgatctgcttgatcaagtgggctaagcagcagagcatcttgcctgacagcctggacctattgcagagtttctctttgttctgggcccagctcaaaactagcagctctttgggtcagtgggtaaatgggccag

SEQ ID NO: 163880 - DNA, 601 bp, Human
cccagctttatagcttggtgagtcagatgacatccagtttatcatgggcaactcaggttgaatggtaacttggtgggtggcccatggttaaatgttcaatttctactttaaggcccagtagcaggccaatagttttttctcaaaaggagagtagttattcgcagaggatcacaaggctttgctccaaaatcctaaatgcctgcactgcacctgacctatagggaactgtcggaggcgctaaacagcatttctgtctgtaactgctgcttcaagcactgtttgatctgcttgatcaagtggrctaagcagcagagcatcttgcctgacagcctggacctattgcagagtttctctttgttctgggcccagctcaaaactagcagctctttgggtcagtgggtaaatgggccagagttatgcaaccaaatgaggaatattttgccttcagaaatccaaatggacctctaaacattgtgccattctgttggttgtgggagtggccagatgcaacttcttcttccccttagaaaggatatcttgacatgtcccacaccactggacatgtagaaatttcactgaggtagaaggcacctgaattttt

SEQ ID NO: 163881 - DNA, 601 bp, Human
ggcagatcacttgaggtcaggagtttgagaccagcctggccaacatggcgaaaccctgtctccattaaaaacacaaaaattagccaggcatagtggtgcactcctgtagtcccagctacttgggaggctgaggcaggagaatcgcttgaacttgggaggtggaggttgcagttagctgagattgtgccactgcactccagcctgggcaacagagcaagactctgtctcaaaacaaacaaacaagaaaagaaagagtttagagctcagtgtacccagctttatcgaagtctccccacatgtsctcatttcaactttcaagatccagttccttattgatcaataacctcaatttaacagtagataccctacaaggctaggagttcaatttgctttcagccagtcacaggataagattctaggtttgattttcaacaatctcagctctgcaactaccggcgatatggctgtcctttagggcacacacagaaaatttcaggtcacttatatggtgcttgaactaggaatccctgcgcttatcatcttctttccctactttgtccagtaaaataaggagcaaccaggcaatctcatactgttagta

SEQ ID NO: 163882 - DNA, 499 bp, Human
attttctctcattttgtaggttgcctgttcactctgaaggtagtttcttttgctgtgcagaagctctttagtttaattagatcctatttgtcaattttgtcttttgttgccattgcttttggtgttttagacatgaagtccttgcccatgcctatgtcctgaatggtattgcctaggttttcttctagggtttgtatgrttttgggtctaacatttcagtctttaatccatcttgaattaatttttgtataaggtgtaaggaagggatccagtttcagttttctacatatggctagccagttttcccagcactatttattaaatagggaatcctttccccatttcttgtttttgtcaggtttttcaaagatcagatggttgtagatgtgtggtattatttctgagggctctgttctgttccattggtctatatctctgttttggtaccagtaccatgctattttggttactgtggccttgtagtatagtttgaagtcag

SEQ ID NO: 163883 - DNA, 601 bp, Human
tttctttttttaaatgtttaatgttacagaagccaaggctgcccccaaagattgtttcattgaagtgaattctaaaggtgacagatttggcaattgtggtttctctggcaatgaatacaagaagtgtgccactgggtaagtggaggtgcggtcataatggaatatgaaagattataagatccgtcatctctagtatcttttttttttttttttttttgagacggagtcttgctctgttgccaggctggagtgcagtggcgcgatctcggctcgctgcaccctccgcctcccaggttcaagygattcccctgcctcagcctcctgagtagctgggactacaggcatgtgccaccacgcccagctaattttttgtattttagtagagatggggtttcaccatgttggccaggatggtcttgatctcctgacttcgtgatccgctcgcctcagcctcccaaagtgctgggattagaggcgtgagccactgtgcccggccgtctctagtatcttttacaactgctctctgtgaccgctgattttctcccccttaaatacctaacttttcaaacattttacaatgcaaagcttcagagagactctg

SEQ ID NO: 163884 - DNA, 601 bp, Human
atctctagtatcttttttttttttttttttttgagacggagtcttgctctgttgccaggctggagtgcagtggcgcgatctcggctcgctgcaccctccgcctcccaggttcaagtgattcccctgcctcagcctcctgagtagctgggactacaggcatgtgccaccacgcccagctaattttttgtattttagtagagatggggtttcaccatgttggccaggatggtcttgatctcctgacttcgtgatccgctcgcctcagcctcccaaagtgctgggattagaggcgtgagccacygtgcccggccgtctctagtatcttttacaactgctctctgtgaccgctgattttctcccccttaaatacctaacttttcaaacattttacaatgcaaagcttcagagagactctggtgttaggaaaagaactggtaacataatttgtccctttagacatcaactacaatctagtggtttttagactcttattttgtttatccttgatttataataagaaccccaactaaacaccattttcattttcctttccataaaagattatgttactaagtccctagataaaggtacctgcagaaga

SEQ ID NO: 163885 - DNA, 601 bp, Human
atacagaggagtagaaagaatagtgtgatgaacaccaatatatcccagaccaagacattattaatgccttatcattatttgcttcatcaagattttgctgaaccattttaagtaaattatagacatgatactttactcctaaattcctcagcatccgtcttcaacaaataaggccattcacatgatcacatcacacctaacaaaatgaatgatttcctaatatcatctagtatctgatcaatattagtatttccataagtgtcctcaaactgtcttttatagccggcattttccaacatcmggactcaatcaaggatcacacattgcatttagttgttatgtcacttaagtcacttttaatccagaataccttttagactgattttttttcttttcagtgacattgatttatggaaatggctgggccagtgggctcatgttctggatttgttttagtttccttttggtgttgcttaacttatgtctctatcatccgaattttatttaaatcagaagttaagcccaaaatcttttttttttttttttttttttgagtagagcctcactctctcgctcaggctggagtgcagtggcatgatct

SEQ ID NO: 163886 - DNA, 601 bp, Human
tgatttatggaaatggctgggccagtgggctcatgttctggatttgttttagtttccttttggtgttgcttaacttatgtctctatcatccgaattttatttaaatcagaagttaagcccaaaatcttttttttttttttttttttttgagtagagcctcactctctcgctcaggctggagtgcagtggcatgatctcagctcactgcaacctccacctcccagattcaagtgattcttgtgcctcagcctctggagtagctaggactacaggtgtgcaccatcatgcctggctaagtttygtatttttagtagagatggggtttccctatgttggccaggctggtctcaaattcctgacctcaaatgatccgcttaccttagcctcccaaagtgctgggattacaggcgtgagccaccgcgcctggccctaagcccaaaatcttaattgaattcaggttaaatatttttggcgagaatgttcataagcaatgcattatatcaaggagtcacttagtgctgggtagtcttattaatattagtgatactaagtggcaatgaccagatcttgctattgtggagttatgctttttaaaattgca

SEQ ID NO: 163887 - DNA, 601 bp, Human
cttctgttaattacctccctattttaaattagggctgggcacggtggctcatgcctgtaatcccagcactttgggaggctgaggtgggcggatcacttgaagtcaggagttcgagactagcctgaccaacatggtgaaacctcgtctctacagaaaatacaaaaactagccagtgtggtggtgcatgcctgtagtcctaactactcaggaggctgagacaggagaatcgcttgaacctgggaggcacaggttgcagtgagccgagattatgccactgtactccagcctgggcaacaaagtragactcccatctaaaaataaagtaaaataaaataaaataaaatagtatgctatttctagatttatctattttagacattatccactagttttatttttgatagataagaattcaattttcttatgcaaatcccagtttccctgctgtaccttttcaaaataagtgcttaatatttacataattaatattggggtgttattgaatgagtccacaacatctcactgttcactgggcatattccagacgaggtgagagaaaacaggggaggctaaacaattggagatcaaaggatcattttta

SEQ ID NO: 163888 - DNA, 601 bp, Human
caggatcttgctatgttgcctaggctggtcttcagctcctgggctcaagcgattctccctcctcagcctcccaaagtgctgggattacaggtgtgagccactgcacctagctgggcatctttccatgtctttattagatccatgtatttttttctgagaagttcatattgatatctctttttctattagcttgccattttttgaggcttctcatatgagaagaatattaactgtcagtcagttatatctatgtaaatatgatcaacaatttgacataagcctattttaaaatatcatgaattttttttttttttttttggagcctcactctgtcacccaggctggagtgcagtggtgcaatctcagtgcaacctccgcctcccaggctcaagtgattcttgtgcctcagcctccccagtagctgggattacaggcatctgccaccatgtctggctaatttgtgtgtttttagtagagacggggtttcgccatattggccagactggtctcgaattcctaacctcaagtgatctgcctgccttggcctccaaaagtgttgggattacaggcgtgagccatggcatccggccttaaaatatca

SEQ ID NO: 163889 - DNA, 601 bp, Human
aaaagctttttgtatctcagtataatatgaatatctggcttttattggcacaatttattaacatttcatcctatttctctgatcttattgctgctgttaaatattttcttgatattttctactttatcttcctcttgcagtattacacaaattatttatttgtgtgtggggtgtgtgtgtgtgtgcacatacactttggtagttgtatgtctttctattctgcttgtttacttaataacaaaaaaatgaatatatttttctcaaagttgtcgtgattaaaaatagtatctactgattgttkcagtgtaagctataccactattacttccaaacccccatgtcccagtttttacttggtaggaaaaatattggctttagattccaggttgttattaacatatatcaatgtatttttaagaccttttgtctttctggattttattgctaactgcatagttttctagctatgacaataatatttatgtacaagaaaggatagcaagtggttggtgtgtgtacctggactgatacaccttgacccaaactgacatgccgttgagaccatataccacacgttctgtacagctgtaactttgtaact

SEQ ID NO: 163890 - DNA, 601 bp, Human
cagtgtaagctataccactattacttccaaacccccatgtcccagtttttacttggtaggaaaaatattggctttagattccaggttgttattaacatatatcaatgtatttttaagaccttttgtctttctggattttattgctaactgcatagttttctagctatgacaataatatttatgtacaagaaaggatagcaagtggttggtgtgtgtacctggactgatacaccttgacccaaactgacatgccgttgagaccatataccacacgttctgtacagctgtaactttgtaactrttggtttaatctgtgagtctaacacccaagttttcacacggcagataggatcctgtcccttctggtatgtaccaaagcctagactggacagtttgagcagactgacaacttggtacttcttcagatctgtattctttatatatttattcaacatttatttccaggacaagctaaacgtggggtagggggaaaagtggaaaataagaactcctcaccttcatttttattgtcccaggtagttcaattttgctccccacttgcatcctgaaatcagtaaaccagaagtcctatagtcaactt

SEQ ID NO: 163891 - DNA, 601 bp, Human
accactattacttccaaacccccatgtcccagtttttacttggtaggaaaaatattggctttagattccaggttgttattaacatatatcaatgtatttttaagaccttttgtctttctggattttattgctaactgcatagttttctagctatgacaataatatttatgtacaagaaaggatagcaagtggttggtgtgtgtacctggactgatacaccttgacccaaactgacatgccgttgagaccatataccacacgttctgtacagctgtaactttgtaactgttggtttaatctrtgagtctaacacccaagttttcacacggcagataggatcctgtcccttctggtatgtaccaaagcctagactggacagtttgagcagactgacaacttggtacttcttcagatctgtattctttatatatttattcaacatttatttccaggacaagctaaacgtggggtagggggaaaagtggaaaataagaactcctcaccttcatttttattgtcccaggtagttcaattttgctccccacttgcatcctgaaatcagtaaaccagaagtcctatagtcaactttgctctacttgct

SEQ ID NO: 163892 - DNA, 601 bp, Human
ctgttggtttaatctgtgagtctaacacccaagttttcacacggcagataggatcctgtcccttctggtatgtaccaaagcctagactggacagtttgagcagactgacaacttggtacttcttcagatctgtattctttatatatttattcaacatttatttccaggacaagctaaacgtggggtagggggaaaagtggaaaataagaactcctcaccttcatttttattgtcccaggtagttcaattttgctccccacttgcatcctgaaatcagtaaaccagaagtcctatagtcaastttgctctacttgctgcgtggtggttgttggtggtggccatgggtggtagggggagtggtagtagtatgtgagaggatggtcttaccttcccactgtgagagttttttttttttttttttttgaggcagggtctcgctctttgacccaggctggagtgcagtggagtgcagatcttggctcactgcagcctctgcctcctgggttcaaacgattctgctgcctcccaggtagctggaattacaggcttgcaccaccatgcccggctaatttttgtgattttagtggagatgggggtttca

SEQ ID NO: 163893 - DNA, 601 bp, Human
actgacaacttggtacttcttcagatctgtattctttatatatttattcaacatttatttccaggacaagctaaacgtggggtagggggaaaagtggaaaataagaactcctcaccttcatttttattgtcccaggtagttcaattttgctccccacttgcatcctgaaatcagtaaaccagaagtcctatagtcaactttgctctacttgctgcgtggtggttgttggtggtggccatgggtggtagggggagtggtagtagtatgtgagaggatggtcttaccttcccactgtgagagttttttttttttttttttttgaggcagggtctcgctctttgacccaggctggagtgcagtggagtgcagatcttggctcactgcagcctctgcctcctgggttcaaacgattctgctgcctcccaggtagctggaattacaggcttgcaccaccatgcccggctaatttttgtgattttagtggagatgggggtttcaccatgttggccaggctggtcttgaactcctggcctcaagtgattcacccacctcggcctcccaaagtgctgggattacaggcgtgagccactgcacccggtcc

SEQ ID NO: 163894 - DNA, 601 bp, Human
ccaggacaagctaaacgtggggtagggggaaaagtggaaaataagaactcctcaccttcatttttattgtcccaggtagttcaattttgctccccacttgcatcctgaaatcagtaaaccagaagtcctatagtcaactttgctctacttgctgcgtggtggttgttggtggtggccatgggtggtagggggagtggtagtagtatgtgagaggatggtcttaccttcccactgtgagagttttttttttttttttttttgaggcagggtctcgctctttgacccaggctggagtgcagtrgagtgcagatcttggctcactgcagcctctgcctcctgggttcaaacgattctgctgcctcccaggtagctggaattacaggcttgcaccaccatgcccggctaatttttgtgattttagtggagatgggggtttcaccatgttggccaggctggtcttgaactcctggcctcaagtgattcacccacctcggcctcccaaagtgctgggattacaggcgtgagccactgcacccggtccccactgtgagagtttttgggtgtattcctttcagtttgatttttcccattccacaaggta

SEQ ID NO: 163895 - DNA, 601 bp, Human
atttttgtgattttagtggagatgggggtttcaccatgttggccaggctggtcttgaactcctggcctcaagtgattcacccacctcggcctcccaaagtgctgggattacaggcgtgagccactgcacccggtccccactgtgagagtttttgggtgtattcctttcagtttgatttttcccattccacaaggtaaacactgccaatcagaacaccctttctctggaggacttggaattttcctgccccttaaagtaaatctgccagttattaacacatttcatcttatttaacacttcrggtgtccgctatgaatcaattattgacaggaaaatcttcttttaactggtagggaaactcttggtaaatatctcctctaaagacttgcggatgtaagaaaaaagtattttgaaatctttattcaggagtagtgcatggctagaggacacatgaggagtgacttactgtagaatcttctgtaattttggaattttaaatcatatatgtcctatttaaaaattaatggaaaattggaggaaacagtgtttggagatcttttgactttaaaagtacaattctgtttaaacctgtgtatttttt

SEQ ID NO: 163896 - DNA, 601 bp, Human
ggtaaggctatcgatatttcgttgtaggtttgttctctaattgttctttatttcatttgagcatttaaatattctgatcttgtacacaagatcagttggttagttacctaataaaattttaaaatagcactcaacagtcttttaaaacgttagtcttctttttttcctctaacatcacaacagagcagttttcacaaagatgtcaactaaaaaatttctaaaatgtgttgagctgatttctttagatcttaggtttaatatttttttctgaggtaatggtttttatctctcagtagctagrattcatttctgtttcatatctcatcatatgaactagaatttcttgaaccatgtaagattataacttattttcaacagtgcttttaatagaaatatctaatcatggtactagaaaacagattttatcttgtcaacaaagtacccttttatttttgaaagaattttaaaaattaaaatgagttttaaatattatccttttgatatctgtcatagtaacaacactttatgagaggtgtaatagaaatagaccttctatccttgaaactttcttgtagtcctggggttaactctatctagttac

SEQ ID NO: 163897 - DNA, 601 bp, Human
tctcccagtggcccaaggcataaattgggcatcctcgtacctctccctcacttcccacatcagttatacatttaattatgttgattcagcctcctaaattccttgtgactgtttccatttttctcatccccatttattactttcaatttcttgcctggacatacatcatagcctcttatgtaggctccctatttttcatcttgcttcctataatccatgtttcactctacattacagtttcagtgttttcctacaagaattcagttttgattttgtcagcgtcttgctttaattcagtgcrtctgcattgctattagaatgaagtccacaactccttaacatgggttaaatgccctgcatgacttgcccctagcttgcctttcaagcctcatttcactatgttgaagacatattgtaacttctttgatttcctgtactaggctactatcttttacctgtgggctttcataccgtattattttcacattgttggcccttggctaattgctatttaggtttcagattatacctcattttctaaagaaagtttcccctggctgcttaaatctaaattatcatttccttctattgcttttctagt

SEQ ID NO: 163898 - DNA, 601 bp, Human
ttacttctactaatgttataaatcccacaattcattgttactcattttgctttgaacagttgattatctttcagagacttaatggtagaaaaagtctttatatttacccatataattaccatttctggtgtttttcatttatgtaaatttgcatttcaatctgatttaatttctgcttgaaggatttccttttacatttcttataataccagtgtgctagtgacaaatatttttagcttttgtatgtctgaaaaagtctttaatttgccttgctgcttgaataataatttaactgggcaasgattttgggtgatagttttcctcccgttttacttctaaggatattccttgtcttctgacttgcattgtttttcctgaaaaatctgctatcatccttttctttgtatataatgtcttccgtatatgtctttttctaatctctggtcacttgtaatgttttgctctttatctccggtttttatattgtgccttggtgtagttgggattttttgagctttttggatctgtgcttttatagttttcttcaaatttggaaaatttttggccatcgtttcttcgaatatttttttctgtcttcctc

SEQ ID NO: 163899 - DNA, 601 bp, Human
ctgcttgaaggatttccttttacatttcttataataccagtgtgctagtgacaaatatttttagcttttgtatgtctgaaaaagtctttaatttgccttgctgcttgaataataatttaactgggcaaggattttgggtgatagttttcctcccgttttacttctaaggatattccttgtcttctgacttgcattgtttttcctgaaaaatctgctatcatccttttctttgtatataatgtcttccgtatatgtctttttctaatctctggtcacttgtaatgttttgctctttatctcyggtttttatattgtgccttggtgtagttgggattttttgagctttttggatctgtgcttttatagttttcttcaaatttggaaaatttttggccatcgtttcttcgaatatttttttctgtcttcctctttctcctcatccaggtcctccaattttatgtatatttggctgcttggtgttatttcacatgtcactgattggctgttgattttttatttttgtttttttttcttaaattttaatttaactttactttttttgagacagagtcttgctctatcacccaggctggagtgcagt

SEQ ID NO: 163900 - DNA, 601 bp, Human
ttgtaatgttttgctctttatctccggtttttatattgtgccttggtgtagttgggattttttgagctttttggatctgtgcttttatagttttcttcaaatttggaaaatttttggccatcgtttcttcgaatatttttttctgtcttcctctttctcctcatccaggtcctccaattttatgtatatttggctgcttggtgttatttcacatgtcactgattggctgttgattttttatttttgtttttttttcttaaattttaatttaactttactttttttgagacagagtcttgcyctatcacccaggctggagtgcagtggtatgatcttggctcatggcaatctctgcctccggggttcaagcaattcttatgcctcagcctcctgagtagctgggactacaggcgtgtgccaccacgcctggctaacttttgtatttttagtagagacagggttttaccctgttggccaggctggtctcaaagtcctggcctcaaatgattcacccacctcagcctcccaaagttctgggattataagtgtgagccagcatgcctggctggctgttgatttttaaaaattattccttattctc

SEQ ID NO: 163901 - DNA, 601 bp, Human
gccatcgtttcttcgaatatttttttctgtcttcctctttctcctcatccaggtcctccaattttatgtatatttggctgcttggtgttatttcacatgtcactgattggctgttgattttttatttttgtttttttttcttaaattttaatttaactttactttttttgagacagagtcttgctctatcacccaggctggagtgcagtggtatgatcttggctcatggcaatctctgcctccggggttcaagcaattcttatgcctcagcctcctgagtagctgggactacaggcgtgtgccaccacgcctggctaacttttgtatttttagtagagacagggttttaccctgttggccaggctggtctcaaagtcctggcctcaaatgattcacccacctcagcctcccaaagttctgggattataagtgtgagccagcatgcctggctggctgttgatttttaaaaattattccttattctccatgtttaattttgagtaacttctgttactcttcaagtttacatttcttgtgtgaagtctaatttgccattaacttgatctagtgtgtttttcattttagacattgtagtttttat

SEQ ID NO: 163902 - DNA, 601 bp, Human
aggtcctccaattttatgtatatttggctgcttggtgttatttcacatgtcactgattggctgttgattttttatttttgtttttttttcttaaattttaatttaactttactttttttgagacagagtcttgctctatcacccaggctggagtgcagtggtatgatcttggctcatggcaatctctgcctccggggttcaagcaattcttatgcctcagcctcctgagtagctgggactacaggcgtgtgccaccacgcctggctaacttttgtatttttagtagagacagggttttacsctgttggccaggctggtctcaaagtcctggcctcaaatgattcacccacctcagcctcccaaagttctgggattataagtgtgagccagcatgcctggctggctgttgatttttaaaaattattccttattctccatgtttaattttgagtaacttctgttactcttcaagtttacatttcttgtgtgaagtctaatttgccattaacttgatctagtgtgtttttcattttagacattgtagtttttatttctggaagttccatttgtttcttttatatatctttcatgactctacata

SEQ ID NO: 163903 - DNA, 601 bp, Human
tagattttgtctgttatatgtattatatactgtattattataataaagcaagctagagaaaagcaaatttattaagaaaatcataagagaaaatatatatactattcattaagtggaagtagattatcataaagaccttcatcctcatcatcttcctgtagagtaggctgaggaggaggaggaagaggagaggttggtctcaggggtggcagaaacacaagatagcctgcatataagtggacctgcacagttcaaacccacattgttccagggccaactgtattttgattttcagttgggatattgtttcatatagttttatacaactttttttttttttgagatggagtctcgctctgttgcccacgctggagtgcagtggtgcaatctcggctccgcctcccgggttcatgccattctcctgcctcagcctcccgagtggctgggactacaggcgcctgccaccacgcccagctaatttttttttgtatttttagtagagacggggcttcaccatgttagccaggatggtctcgatctcctgaccttgtgatccgcctgcctcggcctcccaaagcgctgggattacaggtgtgagcca

SEQ ID NO: 163904 - DNA, 601 bp, Human
tttgtatttttagtagagacggggcttcaccatgttagccaggatggtctcgatctcctgaccttgtgatccgcctgcctcggcctcccaaagcgctgggattacaggtgtgagccactgcgcccggccagttttatacaactttttacagaaatttctggttcttttacaaacttaaaattatgaatcagtttaccactcccgtttatatctactatattgtttctcaaaagaacacagaacagataaaatacttaaagaatttgtaaaagttctaatgaaacttaaaatctagaaggcrtaaaaataagattgataaattcaactatacaaaaataataaacttttccgtggagaaaagcatagtgccataggttaaaatggggaaaatatttccaacttgtatcatggacaaagctaatctctctaatatataaagaacttttagaaattaagaagaaaaaagcaagagtccagtagaaaaacagtcaaaggactgagcagaaaaaaataaataatgtttccttaagaaaaaagtgaggccaggcacggtggctcacgcctgtaatcccagcacttagggaggccgaggcgggcagat

SEQ ID NO: 163905 - DNA, 601 bp, Human
ggaggccgaggcgggcagatcatgaggtcaggagttggagaccatcctggccaacatggtgaaacctgtctctactaataatacaaaaaaattagctgggcgtggtggcgcatacctgtaatcccagctactcgggaggtggaggcagcagaatcgcttgaacccaggaggcagaggttgcagtgagtggagatcgtgccattgcactagcctgggcaacagggtgagactccatctcgggaaaagaaaagaaaaaaaaattatcaactcatagtataaaaaaatgtaaattaaaattctrtaagagaaaatttttcacctgcctggttggcaaaaatccggaaatttggctctgtgggtgaggctatggggaattcttatatattgcttgtaatattcttataaattgtaaccattactattgaaagacaatttgacaatacctaaaagaaatgatgaatgcacttatttattgatacagcatttctgctttagggaaattattctgtagttattatacctgcactaatatgatacaacatatgtgcaaggttattcattatagcagtttttttggtagtagcaaaagattggaaaaata

SEQ ID NO: 163906 - DNA, 601 bp, Human
atagatcagggaaacttatgtcttggtgaaatggaagaccatgtttctaaacacctgtcgccaggttggttcaccttgctgtggtactgttcttaatcctgcctcagtgatactgtattttttagaaacttaagggattctaacatctttctgaatctcatcattgatatcaggagatcctgtggggttttttttatttgattttttaaaatgggcattttaatataaaagtcagaaaggtattctttggccatgtaatcttcctagaagtatccaggaatttttctttaactcctcttcygtagtgccagttaatgatctaatgctttcaaattgagaaaagaaccaaaacaccagagaatctttggaaactaatgcaaaatggaggatccaaaatctcttaaatataattctgtttttttcctaagttgaaaggtgagaaaagtattattaagtggcttcccagctatgctctaaggaattctaaactttctaggaagaaccagggacaatttcaggagtcaggggatgctgataagtggaattccaggctctctatgatgcttccaaccccataaaccagagtagctggtttgcatag

SEQ ID NO: 163907 - DNA, 601 bp, Human
ccttggcttgtggtcacatcactttctgctgggcctccatcctcacatcacatctctctctgcgtcttcctttctgtgtgtgtgtctctgaactccctctggctctttttgttataaggatacatgtgattgcatttagggcccacctgggtaatccagggtaagattctctctcaacagccttaatttatacactcttttgccatataaggtaatattacaagttctggggatccagacatggacatagctggcattcaccctattataactttttacacacaattctgccgtttgagtrtatcttgtccgaaatgcttgaaaccaggtcagctgtggaatttgtcacttgtgatgtcaaataggcactcaaaaagttttggattttgaagcataatttttctgatttttggatttggggatgttcaacctgtattagaaatcaggggaattgttttgtatgggaggtgtacttccaattcttcatagataattatatactggtttatattatttttttctaacttgcccattataaagcatttttagttagtttgacccttattgccagttagcattctcaaagtcatttaaccaccgc

SEQ ID NO: 163908 - DNA, 601 bp, Human
ttctaaaagaaaaggcaaagttattgggcttcagtccatcccaccacataaattgttgaaaaacacctgaaggtcactcttgtaaacagtgatattatattggagcctatacactcaaaaacattatggacagcacaggtgtaaataagctggaaagatgatgaatttcaaaagactttgaaggatagttgtagtttttgaattccaaagataagaatataaattctgatgaacaagaccatcagaatggacatgcgcaagaactgaaatctggaaattcccagaggaataaaatcgaagragtataattttatgcagaaaaagttagctttcatgttgtgttatagtggaatcagcaacaaaagccctaatgaaaaaaaatactagttgtggtagcaatttggtcacctactagacattatacttaaaaaagtcactttgcaattctgatcctttatgccctcatctatgaaacgtgattcaaaataccagttccttggagttcatgggattatgaaaataaattatttgtatttttagaaaaataaaaagctctaaaacattgtttatttttatgcaccctattacaagtaaagccaat

SEQ ID NO: 163909 - DNA, 601 bp, Human
atgtatattactgacagtatttctaatacttatattttaattttttattttcattgtcagtggatatttaatttatttaattgaattttagagaaaattatttaaatgagtataggtaattatttaagtgacagatagtgaatgccaataagaattttctttcttataataataggcttgtaatctactgtttttttcaacaaaacctaatttttttaatcttatactttttattttaattttttctcatgcgcatgtttggtcattttagtcatatcttagttctattattatattgacraagatatattcaattttgctaattattaaaagatgttcaaaatttattgaggtgatttaaaggcagtggctctaattaggcttattgaattcaaatatgcatgtaacaatttgttttctatttctttagataatccaaaatctactctacatcttttcctttgtattgccttcaaatatcactcttcaaagtttagtgactaggcttaaagattccacatataatccaaagaaatctgttcaagtggacatctatcaacacgtaaaactatacttttaactctgtttttcttggctgtgc

SEQ ID NO: 163910 - DNA, 601 bp, Human
ttataataataggcttgtaatctactgtttttttcaacaaaacctaatttttttaatcttatactttttattttaattttttctcatgcgcatgtttggtcattttagtcatatcttagttctattattatattgacgaagatatattcaattttgctaattattaaaagatgttcaaaatttattgaggtgatttaaaggcagtggctctaattaggcttattgaattcaaatatgcatgtaacaatttgttttctatttctttagataatccaaaatctactctacatcttttcctttstattgccttcaaatatcactcttcaaagtttagtgactaggcttaaagattccacatataatccaaagaaatctgttcaagtggacatctatcaacacgtaaaactatacttttaactctgtttttcttggctgtgcttacaagctgtgcttgttaaaagaaataagacacaacagatataaattgtatgaaaatgttacagaattgggcataggaaaaaaaggcatgaagccagagtgtgtatgacttgaatcttgacaattggtcaactcaagagtcactaatgaggaagaggtgaca

SEQ ID NO: 163911 - DNA, 601 bp, Human
ggagaaaaaacgcttaatcatatgttttttatttaaaggcaaggaaacttttgaaaggaatgatttgtgtagcatctgagaaaatagcttcacttttataacaaagcaggaacaatttaagtagttgacaattcagagaactaacatacagtacattagaaaaacatgaatttaatagggaatataaatcagaattcctaggtgatattccttcaggccagaatgtagagaaatgtgaaacagttgattatctatggaaggctgatgtgcaggtcacttattgtcattcagaaccattaaygaaagaacacttgtgcattaaaatatgtctggggatatgattgatacttagaggaggatatgtagttgtgtgtatgcatgtgcacacgcacgtgggtgcacatgtgtatgtgagtttgagatagaaaaatgggaagagttgaaggaaaaggctggtagtatatgctattactatccatttttacttctttccgtttttctgatgcttccatttttagtccttttctgaatttggatggtggcctcatcatttacttgtatatactgtagtcaagatatatttagcaaatattcctttcct

SEQ ID NO: 163912 - DNA, 601 bp, Human
tgaagatgtcttacactggatggcatcttatgatcattgttgctaaggtggcaggaatggcagagtcatggcctatgcctattaattgtttctgatcatgattgtacagtttcagtcttttgatatttcagtcaataaaccgtttgtggaccattagaggaaggaatataagttccgttgttcactgaatatcttctgttgatattttctggtaagatgaagaacatcagtgtcaaaatttaaaatggcataagcagcttgaaagaaattcctagagacagtaatggagtactctgtagamatgccaaaccatggatgctctttataggccagaggaggatattgtgtaagaaaacacagctattgcaaactgtgattcaaaaagtgattcagaagaatcataatccgattgtgaaaatatttagcaatacctaatgagttagaagttgttttcttttagtacatatttatacacgtaattttgatataacttaaaattgttgtcattttcaattggataaaatgtattatgtaaacatgtataactgaagctatagcagagtattcaccagtatgtttacatagtttactctagtgttag

SEQ ID NO: 163913 - DNA, 601 bp, Human
attatgagtggttccatatttgtaaatttgcatatccacagaaatttgtgattcacagcacttttgcaatcatttgctgacatgcacagaacagcaaaaaaatttgttatgcaacacttacattcccagctgaagtcaaacaaggcaagaccctgccttctggttttagttttctctcatactgtaaaccagtattctttttatagtctaataccatgtttttcacattttgtgctttttgctggtgatcttgctgtttaaaatggtccctaagagtaatgctgaagtgctttctagcatwcctcagtacaagaaaactgtgaagtgttttatagaaaaaatacttgtgttagataagcttcatccagacatgagttacagcgctattcgctgtaagttcaatgtcagtgaatcagcaatatgtattaagtaaggtgtctttaaacagaaacacacataaaacaaggttttgtattgattggttgatgaaaatgtgatcagagtctcacagaaacctatccttgtttttctactatgtgcagcggttcagcatttggtaattcagtgttcatggtgactttacagaacacagcttccatga

SEQ ID NO: 163914 - DNA, 601 bp, Human
cagatttataagtctatgtgcatcatgtctgaatctaaaattataatattaaatttaaaaactgtttccaagattatatatgtcatatgcatattattacatgcatataatatagaaaatttaatatatatttgaaatattaataattgtattaaataattatttaattattaattattaagaatttaattttgactctttgatctatatatattttaggtaatgcaaattttatataaaatgtaatatatttagtttatgtattacatataaatttaggaacacatacacatatacatayacacacgtacatatatggtaaaagtataaataaaattaagttaaaagccatcatacaattcgggatagttgttgccttttggtagagaaagagtgatgtggtcagagaggaacacacagaggtgtttagattaaaaatggctattgctattttctgaagatcctaaaattatttcatatttttagagaaactctggaggatttcacattcagccccaactatgacttattgaacacttaactatgtacagatgactaatctgaggcaagcatacattatttcatttaattcttatattac

SEQ ID NO: 163915 - DNA, 601 bp, Human
tatttttagagaaactctggaggatttcacattcagccccaactatgacttattgaacacttaactatgtacagatgactaatctgaggcaagcatacattatttcatttaattcttatattactcttgtgaggtaggtactccatgcaatttttttcgacgctcaagatgagatcgtcatgcaaagttcactttaagatttggcttttaaaagttatagcttctacattaaatgtaataaaagacatgtaatttggaaagccacatatatattttttctcttcaaaaatgtaattttaasatcttcactcatcttcattttatgtataattttaagaaaaattaggatgataggtaaatttgtctagtacgtattagtcatgccatttacatgtagtcttctgtcaatgctcttaattaccttgtaaactaaatatagttattaacctgtttttacagatgaaaccacagactcagttttattactttactaagtgttacagagtaaatgatggagccagtattcgtagcatttgaagctcttatgcttaattttcatgccacaagatgaaaccatgtaaaggaaaataggcttaaattt

SEQ ID NO: 163916 - DNA, 601 bp, Human
gactcagttttattactttactaagtgttacagagtaaatgatggagccagtattcgtagcatttgaagctcttatgcttaattttcatgccacaagatgaaaccatgtaaaggaaaataggcttaaatttacaatttcataataaactagaattttagaaaatagaattgtgtatatgtgtgtgtgtgtgtacattctgtcttctattttattctttgtataggagcaaaccaagtagaatgcttttaaagggtctataagttcaaattattttaatataagagtgatacatttcttaakgggggcatatttaaatgctgggaaaattctaattcatagaatttatactagtgttgacacctatttattgtgtgagtctgcacacacctctttactttcctatgggcatagtttcctgtctgtaaaatggaaatcccatatttataacatgatttgaatattaacaaattataatatttgtattgatgttattattttaaaatatgggtttaagattacttagaaatgttatttatgatctttgaagtgagtgaaaaataaataatccagttgtatttctgaatgtttactatagcagat

SEQ ID NO: 163917 - DNA, 601 bp, Human
aaaaaatctttcaagttattttattcattttttgaaaagcagatgcctatgaccattttgatcaataaaaagaatactacggatatgcagagaggatgtaataaaaatgccgaggatttttttgcttgcttttttttctccctaaattacatcactcggcagtcttatttctaattctatttatattatctgtagagtcagcagtgattagtgaaatccagtcactgctattactattttacttaggtcaggcttcttaatatctctgaaatttgtcacatttaaaaaatagaaaaaataycttaaaaggcttttattgaaactaaactgaataaatacttactgaaaataaaaagcatttatttagcataataagtacacagtatttattgagtgagatccccttatccatttttgtatacctataagattacattataggttactttgagtatcatgcattaattcaataagataagtaatttgaactcttgaaactattccatcaaattaatgccactgtatccaaagccatattttatatgtgtgtatttagtcaggaataactttaaattttactttattgtaatttcttggaaaa

SEQ ID NO: 163918 - DNA, 601 bp, Human
aaggatggaaaagaatgcaaattatgtttataccttacttcatccttagaataatggcatcacattacagcaatccatctggatgtccatatgttctcctggagatctagcaaattttagcaaataggtcaaacagtgtggtcaccccattaataaagcactaagtagaggtagaaaacataatttaaactttctacactgtttagaaggacatagggttttattttgtaaatagtgattacataggattatcttttagtgcaatatttgtttttgtattctattgaatgataatctatayatggttacctctacagttactggcgacagatttggactgccagtttctgtgagtactttatatgacttttctggtaaaaatctattctgacttggaagaatcagccattctggagagaagaattggctttgtctccatggtaacttatttttctgttttatgtgaatagtgacggccaattgtgctaaagtaagggtgatagttttgtgatgaactactttacatggggattgaacattagaacactgagcttattttactggaggccgagaagcaaaaggctttaacatagcaggttgg

SEQ ID NO: 163919 - DNA, 601 bp, Human
tccctttctctacagttatatagactatactgatcattacaaacatgagggcttggtttattgtgtaacaacaatataagttatataaattattacatgggatgagaacacactatgagatagccttagtcaatttagcttatattatatcatgaaatgtacaagtgctactctatcagatctctgttagagaagaggtatcctttggtagcctagagaacacctaagatctgacacattcattagggcttagcagtcaacctattaatcactactgtggggtcactgagtaagacagagygtgttcagagcatgttcatttttctcaaatgaaaaagaagttgtgagtggatattatcattgccagtcttcatggaataaaagtgagaggcaaggacttcaaaacacaaagtaggaatggaatcatggccctggagctttctatgatgaaatctgtgtgtctcttccaaaacagggatgaaaggggacagaggtcaacaacagattggaagtgtgcttagagcctttgaaattattccaggacacactttccctacagagggctgataatctagtacaaataatatcagatagttactaa

SEQ ID NO: 163920 - DNA, 601 bp, Human
cacttcagcctcatatttcagctcaaatttgacactaggaagactgccactattccctaagttatactttgacaaattctaaggaagattgctaggacatggcctactttgcatttgccctgcaggcagtgggtgaatgagggactaacattggcagcctgagtggaactatgtatctgagataggaaacgagcagttccgtaatggaagggcactactgttcccagaagaaggaaggattctgaagagacaaagtattaacaataagcacttactactttagtctttttaaagagattartatgttatgtttcaagaataaaaatgtgttgggttttactagtcactcatggggaattttgcatgtagatactttatagctagctagcaagctgcatagataggttacatgtcaaaatgcatatatcatatttggaaactattgcctaatgaaatataatgcttagtagccatgaaatataatgcttagtagccacccagaggactcaattgcattttgttaaaatttgaaacagggtcactctgttgcccaagctgagtgtagtggtgtgatcatggctcactacagccttgacttcct

SEQ ID NO: 163921 - DNA, 601 bp, Human
tgtgtatgtataatgtacactctcctgctcagagtcattattagtaataaacaccaaatacgatacttaggaaattgtagtttttgattcactgcagttgttgctgctgttgttcttgatattctccattatgcagtgaaactgcagataaggaacaaagaagatagtaagtctgactcaagcaatctgtgccaataacatttaaaaacgactggaaatgcaagaaataaatagggtcaataatcatttctaaaagaaatctatgccctttacccatattttccgtggcatttctcttgtscctcctatgatttgaatagtggacaagacattggtcattctttttgggccatcctatattgaaaaatccttctatgtttagggaattcccaacatcaccattttctgactccccaagggaaaagacagaaatatactttctcagagtttattacacttaagggcacaggcatgtgacccagtctccgtcaacccggtgtagaaaggcccgttttcattcagaaactactgatgtgtagaagcagattcctcaagaaaaacattcagatgaggtggttataggtaattaataatccattca

SEQ ID NO: 163922 - DNA, 601 bp, Human
tgtgccaataacatttaaaaacgactggaaatgcaagaaataaatagggtcaataatcatttctaaaagaaatctatgccctttacccatattttccgtggcatttctcttgtgcctcctatgatttgaatagtggacaagacattggtcattctttttgggccatcctatattgaaaaatccttctatgtttagggaattcccaacatcaccattttctgactccccaagggaaaagacagaaatatactttctcagagtttattacacttaagggcacaggcatgtgacccagtctccrtcaacccggtgtagaaaggcccgttttcattcagaaactactgatgtgtagaagcagattcctcaagaaaaacattcagatgaggtggttataggtaattaataatccattcacgcaaaactagtgtcagtgtttagggtcaatgggacttgcagtgtaaactatgtggtcattggtggcagctgtgatgtccccactggagcaatcagttttgtcatgtgatttggtcagcatcatagcttggtttttttaatcccccctcatattctctgacattctttcatgtccttattgaatgcc

SEQ ID NO: 163923 - DNA, 601 bp, Human
tgaggattcatttgtagtcaccagaggtagggatgtccaggtaatccagcatcacaattaagaagaaaactatacataatttcactcattcatttattccatagatacacactgagcatcttaaatgtgcaaaacactggtgtggcattggaaaaaccacagcgagccaacagacacaggctatgctttcagaatattaaatagccatttacacttttccttatttcattacagttatgataaatgttagtaaagaggcacagtgggtgccatgcaacagcagaaaatggaaatcgatctyataattgagtgatcaggcaatatttcttggagctgaatttgaaggataaggaggcagcgttagtcaagggagaggaagtgtttgaggcagaggaaacagtatttgtgaaagccgtggaagagtcatggagagttctagtagcccagaggaggtgaatgtgattgatctatggtgaaaagatggagaaagttgtgtttgacagtctaaaacctactggaaatgatcctgggccacatattgtatccatataaacaaaagagaagaggatcagaggataggcatctatgctaccatgttagt

SEQ ID NO: 163924 - DNA, 601 bp, Human
tggaaatgatcctgggccacatattgtatccatataaacaaaagagaagaggatcagaggataggcatctatgctaccatgttagtctgctctagctgccataaaataatatcacagactgagtggattaaacaatggaaatttatttctcacagctgtggaggcaggaagttcaaaatcaaggtgccagtagggctggtttctggtggggcctctctcttcggcttgttagatggctgcctcctagttgtgtcctcacatggtcttttctttgcatgtgcacccacccctggtgtctttctctctctctctctctttttttttttccttttgagatggagtcttgctctgccgcccaggctggagtgcagtggcacgatctaggctcactgcaacctccgcctcccaggtccaagtgattctcctgtctcagcctctcgagtagctgggattacaggtgcccaccaccatgcccagcaaatttttgtatttttagtagatatggggtttcgccacattggcaagactggtcttgaactcctgacctcaggtgatccacccgcctcggcctcccaaagtgctgggattacaggcatgagcc

SEQ ID NO: 163925 - DNA, 601 bp, Human
ttcgtaacaggtactaggatcataactctgagtactctcctcccttttaatcaattttaagagcaaatgcataatccagaatgtgttaaaatacaggtggttgtcattatttgtggtagttatgctctataaagttgccacaaacactgaatgaaaaaataccaaattgctgcttctaggggagatttagggttacaggcccctgaacctctgatcataaaattttaattcaccaagcaatccatgactttgttttctatgtgtttccatttaaagacattgtattcaatatatttcactractgacattgaattttggccaaaggtgctataatttattcctgaattaagcttattaaacacatacctttcctccataagtcatatcacagccgtcttgtgcctaggaacaccaaacagcacttcagcattatgctttgaggccattttaaacagaagaattaccaactaaaagcacaaaaatgcagaaaatgtggtattatatagaccctgaaaaggacagttgtttacactctgggagctggaccaagaaagcagttcatcatcttgtttgacctccgctgggaaggtgagggcacac

SEQ ID NO: 163926 - DNA, 601 bp, Human
tccatcagaaatatgcaaagggttgaattttaataaccttagttacagtgttcttgaatacacagaggttgtcattaactttccaaatgcctcttgggcgccaggagtatttcatgattagtttaaaatgtatgtaaaatatctacacagagttagtttggcacttgcagataaagaaaaacaagtttaatcagatgaccctgataaaatgaactgtaagtccttctcatgaacactgcttctcacgagaaatattaagtacctctgttgtggcaaaaatattacttaatggtattccttraatcgaacatgatatgttttagaagctagatacaacttttcaaaggcaacataacctctgccccttagagttggctcccaaattagatcaaacacaactgaactagaaacctgaggcaattcatgcatgcttctgaaactgtttccctaacaaaatagtctcacctctgtgccctataaacactccaaaatacaaatgtgggagaaaaaaaggaaaggtttttattcacttcatattttaagtttatatttgtaatctcttgtttatttgagtgattttattctctttggcttattaaat

SEQ ID NO: 163927 - DNA, 601 bp, Human
agctaagtcataaatatttattaaccatagaataaatttaataaggtcaaaattaaattagctatatatacaagtactagttatagcttcaatggtacttatgtaatattccaaatataactctttatttgttgtggtgatttttttctaagaggtcttcctttttccactggcaatcttgtttatttattcctttggagtgcttaatcattgattttaagtaaagagcctgcatacaatcttgtttcaaagcataccaaaagctttcagagatgaataactcatcgtttttactaaatayctaaacaattttttgccttttttgtttctaagaggcattgacatagtggaatagtggtagggcatggaggatttggctgtgttcagattccagtgctgcttcctactaattggaattttgggaagatactcgatacctctctgcttcaattccttatgtataaaatgcccatggtttatttgtatgaactaatatttctgaactctactgattagctcatatctcataattaaatacaataagaaagaataacgtggctatctgggtgaagatgtcttaccttctcaacatgtttatgtt

SEQ ID NO: 163928 - DNA, 601 bp, Human
agaataaatttaataaggtcaaaattaaattagctatatatacaagtactagttatagcttcaatggtacttatgtaatattccaaatataactctttatttgttgtggtgatttttttctaagaggtcttcctttttccactggcaatcttgtttatttattcctttggagtgcttaatcattgattttaagtaaagagcctgcatacaatcttgtttcaaagcataccaaaagctttcagagatgaataactcatcgtttttactaaatatctaaacaattttttgccttttttgtttytaagaggcattgacatagtggaatagtggtagggcatggaggatttggctgtgttcagattccagtgctgcttcctactaattggaattttgggaagatactcgatacctctctgcttcaattccttatgtataaaatgcccatggtttatttgtatgaactaatatttctgaactctactgattagctcatatctcataattaaatacaataagaaagaataacgtggctatctgggtgaagatgtcttaccttctcaacatgtttatgttaaggttatgttataacattgagcttatt

SEQ ID NO: 163929 - DNA, 601 bp, Human
gcccatggtttatttgtatgaactaatatttctgaactctactgattagctcatatctcataattaaatacaataagaaagaataacgtggctatctgggtgaagatgtcttaccttctcaacatgtttatgttaaggttatgttataacattgagcttatttaagctgttttgaaaattcaaaattatccaaagatgtggacagcttctgcagcatgggaactagggaaaatggataagaaggaaataagtatcacatgataatgcctgctttgccttatatttcaacctaaaagaattrtagacataaggagaaaaagtgattcatctttctgttactctggccatctttagcctatggtacttctagacactatctagattagatgttttaacatttagtccaggctttatgttctatcatctaggacccgattcccccacttcttttgtctttttcaatgcactagagtaagaaaacttgtcacatgtgagaatgtataaattgtaaaatccattttaattacagaggtcattgtgctttccctttgctgtgaatagctgtgtattgtgttcaaacagactataacacaataggtgc

SEQ ID NO: 163930 - DNA, 601 bp, Human
tagacactatctagattagatgttttaacatttagtccaggctttatgttctatcatctaggacccgattcccccacttcttttgtctttttcaatgcactagagtaagaaaacttgtcacatgtgagaatgtataaattgtaaaatccattttaattacagaggtcattgtgctttccctttgctgtgaatagctgtgtattgtgttcaaacagactataacacaataggtgcacaaaatgagcaccattcttcataacatggcatccagagaaaattaaaaacagagaagctaaaatcwtcaaaagcacgtatttgtgaattcatgtttgtttttgaaacagacaatacctgttctagtaagaaagacaaatcagattttatctttacaaggtaaaaatatcaagtctaagaagagatataataaaacaatatgaaatcctgaagagtatgcattatatgaagagatgtgttaattaaattccacaatattggaattgcagtgggaaataagacagaaaaatggggcccaagagaagcttgaaaaagatctattttataacataagggaaaaatatacaaaatgtgtgatcccaaaaaa

SEQ ID NO: 163931 - DNA, 601 bp, Human
tagattagatgttttaacatttagtccaggctttatgttctatcatctaggacccgattcccccacttcttttgtctttttcaatgcactagagtaagaaaacttgtcacatgtgagaatgtataaattgtaaaatccattttaattacagaggtcattgtgctttccctttgctgtgaatagctgtgtattgtgttcaaacagactataacacaataggtgcacaaaatgagcaccattcttcataacatggcatccagagaaaattaaaaacagagaagctaaaatcttcaaaagcacrtatttgtgaattcatgtttgtttttgaaacagacaatacctgttctagtaagaaagacaaatcagattttatctttacaaggtaaaaatatcaagtctaagaagagatataataaaacaatatgaaatcctgaagagtatgcattatatgaagagatgtgttaattaaattccacaatattggaattgcagtgggaaataagacagaaaaatggggcccaagagaagcttgaaaaagatctattttataacataagggaaaaatatacaaaatgtgtgatcccaaaaaaatgagttaaac

SEQ ID NO: 163932 - DNA, 601 bp, Human
ttcacagcatgaataaaagctccatggcctcccacggagtggcccaaaatagacaattttccgtggtccactggaaagttggcatttatcagtggtggaaccttagctattataaacatgctaatcttctaagtaaatattggaaacaggatgcatacctgggtctacctgactttgaatctcatgtttttgtaaacttttctggaataggaatgcctcatgactatacctttcttttctaattcttcaggttggtatcatatgcaatagctgtatattccatcagttgattgacgtgttrttatgggatcgctgtctaaagaacacaattggaaagataataaatttgttccagtttggaatcttcctaagttattgttaattgttacttatgtatttatagttgactaaaatttattaggtctttttctttttttaagcaccctttcataaatttggtctatgttttcttgaaataggtttttagtcttgtgagaccataattagtacccataacaacagaaatgtatatctttttgtcattgaaaaggaccagtcatagtagggtaaacttcttgtatcactaaaatgaaatagtgaa

SEQ ID NO: 163933 - DNA, 601 bp, Human
cctcccacggagtggcccaaaatagacaattttccgtggtccactggaaagttggcatttatcagtggtggaaccttagctattataaacatgctaatcttctaagtaaatattggaaacaggatgcatacctgggtctacctgactttgaatctcatgtttttgtaaacttttctggaataggaatgcctcatgactatacctttcttttctaattcttcaggttggtatcatatgcaatagctgtatattccatcagttgattgacgtgttattatgggatcgctgtctaaagaacacgattggaaagataataaatttgttccagtttggaatcttcctaagttattgttaattgttacttatgtatttatagttgactaaaatttattaggtctttttctttttttaagcaccctttcataaatttggtctatgttttcttgaaataggtttttagtcttgtgagaccataattagtacccataacaacagaaatgtatatctttttgtcattgaaaaggaccagtcatagtagggtaaacttcttgtatcactaaaatgaaatagtgaacaaaagcatatatttgatgtcagacca

SEQ ID NO: 163934 - DNA, 601 bp, Human
gtaaacttttctggaataggaatgcctcatgactatacctttcttttctaattcttcaggttggtatcatatgcaatagctgtatattccatcagttgattgacgtgttattatgggatcgctgtctaaagaacacaattggaaagataataaatttgttccagtttggaatcttcctaagttattgttaattgttacttatgtatttatagttgactaaaatttattaggtctttttctttttttaagcaccctttcataaatttggtctatgttttcttgaaataggtttttagtcttktgagaccataattagtacccataacaacagaaatgtatatctttttgtcattgaaaaggaccagtcatagtagggtaaacttcttgtatcactaaaatgaaatagtgaacaaaagcatatatttgatgtcagaccaaggaatgtcctgtttccggtatctccttaagtgtgttatccatcccttctaaattttagtgatttttctacaatataggggaaaattatatatccaatccagacactttgtcataattgagaaaagggaatgaattaagcaatagctatcatcaccattatcat

SEQ ID NO: 163935 - DNA, 601 bp, Human
aattcttcaggttggtatcatatgcaatagctgtatattccatcagttgattgacgtgttattatgggatcgctgtctaaagaacacaattggaaagataataaatttgttccagtttggaatcttcctaagttattgttaattgttacttatgtatttatagttgactaaaatttattaggtctttttctttttttaagcaccctttcataaatttggtctatgttttcttgaaataggtttttagtcttgtgagaccataattagtacccataacaacagaaatgtatatctttttgtyattgaaaaggaccagtcatagtagggtaaacttcttgtatcactaaaatgaaatagtgaacaaaagcatatatttgatgtcagaccaaggaatgtcctgtttccggtatctccttaagtgtgttatccatcccttctaaattttagtgatttttctacaatataggggaaaattatatatccaatccagacactttgtcataattgagaaaagggaatgaattaagcaatagctatcatcaccattatcatcatccaatctcctccccactccttgtcttccagaagctccccaactccc

SEQ ID NO: 163936 - DNA, 601 bp, Human
gttgattgacgtgttattatgggatcgctgtctaaagaacacaattggaaagataataaatttgttccagtttggaatcttcctaagttattgttaattgttacttatgtatttatagttgactaaaatttattaggtctttttctttttttaagcaccctttcataaatttggtctatgttttcttgaaataggtttttagtcttgtgagaccataattagtacccataacaacagaaatgtatatctttttgtcattgaaaaggaccagtcatagtagggtaaacttcttgtatcactraaatgaaatagtgaacaaaagcatatatttgatgtcagaccaaggaatgtcctgtttccggtatctccttaagtgtgttatccatcccttctaaattttagtgatttttctacaatataggggaaaattatatatccaatccagacactttgtcataattgagaaaagggaatgaattaagcaatagctatcatcaccattatcatcatccaatctcctccccactccttgtcttccagaagctccccaactcccatgttcacacccttaaacttgtcattatcaatagctttcaaataa

SEQ ID NO: 163937 - DNA, 601 bp, Human
tttcttgaaataggtttttagtcttgtgagaccataattagtacccataacaacagaaatgtatatctttttgtcattgaaaaggaccagtcatagtagggtaaacttcttgtatcactaaaatgaaatagtgaacaaaagcatatatttgatgtcagaccaaggaatgtcctgtttccggtatctccttaagtgtgttatccatcccttctaaattttagtgatttttctacaatataggggaaaattatatatccaatccagacactttgtcataattgagaaaagggaatgaattaarcaatagctatcatcaccattatcatcatccaatctcctccccactccttgtcttccagaagctccccaactcccatgttcacacccttaaacttgtcattatcaatagctttcaaataatctcaatttttaaataacttactcctcaatcaccatgtcgtatcttccaccgcattgttttctagtactgcaactataataatcctttaactccatcagtactgttaagctattgatatactacctcatccatcactgctttccataccattttcaccttccttaccatctaaacttcaga

SEQ ID NO: 163938 - DNA, 601 bp, Human
tcaatcaccatgtcgtatcttccaccgcattgttttctagtactgcaactataataatcctttaactccatcagtactgttaagctattgatatactacctcatccatcactgctttccataccattttcaccttccttaccatctaaacttcagattcaattaatttaagtttcttgcatacattcttaacttatctacctaccattaatttttttgtatctcttgatgaaaccagaactctggctaaagccatcagcttagttcctttgagtctccatggcagaatgtaaaccacactstaggatttactaatctctttaattgatgatcgataatcttaggtgggcccgaaatgctgcttggtaaccatattttatattatattactctagtccagtctctctctctcgctatatgagatgattatttgtcatttaatccatattccccaaagccactgtcttccctcctttcttcatcccagaaggtaacttcaattcctacttcattcagaaagtttacgttatcagtagaacttccacatacttctactaccacattctcctgcctgtttacatccagatctgacatactttacc

SEQ ID NO: 163939 - DNA, 601 bp, Human
ttttctagtactgcaactataataatcctttaactccatcagtactgttaagctattgatatactacctcatccatcactgctttccataccattttcaccttccttaccatctaaacttcagattcaattaatttaagtttcttgcatacattcttaacttatctacctaccattaatttttttgtatctcttgatgaaaccagaactctggctaaagccatcagcttagttcctttgagtctccatggcagaatgtaaaccacactctaggatttactaatctctttaattgatgatcrataatcttaggtgggcccgaaatgctgcttggtaaccatattttatattatattactctagtccagtctctctctctcgctatatgagatgattatttgtcatttaatccatattccccaaagccactgtcttccctcctttcttcatcccagaaggtaacttcaattcctacttcattcagaaagtttacgttatcagtagaacttccacatacttctactaccacattctcctgcctgtttacatccagatctgacatactttaccttctttcctgtatcagtatctatcctaactaa

SEQ ID NO: 163940 - DNA, 601 bp, Human
agtctctctctctcgctatatgagatgattatttgtcatttaatccatattccccaaagccactgtcttccctcctttcttcatcccagaaggtaacttcaattcctacttcattcagaaagtttacgttatcagtagaacttccacatacttctactaccacattctcctgcctgtttacatccagatctgacatactttaccttctttcctgtatcagtatctatcctaactaaggccaactatacacttcctttctcaccccctcaactattaatgggtattactgtggacaaaattstatcttctctctccattagcaatattccctctcacaactgggtcattcctgtagcttataaccatgatattctaacctccaacttgggaaaaaaacaaaacaaatggaaaatgttatttagaccaatgttacctgtcagccacaaccatacttatgtccttccctttaagcaaaacttcttgaaagtgttgctccagtttctctcttccccttctttttgcccccactccaatcagaatttttcttgtacccctcatctgaaattgctctttccaagtttctcaggacttcaatgctacc

SEQ ID NO: 163941 - DNA, 601 bp, Human
ttctactaccacattctcctgcctgtttacatccagatctgacatactttaccttctttcctgtatcagtatctatcctaactaaggccaactatacacttcctttctcaccccctcaactattaatgggtattactgtggacaaaattgtatcttctctctccattagcaatattccctctcacaactgggtcattcctgtagcttataaccatgatattctaacctccaacttgggaaaaaaacaaaacaaatggaaaatgttatttagaccaatgttacctgtcagccacaaccatasttatgtccttccctttaagcaaaacttcttgaaagtgttgctccagtttctctcttccccttctttttgcccccactccaatcagaatttttcttgtacccctcatctgaaattgctctttccaagtttctcaggacttcaatgctaccaatgtagtggtcatttcttagtccccattgtaattgacctttctggagcatttgatacagtacttaatcaccctcggtcttccatacaacacattcttgattttacttataaaatattacacttaaatattttcttttgatgccattagcc

SEQ ID NO: 163942 - DNA, 601 bp, Human
acctccaacttgggaaaaaaacaaaacaaatggaaaatgttatttagaccaatgttacctgtcagccacaaccatacttatgtccttccctttaagcaaaacttcttgaaagtgttgctccagtttctctcttccccttctttttgcccccactccaatcagaatttttcttgtacccctcatctgaaattgctctttccaagtttctcaggacttcaatgctaccaatgtagtggtcatttcttagtccccattgtaattgacctttctggagcatttgatacagtacttaatcaccctyggtcttccatacaacacattcttgattttacttataaaatattacacttaaatattttcttttgatgccattagccacatcttttcagtatctatttttggttcttcctttccccttaaattctcaatgttcaaaagtttggctcttggatctcctttccatatatacttgctccataaatgaccttgcaccttctcatgactgtagctcatatttataggctgatgcctcctaaatttatatcttcagtttcaacttctcctgaactctagacctatatataaaccctcttttcagtat

SEQ ID NO: 163943 - DNA, 601 bp, Human
ttttcatttgaatagtagtgtcctatagaactttctgtggtgatagaaatgttctataaatctgattgtctaatatatgttatccactagtcacatgtagctattaaacacttgaagctagtctgagaaaggaactgaatttttattgtattttactttaatttaaattttaaaaacctcccttggcaaatggttaccatactggacaatgtgtgtttagaatgtaaactttcagtcccccactggaatataaatatcatgagagcagagattttttttccttctgctttgttcattgctktattcctagacataccctggcatatagtagacaatatttttgaaggaatgaacaaactgatcattataaaaattattataataatgatcaaataagacattgaaagacaatcctagtccttgccctgccactcaataatgtggtgatttttcagaagttacttactttcttggaacccaagttccttcattcatatttttctctttcatttaataaacatgtattgagatcctcctgtgtgccaggaattatggtagatattgatgtacaaaggtgacaaagatgtagtgctaacaaaga

SEQ ID NO: 163944 - DNA, 601 bp, Human
gctttgttcattgctttattcctagacataccctggcatatagtagacaatatttttgaaggaatgaacaaactgatcattataaaaattattataataatgatcaaataagacattgaaagacaatcctagtccttgccctgccactcaataatgtggtgatttttcagaagttacttactttcttggaacccaagttccttcattcatatttttctctttcatttaataaacatgtattgagatcctcctgtgtgccaggaattatggtagatattgatgtacaaaggtgacaaagatktagtgctaacaaagatttaattaggaataaagagaagtaaaatttattaaagcttcatgatacttttaaagacggagatgtgaattgctatgggagaagacagaagaaataaaagacagccttaatggtcaagggaataattgatgaaagggaaaatgcaagactttcttgaagataaaaaaggtttgaaatgtttagaaagaaacagcattttagtataaaggcaacatacagtatattcaaaattcactccttcctataacatgaaatgtggaaatgtgggatatttaggcataaggc

SEQ ID NO: 163945 - DNA, 601 bp, Human
gaacaaactgatcattataaaaattattataataatgatcaaataagacattgaaagacaatcctagtccttgccctgccactcaataatgtggtgatttttcagaagttacttactttcttggaacccaagttccttcattcatatttttctctttcatttaataaacatgtattgagatcctcctgtgtgccaggaattatggtagatattgatgtacaaaggtgacaaagatgtagtgctaacaaagatttaattaggaataaagagaagtaaaatttattaaagcttcatgatactyttaaagacggagatgtgaattgctatgggagaagacagaagaaataaaagacagccttaatggtcaagggaataattgatgaaagggaaaatgcaagactttcttgaagataaaaaaggtttgaaatgtttagaaagaaacagcattttagtataaaggcaacatacagtatattcaaaattcactccttcctataacatgaaatgtggaaatgtgggatatttaggcataaggcattgcacaatgactctgtgtgctattattaggtcacagtgtaaatatgcacaaatactcttataa

SEQ ID NO: 163946 - DNA, 601 bp, Human
ttggaacccaagttccttcattcatatttttctctttcatttaataaacatgtattgagatcctcctgtgtgccaggaattatggtagatattgatgtacaaaggtgacaaagatgtagtgctaacaaagatttaattaggaataaagagaagtaaaatttattaaagcttcatgatacttttaaagacggagatgtgaattgctatgggagaagacagaagaaataaaagacagccttaatggtcaagggaataattgatgaaagggaaaatgcaagactttcttgaagataaaaaaggyttgaaatgtttagaaagaaacagcattttagtataaaggcaacatacagtatattcaaaattcactccttcctataacatgaaatgtggaaatgtgggatatttaggcataaggcattgcacaatgactctgtgtgctattattaggtcacagtgtaaatatgcacaaatactcttataagatctgaaaatccttcagctattttctattacaaaattctaaaacaatacgtatttgttttctactgttgttcccgtttatattgctttttttgtttccattgcctttttttcttccatg

SEQ ID NO: 163947 - DNA, 601 bp, Human
aggaataaagagaagtaaaatttattaaagcttcatgatacttttaaagacggagatgtgaattgctatgggagaagacagaagaaataaaagacagccttaatggtcaagggaataattgatgaaagggaaaatgcaagactttcttgaagataaaaaaggtttgaaatgtttagaaagaaacagcattttagtataaaggcaacatacagtatattcaaaattcactccttcctataacatgaaatgtggaaatgtgggatatttaggcataaggcattgcacaatgactctgtgtgcyattattaggtcacagtgtaaatatgcacaaatactcttataagatctgaaaatccttcagctattttctattacaaaattctaaaacaatacgtatttgttttctactgttgttcccgtttatattgctttttttgtttccattgcctttttttcttccatgtgagaagtatattcccacttatagttagtgaatattttaccaattttcatcttttcattcttaaacaggcatgcaagttataaaaactcaaaatgaaaaatgtaattgtggcttaaaaaatatgtataatgtcgttgg

SEQ ID NO: 163948 - DNA, 601 bp, Human
atacttttaaagacggagatgtgaattgctatgggagaagacagaagaaataaaagacagccttaatggtcaagggaataattgatgaaagggaaaatgcaagactttcttgaagataaaaaaggtttgaaatgtttagaaagaaacagcattttagtataaaggcaacatacagtatattcaaaattcactccttcctataacatgaaatgtggaaatgtgggatatttaggcataaggcattgcacaatgactctgtgtgctattattaggtcacagtgtaaatatgcacaaatactcytataagatctgaaaatccttcagctattttctattacaaaattctaaaacaatacgtatttgttttctactgttgttcccgtttatattgctttttttgtttccattgcctttttttcttccatgtgagaagtatattcccacttatagttagtgaatattttaccaattttcatcttttcattcttaaacaggcatgcaagttataaaaactcaaaatgaaaaatgtaattgtggcttaaaaaatatgtataatgtcgttggcctaccgattgatatatgtatagtatatgattttaat

SEQ ID NO: 163949 - DNA, 601 bp, Human
aacatacagtatattcaaaattcactccttcctataacatgaaatgtggaaatgtgggatatttaggcataaggcattgcacaatgactctgtgtgctattattaggtcacagtgtaaatatgcacaaatactcttataagatctgaaaatccttcagctattttctattacaaaattctaaaacaatacgtatttgttttctactgttgttcccgtttatattgctttttttgtttccattgcctttttttcttccatgtgagaagtatattcccacttatagttagtgaatattttacmaattttcatcttttcattcttaaacaggcatgcaagttataaaaactcaaaatgaaaaatgtaattgtggcttaaaaaatatgtataatgtcgttggcctaccgattgatatatgtatagtatatgattttaatattttagatacctcaccagctccataatcagtcagatacactttccaagaaactttaaagcagagaagcctgaaggctgtgcaagtgcagagcagcttctgttagatcttcagcagaatacaggttttgtgtgtgtgtctcattctactgctgaggattaagtgac

SEQ ID NO: 163950 - DNA, 601 bp, Human
ttagatcttcagcagaatacaggttttgtgtgtgtgtctcattctactgctgaggattaagtgacagtggaataaaaattactggtaatgtgataaagcagggcaacttttcacctttcacaccagccaaaggacatattgggtatctcccctgaaagctaagcttgttgtcatagtttaatacaacttttcaggtgtatactaaagaaagaagaaaataaattagtctgtaggtttttatgtcaatatagataataaaaaagaatgataattgaacttgctaatctgctgtattacttcraagtaaaaacatgttgcaacatatatttctaagtaaatacatgttgcaaagtgcaaagtgcaacatgtatttacttggaagtaataccacagattagcaaattcaattataattctaagtaactattactacaggacttgctggaaccagttgggtgcttatgtatgagatatttgccaagctgcataaaagaaaagggctagagtttaaaacataaatgtgactttgtatttaattttacagagcatgattaactagtttatgatgtcactcggaatattatcattaaaattagattta

SEQ ID NO: 163951 - DNA, 601 bp, Human
cttgttgtcatagtttaatacaacttttcaggtgtatactaaagaaagaagaaaataaattagtctgtaggtttttatgtcaatatagataataaaaaagaatgataattgaacttgctaatctgctgtattacttcaaagtaaaaacatgttgcaacatatatttctaagtaaatacatgttgcaaagtgcaaagtgcaacatgtatttacttggaagtaataccacagattagcaaattcaattataattctaagtaactattactacaggacttgctggaaccagttgggtgcttatrtatgagatatttgccaagctgcataaaagaaaagggctagagtttaaaacataaatgtgactttgtatttaattttacagagcatgattaactagtttatgatgtcactcggaatattatcattaaaattagatttaaagaaatggagggtttttatgtattttaagaataactttttaaaaattaggatgtatatggaatttctgcatttaagaggatgacattaaaagcaagtctctataaattctttatccttgaaatgaaggtaataatagaaaatttttggtttgtgaaaatacc

SEQ ID NO: 163952 - DNA, 601 bp, Human
attcattgctatgttcataactaaaagtatagaatactatttttgatgcgttcttaatgccattctacaggtatggtttgtcgttaaacagctagattccactttcaactccatagaacttaatattatctaaagaaatatttaccactttgaatcactattgtatgaattcatagatctttacaaagtgagggaaacttttctctactgctttactttacagattaagaaagttaggagttttctgaatgccattcagggagtgtcagtgcgaggtaggatgagggtgtctgcttccaayttccaggattttgtggcaccttctatcattcttttagaattatttatccttgttaggtcagtctccatttccctattaaaaatggttcatcagtttctttcattagaaataacttttctctgccaaattatttcatcacaaaaatagtattttatagattttaaatgacttctttactgcttaataacactctaagatagatgagatgtattttgaaaactatgctaaagaaaatgttgtatagtgttatcattattatcctacctggtgaataataaatgcttttacttttcaatatgt

SEQ ID NO: 163953 - DNA, 601 bp, Human
gtctgcttccaacttccaggattttgtggcaccttctatcattcttttagaattatttatccttgttaggtcagtctccatttccctattaaaaatggttcatcagtttctttcattagaaataacttttctctgccaaattatttcatcacaaaaatagtattttatagattttaaatgacttctttactgcttaataacactctaagatagatgagatgtattttgaaaactatgctaaagaaaatgttgtatagtgttatcattattatcctacctggtgaataataaatgcttttayttttcaatatgtttgagcctttcaaaaaatatgaagttattccatcactgtccttagtattctttggccatgctactcatttttgttctcttaatcaccgctcataaattagttccttaggcttcagacatttcacttgtcttttcttgaacagcctcctacatgttcttattattgtaatttagtttttgagtgttgacagtttacttggcactgtttacagcataacatctttttttcagaggtgactaaaattgccacattgtgtttagtgtgttctcaggaagtcacagactgaac

SEQ ID NO: 163954 - DNA, 601 bp, Human
ccaggattttgtggcaccttctatcattcttttagaattatttatccttgttaggtcagtctccatttccctattaaaaatggttcatcagtttctttcattagaaataacttttctctgccaaattatttcatcacaaaaatagtattttatagattttaaatgacttctttactgcttaataacactctaagatagatgagatgtattttgaaaactatgctaaagaaaatgttgtatagtgttatcattattatcctacctggtgaataataaatgcttttacttttcaatatgtttragcctttcaaaaaatatgaagttattccatcactgtccttagtattctttggccatgctactcatttttgttctcttaatcaccgctcataaattagttccttaggcttcagacatttcacttgtcttttcttgaacagcctcctacatgttcttattattgtaatttagtttttgagtgttgacagtttacttggcactgtttacagcataacatctttttttcagaggtgactaaaattgccacattgtgtttagtgtgttctcaggaagtcacagactgaactttaagtggactaag

SEQ ID NO: 163955 - DNA, 601 bp, Human
catcagtttctttcattagaaataacttttctctgccaaattatttcatcacaaaaatagtattttatagattttaaatgacttctttactgcttaataacactctaagatagatgagatgtattttgaaaactatgctaaagaaaatgttgtatagtgttatcattattatcctacctggtgaataataaatgcttttacttttcaatatgtttgagcctttcaaaaaatatgaagttattccatcactgtccttagtattctttggccatgctactcatttttgttctcttaatcaccsctcataaattagttccttaggcttcagacatttcacttgtcttttcttgaacagcctcctacatgttcttattattgtaatttagtttttgagtgttgacagtttacttggcactgtttacagcataacatctttttttcagaggtgactaaaattgccacattgtgtttagtgtgttctcaggaagtcacagactgaactttaagtggactaagccattctaatcttgtatggaatatgaagaagcaatcaaaattcagtcagtggttagatttcagaagcattttttagtctcaatct

SEQ ID NO: 163956 - DNA, 601 bp, Human
tttaaatgacttctttactgcttaataacactctaagatagatgagatgtattttgaaaactatgctaaagaaaatgttgtatagtgttatcattattatcctacctggtgaataataaatgcttttacttttcaatatgtttgagcctttcaaaaaatatgaagttattccatcactgtccttagtattctttggccatgctactcatttttgttctcttaatcaccgctcataaattagttccttaggcttcagacatttcacttgtcttttcttgaacagcctcctacatgttcttaytattgtaatttagtttttgagtgttgacagtttacttggcactgtttacagcataacatctttttttcagaggtgactaaaattgccacattgtgtttagtgtgttctcaggaagtcacagactgaactttaagtggactaagccattctaatcttgtatggaatatgaagaagcaatcaaaattcagtcagtggttagatttcagaagcattttttagtctcaatctcgtttctcctccaaccacgtttaaagctattttagttaaagtgatcagtgagtacacatctaatttaatttg

SEQ ID NO: 163957 - DNA, 601 bp, Human
aacagcctcctacatgttcttattattgtaatttagtttttgagtgttgacagtttacttggcactgtttacagcataacatctttttttcagaggtgactaaaattgccacattgtgtttagtgtgttctcaggaagtcacagactgaactttaagtggactaagccattctaatcttgtatggaatatgaagaagcaatcaaaattcagtcagtggttagatttcagaagcattttttagtctcaatctcgtttctcctccaaccacgtttaaagctattttagttaaagtgatcagtragtacacatctaatttaatttgtcttagacctgtaaattatcagaatgctactctgaattccagtggcgttcacactgaaattaaaagtgacgtgagactcttttgagaagggtcttgggaatataaagaatggctatttttaggtagccaaaatgtatgtttttaaagaatcaatatttttaaatctattgaaagcacagaataaagtttttagttgtagattagtggaaatattaagtgtatggctttcaagtagatcttccactttaaaaatagaaaaaaaatgaaggatagggtaa

SEQ ID NO: 163958 - DNA, 601 bp, Human
acagcctcctacatgttcttattattgtaatttagtttttgagtgttgacagtttacttggcactgtttacagcataacatctttttttcagaggtgactaaaattgccacattgtgtttagtgtgttctcaggaagtcacagactgaactttaagtggactaagccattctaatcttgtatggaatatgaagaagcaatcaaaattcagtcagtggttagatttcagaagcattttttagtctcaatctcgtttctcctccaaccacgtttaaagctattttagttaaagtgatcagtgrgtacacatctaatttaatttgtcttagacctgtaaattatcagaatgctactctgaattccagtggcgttcacactgaaattaaaagtgacgtgagactcttttgagaagggtcttgggaatataaagaatggctatttttaggtagccaaaatgtatgtttttaaagaatcaatatttttaaatctattgaaagcacagaataaagtttttagttgtagattagtggaaatattaagtgtatggctttcaagtagatcttccactttaaaaatagaaaaaaaatgaaggatagggtaaa

SEQ ID NO: 163959 - DNA, 601 bp, Human
aattcagtcagtggttagatttcagaagcattttttagtctcaatctcgtttctcctccaaccacgtttaaagctattttagttaaagtgatcagtgagtacacatctaatttaatttgtcttagacctgtaaattatcagaatgctactctgaattccagtggcgttcacactgaaattaaaagtgacgtgagactcttttgagaagggtcttgggaatataaagaatggctatttttaggtagccaaaatgtatgtttttaaagaatcaatatttttaaatctattgaaagcacagaawaaagtttttagttgtagattagtggaaatattaagtgtatggctttcaagtagatcttccactttaaaaatagaaaaaaaatgaaggatagggtaaaagagaaagaaggggaagattggattgatttcaggtactatgacagacagctttgtttgtttcatacaatcttcgttttcttactgctcttggatattgaattatgtggtctaaaatcttattaaccagtttctgatccactagattataatgattgtgttagttgtgagcaagttagtaaataacattaaaaattaaaagggt

SEQ ID NO: 163960 - DNA, 601 bp, Human
atataaagaatggctatttttaggtagccaaaatgtatgtttttaaagaatcaatatttttaaatctattgaaagcacagaataaagtttttagttgtagattagtggaaatattaagtgtatggctttcaagtagatcttccactttaaaaatagaaaaaaaatgaaggatagggtaaaagagaaagaaggggaagattggattgatttcaggtactatgacagacagctttgtttgtttcatacaatcttcgttttcttactgctcttggatattgaattatgtggtctaaaatcttaytaaccagtttctgatccactagattataatgattgtgttagttgtgagcaagttagtaaataacattaaaaattaaaagggtacagaaccaaggaccaggagatctgatttctagtcttggattctccgtcttgggctgtcagagatgctggctgtggtgtttcaggtcacgtttttccttaccttcctgtcctgagacgttgcaacctcaactaagcccctccagaaactcaccacccagtaatcattatatacataatctgaaaaaaattaggaattgtatgggaaacaatacttgaa

SEQ ID NO: 163961 - DNA, 601 bp, Human
aatcttattaaccagtttctgatccactagattataatgattgtgttagttgtgagcaagttagtaaataacattaaaaattaaaagggtacagaaccaaggaccaggagatctgatttctagtcttggattctccgtcttgggctgtcagagatgctggctgtggtgtttcaggtcacgtttttccttaccttcctgtcctgagacgttgcaacctcaactaagcccctccagaaactcaccacccagtaatcattatatacataatctgaaaaaaattaggaattgtatgggaaacaawacttgaaaatcagattgtctagagatttatgctttatgatcaatacataatagatcagaatagagatatgcaaagtcacctcagaaaattttaaaagcatctagattacaatagtaataatactaaattcatttacttatctaaagaaggatgacaatcaaaaggagtgatcatgaggcaaaacttgtcagtatctatccaaacactgaccggtgttggaggaactttagccaactgatattgagtattacaattctgtcagcaagatcattaaaaatatgagatggatatatatatata

SEQ ID NO: 163962 - DNA, 601 bp, Human
ctagtcttggattctccgtcttgggctgtcagagatgctggctgtggtgtttcaggtcacgtttttccttaccttcctgtcctgagacgttgcaacctcaactaagcccctccagaaactcaccacccagtaatcattatatacataatctgaaaaaaattaggaattgtatgggaaacaatacttgaaaatcagattgtctagagatttatgctttatgatcaatacataatagatcagaatagagatatgcaaagtcacctcagaaaattttaaaagcatctagattacaatagtaatwatactaaattcatttacttatctaaagaaggatgacaatcaaaaggagtgatcatgaggcaaaacttgtcagtatctatccaaacactgaccggtgttggaggaactttagccaactgatattgagtattacaattctgtcagcaagatcattaaaaatatgagatggatatatatatatatattatatatatatatataatatatatatatgttgtatttagaaggagtaaaactacatattcagatagagtgaggtatttagtcatgaaaagatgagttagtccctggtgatgacgtt

SEQ ID NO: 163963 - DNA, 601 bp, Human
actagaaaattattttgcagcattgggacactgttgagattacatttgaagtttgatatcatgaaatttaaaggcaccagttagtatggttttgtgatctaatccagcaattttcaggtctttagtagagatgcacttgagatcatcctgggttaggtattttccagatacacatcatgaagagaggagtaaataattcagaaatgctttcaaaggagttgttgtaagaattagccatctaatttaagttctataacaaaggaacaaaaagtagggtaacttgataaataccggaggtttsagtgaagtaatagcatttgcatattgggaatcttggagaggctaaaaaactgttaatagtgagagtatttgagcaagtgaaatgaactgacagtagtttaagttggtgagggcgatgtttacattttaattgtgttggggggaggtagtgtcatattggttaatgacaaattttagtttatgaccatgcagtatgtaataaggtggaatatgacaaaaaagagagagacaaaaggtcaggggaaatttaaaaatgttgagaaacttaagaagccacatgtatactgatgtcactatgaaa

SEQ ID NO: 163964 - DNA, 601 bp, Human
tgagatcatcctgggttaggtattttccagatacacatcatgaagagaggagtaaataattcagaaatgctttcaaaggagttgttgtaagaattagccatctaatttaagttctataacaaaggaacaaaaagtagggtaacttgataaataccggaggtttgagtgaagtaatagcatttgcatattgggaatcttggagaggctaaaaaactgttaatagtgagagtatttgagcaagtgaaatgaactgacagtagtttaagttggtgagggcgatgtttacattttaattgtgttggggggaggtagtgtcatattggttaatgacaaattttagtttatgaccatgcagtatgtaataaggtggaatatgacaaaaaagagagagacaaaaggtcaggggaaatttaaaaatgttgagaaacttaagaagccacatgtatactgatgtcactatgaaagatgattggaaatggaacagagatagagtcttagccataagccagtatgaagaggtgagtagagacccaggttccaatagataataacaacaaggaggttggagagggtgctatgagttgatggaaatagcttcaaa

SEQ ID NO: 163965 - DNA, 601 bp, Human
taggtattttccagatacacatcatgaagagaggagtaaataattcagaaatgctttcaaaggagttgttgtaagaattagccatctaatttaagttctataacaaaggaacaaaaagtagggtaacttgataaataccggaggtttgagtgaagtaatagcatttgcatattgggaatcttggagaggctaaaaaactgttaatagtgagagtatttgagcaagtgaaatgaactgacagtagtttaagttggtgagggcgatgtttacattttaattgtgttggggggaggtagtgtcrtattggttaatgacaaattttagtttatgaccatgcagtatgtaataaggtggaatatgacaaaaaagagagagacaaaaggtcaggggaaatttaaaaatgttgagaaacttaagaagccacatgtatactgatgtcactatgaaagatgattggaaatggaacagagatagagtcttagccataagccagtatgaagaggtgagtagagacccaggttccaatagataataacaacaaggaggttggagagggtgctatgagttgatggaaatagcttcaaaacatacagtaaaaagg

SEQ ID NO: 163966 - DNA, 601 bp, Human
attcagaaatgctttcaaaggagttgttgtaagaattagccatctaatttaagttctataacaaaggaacaaaaagtagggtaacttgataaataccggaggtttgagtgaagtaatagcatttgcatattgggaatcttggagaggctaaaaaactgttaatagtgagagtatttgagcaagtgaaatgaactgacagtagtttaagttggtgagggcgatgtttacattttaattgtgttggggggaggtagtgtcatattggttaatgacaaattttagtttatgaccatgcagtatrtaataaggtggaatatgacaaaaaagagagagacaaaaggtcaggggaaatttaaaaatgttgagaaacttaagaagccacatgtatactgatgtcactatgaaagatgattggaaatggaacagagatagagtcttagccataagccagtatgaagaggtgagtagagacccaggttccaatagataataacaacaaggaggttggagagggtgctatgagttgatggaaatagcttcaaaacatacagtaaaaaggcagaaattataaagcagagtattacatggtgggtttaataca

SEQ ID NO: 163967 - DNA, 601 bp, Human
aatgtcttgaactaagatggcaaatgatcaatatgagtttgcccctgggagatggatatgctttcagattactaacaaaaatagtattggagctttcaagtacaagaacctatcgtcatccaggtgtggtggctcatgcttgtaatcccagcactttggaagccaattagctgagcgtggtggagcatggctatagtcctagctactcaggaggctgaagtgggaggatcacttgagcccaggagtttgagtctgcagtaagctaagattgtgccactgcactccagcctggatgacagarcaagatcttttctcttaaaaaataaataagaaactatcatcaagcaatgtttagataatgaatgccattatgtgacacctatgggatgacaatcagctgttatttccccatgaaaagacatacacttttatactttgtagcgtactttttttcctagtagaggaaaataggaacctagaaattctgaaagtttattaacttcttaagtgggaaatatcaaataattaggtgtcctacctagatacttgtctgagatgatttttccaatttgtctcaactttcatgttgtaattcattttt

SEQ ID NO: 163968 - DNA, 601 bp, Human
atggcaaatgatcaatatgagtttgcccctgggagatggatatgctttcagattactaacaaaaatagtattggagctttcaagtacaagaacctatcgtcatccaggtgtggtggctcatgcttgtaatcccagcactttggaagccaattagctgagcgtggtggagcatggctatagtcctagctactcaggaggctgaagtgggaggatcacttgagcccaggagtttgagtctgcagtaagctaagattgtgccactgcactccagcctggatgacagaacaagatcttttctctyaaaaaataaataagaaactatcatcaagcaatgtttagataatgaatgccattatgtgacacctatgggatgacaatcagctgttatttccccatgaaaagacatacacttttatactttgtagcgtactttttttcctagtagaggaaaataggaacctagaaattctgaaagtttattaacttcttaagtgggaaatatcaaataattaggtgtcctacctagatacttgtctgagatgatttttccaatttgtctcaactttcatgttgtaattcatttttgtcaatgaaaaattgc

SEQ ID NO: 163969 - DNA, 601 bp, Human
tcattcagatgccaaatggcatttgtatgctcaaaaactctttcttgaaatacttgcatttcagaatggaatggcccagtactattttcctccactaaagtattactttgttattagatttaagaaagtttcatggtctctgagagacttgctctcaagtctcttcaccacttgtgattatgtatagcagtgtttatcccgagacccatcaagatctttgcactaccgagtcaattggaaacaaaatgggggaggttgtcactctataaaataaattatcatgaaaatctaaagcatacaygtttgtttattaaatttctgccaagacaggtcctcaatgtgtttatgccaagtatcttttttttggtctggtataattccttttacctaataaatggtaaatattgtatactgctaataaaattaaatgtaaaatattcaagcttaaatatgtatatactttttaactttattcaaatgtttgttcaaaatttatgaatcaaataagaaactgctcttaagaccttttaagaaaatcatgagttaagtggtagaaaacagtgacattttacatttgtatggcattgtaaagtttatagca

SEQ ID NO: 163970 - DNA, 601 bp, Human
tctcttcaccacttgtgattatgtatagcagtgtttatcccgagacccatcaagatctttgcactaccgagtcaattggaaacaaaatgggggaggttgtcactctataaaataaattatcatgaaaatctaaagcatacatgtttgtttattaaatttctgccaagacaggtcctcaatgtgtttatgccaagtatcttttttttggtctggtataattccttttacctaataaatggtaaatattgtatactgctaataaaattaaatgtaaaatattcaagcttaaatatgtatataytttttaactttattcaaatgtttgttcaaaatttatgaatcaaataagaaactgctcttaagaccttttaagaaaatcatgagttaagtggtagaaaacagtgacattttacatttgtatggcattgtaaagtttatagcatccttttacatgtgttacctcatttgaatttcaaacaatttatcagttagagaaggatatgatcatcattttccaaattatagaaatgaagtacaaaaaggttaaatggtgaaagatcacaggactagttcctaggaaagcaagcctggtagccccaag

SEQ ID NO: 163971 - DNA, 601 bp, Human
acaggactagttcctaggaaagcaagcctggtagccccaagctcagtgctttgaagtgcttgatagtaggataagaatcccagatagccctcccattaacttttctctgtatagcttcaattaattgagtttgctggctaagaactttgaatttaaaataaaaagaccaaattccagtcttcgttattttctagccatgtgattcttattcaaatgatgtaaactctctgagcctgacttctgtatctgcaacatggttatagtgcagctcctggatcttccacatagagctcatttggcycacaccaacaaggaaaaatgctctgaaaatgactgaatgccttttaaaaacataaacaaatattgtttcataccatcatggcattttgtaatgaggatttaacccagaggcaaaagatatagggtcaaacctcaactctaccactagaagctgtgtgactccagacaagtccttgaacctgtgtgagaatttgttttgttcacggtaaaataaggatttttgagtgatatttaagtcatttaaatagtgatatttatcaatgacaaattgctgtgagtggttgaatgggataaacaaaag

SEQ ID NO: 163972 - DNA, 601 bp, Human
atatatattatatatatatttccatatatatagagaaaagcattatttgcatatagtatacttaaaaatgctaatttttggctgggcacagtggcgcatgcctgtaatcccagcactttgggaggccgaggtgggcagatcacctgaggtcagagttcgagaccagcctgaccaatatgaagaaaccctatctctactaaaaaaaaacacaaaattagcctggcatggtggcacatgcctgaaatcccagctacttgggaggctgaggcagaagaattgcttgaacctgggaggtggaggwtgaagtgagccgagatcgcgccactgcactccagcctgggcgacaagagcaaaactccgtctcaaggggaaaaaaatgctatagttttagtactatgtcagaaaacataatggctcctgaatctttttggcttctaaaggaaatatgccaaagtaggtatatgagagggtgctgtgcacagaagatcatatgtgactgaagcctaatttgtgacttgtaactcactcatcttcacacttttgcctttctcagggagtttcaaactcctttcttcctgtattacttaaatttctcaaatac

SEQ ID NO: 163973 - DNA, 601 bp, Human
ccagcctccctcccagagctcattgatgcacagagtttcagaggggttccaggcaggattggcatgtcaacactgccccaagcaggtgcatatggccagatcacaacagcacccaggctcggcttcaactttaaccttaaatctgggcaggcaccaggagtggggaaaggccagggagcaggagcaggcacttctgagcctgcaggggcaggggggcttcctgggccccagagagtgcagggatgtccaggtctggagccatggctaggcagcagcagcagcagctgcacctgcactgggragtgtgggtctccaacccctttaacttggtagggggcggggctgccacctgttcctggcccctgccggctttgcacagtgtggggccctggccacacctgccccactgcagcatctgcctttgcagaggccacttcaggcagcctctgctgccattaggaccaaaaatagtaaaattcctctgagattatagttgagtggatttggggactttgatgatatacatcattgtcattctctatttcatttgtaactagatattattcagatgttaaattcaaaaaaatataaataacacatt

SEQ ID NO: 163974 - DNA, 601 bp, Human
ttaaatctgggcaggcaccaggagtggggaaaggccagggagcaggagcaggcacttctgagcctgcaggggcaggggggcttcctgggccccagagagtgcagggatgtccaggtctggagccatggctaggcagcagcagcagcagctgcacctgcactgggaagtgtgggtctccaacccctttaacttggtagggggcggggctgccacctgttcctggcccctgccggctttgcacagtgtggggccctggccacacctgccccactgcagcatctgcctttgcagaggccacttsaggcagcctctgctgccattaggaccaaaaatagtaaaattcctctgagattatagttgagtggatttggggactttgatgatatacatcattgtcattctctatttcatttgtaactagatattattcagatgttaaattcaaaaaaatataaataacacattaaaagagtagtttcattaggtatatagctatattctttaaaatctcatccattgctataaattcatgcatttatgcattactctctagtttcttaacattcagcttgacatttccttttctattgacaccaataaa

SEQ ID NO: 163975 - DNA, 601 bp, Human
ggcggggctgccacctgttcctggcccctgccggctttgcacagtgtggggccctggccacacctgccccactgcagcatctgcctttgcagaggccacttcaggcagcctctgctgccattaggaccaaaaatagtaaaattcctctgagattatagttgagtggatttggggactttgatgatatacatcattgtcattctctatttcatttgtaactagatattattcagatgttaaattcaaaaaaatataaataacacattaaaagagtagtttcattaggtatatagctatattytttaaaatctcatccattgctataaattcatgcatttatgcattactctctagtttcttaacattcagcttgacatttccttttctattgacaccaataaagcccaatgcattttctgtataactaaatcatcttgaaaagagtttaaaacatgatacaaaaatgaaattgaaattgtcttttatagcttatgaataaattttgaatattccctttgtgctttgtgatttaggtgctgaacggctaaggtataaatagtacaccactactaggttcctaaaaagccgctttgatttgaga

SEQ ID NO: 163976 - DNA, 601 bp, Human
ctataaattcatgcatttatgcattactctctagtttcttaacattcagcttgacatttccttttctattgacaccaataaagcccaatgcattttctgtataactaaatcatcttgaaaagagtttaaaacatgatacaaaaatgaaattgaaattgtcttttatagcttatgaataaattttgaatattccctttgtgctttgtgatttaggtgctgaacggctaaggtataaatagtacaccactactaggttcctaaaaagccgctttgatttgagatatatttaacttctacctcraagacatagtttttatattggaagaaaatgttttttgctcctaggaaacttcagtattattctcatcacaagcttaacatgctatatctttcccaaagttggtgtatttcattgaatcattttaatgtgctctgactgaagaatatcaatatcactcttcagatgaaaggtggttccagtaatgcctgatgtctcagcatcatttgtaatacaaatgatggggagcctgtggcttaatggccactaatttattttgaatttatgatgcattgcagccattagtagtaagctgctttacat

SEQ ID NO: 163977 - DNA, 601 bp, Human
tgactgaagaatatcaatatcactcttcagatgaaaggtggttccagtaatgcctgatgtctcagcatcatttgtaatacaaatgatggggagcctgtggcttaatggccactaatttattttgaatttatgatgcattgcagccattagtagtaagctgctttacatcagttcatggcgaataagagttctgtttgtggtaggttttatttcttgatgtcagatgagaaaatatgactatttcaaaaggaaaataaacccagtcctaaagtggaatcaggtcagaagtctaccagttctrtgtaacaatatatcatgcacttcactgtgccttatcataggtaactgtggggtatttttaaatgaaaaactgtagccctgctgcttttgcattatattaaaacataaatttaatatgcaatttccactggggttttttgaacactttattaatatatatttatcatgaaattttgcagaataagtaatatattataaattttatgttatgaagattgccatatatttaaaaacataccaacattagaataaaactaacctttcaaatggcccctaacagatataaattctctatgacttt

SEQ ID NO: 163978 - DNA, 601 bp, Human
gggagcctgtggcttaatggccactaatttattttgaatttatgatgcattgcagccattagtagtaagctgctttacatcagttcatggcgaataagagttctgtttgtggtaggttttatttcttgatgtcagatgagaaaatatgactatttcaaaaggaaaataaacccagtcctaaagtggaatcaggtcagaagtctaccagttctgtgtaacaatatatcatgcacttcactgtgccttatcataggtaactgtggggtatttttaaatgaaaaactgtagccctgctgctttygcattatattaaaacataaatttaatatgcaatttccactggggttttttgaacactttattaatatatatttatcatgaaattttgcagaataagtaatatattataaattttatgttatgaagattgccatatatttaaaaacataccaacattagaataaaactaacctttcaaatggcccctaacagatataaattctctatgactttgataggaaaaaaggagaagcggaatgcatcattcaccctttaaagagatcaccatctacttgaggtaacaagattttggtagaaacat

SEQ ID NO: 163979 - DNA, 601 bp, Human
catacaactgtgagagatttattcccatatctgagaataaaaggtatcagtggttggaaatatgagagcaagcctccagggacagaagcatcatggacatggctgagtttgagctggatcttaaagaaagagcaaaatattagcagaaacaacatgcacacaaagcacaatggaggcaaaataataaaaattgctagagagtgggtgttaaatcaaatggtttatctgagagaagagatttcataaatatgaaataatagaaaatagggagggcttgagtgaaatgctttaaatgaacacmaaaaacaaacaaaaacaaagtttttctaaaactaattttaaacaccatatccaaattactaactccagcagccactaaggtccattgtagggtgagttcttgtcttgagctaattttcactttggtcaggcatcactccaaggctggattggttcaggaggctacacttggtgactttccccactatcagctgctgcagatgctgtatttcccaccactgcagttaaatcattccttctaaacaacagactgggcagatgccactttaggaccctatcaaaataacttgaccacagatga

SEQ ID NO: 163980 - DNA, 601 bp, Human
ggtatcagtggttggaaatatgagagcaagcctccagggacagaagcatcatggacatggctgagtttgagctggatcttaaagaaagagcaaaatattagcagaaacaacatgcacacaaagcacaatggaggcaaaataataaaaattgctagagagtgggtgttaaatcaaatggtttatctgagagaagagatttcataaatatgaaataatagaaaatagggagggcttgagtgaaatgctttaaatgaacaccaaaaacaaacaaaaacaaagtttttctaaaactaattttaarcaccatatccaaattactaactccagcagccactaaggtccattgtagggtgagttcttgtcttgagctaattttcactttggtcaggcatcactccaaggctggattggttcaggaggctacacttggtgactttccccactatcagctgctgcagatgctgtatttcccaccactgcagttaaatcattccttctaaacaacagactgggcagatgccactttaggaccctatcaaaataacttgaccacagatgaccagcctcgttggaactcactgcctaattctgcctagaaatt

SEQ ID NO: 163981 - DNA, 601 bp, Human
agtgaaatgctttaaatgaacaccaaaaacaaacaaaaacaaagtttttctaaaactaattttaaacaccatatccaaattactaactccagcagccactaaggtccattgtagggtgagttcttgtcttgagctaattttcactttggtcaggcatcactccaaggctggattggttcaggaggctacacttggtgactttccccactatcagctgctgcagatgctgtatttcccaccactgcagttaaatcattccttctaaacaacagactgggcagatgccactttaggaccctaycaaaataacttgaccacagatgaccagcctcgttggaactcactgcctaattctgcctagaaattaagacctcatcttaattatttagttcttcatctctttctagcctttgttactaaacaagtcctgatcatctgtcctccttatgcataacttcctccacatgctgaccaatgattctccaatgatttctagtcttgcattagcatgccttccaatccctcccactgagccctctgaaactgcttttccaagatatttcctgtcatctgttctctacaccctcagcctccatttcac

SEQ ID NO: 163982 - DNA, 601 bp, Human
ggaggctacacttggtgactttccccactatcagctgctgcagatgctgtatttcccaccactgcagttaaatcattccttctaaacaacagactgggcagatgccactttaggaccctatcaaaataacttgaccacagatgaccagcctcgttggaactcactgcctaattctgcctagaaattaagacctcatcttaattatttagttcttcatctctttctagcctttgttactaaacaagtcctgatcatctgtcctccttatgcataacttcctccacatgctgaccaatgattmtccaatgatttctagtcttgcattagcatgccttccaatccctcccactgagccctctgaaactgcttttccaagatatttcctgtcatctgttctctacaccctcagcctccatttcactgaacaattcctctgtttgcttatcctaagcaagccctgaggtcttctctgactgacttccaatatgcatattggagattgcatgttgttccacagcttttcaatggtgagtcacagacaccggctctcaagactcagataacatctgtgcttgtgctgtgaggcacagttgcagatggg

SEQ ID NO: 163983 - DNA, 601 bp, Human
ctgacttccaatatgcatattggagattgcatgttgttccacagcttttcaatggtgagtcacagacaccggctctcaagactcagataacatctgtgcttgtgctgtgaggcacagttgcagatggggaagggatctgcaaatgaggtacaaaggacatttagggtcagcatcaaacaggacatacaactcacctaatcctctccatgaggttatcttctttgagagaattttggcacacacctaaaagcctagataataataataaagaggctactcattatcttatgaaatcattgaygaattaaaattgaagatttataataagttaaaaatgccagtgtttgggttgattgcattgttgagaaagaggaatttcagaccagtttattagaattctaaggagtgatttttgcttagtaatggaccttttaaaatagtcagtccaatctctaaaacctctttcctcttgaaacatcattaaataattttactttaaactatgtcctcttaggcatttgattactaacaaaatgtttatgctccttaactgctttgactgcaataaaaagggagctgacttcctgagtaactgggtaaa

SEQ ID NO: 163984 - DNA, 601 bp, Human
tgaggtacaaaggacatttagggtcagcatcaaacaggacatacaactcacctaatcctctccatgaggttatcttctttgagagaattttggcacacacctaaaagcctagataataataataaagaggctactcattatcttatgaaatcattgatgaattaaaattgaagatttataataagttaaaaatgccagtgtttgggttgattgcattgttgagaaagaggaatttcagaccagtttattagaattctaaggagtgatttttgcttagtaatggaccttttaaaatagtcartccaatctctaaaacctctttcctcttgaaacatcattaaataattttactttaaactatgtcctcttaggcatttgattactaacaaaatgtttatgctccttaactgctttgactgcaataaaaagggagctgacttcctgagtaactgggtaaattgataggactttttctagattttctaatgtttaataccattgcttttatttgaaaagactggacttttggggggatgacttggactccctgtctttagattgtcctgactctagcctgtccctgttacacaattttccctag

SEQ ID NO: 163985 - DNA, 601 bp, Human
agcagatgtctggtctaaactattttgcccagcacgtataccacattggatttgggtggtttcagttttgatttggagaattgctttagcagtctatgtcacaccatcacaagaatgaaatctttctgccaaggaattattttatccataaaatatgcaactatactataagatttccaagatagaatacctcctaacaaaaacataattcttcaaagcgtatgtgtgaatgattgtgaaatacaagtacaaatctaaacttgtttccatatcaaactgagggctgggctgctatttctcrtggaccaataacaagatgcagatgaactggggaggaagagagtttttattttctgcaactggttatgggagaaggcctgtctattctgacatagaccaagtctctgtccttgtttccaaaatataaagtatttttcattcatcctaccctttgctggcatttcaacattttgcttgtcactaattttgactctttatcttaacaagggtttatggcagggaatagtattgacccacagatgagctttgcctcagagaaagaaaatgctaatgactgctcataggtgaaagactatgagca

SEQ ID NO: 163986 - DNA, 601 bp, Human
tatctagaaaaccccaatgtctcagcccaaaatctccttaagctgataagcaacttcagcaaagtctcaggatacaaaatcaatgtacaaaaatcacaagcattcttatacaccaataacagacaaacagagagccaaatcatgtgtgaactccctttcacaattgcttcaaagaaaataaaatacctaggaatccaatttacaagggacgtgaaggacctcttcaaggagaactacaaaccactgctcaatgaaataaaagaggatacaaagaaatggaagaacattccatgctcatggktaggaagaatcaatatcatgaaaatggccatactgcccaaggtaatttatagattcaatgccatccccatcaagctaccgatgactttcttcacagaattggaaaaaactactttaaagttcatatggaacccaaaaagagcccgcatcgccaagtcaatcctaagcctatcctcaaagattcttatgcagttggtatcaaagtgccctttataccttggagcactttgagaaaccttacccagtgtgtttgtaaatgtggtgtcaggaggaacaaacttttcacagctgtcctggacag

SEQ ID NO: 163987 - DNA, 601 bp, Human
caatgtacaaaaatcacaagcattcttatacaccaataacagacaaacagagagccaaatcatgtgtgaactccctttcacaattgcttcaaagaaaataaaatacctaggaatccaatttacaagggacgtgaaggacctcttcaaggagaactacaaaccactgctcaatgaaataaaagaggatacaaagaaatggaagaacattccatgctcatggttaggaagaatcaatatcatgaaaatggccatactgcccaaggtaatttatagattcaatgccatccccatcaagctaccratgactttcttcacagaattggaaaaaactactttaaagttcatatggaacccaaaaagagcccgcatcgccaagtcaatcctaagcctatcctcaaagattcttatgcagttggtatcaaagtgccctttataccttggagcactttgagaaaccttacccagtgtgtttgtaaatgtggtgtcaggaggaacaaacttttcacagctgtcctggacagatgccagaaatttccccttctttgctcttagtgctggttagtcttaggaataacaggcttcctagggtttcttgtagatg

SEQ ID NO: 163988 - DNA, 601 bp, Human
gcactttgagaaaccttacccagtgtgtttgtaaatgtggtgtcaggaggaacaaacttttcacagctgtcctggacagatgccagaaatttccccttctttgctcttagtgctggttagtcttaggaataacaggcttcctagggtttcttgtagatgctcattaaaaatagggcaaaaaatccagagatacagtgacgggttctgctcctttctttcagaaggaaatgaaaagcaagttatcgtagggatagcatgctaatacagtcaccgttttcagttaccaccattcttttcactsaattttagagttctttcaagaagcaaggaaacatcaatttgaatctgaagaaaattcacgggaatctctgaagccagccagtagttaaaagcaagaactttgtgctattggttagttgatttacagcttattttaggacagagaggaaaggagtgtgtgttcaatgttcactttgttgcctgccagtcctcctgttatggtagaagttatctgagttactggtggtgaatccatctgggtctgcagcaacctcaattcctgcctccccagaagaaataatttgactgaggggcataaggc

SEQ ID NO: 163989 - DNA, 601 bp, Human
gctcttagtgctggttagtcttaggaataacaggcttcctagggtttcttgtagatgctcattaaaaatagggcaaaaaatccagagatacagtgacgggttctgctcctttctttcagaaggaaatgaaaagcaagttatcgtagggatagcatgctaatacagtcaccgttttcagttaccaccattcttttcactcaattttagagttctttcaagaagcaaggaaacatcaatttgaatctgaagaaaattcacgggaatctctgaagccagccagtagttaaaagcaagaactttrtgctattggttagttgatttacagcttattttaggacagagaggaaaggagtgtgtgttcaatgttcactttgttgcctgccagtcctcctgttatggtagaagttatctgagttactggtggtgaatccatctgggtctgcagcaacctcaattcctgcctccccagaagaaataatttgactgaggggcataaggcagaaagagactgaggcaagtttcagagcaggagtggacgtttattaaaaagttttacagcaggaaagaacacttaaaagagatcctagcgggtgacttgggg

SEQ ID NO: 163990 - DNA, 601 bp, Human
tccaacattttgtctcttaatgctcatgtccaggaacttgcttctccctggcacttgcattctattaacactttaatgttaacagctctggatcatcaggaaattgtctctccctggtggcctaggtggggctgctgaattatcatttttaaagaggcagtgtgataattgtcaaaccaccacctaatattcctagtggatgtgggagaaaagcccactcttgccctgttcatgcctaacaacctgtaacactccacagtgtccctaaatgtcaacctaggaggaaagtgagaaatcacartggagatgggaaaatcaagtgttctgcagtttaaagagaaattaaaggcaaggaaaaatatcctaatgaaagctgttgaaaatgtatagagaggtttgaaacaatcaggcatctgtagataatggtcctgatctaaaagataaacccaaagaagagaaacacttatcaaaatgaatttctctagagatattttaggctctgctgaaagtaaggatggggaattaatgatattcttgggctacatctttatcaatatctttatcagtcaatatattttgaagattctctttccttcagcat

SEQ ID NO: 163991 - DNA, 601 bp, Human
tgttaacagctctggatcatcaggaaattgtctctccctggtggcctaggtggggctgctgaattatcatttttaaagaggcagtgtgataattgtcaaaccaccacctaatattcctagtggatgtgggagaaaagcccactcttgccctgttcatgcctaacaacctgtaacactccacagtgtccctaaatgtcaacctaggaggaaagtgagaaatcacagtggagatgggaaaatcaagtgttctgcagtttaaagagaaattaaaggcaaggaaaaatatcctaatgaaagctgwtgaaaatgtatagagaggtttgaaacaatcaggcatctgtagataatggtcctgatctaaaagataaacccaaagaagagaaacacttatcaaaatgaatttctctagagatattttaggctctgctgaaagtaaggatggggaattaatgatattcttgggctacatctttatcaatatctttatcagtcaatatattttgaagattctctttccttcagcatgtttttcctctctgtataaatccatgcacagttaattttcttcataatttcatgttttagtttggttttattacta

SEQ ID NO: 163992 - DNA, 601 bp, Human
acaaagaagaaaccactctttcagaacttaattatgtataatgctaggctgcagaagaagcaatgcttgaggtaccagagggaaaatgcatatgaatatcagttactcaagggactcatcatgctgtttcactgataattagtcatactgtttaaaaagagaaatttaggatgccggcactaaagaaagaggctagagtaattactgaggagtcagaacaaaaggcaaactttgtaaattatttacctataaatcaaaacatcgtttttctacattaatatttttggacttaagaaaatasttgtaaaagttatattgacaaaagatcatttaaatgcctttgcatttaaaattcattctgataatttgccatctctaaattagagaaaaggatacaacatcataatcttacatgacatgctttgcatttttagcatttatataaatcctttaaaatataaactccttaaaggcaggcatcataactatcttgttcatcataatccctgcacatagcctgaaagatgctcagtaaatatgtggtgagtaaaggaatgaacaaattttttcacttgtattgttgtaaaaattgtctaaatca

SEQ ID NO: 163993 - DNA, 601 bp, Human
ggaatgaacaaattttttcacttgtattgttgtaaaaattgtctaaatcaattttcaagtaaattaagactttaacaaatttttattaaacaaattaaatatatttagaagctactacatccaaatattacatttaaatgtgtacaattgatacataaattttccaattacatatcaatttctaattttgaaaatgaggaatttttatactgaacttacaataatcttaagcacataggatttgcaatgaaaaagacttagattcaaagcctggctctgtaatttgttcagtcacaagaayttaacttttccaagcttccatttccaaatctgtagaatatgagttcaactatttaacttacagtcttactgagagaaaatgaaatactgaatgaaagtcacttagtggagtacttgtaattcactaaaactcactgttgaaagttattattaggatgttttctatatgagaaacaaaaaaagattcagtttaaacaaaatgcacatatattatcttgcgtaagattattgatagggactggaggcagggaaattctgagcagaagagggcgagtcccctggcaagtgccccaccctcaag

SEQ ID NO: 163994 - DNA, 601 bp, Human
ataaattttccaattacatatcaatttctaattttgaaaatgaggaatttttatactgaacttacaataatcttaagcacataggatttgcaatgaaaaagacttagattcaaagcctggctctgtaatttgttcagtcacaagaacttaacttttccaagcttccatttccaaatctgtagaatatgagttcaactatttaacttacagtcttactgagagaaaatgaaatactgaatgaaagtcacttagtggagtacttgtaattcactaaaactcactgttgaaagttattattagratgttttctatatgagaaacaaaaaaagattcagtttaaacaaaatgcacatatattatcttgcgtaagattattgatagggactggaggcagggaaattctgagcagaagagggcgagtcccctggcaagtgccccaccctcaagcctggaacagcagcccaaaatgagaacatacatttcttttttcccactggaatgttgccttttccaaaaccacccataaccccccacccagcacccccatcccatacccataaaaaccctaggctctgctggcagagaagaggagaagcagctg

SEQ ID NO: 163995 - DNA, 601 bp, Human
agtggagtacttgtaattcactaaaactcactgttgaaagttattattaggatgttttctatatgagaaacaaaaaaagattcagtttaaacaaaatgcacatatattatcttgcgtaagattattgatagggactggaggcagggaaattctgagcagaagagggcgagtcccctggcaagtgccccaccctcaagcctggaacagcagcccaaaatgagaacatacatttcttttttcccactggaatgttgccttttccaaaaccacccataaccccccacccagcacccccatcccrtacccataaaaaccctaggctctgctggcagagaagaggagaagcagctggacattagagattatggttggacgtcagagagaagcagcttgacttcagagtgacggcttgacaatgttgcttcaaagaggagtccagcggggaaggctggactctgggggaagcttatcttccagttccattccctttgcagctccccttcctgctgaaagccactttcattggcaacaaaatcctccatattcaccaaccctcaattcattcgtgcaacctgatttttcctggatgctaaacaagagc

SEQ ID NO: 163996 - DNA, 601 bp, Human
aactcactgttgaaagttattattaggatgttttctatatgagaaacaaaaaaagattcagtttaaacaaaatgcacatatattatcttgcgtaagattattgatagggactggaggcagggaaattctgagcagaagagggcgagtcccctggcaagtgccccaccctcaagcctggaacagcagcccaaaatgagaacatacatttcttttttcccactggaatgttgccttttccaaaaccacccataaccccccacccagcacccccatcccatacccataaaaaccctaggctctsctggcagagaagaggagaagcagctggacattagagattatggttggacgtcagagagaagcagcttgacttcagagtgacggcttgacaatgttgcttcaaagaggagtccagcggggaaggctggactctgggggaagcttatcttccagttccattccctttgcagctccccttcctgctgaaagccactttcattggcaacaaaatcctccatattcaccaaccctcaattcattcgtgcaacctgatttttcctggatgctaaacaagagctcgggtgccacaggtgcagatgct

SEQ ID NO: 163997 - DNA, 601 bp, Human
atgagaaacaaaaaaagattcagtttaaacaaaatgcacatatattatcttgcgtaagattattgatagggactggaggcagggaaattctgagcagaagagggcgagtcccctggcaagtgccccaccctcaagcctggaacagcagcccaaaatgagaacatacatttcttttttcccactggaatgttgccttttccaaaaccacccataaccccccacccagcacccccatcccatacccataaaaaccctaggctctgctggcagagaagaggagaagcagctggacattagagaytatggttggacgtcagagagaagcagcttgacttcagagtgacggcttgacaatgttgcttcaaagaggagtccagcggggaaggctggactctgggggaagcttatcttccagttccattccctttgcagctccccttcctgctgaaagccactttcattggcaacaaaatcctccatattcaccaaccctcaattcattcgtgcaacctgatttttcctggatgctaaacaagagctcgggtgccacaggtgcagatgctaaaggctatcacactgaccctctgccctcactggcaga

SEQ ID NO: 163998 - DNA, 601 bp, Human
atgttgccttttccaaaaccacccataaccccccacccagcacccccatcccatacccataaaaaccctaggctctgctggcagagaagaggagaagcagctggacattagagattatggttggacgtcagagagaagcagcttgacttcagagtgacggcttgacaatgttgcttcaaagaggagtccagcggggaaggctggactctgggggaagcttatcttccagttccattccctttgcagctccccttcctgctgaaagccactttcattggcaacaaaatcctccatattcacyaaccctcaattcattcgtgcaacctgatttttcctggatgctaaacaagagctcgggtgccacaggtgcagatgctaaaggctatcacactgaccctctgccctcactggcagagagcacccacctcatgcaaaaaggcagagggcccactgagctataaatacttaagccgtctgtggacggcaaaagctaaaagagtgctgactgtaacacatgccctctgaggcttcggcgatagcaggcacctcctagacactgctgcagggccctggatggagattggtctggccagcacccaaa

SEQ ID NO: 163999 - DNA, 601 bp, Human
ctcttgcgaggggtgaaatgtaatgggtcccagtgagtggagtttgcccctgccagtgctgaagtggccggctacatccagtgcccatgtactctagatccccccatcaaaggtgtcagggaaacttttctgcttcattatgagagcctcatctcattgaattgagaggtagggtagaccctaaggttagttgattctggagttcaaggatgtcatcagaaaccaggtatttacacccctcccctcatctccctcatcaccttcatccttagactgcttctctttatgattataaaatggstgccaggagcaatcagacaatatgctgtctttttcatatctgaagaaaacagaaacaaaatttgtcttccttaccctcaaagccctaaccaagtctattctcgcattttattcactcaaatgagtttaggtctaaccattcccataaagtattagcaaaagaatgaggtcattgtcactggcatagagtcctattgggttgggaatggatgttggagaatcaagcatagtatccactataatgatgataatgacaatggggatgatggataattgccctatgaattgatacaaaagtagt

SEQ ID NO: 164000 - DNA, 601 bp, Human
tcccctcatctccctcatcaccttcatccttagactgcttctctttatgattataaaatggctgccaggagcaatcagacaatatgctgtctttttcatatctgaagaaaacagaaacaaaatttgtcttccttaccctcaaagccctaaccaagtctattctcgcattttattcactcaaatgagtttaggtctaaccattcccataaagtattagcaaaagaatgaggtcattgtcactggcatagagtcctattgggttgggaatggatgttggagaatcaagcatagtatccactayaatgatgataatgacaatggggatgatggataattgccctatgaattgatacaaaagtagtaaaatttcaagttaagatttaaatcaacaaataatagaagaaactctgtacataggcactgaagtagaaattcaatgggttggtcacaaaacacacaatgaatgacaaaaaataattcacattctacctcaggagacagaagtatcagaatcaaagtaacatgccataatatagaactgtggcaattatgatacacgcacacataaaaaaggagatattcttcctggaaggtttagaag

SEQ ID NO: 164001 - DNA, 601 bp, Human
accaagtctattctcgcattttattcactcaaatgagtttaggtctaaccattcccataaagtattagcaaaagaatgaggtcattgtcactggcatagagtcctattgggttgggaatggatgttggagaatcaagcatagtatccactataatgatgataatgacaatggggatgatggataattgccctatgaattgatacaaaagtagtaaaatttcaagttaagatttaaatcaacaaataatagaagaaactctgtacataggcactgaagtagaaattcaatgggttggtcacmaaacacacaatgaatgacaaaaaataattcacattctacctcaggagacagaagtatcagaatcaaagtaacatgccataatatagaactgtggcaattatgatacacgcacacataaaaaaggagatattcttcctggaaggtttagaaggtgtacatagaggttatatttaagattaattttgaaattcttatagacatttcttatgtctgcaaaaaaggcatattcgtcagaattacactgaaagcactggaagactaggaagtttaattatcttttgttcattctgtatcatcagt

SEQ ID NO: 164002 - DNA, 601 bp, Human
ttggagaatcaagcatagtatccactataatgatgataatgacaatggggatgatggataattgccctatgaattgatacaaaagtagtaaaatttcaagttaagatttaaatcaacaaataatagaagaaactctgtacataggcactgaagtagaaattcaatgggttggtcacaaaacacacaatgaatgacaaaaaataattcacattctacctcaggagacagaagtatcagaatcaaagtaacatgccataatatagaactgtggcaattatgatacacgcacacataaaaaagsagatattcttcctggaaggtttagaaggtgtacatagaggttatatttaagattaattttgaaattcttatagacatttcttatgtctgcaaaaaaggcatattcgtcagaattacactgaaagcactggaagactaggaagtttaattatcttttgttcattctgtatcatcagtgcctagagctatgtttaaaacatagtgggtactcaatatttataagaatatgaacaacattcacaaaggtaatcatgaaagaatggaaaacataaagtgaaaaattgtgaagttgaagacaggt

SEQ ID NO: 164003 - DNA, 601 bp, Human
tttaaatcaacaaataatagaagaaactctgtacataggcactgaagtagaaattcaatgggttggtcacaaaacacacaatgaatgacaaaaaataattcacattctacctcaggagacagaagtatcagaatcaaagtaacatgccataatatagaactgtggcaattatgatacacgcacacataaaaaaggagatattcttcctggaaggtttagaaggtgtacatagaggttatatttaagattaattttgaaattcttatagacatttcttatgtctgcaaaaaaggcatattcrtcagaattacactgaaagcactggaagactaggaagtttaattatcttttgttcattctgtatcatcagtgcctagagctatgtttaaaacatagtgggtactcaatatttataagaatatgaacaacattcacaaaggtaatcatgaaagaatggaaaacataaagtgaaaaattgtgaagttgaagacaggtcacatgatgaatgggacatgtcttattttaaagtatttagcctttattctggagctaatagtcaattacgggttttaaaaaggagaaccataatcaataatatgct

SEQ ID NO: 164004 - DNA, 601 bp, Human
aaactctgtacataggcactgaagtagaaattcaatgggttggtcacaaaacacacaatgaatgacaaaaaataattcacattctacctcaggagacagaagtatcagaatcaaagtaacatgccataatatagaactgtggcaattatgatacacgcacacataaaaaaggagatattcttcctggaaggtttagaaggtgtacatagaggttatatttaagattaattttgaaattcttatagacatttcttatgtctgcaaaaaaggcatattcgtcagaattacactgaaagcactrgaagactaggaagtttaattatcttttgttcattctgtatcatcagtgcctagagctatgtttaaaacatagtgggtactcaatatttataagaatatgaacaacattcacaaaggtaatcatgaaagaatggaaaacataaagtgaaaaattgtgaagttgaagacaggtcacatgatgaatgggacatgtcttattttaaagtatttagcctttattctggagctaatagtcaattacgggttttaaaaaggagaaccataatcaataatatgctttttgaaagatcactcttggtta

SEQ ID NO: 164005 - DNA, 601 bp, Human
atagacatttcttatgtctgcaaaaaaggcatattcgtcagaattacactgaaagcactggaagactaggaagtttaattatcttttgttcattctgtatcatcagtgcctagagctatgtttaaaacatagtgggtactcaatatttataagaatatgaacaacattcacaaaggtaatcatgaaagaatggaaaacataaagtgaaaaattgtgaagttgaagacaggtcacatgatgaatgggacatgtcttattttaaagtatttagcctttattctggagctaatagtcaattacrggttttaaaaaggagaaccataatcaataatatgctttttgaaagatcactcttggttacttctttgtgtccagtaaaaggtcggatgaacttcaagtaaggaaacagcaacaaggagaaaagaaataactgtcttcgaagtatatttagaaaacagacttgtcagtactttgtaattaatttgatgtcaaatgtgaagcacaaggagtaatctaagatgatgtctggctttcaggcttgattgaatggatagtgatgtctaccaatgaaatcagcaatacaagagccaaagcaaatttt

SEQ ID NO: 164006 - DNA, 601 bp, Human
attacgggttttaaaaaggagaaccataatcaataatatgctttttgaaagatcactcttggttacttctttgtgtccagtaaaaggtcggatgaacttcaagtaaggaaacagcaacaaggagaaaagaaataactgtcttcgaagtatatttagaaaacagacttgtcagtactttgtaattaatttgatgtcaaatgtgaagcacaaggagtaatctaagatgatgtctggctttcaggcttgattgaatggatagtgatgtctaccaatgaaatcagcaatacaagagccaaagcarattttatttcagggcatgaattaaacaatatatatgactcagtttattttgaggcatcagtgacatgagcacctgaaaatgctagaaaggtcttgtttgtcttgtcctacaatcagaaaagagttttaatctacaatttttaatttggtacccaccaggtagtcaaagtctaaagaaaacttagaaagtgagatgagaagatggcttcacatttaacgttgagctgagcaaaagtagactctgagttaatgttaactccctcaagaacatctttaatagtaccccagtttggttcaagct

SEQ ID NO: 164007 - DNA, 601 bp, Human
ctgtcctctcatgcatctgaacccagcagaaaattattttatcttttccttcaaagaatattgacaaagtaacagcaacataattaagaaatttatggatgaggatgtccttgcaatatgatccctaccccctcaaagtcagaaaggcaatagtgtgtttttttactgttgtttgtatgtatgtgtttttgcttttgtgacaggatctcactctgtcatgcaggctggagtgtagtgacgatcatagcttgctgcagtctcaaactcttgagctcaggcaatcctcctgcctcagcctaaygggtagctgggactacaggtgtgcacccccatgcctgtctaattattttattttagtagtgacagtgtctcaccgtattgcctaggctagtctctaaatcctgtgctcaagagatcctcctgcctcagactcccaaagagctggaattacaagtgtgagccagtgcacctggcctattgtgttctaaaacaaatgacattttactaccaagaactggacatgcatacatatatgtgtatacatctaatgatatagttatatgaaagaaaggcattaaaaattaagttactatttaagcag

SEQ ID NO: 164008 - DNA, 601 bp, Human
caacataattaagaaatttatggatgaggatgtccttgcaatatgatccctaccccctcaaagtcagaaaggcaatagtgtgtttttttactgttgtttgtatgtatgtgtttttgcttttgtgacaggatctcactctgtcatgcaggctggagtgtagtgacgatcatagcttgctgcagtctcaaactcttgagctcaggcaatcctcctgcctcagcctaacgggtagctgggactacaggtgtgcacccccatgcctgtctaattattttattttagtagtgacagtgtctcaccrtattgcctaggctagtctctaaatcctgtgctcaagagatcctcctgcctcagactcccaaagagctggaattacaagtgtgagccagtgcacctggcctattgtgttctaaaacaaatgacattttactaccaagaactggacatgcatacatatatgtgtatacatctaatgatatagttatatgaaagaaaggcattaaaaattaagttactatttaagcagaaagttttacaattattagactattataataaagttattatgttgtacatttcaataaaatcattaaataactct

SEQ ID NO: 164009 - DNA, 601 bp, Human
agtctcaaactcttgagctcaggcaatcctcctgcctcagcctaacgggtagctgggactacaggtgtgcacccccatgcctgtctaattattttattttagtagtgacagtgtctcaccgtattgcctaggctagtctctaaatcctgtgctcaagagatcctcctgcctcagactcccaaagagctggaattacaagtgtgagccagtgcacctggcctattgtgttctaaaacaaatgacattttactaccaagaactggacatgcatacatatatgtgtatacatctaatgatatarttatatgaaagaaaggcattaaaaattaagttactatttaagcagaaagttttacaattattagactattataataaagttattatgttgtacatttcaataaaatcattaaataactctaaacaacaacgaaattgttatttaatgcaaaattcaaaatatattgtacagaaaatagtataatgtattaagggtttcaaattaaaaaattataaaatatttttctaattaattgtttttaactcttttctaataaataaacatttgattgtatcattcttttcctgatccccaccacat

SEQ ID NO: 164010 - DNA, 601 bp, Human
agtgtctcaccgtattgcctaggctagtctctaaatcctgtgctcaagagatcctcctgcctcagactcccaaagagctggaattacaagtgtgagccagtgcacctggcctattgtgttctaaaacaaatgacattttactaccaagaactggacatgcatacatatatgtgtatacatctaatgatatagttatatgaaagaaaggcattaaaaattaagttactatttaagcagaaagttttacaattattagactattataataaagttattatgttgtacatttcaataaaatcawtaaataactctaaacaacaacgaaattgttatttaatgcaaaattcaaaatatattgtacagaaaatagtataatgtattaagggtttcaaattaaaaaattataaaatatttttctaattaattgtttttaactcttttctaataaataaacatttgattgtatcattcttttcctgatccccaccacatatctagaacttgtgatcttaacttcttctttcaggccaaatggagggaaacaatccaggaagaggagcacataggaggcaccataagtgaaagggtgcaattgtctagc

SEQ ID NO: 164011 - DNA, 601 bp, Human
gcctaaaacatgtgtgacacttatctctatgtgagcggttctttcctctagtaaattatcacaataaaaaatgggctctcagagttcttgcatattttgtatcatgtttcgtgcaataccataaaccttgaataacaccacgggacccatacaaagttgaattgcttgatatgtaccatagactgaagtcggctactgtagctgcctaccatttcaagataattgaatacagcaaaaatactactgtaagaaaataaaaggaaatttatgaaatttttgttgcagactctgccaacaggtrtgaaaaccttacactttttgcaaactacctttttatcttgtattgaaaatgcagcttttatgtaggttcgggattgctataagacttacctatagatatgcactttaatatgatttgagaacaagcaaatgacaacttaaagtaaaagctaaatgaaatatctaaatccagagtatttaataccagcaaactgtggtttgataattttaagtagagatttggctttaaaaaatgtcacgataacaggagaagcagcttctactgaccaaaaagcagcagatgacttccaagacatcactg

SEQ ID NO: 164012 - DNA, 601 bp, Human
atattttgtatcatgtttcgtgcaataccataaaccttgaataacaccacgggacccatacaaagttgaattgcttgatatgtaccatagactgaagtcggctactgtagctgcctaccatttcaagataattgaatacagcaaaaatactactgtaagaaaataaaaggaaatttatgaaatttttgttgcagactctgccaacaggtgtgaaaaccttacactttttgcaaactacctttttatcttgtattgaaaatgcagcttttatgtaggttcgggattgctataagacttaccyatagatatgcactttaatatgatttgagaacaagcaaatgacaacttaaagtaaaagctaaatgaaatatctaaatccagagtatttaataccagcaaactgtggtttgataattttaagtagagatttggctttaaaaaatgtcacgataacaggagaagcagcttctactgaccaaaaagcagcagatgacttccaagacatcactgaaaaaatcattgagaagaaatgacatctgcctgaacaggtttttaatgcagacaaaagtacactagtttggggaaaaaaatgccacaaagg

SEQ ID NO: 164013 - DNA, 601 bp, Human
gggctgccatactggcagtttttttgatattggataatgaccttgaccacccaaaaccccacgaattcagtgccaaaggtgtcgaagtggtctacttgcccccatacacaaaatatctcattcagcctctagatcaggaggtgaggtcatagcacctttaaggctcattacacatggtactctatggaaaaaatggtcaacgctgtggaagagaacctctatatagagagtatcatggatgtttggaagaattacacccttgaagatgtcgttattgttatagaaaaagccatgaaagtcrccaagcttgaagcaataaatttctgctagagagaagatgttttgcaagacttcacaagatttatgatagagccaatcaaagaaatcatgaaagagattgtggatgtggcagaaaaggttggaatgtaaaggacttcaagatatggatcttggagaaattcaagagataataaaaatcacaccagagtaattagtagaagctgacttgatggagatgaaagtttccaaaccagcgccagacattgaggaagaacacatagaagaagcagggcaatggggaaagcattccctatttaacaaa

SEQ ID NO: 164014 - DNA, 601 bp, Human
aggaaacaacagatgctggagaggatgtggagaaataggaacgcttttacaatgttggtggaagtgtaaattagttcaactgttgtggaagatggtatggcgattcctcaaggatctggaactagaaatacaatttgacccagcaatcccattactgggtatatacccaaaggattataaatcattctactctaaagacacatgcacttgtatgtttactgtagcactgttcacaatagcaaagacttgcaaccaacccaaatgcccatcaatgatagactggataaagaaaatgtggcgyatatacaccatggaatactatgtagccataaaaaaaggatgagttcatgtcctttgcagggacatggatgaagctggaaaccatcaatctcagcaaactaacacaggaacagaaaaccaaacaccacatgttctcactcacaagtgggagttgaacaataagaaaacatggacacagggaggggaacatcacacactgaggcctgtcggggggcggggggctaggggagggacagcattagaagaaatacctggatcgctggagccaagatttgctggagccaaataggaacagctccgg

SEQ ID NO: 164015 - DNA, 601 bp, Human
agaggatgtggagaaataggaacgcttttacaatgttggtggaagtgtaaattagttcaactgttgtggaagatggtatggcgattcctcaaggatctggaactagaaatacaatttgacccagcaatcccattactgggtatatacccaaaggattataaatcattctactctaaagacacatgcacttgtatgtttactgtagcactgttcacaatagcaaagacttgcaaccaacccaaatgcccatcaatgatagactggataaagaaaatgtggcgcatatacaccatggaatacyatgtagccataaaaaaaggatgagttcatgtcctttgcagggacatggatgaagctggaaaccatcaatctcagcaaactaacacaggaacagaaaaccaaacaccacatgttctcactcacaagtgggagttgaacaataagaaaacatggacacagggaggggaacatcacacactgaggcctgtcggggggcggggggctaggggagggacagcattagaagaaatacctggatcgctggagccaagatttgctggagccaaataggaacagctccggtctacagctcccatcgtga

SEQ ID NO: 164016 - DNA, 601 bp, Human
aacgcttttacaatgttggtggaagtgtaaattagttcaactgttgtggaagatggtatggcgattcctcaaggatctggaactagaaatacaatttgacccagcaatcccattactgggtatatacccaaaggattataaatcattctactctaaagacacatgcacttgtatgtttactgtagcactgttcacaatagcaaagacttgcaaccaacccaaatgcccatcaatgatagactggataaagaaaatgtggcgcatatacaccatggaatactatgtagccataaaaaaaggwtgagttcatgtcctttgcagggacatggatgaagctggaaaccatcaatctcagcaaactaacacaggaacagaaaaccaaacaccacatgttctcactcacaagtgggagttgaacaataagaaaacatggacacagggaggggaacatcacacactgaggcctgtcggggggcggggggctaggggagggacagcattagaagaaatacctggatcgctggagccaagatttgctggagccaaataggaacagctccggtctacagctcccatcgtgagcgacgcagaagacgggtga

SEQ ID NO: 164017 - DNA, 601 bp, Human
acacatgcacttgtatgtttactgtagcactgttcacaatagcaaagacttgcaaccaacccaaatgcccatcaatgatagactggataaagaaaatgtggcgcatatacaccatggaatactatgtagccataaaaaaaggatgagttcatgtcctttgcagggacatggatgaagctggaaaccatcaatctcagcaaactaacacaggaacagaaaaccaaacaccacatgttctcactcacaagtgggagttgaacaataagaaaacatggacacagggaggggaacatcacacacygaggcctgtcggggggcggggggctaggggagggacagcattagaagaaatacctggatcgctggagccaagatttgctggagccaaataggaacagctccggtctacagctcccatcgtgagcgacgcagaagacgggtgatttctgcatttccatctgaggtactgggttcatctcactagggagtgccagacagtgggctcaggacagtgggtgcagcgcaccgtgtgcgagccgaagcagggcgaggcattgcctcactcgggaagcgcaaggggtcagggagttccctttcctag

SEQ ID NO: 164018 - DNA, 601 bp, Human
tgggagttgaacaataagaaaacatggacacagggaggggaacatcacacactgaggcctgtcggggggcggggggctaggggagggacagcattagaagaaatacctggatcgctggagccaagatttgctggagccaaataggaacagctccggtctacagctcccatcgtgagcgacgcagaagacgggtgatttctgcatttccatctgaggtactgggttcatctcactagggagtgccagacagtgggctcaggacagtgggtgcagcgcaccgtgtgcgagccgaagcagggcraggcattgcctcactcgggaagcgcaaggggtcagggagttccctttcctagtcaaagaaaggtgtgacagaggcacctggaaaatcgggtcactcccaccccaatactgcgcttttccgacgagcttaaaaaacggtgcaccaggagattatatcctgcacctggctcgtagggtcttacgaccatggagccttgctgattgctagcacggcagtctgagatcaaactgcaaggcggcagcgaggctgggggaggtgcgcccgccattgcccaggcttgcttaggtaaacaaagcagcc

SEQ ID NO: 164019 - DNA, 601 bp, Human
atggacacagggaggggaacatcacacactgaggcctgtcggggggcggggggctaggggagggacagcattagaagaaatacctggatcgctggagccaagatttgctggagccaaataggaacagctccggtctacagctcccatcgtgagcgacgcagaagacgggtgatttctgcatttccatctgaggtactgggttcatctcactagggagtgccagacagtgggctcaggacagtgggtgcagcgcaccgtgtgcgagccgaagcagggcgaggcattgcctcactcgggaagygcaaggggtcagggagttccctttcctagtcaaagaaaggtgtgacagaggcacctggaaaatcgggtcactcccaccccaatactgcgcttttccgacgagcttaaaaaacggtgcaccaggagattatatcctgcacctggctcgtagggtcttacgaccatggagccttgctgattgctagcacggcagtctgagatcaaactgcaaggcggcagcgaggctgggggaggtgcgcccgccattgcccaggcttgcttaggtaaacaaagcagccaggaagctccaactgggtggagc

SEQ ID NO: 164020 - DNA, 601 bp, Human
ataaaataaaataaaataaaaaaagaagaaatacctaatgtaggtgacgggttgatgggtgcagcaaaccaccatggcacgtgtatacctatgtaacaaacctgcacattctgcacatgtatcccagaactttaataataataaaaaaagaagacaaagtagttccagaaaacaaattgacattagataatctgacagagggttctaattattcaagactgcttttgatttttttcatgacttgcactcttctatgatacaggcactggaactaaagcaaaatggtggaagaagattagtmctctatagaaacatttttagagaaatgaaagtgcaaaaatgtcagacagaaatttctgtgtattttcacaaagttacaccgtgtgcctgcctctcctgcctctcctgcctccccttccacctcctccacctcttccatctctggcacccctgagtcagccagaccaacttctcctcttcctcctcctcctcagcctacttaacatgaagataatgaggattaagacctttttgatagcccacttccactccattaatagtaaatatactttctcttccttatgattttcttaattgcatt

SEQ ID NO: 164021 - DNA, 601 bp, Human
ctaattattcaagactgcttttgatttttttcatgacttgcactcttctatgatacaggcactggaactaaagcaaaatggtggaagaagattagtactctatagaaacatttttagagaaatgaaagtgcaaaaatgtcagacagaaatttctgtgtattttcacaaagttacaccgtgtgcctgcctctcctgcctctcctgcctccccttccacctcctccacctcttccatctctggcacccctgagtcagccagaccaacttctcctcttcctcctcctcctcagcctacttaacrtgaagataatgaggattaagacctttttgatagcccacttccactccattaatagtaaatatactttctcttccttatgattttcttaattgcattttctttttgctagcttcagttataagaagacagtatataatacatatacaaaatgtgcgttaatctattatttatgttatcagtaaagcttccagagtcagcagaaggctattagttttttagccattttagctattagttattttttgttaattgacaaataagtattacatacaattcacccttgaacaacacagggtccaa

SEQ ID NO: 164022 - DNA, 601 bp, Human
atagtagttgagttaaaatcaatccatctttctatgtgcctatctacatagctgcacttttatctgtctgttaaagtctgttctttatataccattggaaacattcgagggtcattaaaataggaccccattttcttgttcactgaataagatttacttcatatttatgggcatttttcttaaaacctcttgacaatagttagggatgcaaagaaacatggtaaattatatccttgaagttcttattttgtcggttatttgccagatacttttaattttatcatttgcctttagaatacarttttttatttacgtcccaatgtttctttacagattactgaactatgaaaaacaatatttatatttcaagaaaagtaacagtcttattaatgaatgtaaatagacatctttcttgtgatttatgttattaaggcacaatagtaaatattttataaaatatttgtaggctgtatttgagataaattcaggggaaaatattttatttcagaatgctctgatgctctgcctctgagatatagaacaatgcagtggtgtgtttaggataacttatgcaatattaaaggctatcttttctgtggaa

SEQ ID NO: 164023 - DNA, 601 bp, Human
tacttttaattttatcatttgcctttagaatacagttttttatttacgtcccaatgtttctttacagattactgaactatgaaaaacaatatttatatttcaagaaaagtaacagtcttattaatgaatgtaaatagacatctttcttgtgatttatgttattaaggcacaatagtaaatattttataaaatatttgtaggctgtatttgagataaattcaggggaaaatattttatttcagaatgctctgatgctctgcctctgagatatagaacaatgcagtggtgtgtttaggataayttatgcaatattaaaggctatcttttctgtggaattatttttggtcagttcctataaacaatcttttttcttccttaaattgcacaattaactaatattagcatgacattttaaacctagcaattatgtttttctaatgagatttatgtgtagatcaaaaatagatggcctctgatcttcatggccatagagaaaataaatatgtttcttgtgaacaccctggaattttcccagttttatggatcacattaatttaaaaatctatcatagatcttagtgtctgagaaatacacagaaact

SEQ ID NO: 164024 - DNA, 601 bp, Human
aaatctcaatgcatttatatgactctctagtaatttgttatacaaagagtacagaaaacagtgatttaccatagactattgtttacatctgaatctatttgttcaactcttttattaccattgccttgtttggctcatataaattttatttaatttttctttctaactaatcacaatgataccaaattgtagtatatagttttatttgtagcatagattgctctctaaaaatatgtaccatgagtacatgtgtaaatcaatgaacatcaacttaaacagtagctatttcatgtgaactacrcacattcttgtcaagaaacaggagtaaatggctgaggcccaggcataattccttggaagtgacaatgccaaaatgcccaaggaagctcttggcagggctactcatttgttttcacatatttatctatttgttcccttggtttcaaggctttaaacagaaattcagagcattttcatggtatctgggcatcattacaatatttactaaaagagaagtcctaaacatggtcattttatgggagaaatcagtagcacatggtgtttatgcaatgttatatatgattttactcattatgccaac

SEQ ID NO: 164025 - DNA, 601 bp, Human
atcattacaatatttactaaaagagaagtcctaaacatggtcattttatgggagaaatcagtagcacatggtgtttatgcaatgttatatatgattttactcattatgccaactgtattaaggggattccatctttctttgggccctcatcaggctaccacgatatacaatgagtggtatacttaagctctggctgaattgttctgtaatgtaatctgactcaaggagaacaaatggagagggtctttgtcattctactgtgtcatgtgaattttctctgtttctggagtctaagttgttctgtttttcacctgctatttgagaaattttttacaattttcgtgtcataagccagaatgcaatgggatgaatatggagcctttctttttatacactctcttgaaactcttcatgaaaagctttcttattgaattgtttcattctagcttgaatatcgaaatggaatgtgttacgataaattcataagtacgtttctattattatactatttatatagttatgacacattgtgaattgaatgaaaggtcttataaaattctgaaaagctgtgctgttgcttgtgtattatttatttatatct

SEQ ID NO: 164026 - DNA, 601 bp, Human
gatatacaatgagtggtatacttaagctctggctgaattgttctgtaatgtaatctgactcaaggagaacaaatggagagggtctttgtcattctactgtgtcatgtgaattttctctgtttctggagtctaagttgttctgtttttcacctgctatttgagaaattttttacaattttcgtgtcataagccagaatgcaatgggatgaatatggagcctttctttttatacactctcttgaaactcttcatgaaaagctttcttattgaattgtttcattctagcttgaatatcgaaatrgaatgtgttacgataaattcataagtacgtttctattattatactatttatatagttatgacacattgtgaattgaatgaaaggtcttataaaattctgaaaagctgtgctgttgcttgtgtattatttatttatatctctaaaattatccactgactgcaaattgtccgtaagggacatattcaatgtaaaacaatcattcccagaactaaaaaaggtctaaaaatttcttttgaattttctttctactacaaatttttgcataagaacagaaacagtaacttctttctaaaacaacaa

SEQ ID NO: 164027 - DNA, 601 bp, Human
tatctctaaaattatccactgactgcaaattgtccgtaagggacatattcaatgtaaaacaatcattcccagaactaaaaaaggtctaaaaatttcttttgaattttctttctactacaaatttttgcataagaacagaaacagtaacttctttctaaaacaacaatggaatctcaatatcaaaattagtctggttaagtacagcatgactgtaggcctagctgcttgggaggctgaggtgggaggatcacttgaggctcagagtttgaggctgcagtgtactataatagtgcctaggaayagccactgtacttgaagctggtcagcataatgagaccacatctttctcaaaaaaaaaaaaatctgatgctcagtatcaatcatttaaaaataaatgaatgaatgatcatgggacagaaaaatgataaattctgtattcaatctacatttgaacttatatttttgttacatctctgcaaattattttcatgggtttaagtatttttaattcattttatttttatttgcaaaaacattgcacatacatctaatttttaaaaattttctgggatcataagactacatggttaaaatattctat

SEQ ID NO: 164028 - DNA, 601 bp, Human
caatgtaaaacaatcattcccagaactaaaaaaggtctaaaaatttcttttgaattttctttctactacaaatttttgcataagaacagaaacagtaacttctttctaaaacaacaatggaatctcaatatcaaaattagtctggttaagtacagcatgactgtaggcctagctgcttgggaggctgaggtgggaggatcacttgaggctcagagtttgaggctgcagtgtactataatagtgcctaggaacagccactgtacttgaagctggtcagcataatgagaccacatctttctcaaaaaaaaaaaaatctgatgctcagtatcaatcatttaaaaataaatgaatgaatgatcatgggacagaaaaatgataaattctgtattcaatctacatttgaacttatatttttgttacatctctgcaaattattttcatgggtttaagtatttttaattcattttatttttatttgcaaaaacattgcacatacatctaatttttaaaaattttctgggatcataagactacatggttaaaatattctattatacttttatagcagattcaatcaaaataagataattactgaataaaa

SEQ ID NO: 164029 - DNA, 601 bp, Human
acagccactgtacttgaagctggtcagcataatgagaccacatctttctcaaaaaaaaaaaaatctgatgctcagtatcaatcatttaaaaataaatgaatgaatgatcatgggacagaaaaatgataaattctgtattcaatctacatttgaacttatatttttgttacatctctgcaaattattttcatgggtttaagtatttttaattcattttatttttatttgcaaaaacattgcacatacatctaatttttaaaaattttctgggatcataagactacatggttaaaatattctrttatacttttatagcagattcaatcaaaataagataattactgaataaaatgtaaacattgactagaaatgtcccttttaatgaaatcaataggcatcctgtatatctatagatgaataatttttagtgctagttaagcagatacaggtttttgtctcaattatatttctttcttggtttttcttggtttttaattgaggtacgtgctgagtaacttgttcacataataaagtagatgacagtggaaagtattttattttcagtattagtcaattatttgaacttgccaaaaatcacata

SEQ ID NO: 164030 - DNA, 601 bp, Human
tacatttgaacttatatttttgttacatctctgcaaattattttcatgggtttaagtatttttaattcattttatttttatttgcaaaaacattgcacatacatctaatttttaaaaattttctgggatcataagactacatggttaaaatattctattatacttttatagcagattcaatcaaaataagataattactgaataaaatgtaaacattgactagaaatgtcccttttaatgaaatcaataggcatcctgtatatctatagatgaataatttttagtgctagttaagcagatrcaggtttttgtctcaattatatttctttcttggtttttcttggtttttaattgaggtacgtgctgagtaacttgttcacataataaagtagatgacagtggaaagtattttattttcagtattagtcaattatttgaacttgccaaaaatcacataatgatttattatcaaaaattatttgtaatgatctgtggactgacaattcacttgaatcttccctcaatattgtgaagagcagaaaattggaaaccatctgattaacaaaaagattatttctagtcaataaacttagcatttctg

SEQ ID NO: 164031 - DNA, 601 bp, Human
aggtgtctagcactaaggttagccaagttgtgaatgcaaaggaaaagtgaagaaagttttagaagtttggatacaagatcaaaccacccacaacattccctaagccagagcctaatccagagcagggccctaactgtcttcaattctactgaaggtaaggaatctgcagaagagaagtttgaagctagtacatttttttgtttttgttttttattattattatactttaagttttagagtacatgtgcacaacgtgcaggtttgttacatatgtatacatgtgccatgttggtgtgctgcrcccattaactcgtcatttagcattaggtatatctcctaatgctatccctcccccctccccctccaccacaacagtccccggtgtgtgatgttccccttcctgtgtccatgtgttctcattgttcaattcccacctatgagtgagaacacgtggtgtttggttttttgtccttgcgatagtttgctgagaacgatggtttccagcttcatccatgtccctacaaaagacatgaactcatcattttctgtggctgtataatattccatggtgtatatgtgccatattttcttaatccagtct

SEQ ID NO: 164032 - DNA, 601 bp, Human
gctaagaaaaaaagttcctttcaaaatattactgcttattgacaatgcacctgggtcacccaggagctctgatagagatgtacaaggaggttaatattgttttcatgcctgctaatacaacattcattctgcagctcatggatcaaggagtcatttcaagtttcaatttcagcaaactatcgcaaggacaaaaaaccaatcaccgcatgttctcactcataggtgggaattgaacaatgagaacacttggacacaggaaggggaacatcacacactggggcctgtcgtggggtggggggargggggagggatagcattaggagatatacctaatgtaaatgaggagttaatggatgcagcacaccaacatggcccatgtatacatatgtaacaaacctgcacgttgtgcacatgtaccctagaacttaaagcataataaaaaaatttaaatacattttgtaagcttacagctgccgtacataatgactcctctgatgaatctgggaaaaggagatggaaaatcttctggaaaggatttgctattctagataacatcacgatcattcactgttatgggaggaggtcaaaataccaacattaa

SEQ ID NO: 164033 - DNA, 601 bp, Human
catgttctcactcataggtgggaattgaacaatgagaacacttggacacaggaaggggaacatcacacactggggcctgtcgtggggtggggggaggggggagggatagcattaggagatatacctaatgtaaatgaggagttaatggatgcagcacaccaacatggcccatgtatacatatgtaacaaacctgcacgttgtgcacatgtaccctagaacttaaagcataataaaaaaatttaaatacattttgtaagcttacagctgccgtacataatgactcctctgatgaatctgggaaaaggagatggaaaatcttctggaaaggatttgctattctagataacatcacgatcattcactgttatgggaggaggtcaaaataccaacattaacagaagtttggaagaagtttatttcaatcctcatgggtgactttaagaggctcaggacttcagtgaagtaagtaactgcagatgtggtagaaatagcaagagaactagaattagaagtggagcctgaaggtgtgactagattgctgcaatcttataaaacttgaatcaaggagagttgcttcttatggatgagccaagaaagtgg

SEQ ID NO: 164034 - DNA, 601 bp, Human
tttagaatagtacataaacttagttgataaagcagtggaaaggtttgagagaattgactccagtttagaaagaagttctactgtgggtaaaatgctgtcaaatgacatcgcatgctacaaagaaatctagcatgaaaggaagaatcaactgatgcaacaaacttgtttgtcttattttaagcaattgccagccaggtgcaatggctcacacttataatcccagcatttagggaggctgaggtggtagtatcacttgagcccaggaattcaagaccagcctgggcaacatagcaaggccccrtctctatgaaaaaaattaaaaagaatagccaggcatggtggcacacacctgtggtcccagctactagggagacttagttgggaggatctcgagtctagggggtcaaggcttcagtgagctatgatcgatccactgcactccagcctgggtgacagagcaagactctgtctcaacaacaacaacaaaagattgccatagctaccccagcctttagcaactgccaaccctgatcagtcagcagccatcaacatcaaaacaggaccctccaccagcaaaaagactgaaaatcactgaaggctg

SEQ ID NO: 164035 - DNA, 601 bp, Human
aatgctgtcaaatgacatcgcatgctacaaagaaatctagcatgaaaggaagaatcaactgatgcaacaaacttgtttgtcttattttaagcaattgccagccaggtgcaatggctcacacttataatcccagcatttagggaggctgaggtggtagtatcacttgagcccaggaattcaagaccagcctgggcaacatagcaaggccccgtctctatgaaaaaaattaaaaagaatagccaggcatggtggcacacacctgtggtcccagctactagggagacttagttgggaggatctygagtctagggggtcaaggcttcagtgagctatgatcgatccactgcactccagcctgggtgacagagcaagactctgtctcaacaacaacaacaaaagattgccatagctaccccagcctttagcaactgccaaccctgatcagtcagcagccatcaacatcaaaacaggaccctccaccagcaaaaagactgaaaatcactgaaggctgagatgatcattaacattttttagcaataaaatatttttaattgttatgcacactttttagatataattcaatgcacacttaatatagtgt

SEQ ID NO: 164036 - DNA, 601 bp, Human
ccatcaacatcaaaacaggaccctccaccagcaaaaagactgaaaatcactgaaggctgagatgatcattaacattttttagcaataaaatatttttaattgttatgcacactttttagatataattcaatgcacacttaatatagtgtgtaaagtgtaaacgtaacttttatatgcactgagaaaccaaaaaatttgtgactcactttattgcaatattcactttatcaaggttctctggaacctcacctgcagtgtctctgaggtatgtcttatataatatgtgttatatatattctcyacgtgtataatttattttcttcagctcttcaggtgaactttaccatgttagggacagaattatattctttttatacaacttgtacaattttcttttagttcttccctccaaaccctgttgtttttatagagcattctttcatgtggcctttttaaagttttatgttgcttgctattataaatgcaaacttttgtattctgtgtttgagttatctctttctgaaattgtgttattaccaatattctttcaaaagatattgtggagttaatagtattaggcactgaagtttaattttaaatt

SEQ ID NO: 164037 - DNA, 601 bp, Human
tcaatgtgttttatatatgatccatgtaaaaattctcaaatacaatacacttggaaattcttaataccatagtattagctgaaaaattatgttttttaggccaaatattggattgaaaattctgacctaacctagtatttatttcctccaaatagtgtccctagtttcagatgaaatacaattttaatttaagaatgaaatatgaaagcaagccatttatacattgacaagtcccataaagtactatggaatttaatcaagtctaagatagtctcaattgttaagttacactgttattttrtagtacaccaagaaagaaaataatgctgtcactgaagtaaaacacagtttcttaacatttagaatttttataactactaaaagaacttttttagacttaaatgcagattattttaataattttaatcacttgtgaatattttatgtatatacacacacagacatacattggaaaatatacattaaaaaattggtaaggcattcctaaaccttcttccctttcactaccggactcttctaaattactttggagtctgagttttcaacattcacatctcacacctaagcttattctgtcagt

SEQ ID NO: 164038 - DNA, 601 bp, Human
tctgtcagtgtgcaatatattttaacagagagatccaccatttttccagtgatttcatctaaagagctacacccaatctttaagttttgatgttgctatttactccaccttactagaacgtgtcaacagaagattttcctgtcaaaaatcaggatttatatttatattcatttttcaaatgctccttaaaaggttctactgaaatgtgattaagcattgtccaatcaagccacaggaaataataaccaaattcagacatgcatagtccatgataacaacattactacctatgactgcctcytgatgaacctatattggaaaaagtcattaggtgtaagacatcctttatgctaatatgataggatgtgaaaacaataggtgtcttagaatcaataaattatagtattaaagaaaaatcactgttgaagataattttaaaaaacaatttcagctctaattaatggcatatgtatgtgaatacagacacattattctagaaaataaaattttaacagacaagtcatttatgtaattcctagatttttttgttacataaatttacttgcatcttttaagatgttttggatattttaggtatgtt

SEQ ID NO: 164039 - DNA, 601 bp, Human; identical to SEQ ID NO: 31065

SEQ ID NO: 164040 - DNA, 601 bp, Human; identical to SEQ ID NO: 31066

SEQ ID NO: 164041 - DNA, 601 bp, Human; identical to SEQ ID NO: 31067

SEQ ID NO: 164042 - DNA, 601 bp, Human; identical to SEQ ID NO: 31068

SEQ ID NO: 164043 - DNA, 601 bp, Human; identical to SEQ ID NO: 31069

SEQ ID NO: 164044 - DNA, 601 bp, Human; identical to SEQ ID NO: 31070

SEQ ID NO: 164045 - DNA, 601 bp, Human; identical to SEQ ID NO: 31071

SEQ ID NO: 164046 - DNA, 601 bp, Human; identical to SEQ ID NO: 31072

SEQ ID NO: 164047 - DNA, 601 bp, Human; identical to SEQ ID NO: 31073

SEQ ID NO: 164048 - DNA, 601 bp, Human; identical to SEQ ID NO: 31074

SEQ ID NO: 164049 - DNA, 601 bp, Human; identical to SEQ ID NO: 31075

SEQ ID NO: 164050 - DNA, 601 bp, Human; identical to SEQ ID NO: 31076

SEQ ID NO: 164051 - DNA, 601 bp, Human; identical to SEQ ID NO: 31077

SEQ ID NO: 164052 - DNA, 601 bp, Human; identical to SEQ ID NO: 31078

SEQ ID NO: 164053 - DNA, 601 bp, Human; identical to SEQ ID NO: 20270

SEQ ID NO: 164054 - DNA, 601 bp, Human; identical to SEQ ID NO: 20271

SEQ ID NO: 164055 - DNA, 601 bp, Human; identical to SEQ ID NO: 25336

SEQ ID NO: 164056 - DNA, 601 bp, Human; identical to SEQ ID NO: 25337

SEQ ID NO: 164057 - DNA, 601 bp, Human; identical to SEQ ID NO: 25338

SEQ ID NO: 164058 - DNA, 601 bp, Human; identical to SEQ ID NO: 25339

SEQ ID NO: 164059 - DNA, 601 bp, Human; identical to SEQ ID NO: 25340

SEQ ID NO: 164060 - DNA, 601 bp, Human; identical to SEQ ID NO: 25341

SEQ ID NO: 164061 - DNA, 601 bp, Human; identical to SEQ ID NO: 25342

SEQ ID NO: 164062 - DNA, 601 bp, Human
gatctggaaattaatgctgtgagcagtattccttcccaaccctgccctaaaaaatgtaacagggatagagggaaaaacctcaaaataggcaagcttaaaaagacaaacatttccgtacgcaagaaacatgtatgggctgggcacggtggctcacgcctgtaatcccaacactttgggaggctgagacaggtgggtcacttgatctcaggagttccagactagcctggcaacatgcagaaatgccatctctaaatttaaaaaatatatatatacacaaaaatgtagccaggcccagtagcaagtacctgcagtcctaactactcaggaggctgaggtgggaggatcacctgagccaaggaggtcgagactgcagtgagctgtgattgctccactgcactccagcctgggcaacagaatgagaccctgtgtaaaaaaaaaaagaaaagaaaaagaaaaaaaaaacacttatggaaaaaaatggggctgacactgggacctgctgggctgagcctggaagccctaagccaggcagcctcggctccagcaggggaacaaggtgggggctgaaccaggccaggcaggcttccccactcttccatgc

SEQ ID NO: 164063 - DNA, 601 bp, Human
tagccccctcagcttaccaaggcacatcccctctgactcaaaaatctcactcttggaaatctatccttcaattacacctgagtgaaacaacttatgtgccaggttattcagggtagtgctatttgtaatagcaaaacattagaaacagtctagatgtctatctgcagtaattaaataaattatggtgtatctataccatggatcactttgcagttataaaaaacaatgaagataatccttatacactgacacaggtatacagaacatcatctgtatatcagaaagtgaaaagagcaagaamggagctacagacacagatctgtagatacagacacttccttctacaacaaaaactgctccccctaaacagagacagagtaaacatccccctatcctagggctatcagtaatgacaggcacagatctggctggtggtgcggctggttctccctctattccctcaaagtgctatcagatccagggatcttctctgtaattgttctgtatgatgcagtatctttgatcaccagtattactccgcaggaataaaggggctagggagaagaataggcacaatgaaagaatataaatggccaaggaa

SEQ ID NO: 164064 - DNA, 601 bp, Human
agctttctaaacttaataaagtctggttttcttttgggtaactaatagataacagaagaatcttggcatcgttcacctcaggaaattgatcaagtttttataaaaatatcagcagattagtataccccttttgggaacaagatgtcctttcttctccaaaactatcttaaactaaactcgtggccttaagttttgtctcctaaactaacattgtacaatcaatcagctatgaaaggaggttttctctgcctaaccagatgattttgtctccaatatgcaattgcatttgcattgtatttaytgagcaacggacacatttccacactcaaagtcaagtcttacacttgtctttttgcttgtgttttatttttactaagctaagacaatggtattaaagtacttatttctaaacagttctcctgagatggtcagaggtgtaggaagcaggagtgacagaagtcattgcctagaggtgtcagtatcacagcagtgccaggcgaaactgacagctgtgtgtgcccacatttctcaagcagaagtgacagtgcatgtgctgcttcgtgacacctgtcaagcggagggcactagcacctgcaaaacc

SEQ ID NO: 164065 - DNA, 601 bp, Human
ttattaaaatagatactctaatggcctatttttaatgcaaaatttaattttaaaaatcaaatggtaaaaatcagttcttgaggactgaattttttatgggaaaaggattaaaatgctgatgatagtagcaaagcttcatattttggaacttttaaatattattttaactgggaaataaaacatgtcttgggaagctttctaaacttaataaagtctggttttcttttgggtaactaatagataacagaagaatcttggcatcgttcacctcaggaaattgatcaagtttttataaaaataycagcagattagtataccccttttgggaacaagatgtcctttcttctccaaaactatcttaaactaaactcgtggccttaagttttgtctcctaaactaacattgtacaatcaatcagctatgaaaggaggttttctctgcctaaccagatgattttgtctccaatatgcaattgcatttgcattgtatttactgagcaacggacacatttccacactcaaagtcaagtcttacacttgtctttttgcttgtgttttatttttactaagctaagacaatggtattaaagtacttatttcta

SEQ ID NO: 164066 - DNA, 601 bp, Human
catctcaacaaataaaaaataaaataaaataaaaataaaaactatgccagagatctcaattaattagtacatactcctacagagcagaattctcttacattacttcaaataaagacctgcttttaaaattatttctcaaacatgttatagttttttacacaagccaactgagtttgtggagctggtttacctataaaaactggctgctgggaggatacacattcctggccaagttcaggtccacgagatgaaactcttaacttacagagagaactgtgctccaagtcatatcgcagcagtrctcaacccactgagaagccaagagcaacacgctctcaggatgaactctcctaaaacacggatcagttactaaatcattagagaaacctagatatgattgaaagtctgactctagccaaactaaccttcacctgcatttatctcgggttgctgcagggaacagcaactttaccagtaaggggtttcctttgcaggagatgaaaatgttttggaaccaaatggacgaggctgtataacactgtgagtgtattaaaatatcactgaattgttcactttaatttcatgttatgcaaacttcacc

SEQ ID NO: 164067 - DNA, 601 bp, Human
ggtggctcaggactgtaatcctggcactttggaaggctgaggcaggcagatcacctgaggtcgggagttcgagaccagctggccaacacagtgaaaccccgtctctactaaaaatacaaaaataagccaggcatggcgttgcacatctgtagtcccagctactcaggaggctgaggcaggagaactgctggaacatgaaaggtgggggttgcactccagcctgggtgaccgagcaagacatcgactctaaataaatacataaataaataaatagctagctgatgtactaattaaaaaaaaactccaagaaatactgtttttaaaaagttataaaacaataagcctagaattatcccaactgagctaaaaaagaaaattgtaatgaccccaccacttgtctaaaaaggacagaaaagcatacaggaaaatcacaaccagtaggaagggtgctgccttagggacaagaacggcaatagcagacacctttcatctttttactcacaaccctttgtaagtgtttggatcttttatgatcaggatgtatttgtgttatttgtatactgcttttttaaaaatggataatttaaaaaaaaagacatac

SEQ ID NO: 164068 - DNA, 601 bp, Human
ccgtagtgtagatcgccatgagctcagtgtcctcattgtcctgctcaccgctggaggtggcgcctccatttatcaccacctgcagagacaatccacttagaggctgtttcagcgtgaaccacattttcctccccccgaaagccatttgtaattctcctggtgagtgcatgaccaggcatggttttgatggagaaacatactccatgtaccgtatggggaggctgccttagcagaaggctcagccggggagaaaagaaataaaatcccagggcaacctcagcaggggcacccccacatcctycaggggaagggaagtttggctcagaggcccatgctgtttgtggacgaggcccaggctgaacaggtgagagtaccctgagctgcctcggttaagatccctgcccacataaccacctgaggccgacttcctgcacctagaaggggaaatgttctagctggaggaactcaagctttgctgttcacctaagtaaaccagcccactggagaacactcctcggtaaggggccacaccatcgtcccgggttctgccagccagtagcaagagccataaaatatttttactttttagccaaacggttcc

SEQ ID NO: 164069 - DNA, 601 bp, Human
gcacatgtatctgtaacaggcacgatgctaataacttcacatatcatttcattcaatccacaaaacaaccagatgttgacatttttattcccattttagagacagggaactgaggcccagagaacttctataatttcctcagtctgactcatatttgcacccagacctgatgccagacctcaagctcttaaccacttccctctgccatcttggctgaggcctttttaaatacctggatcctcctctatggttctcaccttaaatgccattaaaacaatcaaaaaaaaaaaaaaaaaaaaaactagtaacttctattccctatggctcctcctacttcccttatgaagagaacacagccccttgggagtcagagaccaagccccagacgaaggacatgcaagtgtctgaaagggatccggatccagatccggggcagcacttgtgggaggggatggcggtgggagtggggacacggggtgacggaaggggtaccttttctgcaatgccgttttccgtagtgtagatcgccatgagctcagtgtcctcattgtcctgctcaccgctggaggtggcgcctccatttatcaccacctgcagagac

SEQ ID NO: 164070 - DNA, 601 bp, Human
tacaatttggagatatcagattatctaacttctcatatgttagacatcatggcagatacaaagaaaaaaagaaatcgggatatctggacctactttattttatttttatttatgaatttatttatttattttttttagagacagggtcttactctgtcttcccagttggagtacagaagcatgatcttagctcactgtagcctcaaactcttaggctcaagcaattctcctgcccctgagtagctgctactataggcacacatcaccacacctggataattatttctttttttttttttttgtagagacaggatcttgctacgttgcccaggctggtctcaaactcctggcctcaagcaatcttcccgcctcagcctcccaaagtattgggattataggtgtgagccactgagcccagattggagccgctttgggcaactttatcctgacctctatggtcacaaagtctgaccattcaaggagatggaacgaggcacagagcaaaacaaaaataaacaaaaaaaccacaaacacgattctccccaccttagtgtgccatttccattggcacactaaggtgccaaaggtgctacggtcaaaa

SEQ ID NO: 164071 - DNA, 601 bp, Human
tagtatacactgtctacagtataatacagtggttccagaatagaatttctcattacataaattgtttagtttcttattatgtcagctgaaaattagtaaattttcatagtataaataaaacctgtgtttaaaatctatcaagtaaaactcaaatgaaagcctcagagctgcgatacaatttggagatatcagattatctaacttctcatatgttagacatcatggcagatacaaagaaaaaaagaaatcgggatatctggacctactttattttatttttatttatgaatttatttatttattttttttagagacagggtcttactctgtcttcccagttggagtacagaagcatgatcttagctcactgtagcctcaaactcttaggctcaagcaattctcctgcccctgagtagctgctactataggcacacatcaccacacctggataattatttctttttttttttttttgtagagacaggatcttgctacgttgcccaggctggtctcaaactcctggcctcaagcaatcttcccgcctcagcctcccaaagtattgggattataggtgtgagccactgagcccagattggagccg

SEQ ID NO: 164072 - DNA, 601 bp, Human
gtgtcaacttctgggtggtctgttattagaatacatagtatacactgtctacagtataatacagtggttccagaatagaatttctcattacataaattgtttagtttcttattatgtcagctgaaaattagtaaattttcatagtataaataaaacctgtgtttaaaatctatcaagtaaaactcaaatgaaagcctcagagctgcgatacaatttggagatatcagattatctaacttctcatatgttagacatcatggcagatacaaagaaaaaaagaaatcgggatatctggacctaytttattttatttttatttatgaatttatttatttattttttttagagacagggtcttactctgtcttcccagttggagtacagaagcatgatcttagctcactgtagcctcaaactcttaggctcaagcaattctcctgcccctgagtagctgctactataggcacacatcaccacacctggataattatttctttttttttttttttgtagagacaggatcttgctacgttgcccaggctggtctcaaactcctggcctcaagcaatcttcccgcctcagcctcccaaagtattgggat

SEQ ID NO: 164073 - DNA, 601 bp, Human
aatattaagatactccatttcattggtattcaaggaaatacaaatgtatcaatgtttagacaatgaaaaaatgttcacccaaacaggaaaatgaacatctagcataaatgtgctagagacatttttcctacaactggatccctcccatcagtaaaaggtaaagctaagccccaaagtgttaatgctcatcactatttatttctaaagacgatctccagacagagaaggaggaagtctgaaaacatgacagcctggaatcatggcatagaggattatatgtggcccaccaagtctgtgaagragccctttgttacaagatggaccgtgtgaaagctgcggcccggcagtgtgggatgtgcctcagctgcagaccacaggcaccaatccacatgccaaacaccactgcactaacctttggggagcagcttggaaccccgcacttctggaatttcagtatctctgcctgaatctactttaattaacctccataaaatttataatagctccaagcagcaggaaaataataacaatattggttgagaggcaaaaatgaaatttccatatcccagactggaattttgtttaaaagggcataaaattt

SEQ ID NO: 164074 - DNA, 601 bp, Human
gatattggaacattgcagatttcagatctcagttttaggacggttactctacatcaggttgccagccgctggttacgtagaatatataaagaacgtagggggcacattttcaactttctccattttttggactgtttactattagacaatcatgttaaaatgaatgtcattttttttttggaacaactagtcctttaacaaaagatagcttaaagagaatccacagggatcaagtcagaaaaggtctcttttgttttgagacagtctcactttgtcactcaggttggagtgcagtagtgcyatcttggctcactacaacctctgcctcctggattcaagcaattctcttgcctcagcctcccaagtagctgggattacaggcgaatgtcatgaagcccggctaaatttttttgtatttttagtagagacggggtttcaccatgttgcccaggctagtctcaaactcctgagctcaggcaatccacccaccttggcctcccaaagtgctggcattacatgcatgagccacccacctggaccaagtcagaaaaggtctctaacaaaaaaaagtagatctcaaagttatagaagacaagtttat

SEQ ID NO: 164075 - DNA, 601 bp, Human
gaccccagaaagtgctatgcttggaagcactagacagagtagcaatggggagaggacaggtcttaactccgcaaactggtcagacagtgtgttaactactgctatcctcctccttcaagaaacaaatatgtatggtttgaagaatataaattggaaagccctcaggctgaggaataccacacagcgatcaaggaaaacagcagcagcaggatactcatctgcttccagaatgccagaaaccaggtcacagaagccagacttatacccacaggagaccacacgattcctttctagagaaagytgatcagccccaaagacaagatagtgacatctatagatcccacagagacaacacggctttccacctggtcactcaagggcaggcccacgattagataaacttcatcacacacaaagacctcacaatcctatcttttattgcctcctatcctggaacagtgaagaaagactaaaaaaatgaaggcaaagaaacagaaaatataatcaatgtagtattttttaaaaagcttaaaaaaaaactatcttcagaaaaataaagttacttcaattgtgggagacaaagaatgctttttaaagactt

SEQ ID NO: 164076 - DNA, 601 bp, Human
tcacttgagcctgagaggttgcggctgcagtgagctgtgatcatgccactgcactccagcctaggcaacagagatcttgtctcaaaaaaaacagaacaggctggtagctcacgtctgtaatcccagcactttgggaggccaaggcaggccaatcacttgaggtcagcctggccaacatggtgaaaccctgaaaccctgtctctactgaaaatacaaaaattggctgggtgtggtggcgtacacctgtagtcccagctacttgggaggctgaggcaggagaatcgcttcaacccaggaggcrgaggctgcagtgagccaagatcgtgccactgcactccagcctgggtgacagagtgacactctgtctcaaaaaaacaaaacaaaacaacaaaaaaccaaaaaacaaaaaacccaaaaagatcaatttcattattcttttcaacaagccagcttttgagttctagttaagcatggtagattgaccacatgtgtcttttcttctaagtcctaaaaacaggaggaataaatatgatactcatcaacaaggacaaagcaaagaggagatcaagaaaaagagattaatattttttttaatatggaa

SEQ ID NO: 164077 - DNA, 601 bp, Human
aaataatctaaagaacaaaaaaactgcctgtgctccaaagactagagtgaactcagaacgctgttctctgcctggagccttcttaacatttttaataacctttgctatctcctctgcggttatttatctagtctagcacctttggggtcgattgtagtctctttctctaggaaatcatttcttctgcagcacagtcagcacatattttttataaaggaccatacagtaaatatttcaagctttgggagccacatggttctgtcactgtagcatggatgcagccttaggcaataggtaaacraagaaatgtggctgtgttccagcaaaactctactgagaagaacagatattaaaccaaatttggcttgccaacccccgctgtagcgtttcaaactgattatcataaagtagcatgtattattctcttgtacatttctcctttttactatactaatgtatatgtgtgctttctattttttttctcttgatcagggccacaacagatcagttttggccaggcatggtggctcatgtctataattccagcactttgggagaccaaggtcggcagactgcttgagctcaggagttcgagaccagt

SEQ ID NO: 164078 - DNA, 601 bp, Human
aggcaggtagatcacctgaggtcaggagttcaagattagcctagccaacatggtgaaaccctgtctctactaaaaatacaaaaattagctgggcgtggtggcgtgcacctgtaatcccagctattccggaggctgaggcaggagaattgcttgaacctaggagacagaggttgcagtaagccaagatcacaccactgcactctggcctgggcaacagagagagattctgtcacaaaaaaaaaaaaaaaaaaaagcaagacttttcgcatccaggcagaggttaagatgtacacacaggcgyatgtatgcacatgcacacacacaagcttttcttagtaatgagggtagccctacaactcagaaacaaaactagtgtaaaggtccacaactggtactaaaatgatacaggagggggctgtgtggtcaagaggatcagacaacactgtgaggcagacgctgtgccccccctcctgatgacagaaggaccactctggccattgtgcactctacgcactgtggcgccacactcagtgatcactgtaaactatgagctattttaaatactgcaaaaacaaaaacctctaataaggtttctgtaaaa

SEQ ID NO: 164079 - DNA, 601 bp, Human
tgcagtggctcacatctgtaattccagcacctgccaaggcaggtagatcacctgaggtcaggagttcaagattagcctagccaacatggtgaaaccctgtctctactaaaaatacaaaaattagctgggcgtggtggcgtgcacctgtaatcccagctattccggaggctgaggcaggagaattgcttgaacctaggagacagaggttgcagtaagccaagatcacaccactgcactctggcctgggcaacagagagagattctgtcacaaaaaaaaaaaaaaaaaaaagcaagacttttygcatccaggcagaggttaagatgtacacacaggcgcatgtatgcacatgcacacacacaagcttttcttagtaatgagggtagccctacaactcagaaacaaaactagtgtaaaggtccacaactggtactaaaatgatacaggagggggctgtgtggtcaagaggatcagacaacactgtgaggcagacgctgtgccccccctcctgatgacagaaggaccactctggccattgtgcactctacgcactgtggcgccacactcagtgatcactgtaaactatgagctattttaaatact

SEQ ID NO: 164080 - DNA, 601 bp, Human
tgtcagcttgacctctggaggggctggtgagtaattaaagttagccacataggcagtcagccatacctatacgacagatccccaattaaaaaccctggacaccaaggcttggatgagcttccctggctgaatgggtgttatcacatatcactgctgggaaaactgaacactgcctgcatgactccactgggagaggatggctgcaagcctgtgcctggtgtctcctagaccctgcctatgtgcctttttccattgttgattttaatctgtatcctttctctgaagaaaaaaacaaccaaamaaaaaaacccttaactgtgagtaaaacagctctgctgaattctctgagtctttctcataaatcacagaacctgatttgggaacttctgaactgagggcaccattttgctaacgtgatggaattacagacctggggctcactacacaaaggtcagctcaacagcaccgcgtcagctacagccacacaggtggtgctgctgctcacaaagtaacatgacaaagtatttcataacaaagagaaatgtctgaagacagaatacataaccctatcatagactagtacaacctgttatacagtaat

SEQ ID NO: 164081 - DNA, 601 bp, Human
cacagtgtcagcttgacctctggaggggctggtgagtaattaaagttagccacataggcagtcagccatacctatacgacagatccccaattaaaaaccctggacaccaaggcttggatgagcttccctggctgaatgggtgttatcacatatcactgctgggaaaactgaacactgcctgcatgactccactgggagaggatggctgcaagcctgtgcctggtgtctcctagaccctgcctatgtgcctttttccattgttgattttaatctgtatcctttctctgaagaaaaaaacaamcaaaaaaaaaaacccttaactgtgagtaaaacagctctgctgaattctctgagtctttctcataaatcacagaacctgatttgggaacttctgaactgagggcaccattttgctaacgtgatggaattacagacctggggctcactacacaaaggtcagctcaacagcaccgcgtcagctacagccacacaggtggtgctgctgctcacaaagtaacatgacaaagtatttcataacaaagagaaatgtctgaagacagaatacataaccctatcatagactagtacaacctgttataca

SEQ ID NO: 164082 - DNA, 601 bp, Human
cacctgtggtcccagcaccatgggatgctaaggtgtgaggatcacttgagaccagggttcaagaacagcctgggcaacatagtgaggcctcttctctagtttatacatatttttttacctgaaacttggccacacagtgtcagcttgacctctggaggggctggtgagtaattaaagttagccacataggcagtcagccatacctatacgacagatccccaattaaaaaccctggacaccaaggcttggatgagcttccctggctgaatgggtgttatcacatatcactgctgggaaaacwgaacactgcctgcatgactccactgggagaggatggctgcaagcctgtgcctggtgtctcctagaccctgcctatgtgcctttttccattgttgattttaatctgtatcctttctctgaagaaaaaaacaaccaaaaaaaaaaacccttaactgtgagtaaaacagctctgctgaattctctgagtctttctcataaatcacagaacctgatttgggaacttctgaactgagggcaccattttgctaacgtgatggaattacagacctggggctcactacacaaaggtcagctcaacagc

SEQ ID NO: 164083 - DNA, 601 bp, Human
gaatttgttacaatggattatggatgtctttaaaaacttgttgggagaaatggtagaaaaagtacgtatgtgtctgaggggtgtagcatgtagtgatgtacaataaagattaactcagcaggtctgggttgtccaaaccccgcacatttcaaagaaagggttgagtcttgcctggtacgtgggggataacctgagctcttggggtttctgcctcttaaacatgtctttttaggcccagtgcagtggctcacacctgtggtcccagcaccatgggatgctaaggtgtgaggatcacttgagrccagggttcaagaacagcctgggcaacatagtgaggcctcttctctagtttatacatatttttttacctgaaacttggccacacagtgtcagcttgacctctggaggggctggtgagtaattaaagttagccacataggcagtcagccatacctatacgacagatccccaattaaaaaccctggacaccaaggcttggatgagcttccctggctgaatgggtgttatcacatatcactgctgggaaaactgaacactgcctgcatgactccactgggagaggatggctgcaagcctgtgc

SEQ ID NO: 164084 - DNA, 601 bp, Human
cagagatgttcccaggttgagaccacaaaatgataccttggcacgagcagtccttgcgtgagaccccagatgaaaaaaatcttagaaaattttaaccactttcaaagagacagcacactgatctgcccctcccagcccacttcatccctgcaagtaaaaaggatctttgtactttaaaattctacaccctcctatccaaacactattgctcagataacgttaggtgaaaagagtaattctaaagtatataaacacggtgatttgaattctgtttaaaaaacaaaacattaaaaatgtattsatagtttaggtgacaggttttttcttctttttctcctaacactagtaaaaaaaatattttaaaacattaagtgtggcatggttttttaagcaaaaatcatcataaagaccagtcactttaggttagagtccagcctcttccaatcacccccagcatcagttctgaactcatgcagtatctgagccaaacagaaaactcaaggtagccccgagttccccaggagaacctcaaaactgctctggtttcaaacaccacacaaataatctttccttggaatttctacaatcatttcttggaatc

SEQ ID NO: 164085 - DNA, 601 bp, Human
tcatccctgagaacaccaaacttgctcagagcttctccccaggcctggggatcctcctgcatggacagagatgttcccaggttgagaccacaaaatgataccttggcacgagcagtccttgcgtgagaccccagatgaaaaaaatcttagaaaattttaaccactttcaaagagacagcacactgatctgcccctcccagcccacttcatccctgcaagtaaaaaggatctttgtactttaaaattctacaccctcctatccaaacactattgctcagataacgttaggtgaaaagagtaattctaaagtatataaacacggtgatttgaattctgtttaaaaaacaaaacattaaaaatgtattcatagtttaggtgacaggttttttcttctttttctcctaacactagtaaaaaaaatattttaaaacattaagtgtggcatggttttttaagcaaaaatcatcataaagaccagtcactttaggttagagtccagcctcttccaatcacccccagcatcagttctgaactcatgcagtatctgagccaaacagaaaactcaaggtagccccgagttccccaggagaacctcaaaact

SEQ ID NO: 164086 - DNA, 601 bp, Human
tctcatccctgagaacaccaaacttgctcagagcttctccccaggcctggggatcctcctgcatggacagagatgttcccaggttgagaccacaaaatgataccttggcacgagcagtccttgcgtgagaccccagatgaaaaaaatcttagaaaattttaaccactttcaaagagacagcacactgatctgcccctcccagcccacttcatccctgcaagtaaaaaggatctttgtactttaaaattctacaccctcctatccaaacactattgctcagataacgttaggtgaaaagagkaattctaaagtatataaacacggtgatttgaattctgtttaaaaaacaaaacattaaaaatgtattcatagtttaggtgacaggttttttcttctttttctcctaacactagtaaaaaaaatattttaaaacattaagtgtggcatggttttttaagcaaaaatcatcataaagaccagtcactttaggttagagtccagcctcttccaatcacccccagcatcagttctgaactcatgcagtatctgagccaaacagaaaactcaaggtagccccgagttccccaggagaacctcaaaa

SEQ ID NO: 164087 - DNA, 601 bp, Human
tgggcaacatctcatccctgagaacaccaaacttgctcagagcttctccccaggcctggggatcctcctgcatggacagagatgttcccaggttgagaccacaaaatgataccttggcacgagcagtccttgcgtgagaccccagatgaaaaaaatcttagaaaattttaaccactttcaaagagacagcacactgatctgcccctcccagcccacttcatccctgcaagtaaaaaggatctttgtactttaaaattctacaccctcctatccaaacactattgctcagataacgttaggygaaaagagtaattctaaagtatataaacacggtgatttgaattctgtttaaaaaacaaaacattaaaaatgtattcatagtttaggtgacaggttttttcttctttttctcctaacactagtaaaaaaaatattttaaaacattaagtgtggcatggttttttaagcaaaaatcatcataaagaccagtcactttaggttagagtccagcctcttccaatcacccccagcatcagttctgaactcatgcagtatctgagccaaacagaaaactcaaggtagccccgagttccccaggaga

SEQ ID NO: 164088 - DNA, 601 bp, Human
ggcatgatgcaggcagggtttcccactcctatctgaccagggaagactgctgggaacatttataagataaacattccaaaaagtgtccttcctgaatctggttcagaatgctcagcccaaggtagactagttgccgaggccactcagctccttttgctctgactcctcccctactcaacagacacctgccagtcggggttaccatgggctgtgatacctgaaacggggtgagggaagggcggggcaactggaaactcaaccaaagtacccagctgttggcagccccaccccagggtgaatsaacctctctggacaatgagatggattttctcggcacctgagataccttaggttgaactgaccacacaaacttgagaagggaaaaatgctaagtccgacctcagaacagagtccaagttaaaaccaaagcatattcagtccaggagtgtgcatttaagaaaagaccctccccacgttgtcccctttctccaaaacgtcccgcgttcatcctatgaaagggaaaagggtgctgaagacagaggagggaagtatcaaagacgccggaggcctccatcagctatgtcaccacccaccttgtccc

SEQ ID NO: 164089 - DNA, 601 bp, Human
gggtaggggaaggtggcggtggtgccattcaccaagagaggaaatgactgggaggaacactgaggggtggggaccaacggccactaggacattcccgtgcctccattctgtccttgccaacagccctaggcaaacggcgcagctcaatgccttctgggggctttggcatcccccattagtaccccaatctcacctgcatccaaacgttgtctgtagcaaagtagtgattcccacacagaagaaaatggtcccaatgagctggctggtggcccactggtcgtaccccacacacatggcatcrgccaacaggaagggcactgcgatcgtgccgctgaagcatgtcaggtagtgctgtgggcaggaaaagggtcagaggagaaacagtaaacccttcctcatttattcttgatttcatcctaattcttctctcttattgtcgttaaaaaatagcccacataaagaatctccttggtttttcgaccaagccatacttttttccttctttttcagtatttctcctttgttgttaagacagtttcactcccattgccctcgacggagtgcaatggtgcgatcttggctcactgtgacctccacctcc

SEQ ID NO: 164090 - DNA, 601 bp, Human
tgaggccagggaaggcaggagacagggctcagaggcatggctggagatggaagtggggcagagagcaagggcaagcctaaatgctgggtgcagcctggtgtgtaaaaagggaggagagctgcagtgtggctcaccctgaggagggtgtggaagtagaaagatggcactgggtgtggggcacaaagtgagtccaagagcggtgccctggaggcagggaagccaacggggagcctggtgggacactctggtctgaacgtaaggaataggggcacagaggggtgctggggagcgagcatgacttgccaagggggcaggggaaggagagtgaggctgagtttccagcttggacaactgggtaggggaaggtggcggtggtgccattcaccaagagaggaaatgactgggaggaacactgaggggtggggaccaacggccactaggacattcccgtgcctccattctgtccttgccaacagccctaggcaaacggcgcagctcaatgccttctgggggctttggcatcccccattagtaccccaatctcacctgcatccaaacgttgtctgtagcaaagtagtgattcccacacagaagaaaatgg

SEQ ID NO: 164091 - DNA, 601 bp, Human
ggcccttgggagtgaggccagggaaggcaggagacagggctcagaggcatggctggagatggaagtggggcagagagcaagggcaagcctaaatgctgggtgcagcctggtgtgtaaaaagggaggagagctgcagtgtggctcaccctgaggagggtgtggaagtagaaagatggcactgggtgtggggcacaaagtgagtccaagagcggtgccctggaggcagggaagccaacggggagcctggtgggacactctggtctgaacgtaaggaataggggcacagaggggtgctggggarcgagcatgacttgccaagggggcaggggaaggagagtgaggctgagtttccagcttggacaactgggtaggggaaggtggcggtggtgccattcaccaagagaggaaatgactgggaggaacactgaggggtggggaccaacggccactaggacattcccgtgcctccattctgtccttgccaacagccctaggcaaacggcgcagctcaatgccttctgggggctttggcatcccccattagtaccccaatctcacctgcatccaaacgttgtctgtagcaaagtagtgattcccacac

SEQ ID NO: 164092 - DNA, 601 bp, Human
gagtcgggagggcaggacaagctgggcctggaggatgagctgttgtgtgccaggcgggttgagggaagacacacaagaaggtagacagcgggcccttgggagtgaggccagggaaggcaggagacagggctcagaggcatggctggagatggaagtggggcagagagcaagggcaagcctaaatgctgggtgcagcctggtgtgtaaaaagggaggagagctgcagtgtggctcaccctgaggagggtgtggaagtagaaagatggcactgggtgtggggcacaaagtgagtccaagagcrgtgccctggaggcagggaagccaacggggagcctggtgggacactctggtctgaacgtaaggaataggggcacagaggggtgctggggagcgagcatgacttgccaagggggcaggggaaggagagtgaggctgagtttccagcttggacaactgggtaggggaaggtggcggtggtgccattcaccaagagaggaaatgactgggaggaacactgaggggtggggaccaacggccactaggacattcccgtgcctccattctgtccttgccaacagccctaggcaaacggcgcagctca

SEQ ID NO: 164093 - DNA, 601 bp, Human
acctgcacatggctcaccgccctccaaggctcccctatccccgtgccgcgttagggcaaccctgaggtcccgaaggattctgactcatcagaatgcagtccctgacttcagctcacacccacctcccaccgcagggagggccaggccttactcagcctgtctctgacagagcaagagacagctggccgtgaacttaggacagtcctgccagagcaggctccacttcctgagcagtgccctggggtaaagcaagaggctgcactgcgaagaggggagaggagcaggaaaggagaggaaaagrcaagcttgcaggaggaggtaggaaggtagataaggatgtttctcttccttcctgtgccagctccacgtccatttaagctggtggctggaaatgcagaagtgaacaagccaaagccctggcatcaaggaggaagcaccgtgggaaaaagacatagaaacaaaaaggacaaactggaataaaggccacactggaaggatgaaaacaaggtgggaattcagagaacaatgaagggctccacagagtcgggagggcaggacaagctgggcctggaggatgagctgttgtgtgccaggcgggttg

SEQ ID NO: 164094 - DNA, 601 bp, Human
tgtgtcccattagcaactttgcccatcaggctcagctgctggccaggcctggcctccttggcatgagctggggcagagctgcacacggtacacacttcactgcaataaacacagctttcatcccctattcaggtcaaccaataatgctcagctagagacactgaccaaattcacagagggattatgcctacaaatccacggataagtcagcggtttagaaaaagaacatctccccagagaaccagtgctccatgggcaaggtaaggatcctgagtgagccaaaaaaagctctgccgtgcaytctggacttgaagcacagagccctgaacactgtacccaaagaatgaaagagggtgctagtcaggttgagcccttcttggaaggcccagaccacatctccttcccctagtcggtcagtgatatccctgccctgccccctggggggtttgaggagaccctcctcccttcagcccagcttggtggttgtgggcagactagcaagggctgggatctgggaaccatcagagcttgccagccccaaagcctttagtccacatagcttctttccatcagcagacctgcagcctaccctcccagggtg

SEQ ID NO: 164095 - DNA, 601 bp, Human
cattgctaggagagtatgtaggggtgagccatcatgctatctgcaactttactttttttttttttagacaggatctcgctctgtctcccaggctggaatgcagtggcgtgatcatggctcagtgaagcctcatctcctgggctcaagcgaccctcccacttcagcctctcaagtagctgggaccacaggtgcacgccaccacacccagctaattatttttattatttgtagagacaaggtctcactatgttgtccaggctggtctcaaactcctgggcttaagcaatcctcccgcctcagmctcccaaagtgctgggattacagccctgaaccgccttgctcagcctgcaactttactttcaagtggctcaaaaatcaaaaaaattacacttgtaccccaacatacatatacagaaagagaagtggggtctctcccttgccccaatctgatcaccgcatccctccatgcttctaagttttataaacaatcatgagttcgaagtccccagatttaagaccttcaagtctcctggagccaccccttgtactcaatgagcacatatcatggacaaggttccattacgggccccaggaacctgac

SEQ ID NO: 164096 - DNA, 601 bp, Human
gcctccagccccatcttctggttgacaacaaatcagagggattgtgggacaaatcaaacaatatgacagggacacaatcaagacaaaatcagacacgagacaccaggtctggaatctttttaaaaagatgatgacgtggggaggaaaaaggtggagacagcaaagagacacaacaaacaaatgcaccacacgaaggagactggtttagagagggaataatggggaaaggtattttaggaacaactgggaagttaaatacgaactgcatatgagatgatgaaacagaatgattgttaatgtycttaggtgtgacaaatggtctcctgtgatacacaagagacaccgtcattgctaggagagtatgtaggggtgagccatcatgctatctgcaactttactttttttttttttagacaggatctcgctctgtctcccaggctggaatgcagtggcgtgatcatggctcagtgaagcctcatctcctgggctcaagcgaccctcccacttcagcctctcaagtagctgggaccacaggtgcacgccaccacacccagctaattatttttattatttgtagagacaaggtctcactatgttgtcc

SEQ ID NO: 164097 - DNA, 601 bp, Human
aaaagaaagacataatgtgtcaaagaaaactttttcttaattgatgacatgttctatcatttactgtatccatccatccatccatccatcgacctgctgaacttttggaaagcagcctgcactgttctatctattcgtggtgatggtgatgtgattgtacacatgggtataagctcatctaactatacagcttaagggtgaattctgctgcatatctattgcccctcgacagagctgacattttaaaaacctatgtctatcaatctaacaagtgttttcagggagtggggacttaggaggrtgggggtagcagaggcagggagatgacaacacattccttaaaacaccagagtcatgccaaatattgaaaaaactccccaaatttaaaacaggaaaagagcttccatccttatttggtgataagtactgttcactcctgtgtagagctgcttttgccagggcagtcacctgcctaaaaaggaagaatgggggttaggggaggggaggtaggggaagcagaaggccatgaggaggaggatgagcaattcagagcccagggaaatgtttggggcaagaaggacctgacagttgaagaagaaag

SEQ ID NO: 164098 - DNA, 601 bp, Human
accaccgtaggagaactgggagaggtgaccttagccctgaagctattctcagtcttgaaggaaccaagccacagaggacatcccaataggctgtggcatggctctgtgtgtcatctttgctttttaattccctttggcatccgctcacatgacgagccagcctgaatcagatctccgcctgtgtccagcctctatctgctcccttcctcgggctgctgctgtctgtgctggtgcactccccacaagctgtcctgcccatctcaaccttgaggcgggcatcccccgatactaggaagtggaytggcttcacccaccatcttgacccaccatgtatcctcagcaccaatgaatacttaatgaaatgaaggagctatttatattctcagaaaggacttctattaaactaaaaataagaggttaagtctttgtggcaagttggttttgactgcacatttggaagagagtggtgattagattaaaagtactcagagttgggggtgaaatgtgcatgggttttcatgattcaaccagataagcctccagatgccgggcggcttgcagtcctcctctggtgccatcagagaaactttaaaagccaatg

SEQ ID NO: 164099 - DNA, 601 bp, Human
gcaggtgcagtcgcttgagcgagtcttaaagaacgagaagtgcttcgccacgtgtgtgggggattatgggtattccgggcagagagaggggaggtgcaaaacaagagccacaggacggacccaggaaccctcagaggactgcagattctccacttgagcgaaagcacagggagctcatatgatgaaggtcagtggggaccagatgacaaatgccccgcgttcttcctgcagcaagagggaaatgagtgaaggacctgctctgaaaggaccaccgtaggagaactgggagaggtgaccttarccctgaagctattctcagtcttgaaggaaccaagccacagaggacatcccaataggctgtggcatggctctgtgtgtcatctttgctttttaattccctttggcatccgctcacatgacgagccagcctgaatcagatctccgcctgtgtccagcctctatctgctcccttcctcgggctgctgctgtctgtgctggtgcactccccacaagctgtcctgcccatctcaaccttgaggcgggcatcccccgatactaggaagtggattggcttcacccaccatcttgacccaccatgtat

SEQ ID NO: 164100 - DNA, 601 bp, Human
gggctcagtaaaagtaactgctatttcttgggtcaaccaacattgaagctgagaagaaacatgaagaagccaaaagcagacaacgcttgtcttttacctctcggatccggggataccagatgtgttctgtgtgcaacagctctgctgttccattggcaactgaaacatcttgaaaacaaaaacaaagtttttcttggagtgacactgatgtctcacatgacatattcattttaccttttaagaagaattttctccctgtttttattacatctgtttcaatccccatccctaaaattcaacytccaacagtatagcttatctcactgaaaggtggatcctcaaatgctaatttaaccaaatgaattcatcgactaagagctccccaaattgtcaaaagctaactgaagtggtgatacacgttactagcaccagcctcacacaaaaaaaccaacctttgcacacagctcattgaaatgcccgacagcaaggttgctggactgaggtttgaaaaacttagataaaacagagggccttttccagttcccagatcaaatcagtggtcacaaagtaactcctaggagcaaggaaggaaatgaaggct

SEQ ID NO: 164101 - DNA, 601 bp, Human
actggggcctgcattcatgatgcaggtgtattacagaaataggtcctggacacacggcccacatgcctttttcactgttaaacgatgcaggcaaaaatttataattcccttttaagaaacacaacatttaaagaccagccttagaggaacactgcagcataaagactctcagctttaaagagtgagccccccaggacatcgacaagacaatgttgttgacagaaattctaaagggatgtttttagtgtgcagaatggccacatctgtgctcattctgaactgatggtgaattatctcacasgttttggaaaatattaatacactgtcagccgtacttcatgtctgcttctgttcaattgcactttggcagacaaatatctttagttctttcaatgaacacaggcaaacactgaggccagagcgaacaattctgctatctgtcgatgatgagcctctgtagctccatccagtgagccacgaacctcagctagctgtgctggcgggtgtgagtggacaggtctgtgggtgtgcaggagggaggaaaccattccttaaggttgcccagagcatttccatatgctttattttagagtattgctta

SEQ ID NO: 164102 - DNA, 601 bp, Human
aggaggccgatgactacttctatcagtgaggacatgatgatggccccctggatctgcaacaagagatggcacagacatgagagtgagctgcttgtacactgcacactcagaatgtcacctacaaccacaactgataattctgcaaggcaataacttattacatcatctaacttgggagagatagctagaaaattccccaggacccgacaagaaacttcagggggcactaactggggcctgcattcatgatgcaggtgtattacagaaataggtcctggacacacggcccacatgccttttycactgttaaacgatgcaggcaaaaatttataattcccttttaagaaacacaacatttaaagaccagccttagaggaacactgcagcataaagactctcagctttaaagagtgagccccccaggacatcgacaagacaatgttgttgacagaaattctaaagggatgtttttagtgtgcagaatggccacatctgtgctcattctgaactgatggtgaattatctcacacgttttggaaaatattaatacactgtcagccgtacttcatgtctgcttctgttcaattgcactttggcagac

SEQ ID NO: 164103 - DNA, 601 bp, Human
ttctcttatgtgatgacttattttgttttaggagttgtactggctggttaaattccagagtaatggaaccatatacctacacataatcaactcttaaacatgctctgcagacacatagagaatgtgggctctgtgttacaaagagttctgtgactctaatcatcagtaatattatcaaactcccctgtgacttcattaacacaaaatgttaactttacttaaagggcaagggacatctttaatggatgtgacattctgtacaaaaggacaggcactgactagcaggaccctggcagaaacyatgtccctcccccaaccacccacccgtcaggagtgcagagctcagtgtggcctggggagaagagtcacatcatcaatggcaacagacctttcccacgacttctctggaaatactccagattcctgccactctggaatatttttgagtctcatgatataaaaatttggcttctcagtatgtcaactcatgaacatgagacttggcaagacctcaaaagtcaaaaacaaatggcgccactaccttaccccactaccaaagcttaaaaacttacaatccaccctcttcatattgctgctaagt

SEQ ID NO: 164104 - DNA, 601 bp, Human
atgtgcacaggcttcctcttatcctgcttagctttgccagaagtttgtctacattgggttttgtttccccctcaagagatcagcttttagatttaccacttctatttgtgtcacattttctgtatctttattaattcgttccccctgcttttactaggttcatttttttgtcctgttttcttagttactgaaattcttcatgtgctgtatctgctttaaaggttgtgaattttcttgagaacacctctggctactaagtgtgactggtgctgttcttgccatcatttcctaaactatcagwaattaattgcaaagtttcaatttcctctctgagagtgatttttaacacttttttttttaagcttgtaagtgctttgtgggttttgttcatccttttgttactggtttcaaattttactgtactatacctacaatttatccattttggcattaattacatttcgctgaaagactattctcacatgccatcttcccatctctgctggtgtgaagaatgttttgaccaacctttggtgaaatgagaatagtaagaacaattttgggctgggcacggtggctcatgcctgtaatcccagcattt

SEQ ID NO: 164105 - DNA, 601 bp, Human
tgaaggcctgcaaaagagaacgggttcagaatttgttccggaggaggaagggcaggatgggctgtgtgggggatgaggcgaaaggaagactgaagaacagatagacatttctggctgaagcaactaggggcacggttgtgccattcaccgaaaggaggaaagcagaagaaactggtttcaggggcaggaaaggaatcaaaagtctggggctttttcatttacagatggagatgtcttgtgtaacagtaagtggaggggcaaaataggggctggatctgtaagtatcgagtttacaggtctraactacaggtttccatggaactatccaccatcaaagaaatgcgatttccttgggggaagtgcatggagagaagggggccaggatcaagtgtggaggcacccccatacttagagataagagtgaggaggagtcaattttggttacttaagttttctgaaaaccactattttcttactttttgttttaatttggggggaggtaacagttttgctccctctgacgggatctgtggcagatctatgtgcacaggcttcctcttatcctgcttagctttgccagaagtttgtctacattgggttt

SEQ ID NO: 164106 - DNA, 601 bp, Human
cttcgagtttatttttattctcaaatacacctgggggcaggcaccctgtgacagagaggcagcagcttagaggtgcagacccgcccatgtccacacatcttaactgagcaaagggatgaagcgttctagccccagctctcaggatgggctgctgtctactccactgggtgcttcccacctcatgtttacctttgctaacttttactttaaaatgttacgcaagtaatacatactaaattgtacaaaaaatttaaaagacagataagcagaaagaaaaagataaaaccctgaagatcatccataatcccccttgagtgataaaaccatgtaatatcgtggtctatctgttctgaacagttttcactccctggatatttgctgggtgctggaggaagacagattgtcatcttccttgtccccagacatgaacaggttattatctaagccaaactggaatcatgctttacgcagcttcctgacctgcctcagtatctatttgcttttccgcctcatcagacagagatttgcagcagcaccttagtgactgcttagcattctgttttatggacataccaggggacgggggagggatagcattagg

SEQ ID NO: 164107 - DNA, 601 bp, Human
catgactgtttctttctgctctaaaacctctctacttcgagtttatttttattctcaaatacacctgggggcaggcaccctgtgacagagaggcagcagcttagaggtgcagacccgcccatgtccacacatcttaactgagcaaagggatgaagcgttctagccccagctctcaggatgggctgctgtctactccactgggtgcttcccacctcatgtttacctttgctaacttttactttaaaatgttacgcaagtaatacatactaaattgtacaaaaaatttaaaagacagataagmagaaagaaaaagataaaaccctgaagatcatccataatcccccttgagtgataaaaccatgtaatatcgtggtctatctgttctgaacagttttcactccctggatatttgctgggtgctggaggaagacagattgtcatcttccttgtccccagacatgaacaggttattatctaagccaaactggaatcatgctttacgcagcttcctgacctgcctcagtatctatttgcttttccgcctcatcagacagagatttgcagcagcaccttagtgactgcttagcattctgttttatgg

SEQ ID NO: 164108 - DNA, 601 bp, Human
acaacctgaggtagagctggcaggaagagtaggttctcagtcaaagctaagcttaattgttcctgggcacagttccaattgttgagatggaatcattagccccatcgacagccggtcaagtgtgactccactgtcacattcctaatgaggtgtggatggcagcccggctggagaacatgcgtgtgttgctccacgggtctccctgcctactcaggcgcttcggtgaactggtgatccatcaggggtctctgccagtaccagttcaaggtcgaaaacacacacagtgcccacgttatttcarttcctctgggatagtgaagtttaacaaaaaacaatatggtaacaagggatactaaaactggaatattttaaacttagacctacatgcaattttcatgtctggaaaaaataaatgctacttatttgtttcagagtgaatattaggagatccaaagatgccccaggcctgctagttttgtcatcattatttcaggcaacacacctgcacatttaagaggggactgagaccacacagaatttgaggagggacacccagatcttaggcccaaatctggcaactcaaatttagaaagcagattag

SEQ ID NO: 164109 - DNA, 601 bp, Human
gacaaagccagaggtccaagatcacacggctagggttgtagcactggggaccaggaatctagctctatggcttgaactgaactctttccttttgccaccctggtcacagggcaaggaggctgggctgcggaagtccctctccttgagcctcacggtcctgactgaactgcactaagtgctatgggaggcaggtgctgacccctccacggcaggaccatggcacttcctgacacaccagtccatgacatcggtctggtgtcccacggggctggcaggtgtggggccacttcccatcccccasgtggatttttactcatcaccgaaacaaaactcgtgcccaacaatgcgtctaagcctccacgcggtctcgctctttcacttacaacctgaggtagagctggcaggaagagtaggttctcagtcaaagctaagcttaattgttcctgggcacagttccaattgttgagatggaatcattagccccatcgacagccggtcaagtgtgactccactgtcacattcctaatgaggtgtggatggcagcccggctggagaacatgcgtgtgttgctccacgggtctccctgcctactcaggcgctt

SEQ ID NO: 164110 - DNA, 601 bp, Human
ttttaaaagagcaaaaagtaagcttcactgctcaagaaaagtagatacagtagaattcagtattaataacattcctgggaggcttctgtgtgccagacattacactaatgtcttcctgtgcagcatctcaaccttacggggtggcttctaagatggtctccttttcacagagacaaagccagaggtccaagatcacacggctagggttgtagcactggggaccaggaatctagctctatggcttgaactgaactctttccttttgccaccctggtcacagggcaaggaggctgggctgcgkaagtccctctccttgagcctcacggtcctgactgaactgcactaagtgctatgggaggcaggtgctgacccctccacggcaggaccatggcacttcctgacacaccagtccatgacatcggtctggtgtcccacggggctggcaggtgtggggccacttcccatcccccaggtggatttttactcatcaccgaaacaaaactcgtgcccaacaatgcgtctaagcctccacgcggtctcgctctttcacttacaacctgaggtagagctggcaggaagagtaggttctcagtcaaagcta

SEQ ID NO: 164111 - DNA, 601 bp, Human
tttccaatctacttacagcatgcataaattacttttaaaagagcaaaaagtaagcttcactgctcaagaaaagtagatacagtagaattcagtattaataacattcctgggaggcttctgtgtgccagacattacactaatgtcttcctgtgcagcatctcaaccttacggggtggcttctaagatggtctccttttcacagagacaaagccagaggtccaagatcacacggctagggttgtagcactggggaccaggaatctagctctatggcttgaactgaactctttccttttgccaycctggtcacagggcaaggaggctgggctgcggaagtccctctccttgagcctcacggtcctgactgaactgcactaagtgctatgggaggcaggtgctgacccctccacggcaggaccatggcacttcctgacacaccagtccatgacatcggtctggtgtcccacggggctggcaggtgtggggccacttcccatcccccaggtggatttttactcatcaccgaaacaaaactcgtgcccaacaatgcgtctaagcctccacgcggtctcgctctttcacttacaacctgaggtagagc

SEQ ID NO: 164112 - DNA, 601 bp, Human
tgaaattctgatgtaaatgccttaggacagcttttcctaaatagaataagaaaacccaaagaatgtacacattgatgggaaacgcttactctatgtaaggggaaaggatgccagatacaacataaactgtaagattataactatgaattaactacaaagcaaaccaagaaactactgcatgtacacacaaacaggtaagaaggacatgatccaaaattctcccagggattcgctttgagtagttacatgatttgcaactggttttcccacttttctgtattttccaatctacttacagcaygcataaattacttttaaaagagcaaaaagtaagcttcactgctcaagaaaagtagatacagtagaattcagtattaataacattcctgggaggcttctgtgtgccagacattacactaatgtcttcctgtgcagcatctcaaccttacggggtggcttctaagatggtctccttttcacagagacaaagccagaggtccaagatcacacggctagggttgtagcactggggaccaggaatctagctctatggcttgaactgaactctttccttttgccaccctggtcacagggcaaggag

SEQ ID NO: 164113 - DNA, 601 bp, Human
ctggcgtattgagaaaacagtaatactaggaatattgtcctgaggagagaaagaaaacaaactaggtcaaaagctgttatgtctctgttataaaataacactcgaagcttctatggcaaaattgacatagtgttcaattcatttacctagaaagctgctagtcctctgaactaccatttgagaaatagtatatctattggaatgtacatcttttggaaatactactgtgggggaagatgttacaactaatttgcctagcatttcttgatactgaaatgaaattctgatgtaaatgccttargacagcttttcctaaatagaataagaaaacccaaagaatgtacacattgatgggaaacgcttactctatgtaaggggaaaggatgccagatacaacataaactgtaagattataactatgaattaactacaaagcaaaccaagaaactactgcatgtacacacaaacaggtaagaaggacatgatccaaaattctcccagggattcgctttgagtagttacatgatttgcaactggttttcccacttttctgtattttccaatctacttacagcatgcataaattacttttaaaagagca

SEQ ID NO: 164114 - DNA, 601 bp, Human
tcgggtgatcctcctgcctcggcctccccaaagtgctggggttacaggcatgtcccgccgcgcccggcctgaaagacgaaactttttaaagctttcctaagtgtattgagaacaaaaagaacagccaacactcatcattcaacatgctcagagcagtcatctttaacccaaccttaaaattcttggcttctctctttttctccttgtcattataaaaaatgaaaataagatggttacacagggaaagaagtgggctgaacctgactaagctcaggctccaattctaataaaaacccagacrccgggactagagtcttcacaatggaaccaagtgtgtaacaaccactgggatcacctacacggggccagctgcgagtccaggtgacaccccagctagggaatgtattcacacccccaacagttacacaacactcaaattaagatgcagcttttggccattagtgactatcaacttacctctacagctgtggccaaatttaaaagattatggctgcccattaagagattatataaattccatcatgcttgagcaggttgcttgctaatccccaggctgttcccactcacatctttccacttt

SEQ ID NO: 164115 - DNA, 601 bp, Human
cgccctcaccctgactgcctcaccaactaattgtaatttcattttatctcagactacaggtatgtttatgaaccatgcacattctttcttggaaaaagaataggtctgtataaatgcacacttagaccatacaatctgatgagaaagttattttagaaagatgaaacttttttttttgagacagtcttgctctgtctcccaggctgaagtgcagtggcgcaatctcgactcactgcaacctccgcctcccagatccaagcgattctcctgcctcagcctcccgagtagctggaattacagrcacccgtcatcaggcctggctcatttttgtatttttgtagagatggggtttcaccatgttggccaggctggtcttgaactcctgacctcgggtgatcctcctgcctcggcctccccaaagtgctggggttacaggcatgtcccgccgcgcccggcctgaaagacgaaactttttaaagctttcctaagtgtattgagaacaaaaagaacagccaacactcatcattcaacatgctcagagcagtcatctttaacccaaccttaaaattcttggcttctctctttttctccttgtcattat

SEQ ID NO: 164116 - DNA, 601 bp, Human
tatttggacttgaaagccataggtcttacttaacaaaaatagcatgggtctctttcgtgtgagaatgaatagactcctttgataaaggagtagcccttcttccgttgaagcattagttataatacactcactgagcagaaagcacagtgggaaaagaacgatggctaaaacacggtctctcatgcaggagccaacaacgtagctggggacacaggacactccaaaagatccggggagagggaaattgctcaacttcaaatggaggcaagctgagctgggtcacaagaagcaccagtgaggyggtcaggaaaaggcgaagtcgggccctggccagggaaggatctgaggaggaggtgggaacggaggtgcccctccagggatcgggagggtctggagggtggggtttgagggtgttctggtgaacgcagagctctcatgcagggcacagggcaggaggcaagttctggaagtgttccaaaagccatctaagccacctagaggggtttggcctgtgttgtaggtagcctagagcaaccactggattgggaagagaaaggatacaaagtcagacgtgcagaataagcctggagtgcggttaagg

SEQ ID NO: 164117 - DNA, 601 bp, Human
ataaaccatgttatgggaaattaaatagtttcatttcagaaagcaaagtgaggccccactgaaacttcattttaagttccgcatttacttaatccctcattagatacttttttcttcacaagtatatttatttggacttgaaagccataggtcttacttaacaaaaatagcatgggtctctttcgtgtgagaatgaatagactcctttgataaaggagtagcccttcttccgttgaagcattagttataatacactcactgagcagaaagcacagtgggaaaagaacgatggctaaaacayggtctctcatgcaggagccaacaacgtagctggggacacaggacactccaaaagatccggggagagggaaattgctcaacttcaaatggaggcaagctgagctgggtcacaagaagcaccagtgaggcggtcaggaaaaggcgaagtcgggccctggccagggaaggatctgaggaggaggtgggaacggaggtgcccctccagggatcgggagggtctggagggtggggtttgagggtgttctggtgaacgcagagctctcatgcagggcacagggcaggaggcaagttctggaagtgt

SEQ ID NO: 164118 - DNA, 601 bp, Human
cctctgaatagccactgcactgtagcctgggcaacacggtgagaccctgggtctttttaaattaaaaacaaacaaacaaaaaaaaaacaaaaaaaacctgtaagcagtgaagagcttgttttgctgggaagaaaaatttcagtttgtgtaaaaaaaaaaaaaaaaagaacagttggaaaggcaagataacagaaaatcaaagtagtgctctctatctctctctctctctctctatatatatatagacagagctactttgattttatctatctaatctccaaatgacacacacacacacaccccccaaaaaaagcaaagaacaagtgcagtgcttggcatgtggtttttgaatttaaggcttacagtggtttcgcagagagtgtgttatttgatgtcactgcaattaaggaagggtaggaattccgttccacgtcatggacgaggaaaatgaaagtaaacaaaggcagtggtgtatcagacagtcgaaagtaaacaaaggtggtgatgcatcaaacagtcgctagagtcctgctgcttggctgggctcctgctgaaactcttggttttgtcttcaaggtaatgtaaacctaagaacaaagta

SEQ ID NO: 164119 - DNA, 601 bp, Human
actcaaggtgctgaggtgggaggattgcttgagcccaggagttcaagagtgtggtgcattacgattgtgcctctgaatagccactgcactgtagcctgggcaacacggtgagaccctgggtctttttaaattaaaaacaaacaaacaaaaaaaaaacaaaaaaaacctgtaagcagtgaagagcttgttttgctgggaagaaaaatttcagtttgtgtaaaaaaaaaaaaaaaaagaacagttggaaaggcaagataacagaaaatcaaagtagtgctctctatctctctctctctctctmtatatatatatagacagagctactttgattttatctatctaatctccaaatgacacacacacacacacaccccaaaaaaagcaaagaacaagtgcagtgcttggcatgtggtttttgaatttaaggcttacagtggtttcgcagagagtgtgttatttgatgtcactgcaattaaggaagggtaggaattccgttccacgtcatggacgaggaaaatgaaagtaaacaaaggcagtggtgtatcagacagtcgaaagtaaacaaaggtggtgatgcatcaaacagtcgctagagtcctgc

SEQ ID NO: 164120 - DNA, 601 bp, Human
acaggggagagcaaacggtatccttgtgctttctgtctgtccgattgtggcagccaagattgggtggggaaacagggaaaaaaacaggtaatttttgcaatgtagaaatagcactgtatagccaagtatggtggtgcacacctgcagtctcagctactcaaggtgctgaggtgggaggattgcttgagcccaggagttcaagagtgtggtgcattacgattgtgcctctgaatagccactgcactgtagcctgggcaacacggtgagaccctgggtctttttaaattaaaaacaaacaaamaaaaaaaaaacaaaaaaaacctgtaagcagtgaagagcttgttttgctgggaagaaaaatttcagtttgtgtaaaaaaaaaaaaaaaaagaacagttggaaaggcaagataacagaaaatcaaagtagtgctctctatctctctctctctctctctatatatatatagacagagctactttgattttatctatctaatctccaaatgacacacacacacacacaccccaaaaaaagcaaagaacaagtgcagtgcttggcatgtggtttttgaatttaaggcttacagtggtttcgcaga

SEQ ID NO: 164121 - DNA, 601 bp, Human
tcaccctctccccaagcttcctgtcccatgtttcccccagtacttgtcactggctgacataatgcatcatttatggacttagtatgctgattgttgattgctagaatgtaaactccactttttaattcactgatgtatcccaagtgccttgaacagtggcctggcagagtcagtgctttataaatatctatactgcatgatggaatgacagcactgagtgcctccctacccggaccagcaagagaagagagacttccaaacaggcattataaacacttaaaaaaaaaaaaaaaaaaaaaaaggagagaagtaattttttagaaccagaggcccgcccatttggaacttgcagtggccagatcgatcaatgaaatggaccaatgcttagaaacccaatcatttaattagaaaaatctgtgtacctttgtaattcccaaaactccaatgttgggactggatgaagtagagccattcccagtaccaaatatgccatcaagaacacaggagaggccttccacgaaaattcccctaagatgtaaaggaatggaggaaagaaaatcattcaatgggataatgcattcactctgaaatagcctctaca

SEQ ID NO: 164122 - DNA, 601 bp, Human
aattatttgatcaagcttgtgacttgttagactgggacaggtgaatgcaaagatgaataagtcacaagcttgatcaaataatctcactgctatgctgttctgctgttgggggagcccagcagcagggaagagaaaatctgaagagttggggagggttgttggagatggtcctgaggggtgagtaagagttcgctagtggaagagcatccaggcagaggaaacagcctatgcaaagactcctggcagggtcgggcaggcctgttaggtatgaagggccaaactggccccagggatacctgaractaaatctggtagcaaagtgacatccagaagactgatctgcctttgatgctgtcaacaatatatgcagcaactaagccattcttgtgttcaatgaatattgaccaagtacctattatgttttattctaactaccagagatagagccctaaaatcccagccttcccggtgcttccccaggacctttgcttcccctctcacagggtccattccctggaatctccttggcacctccctcctgaactgtggctctgcctctaggaccttggtaaaatagaccctgggtttctggatttacaaa

SEQ ID NO: 164123 - DNA, 601 bp, Human
caatggaaaagatcactcaaactgacaaatcaagcaaaagcgactcatgcttggctgttactatggaataaggaaggctttcatttactaatggccctatcttcagcaaacattttcgaggaactatgtaattatttgatcaagcttgtgacttgttagactgggacaggtgaatgcaaagatgaataagtcacaagcttgatcaaataatctcactgctatgctgttctgctgttgggggagcccagcagcagggaagagaaaatctgaagagttggggagggttgttggagatggtccygaggggtgagtaagagttcgctagtggaagagcatccaggcagaggaaacagcctatgcaaagactcctggcagggtcgggcaggcctgttaggtatgaagggccaaactggccccagggatacctgaaactaaatctggtagcaaagtgacatccagaagactgatctgcctttgatgctgtcaacaatatatgcagcaactaagccattcttgtgttcaatgaatattgaccaagtacctattatgttttattctaactaccagagatagagccctaaaatcccagccttcccggtgc

SEQ ID NO: 164124 - DNA, 601 bp, Human
agaggtggaaaagagaaggggctacggatgaggacatctggagcctgactgcgggctcttctcctggcccacgtctgactgtatggtcgggccgacccgtagcctctagagtctcaggatcttcatctcagtcacacacaagcctcgtggttttgttttgaggattaaacgggacctgcataaaactgcctgaatggtagctggcacgcactgagccatctgagagccgcccacatgggcctgctgccactggcctttcctgcacccattccatggggccacggggtcacctttctaacayatgaaattggggaggctggtcccctgcttgcatcctctggtactcatgaaataaagcccacttctcaggctctttccaagcacaccaggcaggcctgggcctgtctacctggacacccttccctgtggttccctcctagccagatcctagatgcatccttttaaacatcacccaaatgctcctctgaaaagcatcccaactccaggactattcccccattataggctctcatagcaccatgtagggcatatctgctactcctgatctctgcctcccagcagcttctgtctagcctgctgt

SEQ ID NO: 164125 - DNA, 601 bp, Human
ctcatctccatgcaaaatcaccgtaagttactaaagaacacacagcagagatacccatggcctggctcgctaccttcacctcctcctcagcccactcttctcacctccactgtggggaccctgagggccgccctctgcatctccaagccttggtgacactccctgcactcaggcctcagggctctactgccctggcacagtcatgggttgggatggccgtctgtgtctcaaatgcaaaggccacactttgcccctgcctatcccctgggttcccggcaccacatgtcaccaaggcaatttyccccaaagtgcttcagcctcaatgccaacttccccacaccggaaatcagaccaaacccccagacatgtctggaacctcctctcctcacggcacgcttcccgtgagaggtggaaaagagaaggggctacggatgaggacatctggagcctgactgcgggctcttctcctggcccacgtctgactgtatggtcgggccgacccgtagcctctagagtctcaggatcttcatctcagtcacacacaagcctcgtggttttgttttgaggattaaacgggacctgcataaaactgcctgaatgg

SEQ ID NO: 164126 - DNA, 601 bp, Human
attttaaaatagaaatttatcgttaccttcttactgaagggagtcagcaaaaacaccatgatccctattaaaaatttggaaaagtaaaggaaaaagccagagaggggagtcttaccaaagagcgtgcagaacagggctcccagcacaggatccggaagggacgcaaagagggcgctgaacttcccgatcatgcccagagcgagcatgagggctgctccgcactgtatcacgcggcggctgccgacctgcagaacacacaggagactgggaaacagggactcatctccatgcaaaatcaccrtaagttactaaagaacacacagcagagatacccatggcctggctcgctaccttcacctcctcctcagcccactcttctcacctccactgtggggaccctgagggccgccctctgcatctccaagccttggtgacactccctgcactcaggcctcagggctctactgccctggcacagtcatgggttgggatggccgtctgtgtctcaaatgcaaaggccacactttgcccctgcctatcccctgggttcccggcaccacatgtcaccaaggcaatttcccccaaagtgcttcagcctcaa

SEQ ID NO: 164127 - DNA, 601 bp, Human
ggttattacagctaaatggtgcagagatcaaacccagagtcccactgtcaaaatggtcagttttaagtagcccattcagagggatggtatttgagttaaattggtcagaaatactaaagagattaaatttaattgaaatgttcatagcacaattacatcttattgttggttccatatttaatataaattcaactcagagagtgataaaagttttcattttttgaaggcatatcctttgtattttaaaatagaaatttatcgttaccttcttactgaagggagtcagcaaaaacaccatgayccctattaaaaatttggaaaagtaaaggaaaaagccagagaggggagtcttaccaaagagcgtgcagaacagggctcccagcacaggatccggaagggacgcaaagagggcgctgaacttcccgatcatgcccagagcgagcatgagggctgctccgcactgtatcacgcggcggctgccgacctgcagaacacacaggagactgggaaacagggactcatctccatgcaaaatcaccgtaagttactaaagaacacacagcagagatacccatggcctggctcgctaccttcacctcct

SEQ ID NO: 164128 - DNA, 601 bp, Human
aggcaggagaatcgcttgaacccaggaggcggaggttgcagtgagctgagatcatgcccaggcctgcactccagcctgagcgacaaagcaagactccatctcaaaaaaaggaatgaagtactgctacatgctacaacatggatgaatcttgaaaacatgctaagtgaaggaagccagatacaaaaagccacatattatgactctatttatacctagaatagaccgtgaatccatagaaacagaaagcacaccggtggctgccagcgggtgggagcaggcggtgatggggatttactgcttwatgagtttggggttttattttggggtaatgaaatgttttggaaactggacagaggtgatggctgcacaacactgtactagatgccattgaactgcttaaagtagttaattttgttatgtgaatttcacccacaaaaaatatatgtataaacaaacactcctcaattctgcactggctaagatattaccagtagcaatggctatgtcttgagacggttcttcctttctacattcctcaggacattgcagtgttaaaacaaaaggaggagttaaaaaggttaatcttgaatgcacaagccac

SEQ ID NO: 164129 - DNA, 601 bp, Human
aacagcaagaatctcatttatccacacactttccatcctgaagatagaataatcctcaacagaaaatcataggcactggtgaggatgtggagaaacagaaaccctcgtacatggctaatgggatagtaaaatggtgcagccgccatgaaaaagtttggcagttcctcaaaaggttaaaaatagaattaccacatgacccaattattccactcttaggtatatacccaggagaaatgaaaacaagtactcaaatatggcccacattgattattcatgaattacgtgtttgtgaaattgcccrtacactaaaatgtatttgtaaacccaaaatgaatacccttggtgccttcatgggtatacagagcagtgaaaaatctgagccacgccacatacattcctgactgatgtcaaataagctgacgctctgccttgttctggcctcatcctgtaaacaagagtcctttttgcggactatgtagtgccatgtctgtcataccgtgtgctttccgttggtgatctcactgtttaaaatgtccaagtggtgtgaagtgctccctgacgtttctacacataaggcggctatggtgtgtgttaaagaaga

SEQ ID NO: 164130 - DNA, 601 bp, Human
gtgttcaccctacaacgaactgtgaagccacaggggtgtagtcggtggataaaaaaaattctaaataaaaaaaaatggtagtcataaggctgagaaaaaattacaaagtgaataataagatgacaaaaatatttctggcacctgcagtcatagaagacttttcagtatcctgggttatcaattagtgcttagctgcttttaatcaggggcaactggatttataaagatgtcctcccatgaatatgacatattaaatgtaaaaaacagcaagaatctcatttatccacacactttccatcckgaagatagaataatcctcaacagaaaatcataggcactggtgaggatgtggagaaacagaaaccctcgtacatggctaatgggatagtaaaatggtgcagccgccatgaaaaagtttggcagttcctcaaaaggttaaaaatagaattaccacatgacccaattattccactcttaggtatatacccaggagaaatgaaaacaagtactcaaatatggcccacattgattattcatgaattacgtgtttgtgaaattgcccatacactaaaatgtatttgtaaacccaaaatgaataccc

SEQ ID NO: 164131 - DNA, 601 bp, Human
gggcctttggcacaggctgtgcagggggacaggagcctggcctgtgcccatcccactgccatctcaccaaacgcagcgaactcagctgctgtctcccaaaagtccttcagcacgagaaacaaaattaatcagtttatgtagcaaaaaactgattcatacatggaggctgggagtgccatcacaactgttttagaaaacagttataaccagtgatggctttgaactcatttactcttcccgttttccatttctatttggcaaaaaaagtaacacatatgttaaaaaaaaaaaaaaaaaaaaagtgtgtttgatatataccacgtacctgggatggtgttatccaggataaaagccacacagccccctacaaacatagcagttgtgagaaggacgttcaacacttgatcgattcctgttatccctagaaagagaacacagccataaacgatcagtgccacagcagcggtgagcctgcccttgacttgggaaggggcaatggtgtgggcagaactccgccaatcaaagcaggaaaggaaagtgtacatttcttagttgtgcacatgtagatgaatttttgccagtaatgttttaaactacgatg

SEQ ID NO: 164132 - DNA, 601 bp, Human
aaacccacactgcagggcctttggcacaggctgtgcagggggacaggagcctggcctgtgcccatcccactgccatctcaccaaacgcagcgaactcagctgctgtctcccaaaagtccttcagcacgagaaacaaaattaatcagtttatgtagcaaaaaactgattcatacatggaggctgggagtgccatcacaactgttttagaaaacagttataaccagtgatggctttgaactcatttactcttcccgttttccatttctatttggcaaaaaaagtaacacatatgttaaaaaawaaaaaaaaaaaaaagtgtgtttgatatataccacgtacctgggatggtgttatccaggataaaagccacacagccccctacaaacatagcagttgtgagaaggacgttcaacacttgatcgattcctgttatccctagaaagagaacacagccataaacgatcagtgccacagcagcggtgagcctgcccttgacttgggaaggggcaatggtgtgggcagaactccgccaatcaaagcaggaaaggaaagtgtacatttcttagttgtgcacatgtagatgaatttttgccagtaatgt

SEQ ID NO: 164133 - DNA, 601 bp, Human
tcagatgaaacccacactgcagggcctttggcacaggctgtgcagggggacaggagcctggcctgtgcccatcccactgccatctcaccaaacgcagcgaactcagctgctgtctcccaaaagtccttcagcacgagaaacaaaattaatcagtttatgtagcaaaaaactgattcatacatggaggctgggagtgccatcacaactgttttagaaaacagttataaccagtgatggctttgaactcatttactcttcccgttttccatttctatttggcaaaaaaagtaacacatatgtwaaaaaaaaaaaaaaaaaaaaagtgtgtttgatatataccacgtacctgggatggtgttatccaggataaaagccacacagccccctacaaacatagcagttgtgagaaggacgttcaacacttgatcgattcctgttatccctagaaagagaacacagccataaacgatcagtgccacagcagcggtgagcctgcccttgacttgggaaggggcaatggtgtgggcagaactccgccaatcaaagcaggaaaggaaagtgtacatttcttagttgtgcacatgtagatgaatttttgcca

SEQ ID NO: 164134 - DNA, 601 bp, Human
acacacacacacatggtcccacagatcaaacctgcctagataacagcaaagaatacttgaggaggtgaaggtgctcagctatccagtgcccaaaccagaagtctaagaagcactaacccctccatgtcctcattcaagcaatcacctaatgaccttctgacctccctatccttctatgtgacccatattctcaattttcactgttagggcccagctcaggccatgttattgctttcctggttcattctatcggtctcccatctggttacctagtcttctggctcatcacctcctgccccargtctgctcaaaaactacctctctaggccaggtgtggtggctcacacctgtaatccaagcactttgggaggccgaggtgagaggatcacatgaagtcaggagttcgagaccagcctagccaacatggtgaaatcccgtccccactcaaaatacaaaaattagctgggcgtggtggtgcatgcctgtaatcttaactactcaggaggctgagacaggagaattgcttgaacccgagaggcagagactgcagtgagctgagatcatgccattgcactctagcctgggcaacagagcaagactc

SEQ ID NO: 164135 - DNA, 601 bp, Human
taaccaagttgggggaaaaagatgagagagagagcaagacacatgggagccaaaagggaagtagtcatgtaaacaatcagattactagcagctatacaccatttagttttgtaaaggtgttttcccatctgttatttcacctaggctcgaaacaacaaaaccaagctgctggggataaatagagggagcggaggagaatcccaaaggcgccggaattcggctagagttgagacaccagaggcgggggccgtcattaagttgcggggtagtctgaaggggacgagaaaacgaagcggagtcygggttacgcgtgagtggtcagtgtgaggtgggcggggagggtgggaggaggcgcggaatagagtcgaaggggaccatggatcgggtcaggaaagaagagcctggagttctgatcccacggggacggtacctgcagcagcacggaacgaatcaacgcgttaacgggtccggtgcatgagtcgctaacgccctggaagcaccagagcacaagcccgcccttggagaaaatggtgaagaagtcgagcatggcggcagcggcagaggagctggggccggcgccgggaattcaggccgcgttcgc

SEQ ID NO: 164136 - DNA, 601 bp, Human
caccaaatcaggtgtattgacagtaatgagtttggccagggcagtcatcagaggggcattgtcttgcatgcggcctgccgtgtccaccagcaccacgtcaaagccttggttacgtgctagagaaagaaagtagtcaactctgaacacctggactaccactcatgctcgttcccagcttcctctcaaaaagtcctagtttgactacctgttcactgtcttgggctctggatttggttccaaggtaatgtgagaaaaacttgattatatgcttggccatcaccaaacatattcaggaaaaggmggacaacaggatgaaggtgaccaaattcaggtttctctggttaaggtatattagctttgcctgcaactacatctgttacccaaaagcagagcatggcaagtaactgatctgactttttactgtaattgaccaacgagtctgtagtagcacaagcctgatcttctgcaaattccaagagaacccaaggagaaaaagggaccccaaataagcccccacacttcccatgcactgtaccaaaagcaatggcttccatggcaatgccagcagcatccttgccatagcccttttcaaacaactgca

SEQ ID NO: 164137 - DNA, 601 bp, Human
ttatggtcatctgccaggagaaaacattcttcccagggatgtagataaatcactgtgaatgccatatgaaggtatataggcaaatacaattcactgatgaaatgtaaaactatatttttcatagtcaacggattattacaacaacattagacatatagtactttgccactgaaagttgacttgagtttggctaagtggatctgtaaatgtttacccttttgaggttaaatagtgcctcaaatacccaggaaaaaattagagaattggatgctaaaattatagatcattgttatcagatgtkgtgagaaattattttgtaatttttacggcagaaaactgtaatctgctttttcattctgttctctaagggggaacttttgttgtagattttgggctagtcctacttgaaattacaaatatagaattagtaaatggcgtaagagcttttttattttacttccatcagctagctgaaagtaaggttcttcagtattgagggatttgcattgttgacttgaatacacttttagggagtataggtatcagtttctcatgtctccttgccttcatttgttcagagtaacaaggtaaagtatgtgtt

SEQ ID NO: 164138 - DNA, 601 bp, Human
gccattctcttgcctcagcctccagagcagctgggactacaggcacctgccaccgtgcctggctaatttttttgtatttttagtagagacggggtttcaccatggtctcgatctcctgacctcgtgatccgcctgcctcggcctcccaaagtgctgggattacaggcgtgagccactgcgcccggcctgaaagaggaattcttgccattttgtaactcgtcattattcatttaaggttgactggtggagagctaatttttactattggcatccgttaggttctcttaataatttcagccartgaagaggaggaattctgaatgatggctctataagatcaggactacctatcattttagctacttgttccaccaataggaactttgtagagataataccaatgtcagtacaggtttcagtggcagaaaacacttcccttaaggttcaatgtctatactgagctgccatgaattcttaactagtcaaattcccagtgattttggcctttgcttagatcactaataataatggcataggcatggattaattgatcctgaagaatagtacagactttatgacaacttgtagaaaagaattgtct

SEQ ID NO: 164139 - DNA, 601 bp, Human
ttagttggttccctaacatccttcagaaatgcacgagttcctgcctgccttttcgttttttcctcctactgttgtgaactttagattcaaatatttgatattcagtcagttgcagttatcttattggtggttaaattgtccagtctttggtgactaggagttctctgctgagtccttttgacacagcccttgtagtctctgaaaacttcctttaatatgacaagatattgccatctcatcttatacatttcctgtcccagacttggaatcagacatttctccaaggagccctggtacttgrtacttattagtggggatggtattgatcactaattataaaccttgtcagtgatctgagctaggaagttgatattttttaaaagataaacttttcatgagttaatatagatacttaatagttaacttaaagttaggtttatagggtttttactatattaatcttaaatctctctcctttacccttaccaaaaatcgcagttctcagcaacaaaacataatgattgatgtgccttatctcccactgtatacgttaacagtctcagaatgacaataccaacaccaccatcagcaatatgaatgt

SEQ ID NO: 164140 - DNA, 601 bp, Human
ttttgcacagaatatcttctaggaaattgagagggcagtggttatagtagtgtatttgcttgactatatctttaaaatacagagaaatgcggaagcctctggttgaaaatataaaatactgcagataataaaatgatttgaaaaacattgaaaattacctggcttggtgaggtgatagtgataagtgagtgctgatgttaaatgtgagcctatactgatttctttttagcccctcagttaagttttaatatgtgggttaacagggctaaacataggcatgggtattattttccaaaggacytaagattgtcatctgcctccatgtacatgatgacttagaagacatcaggggtttaaggggcactatgggagaggtggtgttttttgtttgtttgttttgagatggagtttcgctcttgttgcccaggctggagtgcaatggcgtgatctcggctcactgcaacctctgcctcccaggttcaagcgattctcttgcctcagcctcctgagtagctgggattacaggcatgtgccaccacgcctggctaattttgtgtttttagtagagacagggtttctccatgttggtcaggctgatctc

SEQ ID NO: 164141 - DNA, 601 bp, Human
cacctgctccaaaattacctttttccttgttcatcgtatattttgaggatggtaatatcttgattgtctaaaccaaggcaatactggcaatggtgatgtgtataaaagggtggggtcgggtgggggtagggtgaaagttgtggcaggaggattgttctagatatctagggcagacaacattgctgaagttggggtgaggatgtatcagtaaccaactggagttctggaaacaacctccgtccaggtatttggggggcctatatgacagaaaggccagcaagcaagcttaccctcatcactyacttggcctctattcaaatagcctacttttgtctgatctatccagggatgtgtgggaaggcatattggggctggtgagttctatatttctttagaaatttattatgactcagctgtttatgacttaagttttttgtgatttctatacgttattcctggtatcatctcttagagtaatacattccatataaaatacgaggtgtagctaaacataactttctaaggccccaaagtgttttcccagccccagcgcccacccatttcctgtcttctcttcttactcactgtaattacagacttg

SEQ ID NO: 164142 - DNA, 601 bp, Human
acgtaagtggagtgctgtttaccatgtgattttcacattgttaacttagaagcacaggtaccaaatgaatttttgtgcactttatgtcacagaggaacaaagggaaaagaaaagagatcttttcctgagcaaaacagaaaaagcagttgcctcctgcctttttataagtgtcctaaggagctcgttgtagtcttagatagctgagagacagagttagtgtatgatgggacagtgcggatgtgtacactgctgtacagtgtattggcagcattactggcaatatcctggagtggatctaagrcacattggcctctccttcctggcaagagtcccagcaaacattggaaatggtggagaggttgaataaagaaagtcatagtgctcttagctcaatgagctatgtagtagctttggggaatatactagttgattctgatctctggcttaagaactaccttcctcaaatgttatgtatttaactcaaaattcacagacgatctccaggtaccctcctgcccctgtgccctgtcacccctccagcctccaccaccaaacatgaacatcagtattgaagcggagggacgaaaggcatttgcatata

SEQ ID NO: 164143 - DNA, 601 bp, Human
tggcaatatcctggagtggatctaaggcacattggcctctccttcctggcaagagtcccagcaaacattggaaatggtggagaggttgaataaagaaagtcatagtgctcttagctcaatgagctatgtagtagctttggggaatatactagttgattctgatctctggcttaagaactaccttcctcaaatgttatgtatttaactcaaaattcacagacgatctccaggtaccctcctgcccctgtgccctgtcacccctccagcctccaccaccaaacatgaacatcagtattgaagyggagggacgaaaggcatttgcatataggagatgctgtctatattggtggcaggaggaaatgtggcatctaaaacaaggctgagagtcttttggcatttctcttattgggtgttagagaggcttcctcgcctacatagaaagagactttagtccaggggtcactggttccagtatacccttggttcagtttttacttttcagaatggctttctttttatggatttttaaaaattaaaaatcaaaattagtcatattttaaaaagtaatgactactttttttaaaacaaaaaggaaaaaata

SEQ ID NO: 164144 - DNA, 601 bp, Human
cagttatatgcctctccccaggtgttttatgtctcttctctgtattgagcaaacattttctataaaggaccagatggtaaatatttttagctttatgagtctctgtcacataactttgttgttttttacagcttgtaaaaaacagcttttaaaaaatgtccaaactggctgggtgtggtggctcatgcttgtaatcctagcactttgggaggccgaggtgggaagattgcttgagctcagaaatttgagaccagcctgggcaacatagcaagaccctgtctctacaaaaaatacaaaaatyagccaggtgtgatagcacgcccctgtagtttcagctacttgggaggctgaggtgggaagatcacatgagcccgggaggttgaggctgtagtgagccatgattgcaccactgaactcaagcctgggtgacagagtgaggccctgtctcaaacaaacagacgaaaaaagatcatgcttagctccatggtcttgggtatgtctgccttctctagatgatttttctacgtgttctaacacatgcatgcataaatgcataataatatgcatatgtttataaatggctattaatgatgttgttttt

SEQ ID NO: 164145 - DNA, 601 bp, Human
gtgtacagtgtgaattatatatttttttctttctttttttttttttttttaagatagggtctcactgtgttgcccagattggtctcaaactcctggcctcaagtgatccttccacctcagcgtcccaagtacctgggattacaggcatgagccatcacacccagatcagtgtgaattatattttataggcttattagctgcctgatatatgaggctattcccatttcaaatatttatgaaatttgaatgaagattatatcatcgaattatcattgaatatatgaaaggtttataatctgcmtgcatttgtgaatgaacccaatataagtaataataagtaagtaatgtttttattgattatatctttttagggttggattgagattgttggatgtgctgatcgttcctgttatgacctctcctgtcatgcacgagccaccaaagtcccacttgtagctgagaaacctctgaaagaacccatatcctttctggtcactccaaaaactcaggattcacatgtgaacatcttgctaatgaataagtccaagtctttaccttgttctatggataaatggagatgttttagacactgtagtaacgc

SEQ ID NO: 164146 - DNA, 601 bp, Human
aaaaatgctctgaatatctttcagaacgttaatagtttttctcagctgtttccaaaacgcacttcacacctgcacctacctacgtgctctttaaataaagggtacctggtgaaagctttttccattaaaagatgagtgccatttgatagtagctgaaataataatttagctcacttggtctgaaaatcagcaaaatagaaattttctttctttagtaggcagtgaagttatgagctgatttcttaggggtaggtcagtgacaggaaatagatcttgttttgagcattttagaaatacttaycagaagttcttatgctatgggttgggtcattgctgattagataatatctcttttttctcactgtaactggaaaagtttctattgatggtgttaattttggatgagagttgtctgaatgattttgtggacaggtgtttcatcttgccttaaaatcagcataaacaggatctggagtactgatagagagctggcatggttttaagttgatgattgattgttctcaggctcattttctgaaatactgaggcagtgctgtagttttggattccttgactacttcatacaaaacagtcaatgttg

SEQ ID NO: 164147 - DNA, 601 bp, Human
ctttctggatatgctgtgtttcagaaaattgggaaggatgagataactcctagaatttagccagaccactaagctgtatctgtactctggtaaagtatcaaagggaaccctctcaaactgcatgaaattgtctggggtacttttggggtaaagatgtgaattcctaggttctactctggagatgctgattcactaggtctgagacccagggatctggggtttttttaaaaaaaataagaatcctgagtgatttcactgtgaaagcttgacagatcataaatgggataatagttgtctgggrtatagcctttcctagcattcaagtattgctgaagatagaagtttataagaagtcttcatcagctcccacaaattttcttttcggtctgatgcttctgaatcactgctccttgccttcttcctctttatctccttgccttacttcaccatttttacctcacctctgcctgcagaagttacactcctgggcagattactaggaaagccaaccagaagaatggctagaaaggagaggttgtatatgtcaggttaattgaaagaaacagcgtcatccacttggccattctaaagcttgagtgta

SEQ ID NO: 164148 - DNA, 601 bp, Human
aaatatagactgaataaagaatataaatgattttataaagagtacatgattttagcctgtactcttatttctaagcgagaggatatgcttgctcagatgttttattctggcatttgagtgaggcaaggtaggacccaagagtcagatttaaaaattatttacttctcatactgaccttggtgccaagttcatcgagggaacctgagtggagtgtagcaaccataatggatctacagccacagaatccacagccctgaaaggaatcctggtggtcatctggcacatccacttatttcagagytgggaaatggggagagtccattgacctgcttagagccataaaaatagaggtggtggagtcaggactcaccttctggccttggctcttggtcccatatttgttccccctatagctgtatcagatggaggtatgagtgaagatttggattcccgcaagggatttattaaactttagggatatttctttctcttgcaactcaacttgttgctttcttgtcttggtcccatttataagtctcctgagcttgtaagacagtagttagataacactgggcttaactccattgttttatttttaatt

SEQ ID NO: 164149 - DNA, 601 bp, Human; identical to SEQ ID NO: 18782

SEQ ID NO: 164150 - DNA, 601 bp, Human; identical to SEQ ID NO: 18783

SEQ ID NO: 164151 - DNA, 601 bp, Human; identical to SEQ ID NO: 18784

SEQ ID NO: 164152 - DNA, 601 bp, Human; identical to SEQ ID NO: 18785

SEQ ID NO: 164153 - DNA, 601 bp, Human; identical to SEQ ID NO: 18786

SEQ ID NO: 164154 - DNA, 601 bp, Human; identical to SEQ ID NO: 18787

SEQ ID NO: 164155 - DNA, 601 bp, Human; identical to SEQ ID NO: 18788

SEQ ID NO: 164156 - DNA, 601 bp, Human; identical to SEQ ID NO: 18789

SEQ ID NO: 164157 - DNA, 601 bp, Human; identical to SEQ ID NO: 18790

SEQ ID NO: 164158 - DNA, 601 bp, Human; identical to SEQ ID NO: 35236

SEQ ID NO: 164159 - DNA, 601 bp, Human; identical to SEQ ID NO: 35237

SEQ ID NO: 164160 - DNA, 601 bp, Human; identical to SEQ ID NO: 35238

SEQ ID NO: 164161 - DNA, 601 bp, Human; identical to SEQ ID NO: 35239

SEQ ID NO: 164162 - DNA, 601 bp, Human; identical to SEQ ID NO: 18139

SEQ ID NO: 164163 - DNA, 601 bp, Human
tgggaagtaaggctatatctttcttttttaggaatctgtatgaaggaattaagtctctgtttggtcattatcaggaaacgagtgctgatatgtgcacctgtcctcaaataaccagttcctttacagaaccaggtggtccactccctgacttggcttgataaccatttaccattgaggaaaaagagtggaagtgtcaacactcactgtacagattatgattaatacaaatgtcaatatgcttctgatctcagaggaggggaagaaaagcagaggggctcattaagagtgcttgtaagacatmcattcaaaggtgaaaaaaacttggctatttatttgacctggatatccagtgaaaagcacccatgtttgttcctagctaacaagtgggaccatctccatttggagataagaggcctgttactttagggagtttcaccagttgtcctttgaatgtgggaacagtcttcgtgaccatatcaagacaggccacctcacctactgaactcagtgatttctgccagcctgggactgaaaggttggatgtaatctccataaatgcttaggaccaaatactggttttaattgataagcaatataattg

SEQ ID NO: 164164 - DNA, 601 bp, Human
agactacacacgtggtgaaggaatcacgtgagagcatgaatgtgaaaatgtgctgaaaatgataaatggcatgtaacaatagttggcatcattgcaactgccctttgtgtcaggcactgtgctttgcactttccatgctttatctcttaatactcacagcaggccacaaggtggatgctactggcatccctatttttaacagatgagaaagccaacttaaataccttggccaagatcacagagctgagcctcagattttgtctgggctttgaagactgtgtctaattactctgctacaccrtttctgtagaaagcaaaatgcagcagaagtgaagtctggaaaggtagtcagaagatgtggggtgggaaatggggggtgagggttgtggaggtgggagtggagaggagaggaggaataaaccaaggctcaaagaagtctaaggattgctcaagattacacagcaaatcatcaatgataatgttggggctgcagtgtcaagagtctccatcatcatcaccatcataaaaaatgcttggtgaacatttacaaagcatggacaatgataaacatttttctaggttgggtgcagtggctcacgtc

SEQ ID NO: 164165 - DNA, 601 bp, Human
tgtcatttgtggtctaccctcaaggcagtacatcataactgatccttcatttcctgtcggaagattatttctttctactccaggagaccatctcctctggggtcctttgttatctccattatcattacttactattttctcttgaggggagctgggcatggcatgatattgggttggatttccacttttgatgcacttagactgttgcttacgtgtactttgtaggtcctggtcctccaatttttttagtctgtgctctttggagttatagcagtgtggcacagaacaaacatttatctamggttatgagaactggatcttaatccttgcacagtcaccaagtagctttgtgatatgatctgtacaaacctccgtttcttcagctgtaaactggggaacatagcatgcctattttacagagtggttgtaagactacacacgtggtgaaggaatcacgtgagagcatgaatgtgaaaatgtgctgaaaatgataaatggcatgtaacaatagttggcatcattgcaactgccctttgtgtcaggcactgtgctttgcactttccatgctttatctcttaatactcacagcaggccacaaggt

SEQ ID NO: 164166 - DNA, 601 bp, Human
atgtcatttgtggtctaccctcaaggcagtacatcataactgatccttcatttcctgtcggaagattatttctttctactccaggagaccatctcctctggggtcctttgttatctccattatcattacttactattttctcttgaggggagctgggcatggcatgatattgggttggatttccacttttgatgcacttagactgttgcttacgtgtactttgtaggtcctggtcctccaatttttttagtctgtgctctttggagttatagcagtgtggcacagaacaaacatttatcttcggttatgagaactggatcttaatccttgcacagtcaccaagtagctttgtgatatgatctgtacaaacctccgtttcttcagctgtaaactggggaacatagcatgcctattttacagagtggttgtaagactacacacgtggtgaaggaatcacgtgagagcatgaatgtgaaaatgtgctgaaaatgataaatggcatgtaacaatagttggcatcattgcaactgccctttgtgtcaggcactgtgctttgcactttccatgctttatctcttaatactcacagcaggccacaagg

SEQ ID NO: 164167 - DNA, 601 bp, Human
tacctatagatcatacacatttctctttgaagttacatgtctacacatgttcaaattagcatcacatatacacatgcctatgtatgccactgcacaattccacgatccctcagtatatacctccacatacatactacacagatccatagatgctccagtgcacacacttacacacatttgtccagacaagctagaggttttcatctgagttttagctctttgtagaataccagaggggctgctctagatcaggattccctttcctcttttcctttgtgcgtttctttctttttgtttttctttttttttttttttgagacagagcctcaccctgttgcccagtcttgagtgcagtggcatgatcacagctcactgcagccttgacctcctaaggctcaggtgatcttcctgcctcagcccctgctccaggagtagctggaactacaagcatgtgccaccatgccctgcaatttttttttttttttttttttttagtagagacaggatttcaccatttgcccaggctggtctcgaactcccgggctcaagcaatctgcgcaccttggcctcccaaagtgctgagattacaggtataagccac

SEQ ID NO: 164168 - DNA, 601 bp, Human
agaaatacacatacttatatccatacctatagatcatacacatttctctttgaagttacatgtctacacatgttcaaattagcatcacatatacacatgcctatgtatgccactgcacaattccacgatccctcagtatatacctccacatacatactacacagatccatagatgctccagtgcacacacttacacacatttgtccagacaagctagaggttttcatctgagttttagctctttgtagaataccagaggggctgctctagatcaggattccctttcctcttttcctttgtrcgtttctttctttttgtttttccttttttttttttttgagacagagcctcaccctgttgcccagtcttgagtgcagtggcatgatcacagctcactgcagccttgacctcctaaggctcaggtgatcttcctgcctcagcccctgctccaggagtagctggaactacaagcatgtgccaccatgccctgcaatttttttttttttttttttttttagtagagacaggatttcaccatttgcccaggctggtctcgaactcccgggctcaagcaatctgcgcaccttggcctcccaaagtg

SEQ ID NO: 164169 - DNA, 601 bp, Human
caggtacctgggggaagtgtatctcagaagtattaatggtggcagagtgagaactcaaaccctggtctcctgactcctggttcagatctctgtccattgccccttaacgtcaaataaggccaaacttgtggactgtagttgcataggctgtcatcaatcagcaggggtcctggccacagtgcacctgtcttgtgccaagctagcctgccccttggcaagagaggctggaacacatgttctaataatggaaatactgggattcatgcccaaaggatgtcaacacacactctctctctctcttactctgtctctctctctcatgtttatatacagttctacacaaattccagcaatatacaagtcccttaatgtgcacacatgtatagtcatactcccatactggtacatttaaatactcttttacttattcacttgtattcatatgcacacacattcacattcacatgcacatgcatgtacacacatgtaaacatgcctactcaaatgcggatacatacttaaatatctctttatatattcacaaatatccacatacaaatacccaaagaaaataatacactccatgcacattcgttcttaa

SEQ ID NO: 164170 - DNA, 601 bp, Human
tccatttaaaccttttcttttgtaaattgcccagttttgggtatgtctttattagcagtgtgaaaatggactaatgcaaagtctttgctttggctgactagttagtagtaaataatcttttatatttctatagcatttaccaaagacttgcatacctattactctgtgtgatcctatacaccattcttagggccaggtacctgggggaagtgtatctcagaagtattaatggtggcagagtgagaactcaaaccctggtctcctgactcctggttcagatctctgtccattgccccttaamgtcaaataaggccaaacttgtggactgtagttgcataggctgtcatcaatcagcaggggtcctggccacagtgcacctgtcttgtgccaagctagcctgccccttggcaagagaggctggaacacatgttctaataatggaaatactgggattcatgcccaaaggatgtcaacacacactctctctctctctcactctgtctctctctctcatgtttatatacagttctacacaaattccagcaatatacaagtcccttaatgtgcacacatgtatagtcatactcccatactggtacat

SEQ ID NO: 164171 - DNA, 601 bp, Human
aggctcatagatggaagggacttgccttgtcttggaagagactttggactgtggacttttgaattagtgctgaaatgaattaagcctttgggggactgttgggaaggcatgattggtttcgaaatatgaggacatgagatttgggaggggccaggagcagaatgatatgatttggctgtgtccccactgaaatctcatcttgaatttccatgtgttatggatgggacctggtgggagataattgaatcgttgggggcaggtctttcccaagctgttcttgtgatagtgagtaagtctcacragatctgatgtttactataagggagaattttcctgcacaagctctctctttgcctgctgccatccacgtaagatgtgacttgctcttccttgccttccaccatgattgtaagacttccctagccatgtagaactgtaagtccatttaaaccttttcttttgtaaattgcccagttttgggtatgtctttattagcagtgtgaaaatggactaatgcaaagtctttgctttggctgactagttagtagtaaataatcttttatatttctatagcatttaccaaagacttgcatacctatta

SEQ ID NO: 164172 - DNA, 601 bp, Human
gtagagatgaggtttcaccatattggctagcctggtcttgaactcctgacctaaagtgatccgcccacctcggcctcccaaagtgttgggattacaggcatgaaccactgtgcctggccagctaacttgcttttgattttacaggctcatagatggaagggacttgccttgtcttggaagagactttggactgtggacttttgaattagtgctgaaatgaattaagcctttgggggactgttgggaaggcatgattggtttcgaaatatgaggacatgagatttgggaggggccaggagcrgaatgatatgatttggctgtgtccccactgaaatctcatcttgaatttccatgtgttatggatgggacctggtgggagataattgaatcgttgggggcaggtctttcccaagctgttcttgtgatagtgagtaagtctcacgagatctgatgtttactataagggagaattttcctgcacaagctctctctttgcctgctgccatccacgtaagatgtgacttgctcttccttgccttccaccatgattgtaagacttccctagccatgtagaactgtaagtccatttaaaccttttctt

SEQ ID NO: 164173 - DNA, 601 bp, Human
aaattaggtaacaggcagaggttgggacggtttggagggctcagaagaggacaggaaaatgtgggaaagtttggaacttcctagagacttgttgaatggctttgcctagaatgctgatagcaatatggacaataaaatctaggctgaggtggtctcagatggagatgaggaactagttgggaactggagcaaaggtgacgcttgttatgttttagcaaagagactggcagcattttgcccctgccccagagatttgtggaactttgaactgcagagagatgatttagggttctggtggaastaagcagcaaagcattcaagaagttatgtggttgctgttaaaggcactcggttttataagggaagcagagcataaaaatttggaaaatttgcagcctgacaatgtgctagaaaagaaaaacccattttctgaggagaaattgaagccagctgaagaaatttgcataagtaatgaggagccaaatgttaatccccaagacaatggggaaaatgtctccggagcatgtcagaggtcttcacagcagccactcccatcacaggcccaaaggctttggagaaaatcgtttcgtgggccaagccc

SEQ ID NO: 164174 - DNA, 601 bp, Human
tcttcatgctgtctttgtttcaatttatcctttgctttcttcatgcccctgaaattacattccctaattctacatatgtgccctcccttcccctataccccgttgctgaaactactggatgacactttcttttctacttgacttttctttcctcttttggcactattgaacacacaacagtttttttgaaaccctttcatcctttggttcatcccttgaaactgttctctcctggaaggtttgagcatggggagtaccatgaccagattgctgctttagtaaaatcagtcaatttggtgcygatcagtttagaaaaaaagaaaaaagaaaaataactcgaaagcacacaacagtgcctgacacgtacatattcagagaattattattaataatttacagagaattattattaacttctgtgttccacagcatccttgcatagctctgtaatctcacccatcctactgtggtattatcttgttttccttaaaatagactccttgaaagcagagacctcctactcactgatgtctggttcctgtttacttctggtaccataggaggattatacttctctttgggcagtgccatgtgacttccc

SEQ ID NO: 164175 - DNA, 601 bp, Human
aacaccaatactaacacctcacattcttttcacagtagagctttttgaaaggtttatcttcatgctgtctttgtttcaatttatcctttgctttcttcatgcccctgaaattacattccctaattctacatatgtgccctcccttcccctataccccgttgctgaaactactggatgacactttcttttctacttgacttttctttcctcttttggcactattgaacacacaacagtttttttgaaaccctttcatcctttggttcatcccttgaaactgttctctcctggaaggtttgarcatggggagtaccatgaccagattgctgctttagtaaaatcagtcaatttggtgctgatcagtttagaaaaaaagaaaaaagaaaaataactcgaaagcacacaacagtgcctgacacgtacatattcagagaattattattaataatttacagagaattattattaacttctgtgttccacagcatccttgcatagctctgtaatctcacccatcctactgtggtattatcttgttttccttaaaatagactccttgaaagcagagacctcctactcactgatgtctggttcctgttta

SEQ ID NO: 164176 - DNA, 601 bp, Human
gaaatggaaaggtctttgaggtggaatgggtagaaatggattttagggcctagagaaggttttccaagggcttcctgggggaggcagaggttgagagagaggtcaagagaatgagattcttggtttcctctccagttcaaccagaaccacccatttaagaaatttgtttattaaagtgctacatcagatttaccttacagccaggcgcggtggctcatgcctataatcccagcactttgggaggctgacggtgtggatagcttgaggtcaggaatttgagaccagcctggccaatatggtraaaccccatctctactaaaaatacaaaaattagccgggtgtggtggcgcacacctgtaatcccagctactcaggaggctgaggcaaaagaatggcttgaacctgggaggtggaggttgcagtgagccgagattgagatcacgccactgcactccaacctgggtgacagagtgacactttgtctcaaaaaaaaaaaaaaaaaggtttaccttaaaaattgaactaaggtgggactgctattaaaaacaatgctttgaaattcactaacccagaataagtatggccccactttgctctgctc

SEQ ID NO: 164177 - DNA, 601 bp, Human
tgtattactaatgcactttaaaaaaatgttccagggtgctgctgtccgtaagcatactgcaagtgaacactgtgacatggttcccgaaatggaaaggtctttgaggtggaatgggtagaaatggattttagggcctagagaaggttttccaagggcttcctgggggaggcagaggttgagagagaggtcaagagaatgagattcttggtttcctctccagttcaaccagaaccacccatttaagaaatttgtttattaaagtgctacatcagatttaccttacagccaggcgcggtggctyatgcctataatcccagcactttgggaggctgacggtgtggatagcttgaggtcaggaatttgagaccagcctggccaatatggtgaaaccccatctctactaaaaatacaaaaattagccgggtgtggtggcgcacacctgtaatcccagctactcaggaggctgaggcaaaagaatggcttgaacctgggaggtggaggttgcagtgagccgagattgagatcacgccactgcactccaacctgggtgacagagtgacactttgtctcaaaaaaaaaaaaaaaaaggtttaccttaaaa

SEQ ID NO: 164178 - DNA, 601 bp, Human
gggaattggaggggagggcaaagcaggggcattcttatttctcattctctttttcttttttattgaactaattacaaaagcttgttttcatgtattactaatgcactttaaaaaaatgttccagggtgctgctgtccgtaagcatactgcaagtgaacactgtgacatggttcccgaaatggaaaggtctttgaggtggaatgggtagaaatggattttagggcctagagaaggttttccaagggcttcctgggggaggcagaggttgagagagaggtcaagagaatgagattcttggttycctctccagttcaaccagaaccacccatttaagaaatttgtttattaaagtgctacatcagatttaccttacagccaggcgcggtggctcatgcctataatcccagcactttgggaggctgacggtgtggatagcttgaggtcaggaatttgagaccagcctggccaatatggtgaaaccccatctctactaaaaatacaaaaattagccgggtgtggtggcgcacacctgtaatcccagctactcaggaggctgaggcaaaagaatggcttgaacctgggaggtggaggttgcagtgag

SEQ ID NO: 164179 - DNA, 601 bp, Human
tatggaaactaagatcaccctctgagagttaaaaaacaaacaacggagatgaatatgcaatggagggatttgcatgttcaaatctgaggcctggcatcaatctgaatgatctatgtgtaatctcaatgacttaggatgggcatgtgcttgtaatgtaatgagaagaaccctaatttattgtattacatcttgttttggggactgttttgtaaacatatgtgggacattcattctgtagcataagaaagggccgttcaagtaggaggaatttggcaattggtaatctagcatactgcatcamtatatttgtggaaacaccaactttcttgccattagaaggagggcttctgtgtggtgacgcaaggatggtttcttagaactctctctggcctggatgaaacttccctcaagactgtctacctctcttttctccaattccagttatgttaaaagcaacttttgcttggcaagggagcacactcctggtggacatggcattcttattattacaatagaaagtcttactgtaaattggaacaatttggcagtttgatttccccacttcagtcattcgtgggtttgacggtcatgagtcagcctt

SEQ ID NO: 164180 - DNA, 601 bp, Human
cactttccgtcagcctcattgctcaggcaaattctgccttctcagcttaaggcttatctcctgcaggagacttgatgccccaggcttccctgacctcttcctttttgatctcctagcaagaccgaatcacctggaatgtttaattgagcacttcttcactgtgtatgtcttatgtcctcagcttgattgggagcaatcttagtggatgaaccagaccttatattttcactgcaccatctcacctagtcactcagtcagtgcacctatgagctacctagtacctataagaaggaagaggagrtaaagtcagaaaaagctggaacagaatggacttttcttattttatatctggaaagactgagacccagaggggaaaggtatttcctaagatcacacaacaattcagtaaagaatctggaattagaacttggctctgcttctctgagtctcactgttaaaagaagttaggctagatggtctctaagaacttttccaaatctaacagctaattgttgttagttttattttttccagcaacatttaactgagctctcttaagtgccagatactattctaggcactgaggaatccactgagaaca

SEQ ID NO: 164181 - DNA, 601 bp, Human
accaaaacagagatatagaccaatggaacagaacagagccctcagaaataataccacacatctacaaccatctgatctttgacaaacctgagaaaaacaagcaatggggaaaggattccctatttaataaatggtgctgggaaaactggctagccatatatagaaagccgaaactggatcccttccttacaccttatacaaaaattaattcaagatggattaaagacttaaatgttagacctaaaaccattaaaaccctagaaggaaacctaggcaataccattcaggccataggcatggkcaaggacttcatgtctaaaacaccaaaagcaatggcaacaaaattgacaaatgggatctaattaaactaaagagcttctgcacagcaaacgaaactaccatcagagtgaacaggcaacctacagaatgggagaaaatttttgcaatctactaatctgacatcttactagcttctaaactcaatgcttagttaatgtttctctgatggtactgcagtgtagttattccactgaaagaaaaattcaggagccaaatcaattagggaaatgttagaccggatgaaatacaataggcttcttta

SEQ ID NO: 164182 - DNA, 601 bp, Human
tactacagtacttcttaggcacactaagatttgagagtcactggtctagacaaattgaaggaatgaaaggaaaaaatcaaagctgatgtctgagcattcaaactattctgcctaaagagaacaattaattctcaagaagtgaaggagggatgggcggaagaattctgtagtgttcctgctggtcctagggttcatcccattcgcttttaataccagccttctataacttactgtgacatatgttgatttgtttggaaaggtttactagatgtcatggagtcacatcttactagcttcttgkttttttttatttattatactttaagttctagggtacatgtgcacaacgtgcaggtttgttacatatgtatacatgtgccatgttggtgtgctgcacccattaactcgtcatttacattaggtatatctcctagtgctatccctcccctctcccctcaccccacgacaggccctggtgtgtgatgttcccctttctgtgtccaagtgttctcattgttcagttcccacctatgagtgagaacatgcggtgtttggttttttgtccttgcaatagtttgctgagaatgatggtttccagctt

SEQ ID NO: 164183 - DNA, 601 bp, Human
gcaggctgaccttaccatccccgcagccagctgggcctggatggccatttcctaagcctgtcactcttccagtctggatgtttacttgaggggatgggaaggtgggctcctgagcgaggaaggccatgtaagcctcgggttcctccaagcctgctcttgatgatgaggttcctaagctccctcccctacccagcctgctttcaggaaagaccgagttcagtcaaacctgagggttaggatctgtacagcctctcccacaggcctggacagttaaggctcatcacccaaaggaaaaaaaaaacgtgtttccctgaaggactggagcaggaggagaagacatttaggaccagcgcccttttttaagctctttgaaataaaaacatattcatatattgatcaaatatttgagtgcctattgaatgccatgcactgctataggactttgagagggcatcagattcacactaatatagattagaatctaggctctgctactaacaaactggaaactttggcaggttacttaaatttttctgattctcatttgtctaatctgaaaaatgggcctggtaaaacctgcttcatggggttattaggaggg

SEQ ID NO: 164184 - DNA, 601 bp, Human
gttgaatttctgcagataaaagctccaaagtggggcagctgtcacactgggttaatttcctgaagtcgaatgaccttggaaatgtcactttctgctggtttgtcctatcatgctgtaccaggacttagcttcctagagataggaaattagtctggcagcagcaaaatccaagcaggctgaccttaccatccccgcagccagctgggcctggatggccatttcctaagcctgtcactcttccagtctggatgtttacttgaggggatgggaaggtgggctcctgagcgaggaaggccatgtragcctcgggttcctccaagcctgctcttgatgatgaggttcctaagctccctcccctacccagcctgctttcaggaaagaccgagttcagtcaaacctgagggttaggatctgtacagcctctcccacaggcctggacagttaaggctcatcacccaaaggaaaaaaaaaacgtgtttccctgaaggactggagcaggaggagaagacatttaggaccagcgcccttttttaagctctttgaaataaaaacatattcatatattgatcaaatatttgagtgcctattgaatgccatgcac

SEQ ID NO: 164185 - DNA, 601 bp, Human
tgaactggcactttggctgcatgtgatgaggtacacagccctttgtgaacttccttcctccagctcacacccacagctctggatgtgggcccctttaagcacaaggttgaagcaaaaggggaaaaatggaagggagaggctgaggaagaagaggcaaaagaagggagtggaaggagggaaaaagtgaagagaaagtgaatgcagttgaatttctgcagataaaagctccaaagtggggcagctgtcacactgggttaatttcctgaagtcgaatgaccttggaaatgtcactttctgctgrtttgtcctatcatgctgtaccaggacttagcttcctagagataggaaattagtctggcagcagcaaaatccaagcaggctgaccttaccatccccgcagccagctgggcctggatggccatttcctaagcctgtcactcttccagtctggatgtttacttgaggggatgggaaggtgggctcctgagcgaggaaggccatgtaagcctcgggttcctccaagcctgctcttgatgatgaggttcctaagctccctcccctacccagcctgctttcaggaaagaccgagttcagtcaaacc

SEQ ID NO: 164186 - DNA, 601 bp, Human
tccagcttgaaaggcttttccaacatctgagtgcctgctgcaggggatggagaagaaaggctttcagagcccaaagagccttagatcatcaaggcaactccctcatgtgacaggtgagaaacccagggtgcagagagggataggttgagagtcatctaaagtcacacagcaagctgatacatcagccaggattcaaaaccatgtgtcctggcctttggattctgagtcccatggtggggttgactcaggtgtttgctggcagcactgctctcctgcaaagccaaccccaataccctaagayacctaattggtggtgttctagtggacctgaactggcactttggctgcatgtgatgaggtacacagccctttgtgaacttccttcctccagctcacacccacagctctggatgtgggcccctttaagcacaaggttgaagcaaaaggggaaaaatggaagggagaggctgaggaagaagaggcaaaagaagggagtggaaggagggaaaaagtgaagagaaagtgaatgcagttgaatttctgcagataaaagctccaaagtggggcagctgtcacactgggttaatttcctgaagtcgaa

SEQ ID NO: 164187 - DNA, 601 bp, Human
tgcagctcaagctggaatacaagactccagcttgaaaggcttttccaacatctgagtgcctgctgcaggggatggagaagaaaggctttcagagcccaaagagccttagatcatcaaggcaactccctcatgtgacaggtgagaaacccagggtgcagagagggataggttgagagtcatctaaagtcacacagcaagctgatacatcagccaggattcaaaaccatgtgtcctggcctttggattctgagtcccatggtggggttgactcaggtgtttgctggcagcactgctctcctgmaaagccaaccccaataccctaagatacctaattggtggtgttctagtggacctgaactggcactttggctgcatgtgatgaggtacacagccctttgtgaacttccttcctccagctcacacccacagctctggatgtgggcccctttaagcacaaggttgaagcaaaaggggaaaaatggaagggagaggctgaggaagaagaggcaaaagaagggagtggaaggagggaaaaagtgaagagaaagtgaatgcagttgaatttctgcagataaaagctccaaagtggggcagctgtcac

SEQ ID NO: 164188 - DNA, 601 bp, Human
gggagtcctctcaacagaatttgaggcctgcagctcaagctggaatacaagactccagcttgaaaggcttttccaacatctgagtgcctgctgcaggggatggagaagaaaggctttcagagcccaaagagccttagatcatcaaggcaactccctcatgtgacaggtgagaaacccagggtgcagagagggataggttgagagtcatctaaagtcacacagcaagctgatacatcagccaggattcaaaaccatgtgtcctggcctttggattctgagtcccatggtggggttgactcakgtgtttgctggcagcactgctctcctgcaaagccaaccccaataccctaagatacctaattggtggtgttctagtggacctgaactggcactttggctgcatgtgatgaggtacacagccctttgtgaacttccttcctccagctcacacccacagctctggatgtgggcccctttaagcacaaggttgaagcaaaaggggaaaaatggaagggagaggctgaggaagaagaggcaaaagaagggagtggaaggagggaaaaagtgaagagaaagtgaatgcagttgaatttctgcagat

SEQ ID NO: 164189 - DNA, 601 bp, Human
gccctcaggtagggacagagctcaaattttaagttgagcagcacccatgtgcacctgcagcaggtgttgcaagtggttcttggctaccttcttcacacacagggctcatcaaaggttatttcaaagaggccctctgccttctgggtgtccagacacagttgactacatcagtaggctcatgctggggtcgactggaaaggggtgggctcctcaggattctgggctagctgtttattttggttgttcaaccctgacagaggccacagactcagaaccagagggagtcctctcaacagaattygaggcctgcagctcaagctggaatacaagactccagcttgaaaggcttttccaacatctgagtgcctgctgcaggggatggagaagaaaggctttcagagcccaaagagccttagatcatcaaggcaactccctcatgtgacaggtgagaaacccagggtgcagagagggataggttgagagtcatctaaagtcacacagcaagctgatacatcagccaggattcaaaaccatgtgtcctggcctttggattctgagtcccatggtggggttgactcaggtgtttgctggcagcactgct

SEQ ID NO: 164190 - DNA, 601 bp, Human
aaaaggagcctggttctttctagaggactcatgcaagacactcacagctttccagttgcatgatacatgtctggacatccatggggaaattcttcaagtccatggggcaggccagtgtcagggtgattctgggaagagaagggattttgaatgatgcaggatctgcacatcagggaggctgtgcctctattctagttattgttagaaaatcagttgcccaggatagggaaagaaggtcagggaacttgtgtttgtttttttgtttatttatttatttttgagagatgagatctctctttgyggcccaggctggagcgcaatgatgcaataatggctcactgcagtcttgactttctgggctcaagcaattctcctgcctcagcctccagagtagatgcgaccataggcatctgccaccatgcctgctaatttttaaatttttttttgtagagaccggggtctcgccatgttgcccaggctagtctcgaactcccaggctcaagcagtcctcccacatcagtctccaaaagtgctgggattacaggcatgagccaccatgcccggccgtgacatgattttcatatatagaaagccctgcaaa

SEQ ID NO: 164191 - DNA, 601 bp, Human
tttgggttattacagtaatctcctggggtctagtggttaggagcagctgtgtgggaatttctgcctatcccatgggtaaaaaggagcctggttctttctagaggactcatgcaagacactcacagctttccagttgcatgatacatgtctggacatccatggggaaattcttcaagtccatggggcaggccagtgtcagggtgattctgggaagagaagggattttgaatgatgcaggatctgcacatcagggaggctgtgcctctattctagttattgttagaaaatcagttgcccaggrtagggaaagaaggtcagggaacttgtgtttgtttttttgtttatttatttatttttgagagatgagatctctctttgtggcccaggctggagcgcaatgatgcaataatggctcactgcagtcttgactttctgggctcaagcaattctcctgcctcagcctccagagtagatgcgaccataggcatctgccaccatgcctgctaatttttaaatttttttttgtagagaccggggtctcgccatgttgcccaggctagtctcgaactcccaggctcaagcagtcctcccacatcagtct

SEQ ID NO: 164192 - DNA, 601 bp, Human; identical to SEQ ID NO: 18140

SEQ ID NO: 164193 - DNA, 601 bp, Human
aactaagcagtggcaccagtaccacatccacgcttatgatcccaagggaggcctggacaaagcccaacacctagctggattccatgaaacctccaacatcaacgacttttctgctggtgtagccaatcgtagtgccaacatacacattccctggactgttggccaggagaagaagggttactttgaagactgttgcccctctgccactgcgaacccttttcggtgacagaagccctcatcaacacgtgtcttctcaatgaaaccggcaatgagcccttccagtacaaaaactaagtggacwagacctccagccgtcgagcccctcctagttcttcatcccactccaactcttccccctctcccaattgtcccaattgcaactcaaagggtggaatataaaggtctttttttaattcaaaaaattaaaaaataaataaatcttagctgcaaatacaactttatgctgagtcctatgaatctttctatcaaatctctagatatgagattagtgttggagatccctgacacacagtatttactattaatggtgaaaagagcagaatattgtacttagccctaaaagtgaatggaggagaatgtg

SEQ ID NO: 164194 - DNA, 601 bp, Human
ttcaggctgccataccaacttcagcaccaaggccatgtgggaggagaatggtctgaagtacactgaggaggccatcgagaaactaagcagtggcaccagtaccacatccacgcttatgatcccaagggaggcctggacaaagcccaacacctagctggattccatgaaacctccaacatcaacgacttttctgctggtgtagccaatcgtagtgccaacatacacattccctggactgttggccaggagaagaagggttactttgaagactgttgcccctctgccactgcgaacccttttyggtgacagaagccctcatcaacacgtgtcttctcaatgaaaccggcaatgagcccttccagtacaaaaactaagtggacaagacctccagccgtcgagcccctcctagttcttcatcccactccaactcttccccctctcccaattgtcccaattgcaactcaaagggtggaatataaaggtctttttttaattcaaaaaattaaaaaataaataaatcttagctgcaaatacaactttatgctgagtcctatgaatctttctatcaaatctctagatatgagattagtgttggagatcc

SEQ ID NO: 164195 - DNA, 601 bp, Human
gctggagccaagatggtgggtactaatgctgaggtcatgcctgcccagtgggaatttcaaaccggaccctgtgaaagaatcagcatgggagatcatttctgggtgggctgtttcattttgcatcatgtatgtgaagactttggagtgatagcaacctttgatcccaagcccattcctgggaacaggaagtgttcaggctgccataccaacttcagcaccaaggccatgtgggaggagaatggtctgaagtacactgaggaggccatcgagaaactaagcagtggcaccagtaccacatccrcgcttatgatcccaagggaggcctggacaaagcccaacacctagctggattccatgaaacctccaacatcaacgacttttctgctggtgtagccaatcgtagtgccaacatacacattccctggactgttggccaggagaagaagggttactttgaagactgttgcccctctgccactgcgaacccttttcggtgacagaagccctcatcaacacgtgtcttctcaatgaaaccggcaatgagcccttccagtacaaaaactaagtggacaagacctccagccgtcgagcccctcctagt

SEQ ID NO: 164196 - DNA, 601 bp, Human
atgtgataatgtcattgtgattctccttccttattttgaggtgaattgccatgtctttgttgattcagcaaaaattgcatctacctacctacctgcccatctatctatctatttatccatctgtctacctaaactaagacagtatatgtgggaaaatgatgactggtgaatctgggtaaagggtgtgagggtgtttattgtatgttctttcaacttttctatatcaaaacagaatgttaagcagcattaattggaaatggtgcaaaacattgtttttagcagaaggctaaaggaagcacartgtggtgtctggcattaataatagagcagaatattgtgtctattgttgagtgaatagagcagaatgtgactcaaacaataatagtgaatgtggtagaatgcagcatgtagcattaaaagagagtgaagtagaatgaagtatcaagtattaatagtgaagggaacagaatgttgtacctcaactaggggtgaatggaggagtatatggtgtctagcattaaccgtaagtgaaacggaacattatgtttagcgttaaaactgaattaagtaatcccagcactttgggaggccaaggtgggtg

SEQ ID NO: 164197 - DNA, 601 bp, Human
ggtagagaagaatgtggcatcaactattaatagtgagtggagcagaatgttgaatctaacataaggaaaagaaagcagaacattatgtctgctgctacaattgcacacagcagaatgtgttgtcaggtgttaatagtgatcagagaatgtggattcaagcatttgtagtgaatgtagcagaatttgaggtctagtgtgaatgctgcagagagcatattgtcgagttttgttctaagggtgaatagaggagagtgtggtgtctactgctgatggcaaatgaaacagaatgttgtgtctcacrttaaaagttaatggaatagtcagtgtcatgaaaaacaaaaaacagctgggagactgttctaggttaaaagagacaaaatagagcaactgtgtgcaatatgaattggatccttgattggatccctcatcatattttctgatgacttttttgacaactgggagaatttaaataaagtttctgtattagatgatattattgaattatttcaaattgaattatttctaactcaataataaccattgagttaatgttaatttttaaagatgtgataatgtcattgtgattctccttccttatttt

SEQ ID NO: 164198 - DNA, 601 bp, Human
taaaccataggtagagaagaatgtggcatcaactattaatagtgagtggagcagaatgttgaatctaacataaggaaaagaaagcagaacattatgtctgctgctacaattgcacacagcagaatgtgttgtcaggtgttaatagtgatcagagaatgtggattcaagcatttgtagtgaatgtagcagaatttgaggtctagtgtgaatgctgcagagagcatattgtcgagttttgttctaagggtgaatagaggagagtgtggtgtctactgctgatggcaaatgaaacagaatgttstgtctcacgttaaaagttaatggaatagtcagtgtcatgaaaaacaaaaaacagctgggagactgttctaggttaaaagagacaaaatagagcaactgtgtgcaatatgaattggatccttgattggatccctcatcatattttctgatgacttttttgacaactgggagaatttaaataaagtttctgtattagatgatattattgaattatttcaaattgaattatttctaactcaataataaccattgagttaatgttaatttttaaagatgtgataatgtcattgtgattctcctt

SEQ ID NO: 164199 - DNA, 601 bp, Human
tcgttagcaaaatgcaaatcaaaaccacaatgcaataccatttcacacccactaaatggctatagttaaaaaaaacagataataatatatgtttgtgaagatgtgcagacgttggaaccctggtgggatcataaaatggtatagctgctttggaaaacagtttggcagttcctcaaaaagttaagcatgtagttaacatgtgacacaacagtttcacttctagatatatacctttgagaattaaaaacatgtccacacaaaaacttgtacacagatgttcacagcagcattatttataatagccaaagtgaaaataaaccaaatgcctaactgctgaatggataacaaaatgtgatatatctataccatggaatattattcagccataaaaaggaatgaagtactgatgcattctacagcatggatgaaccttgaaaacattacactaaatgaaagaagccaatcgtaaaaggccacatattgtatgattccatttatacgagatgtccagaaaaggcaaatttatacaggtagttaagtatccatttattgttaccagaggctcttgggagtggggaatgaggagtgactgttggagggt

SEQ ID NO: 164200 - DNA, 534 bp, Human
gatggaattggaagacataatattgttaagatggcaatactcccctgattggtccatggagtcaatgcattctttattaaaactccagctatttttttcatttcaaaaattgacaagctgcttctaaattttttttttttttttttttttgagatggagtctcactctctctcccaggctggagtgcaatggtgcgatctcagctcactgcaagctctgcctcccgggttcacgccattctcctgcctcagcctcctgagtagctgggactacaggcacctgccaccatgcctggctaatwtttttgtatttttagtagagacgaggtttcaccatgttagtcaggatggtctagatctcctgaccttgtgatctgcccacctcagcctcccaaagtgctgggattacaggtgtgagccaccatgcctggccgctgcttctaaaatttatatttgtgttcaaatgaaaaagacagagagtagccaaaacaattcttgaaaaagtagaacaaagttggaggactcacacttccaa

SEQ ID NO: 164201 - DNA, 601 bp, Human
aattcaatttatatagcataaaagaatatatctgtacaacacctgttatataatttaacaaaataagtgcaagacttgtacactgaaaactagaaatcttttttgaaagaaattaaagatgacctaaataaatgagaagaaatcccatgttgatggaattggaagacataatattgttaagatggcaatactcccctgattggtccatggagtcaatgcattctttattaaaactccagctatttttttcatttcaaaaattgacaagctgcttctaaattttttttttttttttttttttgagatggagtctcactctctctcccaggctggagtgcaatggtgcgatctcagctcactgcaagctctgcctcccgggttcacgccattctcctgcctcagcctcctgagtagctgggactacaggcacctgccaccatgcctggctaatatttttgtatttttagtagagacgaggtttcaccatgttagtcaggatggtctagatctcctgaccttgtgatctgcccacctcagcctcccaaagtgctgggattacaggtgtgagccaccatgcctggccgctgcttctaaaatttat

SEQ ID NO: 164202 - DNA, 601 bp, Human
acctagagttaataaatgagttcaggaaagttattggatacaagatgaacatacaaaaatcaattgtatttctatagactagaatgaataatttaaaaattaaacttaaaaacaattcaatttatatagcataaaagaatatatctgtacaacacctgttatataatttaacaaaataagtgcaagacttgtacactgaaaactagaaatcttttttgaaagaaattaaagatgacctaaataaatgagaagaaatcccatgttgatggaattggaagacataatattgttaagatggcartactcccctgattggtccatggagtcaatgcattctttattaaaactccagctatttttttcatttcaaaaattgacaagctgcttctaaattttttttttttttttttttttgagatggagtctcactctctctcccaggctggagtgcaatggtgcgatctcagctcactgcaagctctgcctcccgggttcacgccattctcctgcctcagcctcctgagtagctgggactacaggcacctgccaccatgcctggctaatatttttgtatttttagtagagacgaggtttcaccatg

SEQ ID NO: 164203 - DNA, 601 bp, Human
tatttgtacatcacatggtcttgtataaagaaaatcctaaggatgtataaaagacctagagttaataaatgagttcaggaaagttattggatacaagatgaacatacaaaaatcaattgtatttctatagactagaatgaataatttaaaaattaaacttaaaaacaattcaatttatatagcataaaagaatatatctgtacaacacctgttatataatttaacaaaataagtgcaagacttgtacactgaaaactagaaatcttttttgaaagaaattaaagatgacctaaataaatgrgaagaaatcccatgttgatggaattggaagacataatattgttaagatggcaatactcccctgattggtccatggagtcaatgcattctttattaaaactccagctatttttttcatttcaaaaattgacaagctgcttctaaattttttttttttttttttttttgagatggagtctcactctctctcccaggctggagtgcaatggtgcgatctcagctcactgcaagctctgcctcccgggttcacgccattctcctgcctcagcctcctgagtagctgggactacaggcacctgcc

SEQ ID NO: 164204 - DNA, 601 bp, Human
ggataaaagtagaagaatggaaaaaacataccatgtaaacagtaaccaaaagaggcctttaggtgattataccaacatcagaaaaaaaaaaaacccacaaacaaaccagtctttaagaaaaaaaaattgttaataagagatgaagagcatttgataataaatgagtcaatccatcaagaaatataacaattataaacatctatgcatctaacaacagagccccaaaatatatgaagcaaaactgcctgaattgaagcaataaatagataattcaacaataatacttggtgtcttcaaaacyctgctttttataatgaatagaataattagaagattgccaaggaaatgaaaaacttaattgacactgtaaaccaactagacctaaagaacacctatagaacactccacacagtaacagaagaatgtacattcttctgaagtgcaccatggagtattttcagaataaaccatactattatgcataaaacaagtctcaaacttaaaatagttgaaatcatacaaaatatgttttctgatttcaatggaatattaaaaatcaataaccaaaagaaagttggaaaactcacaacaataaattaaa

SEQ ID NO: 164205 - DNA, 601 bp, Human
atagcatattaataaagagaaatgatagcctgtaatcccagcactttgggaggctgaggcaggtagatcacctcaggtcaggagtttgagaccagcctggccaacatggtgaaacctcgtctctactaaaaatagaaaaaattagccaggtgtggtggtgcatgcctgtaatcccagctactcgggaggctaagattggagaattgcttgaacacaggaggcagagattgtagtgagccgagatcgtatcaccgcactctagcctgggcaacagagtgagagtccttctcaaaaaaagaartgataaagaagaaccaaatagaaattctggagttgaaaagtaaaataactgaaatgaaaacttcactagatggaatcaacagtagatttaagaagacagaagaatcaggaaacttaaagaagaatcagtgaattttagattatatggtctgaggaacagaatgaagaaaaataaacagccccagaaacctgtgggaaaccatgtaatgcaccaacataatgtttaataggaatttgcagtggagacagaaagaatatttaaaaaaatagtgcctgaaaacttatcaaatttgattaaaaa

SEQ ID NO: 164206 - DNA, 601 bp, Human
gatgctggacttaatagacaaagactttaaatcagttattttaagtatgttcaacaaactagaggaaactatgtctaaacaactaaaggaaaatatgagagcagtgtctcaccaaatatagcatattaataaagagaaatgatagcctgtaatcccagcactttgggaggctgaggcaggtagatcacctcaggtcaggagtttgagaccagcctggccaacatggtgaaacctcgtctctactaaaaatagaaaaaattagccaggtgtggtggtgcatgcctgtaatcccagctactcrggaggctaagattggagaattgcttgaacacaggaggcagagattgtagtgagccgagatcgtatcaccgcactctagcctgggcaacagagtgagagtccttctcaaaaaaagaaatgataaagaagaaccaaatagaaattctggagttgaaaagtaaaataactgaaatgaaaacttcactagatggaatcaacagtagatttaagaagacagaagaatcaggaaacttaaagaagaatcagtgaattttagattatatggtctgaggaacagaatgaagaaaaataaacagcccca

SEQ ID NO: 164207 - DNA, 601 bp, Human
aaagaacttaaacaaatttataagaaaaacaaccccatcaaaaagtgggcaaaggatatgaacagacacttctcaaaagaagacatttatgcagtcaacaaacatatgaaaacaagctcatcaccactggtcattagagcaatgcaaataaaaaccacaatgagataccatgtcatgccagttagaatggccatcattaaaaagttaggaaataacagatgctggagaggatgtggagaaataggaatgcttttacactgttggtgagaatgtaaattagttcaaccattgtggaagacastgtggcaattcctgaaggatctagaactagaaatataatttgacccagcaatcccaatactgggtatatacccaaaggattataaatcattctactataaagacacatgcacacgtatgtttattgcagcactgttcacaatagcaaagccttggaaccaacccaaatggccaccaatgatagactgataaagaaaatgtgtcacatatacactatggaatactatgcagccataaaaaggatgagttcatgtcctttgtggggacatggatgaagctggaaaccattattctcggcaaa

SEQ ID NO: 164208 - DNA, 601 bp, Human
cggtctgcagctcccagcaagatcaatgcagaaggcgagtgatttctgcatttctaactgaggtacccagctcatctcactgggactggttagacagtgggtgcagcccacagaaggtgagctgaagcagagtggggtgtcacctcacccagaaagcacaaggggttggggatctccctcccctggccaagggaagccctgaggggctgtgtcatgagggatggtgcactccggccccagatactactcttttcccagtgtctttgcaacccgcagaaaaggagattccctcgggtgcctrtgccaccagggccctggttttcaagcacaaaactgggcagctgtttggacagacaccgagctagctgcagttttgttttttcataccccagtggcacctggaaccccagcaagacagaaccattcactcccctggaaagggggctgaagccagggagccaagtgatttagctcagcagatcccatccccacggagcccagcaagctaagatccactggcttgaaattctcgctgccagcacagcagtctgaagttgacctggaacacttgagcttggtggggggaggagtgtccaccatt

SEQ ID NO: 164209 - DNA, 601 bp, Human
aacagctccggtctgcagctcccagcaagatcaatgcagaaggcgagtgatttctgcatttctaactgaggtacccagctcatctcactgggactggttagacagtgggtgcagcccacagaaggtgagctgaagcagagtggggtgtcacctcacccagaaagcacaaggggttggggatctccctcccctggccaagggaagccctgaggggctgtgtcatgagggatggtgcactccggccccagatactactcttttcccagtgtctttgcaacccgcagaaaaggagattccctcrggtgcctgtgccaccagggccctggttttcaagcacaaaactgggcagctgtttggacagacaccgagctagctgcagttttgttttttcataccccagtggcacctggaaccccagcaagacagaaccattcactcccctggaaagggggctgaagccagggagccaagtgatttagctcagcagatcccatccccacggagcccagcaagctaagatccactggcttgaaattctcgctgccagcacagcagtctgaagttgacctggaacacttgagcttggtggggggaggagtgt

SEQ ID NO: 164210 - DNA, 601 bp, Human
tttcatttcccttggagctttgtggtgttttgccctattcctgtcataatctatccagctccatagtagcattgaaaaccaacagctgtctggaagccattggatggagcagaacacagttggagcttcttcaatgcctcattcccagagagttatcatcatttgatatatctcatggttccctcaaagatgccactcacaaggctgtctttgacctgatttgaagtttgccccgtgtgaacaaccttttctttgaggacatttttcaaaagcaatcaatagtaattgccacctgaggcakttggggcaaaataataggttaatcaaaaagctgaaaaagaaaagctgggtaatgagttgtttatagggggctttggaaagctgtgacatattcttgggaaactgtgtgcaagcttagagctgtgtgaattcccgggaagacttgagatggctctaggctctcacctttggctaaccttgatagtctgagcaagcaggaagtggagcctgagtcaaagttgtaaactgcctcacagaatgtttaaggtagagagccccttggcaaaggctaggagacttatagtttccaggcatttaggaa

SEQ ID NO: 164211 - DNA, 601 bp, Human
tgctataaacaaccatgtacaagtttctgcacagacatgtattttcatttcccttggagctttgtggtgttttgccctattcctgtcataatctatccagctccatagtagcattgaaaaccaacagctgtctggaagccattggatggagcagaacacagttggagcttcttcaatgcctcattcccagagagttatcatcatttgatatatctcatggttccctcaaagatgccactcacaaggctgtctttgacctgatttgaagtttgccccgtgtgaacaaccttttctttgaggrcatttttcaaaagcaatcaatagtaattgccacctgaggcagttggggcaaaataataggttaatcaaaaagctgaaaaagaaaagctgggtaatgagttgtttatagggggctttggaaagctgtgacatattcttgggaaactgtgtgcaagcttagagctgtgtgaattcccgggaagacttgagatggctctaggctctcacctttggctaaccttgatagtctgagcaagcaggaagtggagcctgagtcaaagttgtaaactgcctcacagaatgtttaaggtagagagcccct

SEQ ID NO: 164212 - DNA, 601 bp, Human
aactgccatccaaatgtcaatggctttcacataggacacctagagtgggggtggaggagaaacagggaggtgaaagcaggggaatgtaaaacattaagcatggcggaatattttctgctcttcggtaattccccacatcacccactgctgtctgcttctcagctgggatattagggtggaggtatagaggaaaacagaaaagaaatgcatcagacagactggaaagaatattgggggtaaatagattatggtacctatgacagtactgaagagaagacaatggtatatttagcattatcayttagaacagaatgctgtctttcatttaagggtgattggaacaaactgttgtagtgagcattaaaagtgaatggaggatgtcagcaaaaatggcatcgtaaggacctgaaaattcctccaaaaaattaatgagaacactggaaaaaattgtcagtgccaactttcagaactccactaattaccaaaggcttatatcagtcctgtgaacatttattcaagaaaatcagctgaatcttaataagaacagcaagctttgtggcagtgtttaaaagtgttattgagatataattcacataccata

SEQ ID NO: 164213 - DNA, 601 bp, Human; identical to SEQ ID NO: 18141

SEQ ID NO: 164214 - DNA, 601 bp, Human; identical to SEQ ID NO: 18142

SEQ ID NO: 164215 - DNA, 601 bp, Human; identical to SEQ ID NO: 18143

SEQ ID NO: 164216 - DNA, 601 bp, Human; identical to SEQ ID NO: 18144

SEQ ID NO: 164217 - DNA, 601 bp, Human; identical to SEQ ID NO: 18145

SEQ ID NO: 164218 - DNA, 601 bp, Human; identical to SEQ ID NO: 18146

SEQ ID NO: 164219 - DNA, 601 bp, Human
ctgcaggaagaggaaatggggtatggggagaggaagcacagaccctcccagttacagcaagaaagagttcaggctctaaattactactcacaaccacccttgccctttcctctagagcagggatcggcaaacttcttctgtaacaggccagaaagcaaatgttttaggcattgtgggtcacatatagactctgttgtatattctgtgtattttttttataactctattcctgaacatacaaaaacaggctgtgagcaggatttggcccatgtgctgatctctgttctatactagggctttstgagacagagactcactctgttgcccaggctggagtgcagtggcatgatctcagctcactgcaacctccacctcctgggttcaagtgattgtcatgcctcagcctttggagcagctgggattacaggcgtatgccaccacacctggttaatttttgtatttttagtagagacagggttttgtcatgttgcccaggctggtctcaaactcctaatctcaagtgatctgcccgccttggcctcccaaagtgctgggagtataggcatgagccaccgtgcccagccaccttttttttttaatt

SEQ ID NO: 164220 - DNA, 601 bp, Human
tctagtatgactacacataggaaatggggaacagtgaaagttccaccttggatttttgcccgtaatcagtaacattttctcctcctggtcagagaggccacttgtacacacagtatactcctcagtggctgtgaggaaggccacagctaggacttctctgagggtactgatcctataacatcctgtgctcttcagaaactgtgaatatcctataagcccaggttcactgggggcagtcatgatgtcaaggatggatggagttttattattactgaattcaaccattccgtaaggggaacakgaggcccaaagacctcacagacagcttctgtctgtgcattctgtggccagtagttctgggttggagtaagggacaacggggcccagtcccatgattttcttcaagatccccaagtttcttctccctgccaatcccatcgtcacactgactgcatggctttctccaacgccagccaacagacagcaccctcaggcaaaccccaacagagtagagtggggttttttgttttttgagacttgctctgtagcccaggctggagtgcagtggcatgatctcagctcatcacagcctcaatctcct

SEQ ID NO: 164221 - DNA, 601 bp, Human
actgcctgtcacacctccggcagacaggttcccggctgcgggaacccaggatcaaggcaggggacagcagagaagggactttccaccctgaaatattcagcaggtcctggtgccagctggtgagcagccgggccctggggctctgtggggctgggccccacccaggctgctgctggagcaggagtcctagtggcctcttgggagcagagatgatgtccccagagagacaggtacatggccaggactccagctgagagctgccttggccggtgctgacctaggtctcacctccacagctccyagaagtcccaggcacaagcacctgcctatcctgccctgtcctcaaggtgtttttatgttcattattgcattcaaacccagaacgtccctgtgaaatggaggccacagcgccatgcctcctgggtcttccatggcaccatcctacttcttcatgtctttgggcctcaagttctcctcttccaaaaggagagatagggagaacagcacaataaccacagtggaaggaactggggggtgtctaggccagagaagagggagcagtttgctgtgtgcatgcacacgtgtgtatacatgcatgcat

SEQ ID NO: 164222 - DNA, 601 bp, Human
agaaggctttctggaggtgacgtctaagctgagtcctgagggatgagcaacaggctggccccaaggagtagagtagggaggggaaggcgaagaggaagaaggcatcacacagaggagacacatgacaaagacctggagggaagcaaggggcattcgggaaagccagcccagagtctgcagggctcagagcagatgctggctgtcactaagatcatccactagaagcggggaaggcaaagagatgaggctggagaagatgatggggataaacaattcagactcttgtaagggcagctctagycctgctgggctggcctgggcacaacacctaagtcaggacctgggtaagggcaagactctaacatcctagtgtggttttccttacccattaaactcagctgaccactcacaaccctgtccctagtatctggcattctttactacgttgagccatgtaacttgccttgtatgtagattaaaaacagtcaaatagcagcagatttcatatggttcatgtgacaggtatttcatacaaatacctgtctggttgatatgtgggatctagaaactattttaacttgtctgctggggcaggggtgtg

SEQ ID NO: 164223 - DNA, 601 bp, Human
aggtgcctgggcacagtggctcatgcctgtaatcccagcactttgggaggctagacgggagaccacttgaggtagggagtcagagaccagcctggccaatgtaatgaaaccctgtttcagctaaaaatacaaaaattagccaggcatggtggcaggcacctgtaatctcagctactcaggaggctgggtcaggagaatcacttgaacctgggaggcagaggttgtagtgagctcagatcgcatcactgcattccagcctgggcgacagaatgagactgactctgtctcaaaaaaaaaaaaaggaaacaagaaggttcagaggctcaaaattatttctttgcaacgatccttaaagaccttttagttcagcttcccactcagttattgagtccatggagaatggagactgtcgtgaataagacaaatcattctgcctaagaagaaccgtggagccccagctctagcacaggcttggcatacaggctggaagtaactgtgactgggctaaatgaatggatggagacacccatgacggcccaagctctgagatggaggacgccgaaggggaagacagtgaagggagacctccctggcactggat

SEQ ID NO: 164224 - DNA, 601 bp, Human
agagattgaccaaatactcaagtatttgccacatgaataaaatgaacaagaacacgaaacaactggggtcctccaggaatttcacttctaaatccttttctctttctttctggacacctccagtccagcgatatcaaaaaagcacagcaggcaatattagctactaggatggatggagaaacaagaggtgcctgggcacagtggctcatgcctgtaatcccagcactttgggaggctagacgggagaccacttgaggtagggagtcagagaccagcctggccaatgtaatgaaaccctgtytcagctaaaaatacaaaaattagccaggcatggtggcaggcacctgtaatctcagctactcaggaggctgggtcaggagaatcacttgaacctgggaggcagaggttgtagtgagctcagatcgcatcactgcattccagcctgggcgacagaatgagactgactctgtctcaaaaaaaaaaaaaggaaacaagaaggttcagaggctcaaaattatttctttgcaacgatccttaaagaccttttagttcagcttcccactcagttattgagtccatggagaatggagactgtcgtgaa

SEQ ID NO: 164225 - DNA, 601 bp, Human
ctgccttctccaccccggtgggcagtttgatccagaaacctctgagagcagataccagatccatctgcccactgcacagagattgaccaaatactcaagtatttgccacatgaataaaatgaacaagaacacgaaacaactggggtcctccaggaatttcacttctaaatccttttctctttctttctggacacctccagtccagcgatatcaaaaaagcacagcaggcaatattagctactaggatggatggagaaacaagaggtgcctgggcacagtggctcatgcctgtaatcccagyactttgggaggctagacgggagaccacttgaggtagggagtcagagaccagcctggccaatgtaatgaaaccctgtttcagctaaaaatacaaaaattagccaggcatggtggcaggcacctgtaatctcagctactcaggaggctgggtcaggagaatcacttgaacctgggaggcagaggttgtagtgagctcagatcgcatcactgcattccagcctgggcgacagaatgagactgactctgtctcaaaaaaaaaaaaaggaaacaagaaggttcagaggctcaaaattatttcttt

SEQ ID NO: 164226 - DNA, 601 bp, Human
cctgcaacctgatcacgcccctgggcagagacttaaagagtaacacatgccgaatacccagagcagggcgccttgcaaggagctcagtgagcgcaggatgggggctttactgccagcgctccccttggccttacttcagacctcacggccggagcttgagaaattcctgctgccttctccaccccggtgggcagtttgatccagaaacctctgagagcagataccagatccatctgcccactgcacagagattgaccaaatactcaagtatttgccacatgaataaaatgaacaagaacaygaaacaactggggtcctccaggaatttcacttctaaatccttttctctttctttctggacacctccagtccagcgatatcaaaaaagcacagcaggcaatattagctactaggatggatggagaaacaagaggtgcctgggcacagtggctcatgcctgtaatcccagcactttgggaggctagacgggagaccacttgaggtagggagtcagagaccagcctggccaatgtaatgaaaccctgtttcagctaaaaatacaaaaattagccaggcatggtggcaggcacctgtaatctca

SEQ ID NO: 164227 - DNA, 601 bp, Human
gtctctgtctgcagaggctggctcctctgaggtatgcatgcgtcggcgtggagttactatttaaagttctgaccagaaaggaacacagctctcttcctgccacctgggaatcccctgcaacctgatcacgcccctgggcagagacttaaagagtaacacatgccgaatacccagagcagggcgccttgcaaggagctcagtgagcgcaggatgggggctttactgccagcgctccccttggccttacttcagacctcacggccggagcttgagaaattcctgctgccttctccaccccggygggcagtttgatccagaaacctctgagagcagataccagatccatctgcccactgcacagagattgaccaaatactcaagtatttgccacatgaataaaatgaacaagaacacgaaacaactggggtcctccaggaatttcacttctaaatccttttctctttctttctggacacctccagtccagcgatatcaaaaaagcacagcaggcaatattagctactaggatggatggagaaacaagaggtgcctgggcacagtggctcatgcctgtaatcccagcactttgggaggctagacg

SEQ ID NO: 164228 - DNA, 601 bp, Human
gcctccccctctccccgtctccgtgcctcccaacgtctgcactgcaggaccccggccaggcctctggatgctctctggtctctgtctgcagaggctggctcctctgaggtatgcatgcgtcggcgtggagttactatttaaagttctgaccagaaaggaacacagctctcttcctgccacctgggaatcccctgcaacctgatcacgcccctgggcagagacttaaagagtaacacatgccgaatacccagagcagggcgccttgcaaggagctcagtgagcgcaggatgggggctttacygccagcgctccccttggccttacttcagacctcacggccggagcttgagaaattcctgctgccttctccaccccggtgggcagtttgatccagaaacctctgagagcagataccagatccatctgcccactgcacagagattgaccaaatactcaagtatttgccacatgaataaaatgaacaagaacacgaaacaactggggtcctccaggaatttcacttctaaatccttttctctttctttctggacacctccagtccagcgatatcaaaaaagcacagcaggcaatattagctact

SEQ ID NO: 164229 - DNA, 601 bp, Human
caggaaattaaggcccagagaggggcaagaacttgtccaaggtctcacaatgaacctggcttagaaaacccaggtatcctaacacccagtacagggttctttccaccacaagacaaagaagaacataagcaccaccttcggattgtggctgcctctgggcaaaggcagcgggcggcattatcaggagggggatctaccaaggaaacttcaactatgctaatgaagcactagttcttaaatttggtggtaaatctatgggtgaaatttctattattctttatactttttttctgaaacatttattataacatcatgaaaattaataaaaagaggagaccaaaaaaatgaataagtgcacttcaccatttcacagaccctaccaccaccaccagaagggctctgggctgtgtctacatttgggggatacccctcaagctcccatgaagcctggcacccaccaaagcccttcatggcagtgtacagagcctcggcatcctggttggggtcaaagcctgggaagtcatggatggagccccggtacttggcaccctgtggagaaaaaagtagagggtgagctgccaaccccggactgagaccaagc

SEQ ID NO: 164230 - DNA, 601 bp, Human
ttcttaccgagatggcatctttaatttctttggcatcacaataggcaggtggcctcatcaggcccacaatcaaccgttcaaacttgcccgtcaattcatactttaaatcagcaatgaggtcctggcaggtggggaagaagaggagatagaagaggaaagaggaagagtagttacaacggtaagaattacacttaatgagcacttactctggcaggtgctgggctaagtaatctcattaaatcatcacccttggaggtatgtactgttaccaaccctaagagacaggctcagaaacaacagrggtcttactccatgtcatgctgctagcaaacggctatgcagggtcaggtccacagccctgtgccacttccccaccactgtctgtttcctcgtttactgtgtatctctctcactatctggcagtccacagagttgacacctcacccatcttattcactagtgcagccctaacacctagcacgagcccagcatacagcaggtgctgtgggtgtattaaaggctgaaagacgcccagctgatgagaagaaaaagagcagggtaaggtgtcagcccacaggctaacctggagtgccatatccag

SEQ ID NO: 164231 - DNA, 601 bp, Human
tgtctgcatctctctgtgtgcggatcgggatgctcctctgggataaatttagatgtgtctttgaagcaggacacatgtgctgggtgggtatggggctcaccagttgcttttggaagagcccagaatcttcccattaaccacatccccaccccaacaccacatacacccccacttcttaccgagatggcatctttaatttctttggcatcacaataggcaggtggcctcatcaggcccacaatcaaccgttcaaacttgcccgtcaattcatactttaaatcagcaatgaggtcctggcaggtggggaagaagaggagatagaagaggaaagaggaagagtagttacaacggtaagaattacacttaatgagcacttactctggcaggtgctgggctaagtaatctcattaaatcatcacccttggaggtatgtactgttaccaaccctaagagacaggctcagaaacaacagaggtcttactccatgtcatgctgctagcaaacggctatgcagggtcaggtccacagccctgtgccacttccccaccactgtctgtttcctcgtttactgtgtatctctctcactatctggcagtccaca

SEQ ID NO: 164232 - DNA, 601 bp, Human
atctgtctgcatctctctgtgtgcggatcgggatgctcctctgggataaatttagatgtgtctttgaagcaggacacatgtgctgggtgggtatggggctcaccagttgcttttggaagagcccagaatcttcccattaaccacatccccaccccaacaccacatacacccccacttcttaccgagatggcatctttaatttctttggcatcacaataggcaggtggcctcatcaggcccacaatcaaccgttcaaacttgcccgtcaattcatactttaaatcagcaatgaggtcctgggaggtggggaagaagaggagatagaagaggaaagaggaagagtagttacaacggtaagaattacacttaatgagcacttactctggcaggtgctgggctaagtaatctcattaaatcatcacccttggaggtatgtactgttaccaaccctaagagacaggctcagaaacaacagaggtcttactccatgtcatgctgctagcaaacggctatgcagggtcaggtccacagccctgtgccacttccccaccactgtctgtttcctcgtttactgtgtatctctctcactatctggcagtcc

SEQ ID NO: 164233 - DNA, 601 bp, Human
actttatagactgtaaagtgctagatacacttaaagggctttgcctctctttttcctagggggcaattctctacctctacctcaaccgggctgaactactcttcataccctaaacacagatccacaacttctcctgccatttttacaccctgcaatgaccttgacactgctatccaccaaatcctctctgggctttggggcttaacttgatcctattatccttcaagatgccctctcaaacaacccttggcccagggtcatgttgattacctttagtgtgcccttggcctcaggagtgttrgacacaatttgtctccatgtccctataacctgtatccttggactacaagctcctggtaagggggtctgcatcatgttgacatctgtctgcatctctctgtgtgcggatcgggatgctcctctgggataaatttagatgtgtctttgaagcaggacacatgtgctgggtgggtatggggctcaccagttgcttttggaagagcccagaatcttcccattaaccacatccccaccccaacaccacatacacccccacttcttaccgagatggcatctttaatttctttggcatcacaatagg

SEQ ID NO: 164234 - DNA, 601 bp, Human
gaattcatgcttaatagctcatagaagacaaagatcatagcactttatagactgtaaagtgctagatacacttaaagggctttgcctctctttttcctagggggcaattctctacctctacctcaaccgggctgaactactcttcataccctaaacacagatccacaacttctcctgccatttttacaccctgcaatgaccttgacactgctatccaccaaatcctctctgggctttggggcttaacttgatcctattatccttcaagatgccctctcaaacaacccttggcccagggtcrtgttgattacctttagtgtgcccttggcctcaggagtgttggacacaatttgtctccatgtccctataacctgtatccttggactacaagctcctggtaagggggtctgcatcatgttgacatctgtctgcatctctctgtgtgcggatcgggatgctcctctgggataaatttagatgtgtctttgaagcaggacacatgtgctgggtgggtatggggctcaccagttgcttttggaagagcccagaatcttcccattaaccacatccccaccccaacaccacatacacccccacttct

SEQ ID NO: 164235 - DNA, 601 bp, Human
agagggacccctttggttttatcccgagaacctagcacatcacccagcacagagcaagtacttattgggtagataaatgggtggacaaatggatcagaggaaaggaggagagaaggtagatggctagaatcttagtgtccccactgttgcaatcatcctcattttgtatctgaagatcctaagcggcccctcctgcccatctcaccatctttgtatgctgccaccagctggtgcatctgctcattggtccgggaagccaagatctcaatgaggcacttctcatcagtgccaatgccctggsggtagaaaaagagcgcatgaattaagggcagggatgggaggtcactggacacaggttgggatcagggagtggccagagctatgacaccccaggactcaggaggttcctacccagctcttaggcactgattgggaactgctgccttgagactcataagacatggtcatatgatttggatgtgtttccccaccaaatctcatgtcgaatcgtagacctgaatgttggaagtggggcctggtgggaggtggttggatcatgggggcggtttctcatgaatagttagcaccatctccttgctac

SEQ ID NO: 164236 - DNA, 601 bp, Human
gttaccttatttcctgtacaacacttagctaaaatccatcatcactgtgtttatctgttcacctgtttattgtgtgtctccttcattatctcattatctcattggcctaagagagagggacccctttggttttatcccgagaacctagcacatcacccagcacagagcaagtacttattgggtagataaatgggtggacaaatggatcagaggaaaggaggagagaaggtagatggctagaatcttagtgtccccactgttgcaatcatcctcattttgtatctgaagatcctaagcggcycctcctgcccatctcaccatctttgtatgctgccaccagctggtgcatctgctcattggtccgggaagccaagatctcaatgaggcacttctcatcagtgccaatgccctgggggtagaaaaagagcgcatgaattaagggcagggatgggaggtcactggacacaggttgggatcagggagtggccagagctatgacaccccaggactcaggaggttcctacccagctcttaggcactgattgggaactgctgccttgagactcataagacatggtcatatgatttggatgtgtttccc

SEQ ID NO: 164237 - DNA, 601 bp, Human
tggctgtcttaaaacccatatctgatcatcatactccccaacttctcattagactcagaataaaacaccatctctctcttggcctgcaggccctgtgtgatcctgccctgtcctctacctgtctagccttgtaccggctaccaggctcatttctatttcagggcctttgcacttgccgtgacctctgttggaaggatcttctctccattctttatacgattggttcctcatttcctcccaagacctcactggtaaaagtttgattcttgttaccttatttcctgtacaacacttagctaaratccatcatcactgtgtttatctgttcacctgtttattgtgtgtctccttcattatctcattatctcattggcctaagagagagggacccctttggttttatcccgagaacctagcacatcacccagcacagagcaagtacttattgggtagataaatgggtggacaaatggatcagaggaaaggaggagagaaggtagatggctagaatcttagtgtccccactgttgcaatcatcctcattttgtatctgaagatcctaagcggcccctcctgcccatctcaccatctttgtatgctg

SEQ ID NO: 164238 - DNA, 601 bp, Human
cacggcaacaaggatggctgtcttaaaacccatatctgatcatcatactccccaacttctcattagactcagaataaaacaccatctctctcttggcctgcaggccctgtgtgatcctgccctgtcctctacctgtctagccttgtaccggctaccaggctcatttctatttcagggcctttgcacttgccgtgacctctgttggaaggatcttctctccattctttatacgattggttcctcatttcctcccaagacctcactggtaaaagtttgattcttgttaccttatttcctgtayaacacttagctaaaatccatcatcactgtgtttatctgttcacctgtttattgtgtgtctccttcattatctcattatctcattggcctaagagagagggacccctttggttttatcccgagaacctagcacatcacccagcacagagcaagtacttattgggtagataaatgggtggacaaatggatcagaggaaaggaggagagaaggtagatggctagaatcttagtgtccccactgttgcaatcatcctcattttgtatctgaagatcctaagcggcccctcctgcccatctcacc

SEQ ID NO: 164239 - DNA, 601 bp, Human
cccactgcagtcgtgcagaatgcaggtctgctgctaccgcaactttcaatacattaaaataatccagaaatctggtttttgagcaaaatctcacaatttttaaatgttagcaactaactcaaacttgttttgctttctttcttaaaacacattttatgggaaaacaaacaaaaaatccaacttggcaggttgaattcagccacagacaccaatttgtagcctcctaatagtctctttgtgatatactttgggcgggcggtgaggaggcaataaggctcggatgtgggagactccacacagyagccacaggaatgctggggtccagaaatgctgcatgtgcagctgcagaagcaatggcaggaaggaggcccagagaggagcgggaggagcgagtgtggagagaggaagaaaatcacagcagaagacactcctgggcacgagaggactgtgtgccaaagagaaagaggattagccaaatacacctgcctgtgcaaaccaggggaagctgaccagaccctggacattcagatctacacccagatgagccagacaaaagctatcccaagctccagaggaaaaaaataggctgtgaaccaacctg

SEQ ID NO: 164240 - DNA, 601 bp, Human
tcctgatcattccccagctggttaatatgggattgttatggcaatgagaggaacagagttgggaggagctggtataaaagggaaatgggggaacgaggaaacatagtggtggcttaatttatatataaagtttcataaccatttggtccttggagctgagcttgagacatctcaatgcctgttcccatcgtgcctgtggtcacagagatacctacagagccaggtagataacattcacggtgaaacgggcaggacgcatatgctctccagcccactgcagtcgtgcagaatgcaggtctgytgctaccgcaactttcaatacattaaaataatccagaaatctggtttttgagcaaaatctcacaatttttaaatgttagcaactaactcaaacttgttttgctttctttcttaaaacacattttatgggaaaacaaacaaaaaatccaacttggcaggttgaattcagccacagacaccaatttgtagcctcctaatagtctctttgtgatatactttgggcgggcggtgaggaggcaataaggctcggatgtgggagactccacacagcagccacaggaatgctggggtccagaaatgc

SEQ ID NO: 164241 - DNA, 601 bp, Human
ccaggatctcaaacccccagggttctctttgggactgagcagaagacagagctggcaagcttacaatgtgtgccgcgctgctgcttggtgtcaaaccttgaggatacaaaacgcttgactccaagatacagggataggacactcctctccagaacaagcagctttgaaaatggggcacaggtcacactgtcccactcctgaggtttctcctgatcattccccagctggttaatatgggattgttatggcaatgagaggaacagagttgggaggagctggtataaaagggaaatgggggaamgaggaaacatagtggtggcttaatttatatataaagtttcataaccatttggtccttggagctgagcttgagacatctcaatgcctgttcccatcgtgcctgtggtcacagagatacctacagagccaggtagataacattcacggtgaaacgggcaggacgcatatgctctccagcccactgcagtcgtgcagaatgcaggtctgctgctaccgcaactttcaatacattaaaataatccagaaatctggtttttgagcaaaatctcacaatttttaaatgttagcaactaactcaaac

SEQ ID NO: 164242 - DNA, 601 bp, Human
agcctactacacacccagactccgtggtatagcctattgctcctaggcggcacacctacctgttcagcgtgttatcttaccgaatactgtaggcaactgcaacacaatggcaagaatttgtgtatccaaacagaaataatcatagaaaaggcacagtgaaaatatggggttataatcttataggactagcatcacatatctggtccataatcttatgggactagcatcatatatgtggtccatcattaaccaaaacaccattatgtggtacatgactatacctatatgcctttcttccttwctttctggagaaactcctactcaaccttcaaggcccagattaagtattccatttttttctcaaagtacttcccgatgcccccaggcacagttctatttccctcctttcctccctctcctaggctcccatagctttctacttctttatcactttgatctactgtatatgataatgatttcttcacctgtctatctccacactattgcatgagctcctcaacaacagggactatgtcatagcattctctgtatcagcccctgtagtgctgctggcatgtactgggtactcaaaacacctgca

SEQ ID NO: 164243 - DNA, 601 bp, Human
gaactgctgcctgatccctgaacacacgagtaattggtagcctgaagacctttgcaaataaaacagtcatgcatcatttaatgatggggatacattctgagaactgccattgttaggcgactttgccattgtgtgatcatagagcacttgcacacacctagatggcatagcctactacacacccagactccgtggtatagcctattgctcctaggcggcacacctacctgttcagcgtgttatcttaccgaatactgtaggcaactgcaacacaatggcaagaatttgtgtatccaaacakaaataatcatagaaaaggcacagtgaaaatatggggttataatcttataggactagcatcacatatctggtccataatcttatgggactagcatcatatatgtggtccatcattaaccaaaacaccattatgtggtacatgactatacctatatgcctttcttccttactttctggagaaactcctactcaaccttcaaggcccagattaagtattccatttttttctcaaagtacttcccgatgcccccaggcacagttctatttccctcctttcctccctctcctaggctcccatagc

SEQ ID NO: 164244 - DNA, 601 bp, Human
agcaaataactgcattcatttcctccagtgcatcacaaaaataccagtttctttgtgcgtcatatgtgtaaaagcctgggaagctttctcagaaacacacccagagtggaactgtcacagggtgagcatcatgagtcttagcaggcaaggccaaagtggtcttgcctacatacgctgtataaaaacattctggttaatacttcttcaaagtccgagccgccaacccatttggctggagggatcaggtgcaggctgccaccctaagttcatctgttgactcatgacgtcaggcaggtatgcrggtggcaggacatgtgaccagcagcattcctggctctacagctcacctgcgacagagcaccttcaccagggtcagtcctgtggccatccctgaagggctctctttggccactggatcccaaggacttgtcaaagactcccaatagtcctctccccaaaccccattcacatcagccccaccacgcaccttcatagccttgaagagcctttcagcaaaatattccggggtgctccggatacacttcactgtgaagagggaggaagaggtagagttattctggctgcctcagaagggggatgg

SEQ ID NO: 164245 - DNA, 601 bp, Human
cttctcatacttggtccggaagatctcccgaatgtcgagcatgtccaactcactacgggagaccatgatgcggatcagggtgttgtcccgagtccccaggccctgcaagacaagtgggtttggggaacatggacttgagaggaggctagagtgctgatagctcccagcttagttgaaaatcctattttcataataaaaagttaaaatttagagcaaaagaagcagacattgccattcccattgaagctctctctatgctcctcttactgttttgtttgtttgtttgtttgtttgtttgttgctgagacagtgtctcactcttgtccaggctggagtgcagtggtacgatctcagctcactacaacctctgccttccagactcaagcaattctcctgcctcagcttcctgagcagctgggagtacaggtacccaccactacgcctggctaatttttgtatttttagtagagatggggttttgccatgttggccaggctggtcttgaactggcctcaagggctgccttggcctcccaaaatgctacgattacacacatgagccaccatgcccggccctctcactgttataaacctcttctctc

SEQ ID NO: 164246 - DNA, 601 bp, Human
cttcaaaatgtgaaaggctgtgagaagttctgaggtaaagaaactggcttatttatctttgcttattgtggtttgttacaaacttattttcccatagaacattttgcacataacacctaaaaaaattaccctttggaaacatactttggagaatacaacttggatctctttctctgtcaccccataaagttttatttcagtcatccaaaaaaaaaaaaaaaaagggaaaacccctagctttacatatgtctcctgataaagcctcaggggccggatgtcccagagtcatcaccaatcaccyggcccaggccaaaggttcccctttaaccctcatttgtgttcttcagtgtttcccagccttcttccaggagactgaactatcactgcccttggggcagagtcctcgcacttaattcagcttgcgtgtccttcatgacccagcccctgcctccttctgtagccttaccactcacaaacacccctaacacttgcttttctgttgaatatccttaaattccttgaatgagccacaaggcaggagctcctggaatgtccaagagactcccacttcctaggacatttccttttcctgggaatagtc

SEQ ID NO: 164247 - DNA, 601 bp, Human
gggcagccttcctggctgcagagtccaagcaggataggatttttccaatccttcagcctcccctttcttccttagaatttgaatggcttctatccaactctcccctctcaaagaggccattgagcaagctatggccatgccagccctgcatctcctcctgcaaagtgcctggatgcatcaggagctcagtaatatctgctgaactgcatcaacccctatggtccttaccaaaggttcacaggaaattcttgcatcccttctgtaattggatctttataagatccagagaaaggaaatcagrgcgcagcctgttccctttctcaaacacaaatctggtcaagtaatgtcccaatttaacattctgggaagaggcccccaggccctcccacttctctgccttatttctctctctagtactccataaatgcatgacttcggacatatgaatgaatcaggccactccttctcactcctcggcttttctataggtgatttcctccacccaaacactgtccccagaccctcttcacctggctcttccccttcctccttgggtctcaccgtgtatctccaaagagtctccccttggtctgggctaggg

SEQ ID NO: 164248 - DNA, 601 bp, Human
tgaatcctaccctgcccccgaggccccctctgcctcttaaagagtcattccccctgaaaaggcagcagaaaagttctgaaataccagaacagagtttcccaaatttcagtcactcctaaaggactttcactattccaaattagcacacacactatgccatctcttaatggttttatgtaattcaacttcttttctgtctacttaaatgcatcaatttttgaagtgcatttaaaattactcccaaaaggcaaggaattgtatccgttttatcctgttacatatcccaggtgcctacaacagygtctgacataataggcacactcaaaaaataattgttaagtggattaatgaggcttggcacaatggctcatgcctgtaatctcagcactttgggaggccaaggcaggaggatcgcttgagcccattggttcaagatgagcccaggcaacatggtgaaaccctgtctctacacaaattagccaggtgtggtggtgtccacctgaggtcccagctacttgggaagctaagtggaaggatcacctgagcctggggaggtggcagtgagccatgatcatgccactgtactccagcctggataaca

SEQ ID NO: 164249 - DNA, 601 bp, Human
aagagaaattggctaggctcccgcctgccacgggatctgcctcggttctagtgccccttggctgcttattccaccggggcatccccaattcttctgaatcctaccctgcccccgaggccccctctgcctcttaaagagtcattccccctgaaaaggcagcagaaaagttctgaaataccagaacagagtttcccaaatttcagtcactcctaaaggactttcactattccaaattagcacacacactatgccatctcttaatggttttatgtaattcaacttcttttctgtctacttaaaygcatcaatttttgaagtgcatttaaaattactcccaaaaggcaaggaattgtatccgttttatcctgttacatatcccaggtgcctacaacagtgtctgacataataggcacactcaaaaaataattgttaagtggattaatgaggcttggcacaatggctcatgcctgtaatctcagcactttgggaggccaaggcaggaggatcgcttgagcccattggttcaagatgagcccaggcaacatggtgaaaccctgtctctacacaaattagccaggtgtggtggtgtccacctgaggtc

SEQ ID NO: 164250 - DNA, 601 bp, Human
gagagagaaagagacagaaagatatagagagagggagagagggactcagggctgggagcagggcaagtcctgatcaagagaaattggctaggctcccgcctgccacgggatctgcctcggttctagtgccccttggctgcttattccaccggggcatccccaattcttctgaatcctaccctgcccccgaggccccctctgcctcttaaagagtcattccccctgaaaaggcagcagaaaagttctgaaataccagaacagagtttcccaaatttcagtcactcctaaaggactttcactrttccaaattagcacacacactatgccatctcttaatggttttatgtaattcaacttcttttctgtctacttaaatgcatcaatttttgaagtgcatttaaaattactcccaaaaggcaaggaattgtatccgttttatcctgttacatatcccaggtgcctacaacagtgtctgacataataggcacactcaaaaaataattgttaagtggattaatgaggcttggcacaatggctcatgcctgtaatctcagcactttgggaggccaaggcaggaggatcgcttgagcccattggttca

SEQ ID NO: 164251 - DNA, 601 bp, Human
ttcccattggtgccaaatataggtctgaaagacctgcccagcagggcacactcccaccacagaatgagggctcttgggttccagggtccacagccctgattttacacatagggaaattcagacccagagtggcggagaggctcacccagagtcacacggtgagtcagcagcagagccagggcaccatgccaattttgtgacctggtactttcttcagtgccaggatactgcttccaggaggctgggggacaccttggtccctggaaagggcttctgccaagttccttatgaaccctctccygcccctcctctctatactctgggagctaggagggtggaaacttgagatcaagccttcctcatcctgcagactctaatttgaaacctcactccatcccctgccagcccacggccaaacccaccacacctgctgccctggagaccaaccctgctcccttcccatcccccataccgagtcccttcatggctttccgcagcgctttggcatctgcgtcagggttgaagtcattggctgggcgcacagttcccttcagctgtgagaagcagaaagagactcagcaggtgtctgaaggcccccctg

SEQ ID NO: 164252 - DNA, 601 bp, Human
gatggcctgtcccaggctggactttctgagcacaggcccagctgatctgaacctgtgggtgcagtactcttcccattggtgccaaatataggtctgaaagacctgcccagcagggcacactcccaccacagaatgagggctcttgggttccagggtccacagccctgattttacacatagggaaattcagacccagagtggcggagaggctcacccagagtcacacggtgagtcagcagcagagccagggcaccatgccaattttgtgacctggtactttcttcagtgccaggatactgcktccaggaggctgggggacaccttggtccctggaaagggcttctgccaagttccttatgaaccctctcctgcccctcctctctatactctgggagctaggagggtggaaacttgagatcaagccttcctcatcctgcagactctaatttgaaacctcactccatcccctgccagcccacggccaaacccaccacacctgctgccctggagaccaaccctgctcccttcccatcccccataccgagtcccttcatggctttccgcagcgctttggcatctgcgtcagggttgaagtcattgg

SEQ ID NO: 164253 - DNA, 601 bp, Human
acttcctgcttctcagattaatgccatcaaccacagacccagcacaggggtctttcatggcatttttacctctagcatcctacagtcccaggcgagcttggcaggtatcatcattcccatgagacacatggaaaggaggctcaggaggtgatggacttaacctaaagcctcctgggagttgctgtcagacagatggggcagaaaggcaaagaaagccaaaccctagatggcctgtcccaggctggactttctgagcacaggcccagctgatctgaacctgtgggtgcagtactcttcccaytggtgccaaatataggtctgaaagacctgcccagcagggcacactcccaccacagaatgagggctcttgggttccagggtccacagccctgattttacacatagggaaattcagacccagagtggcggagaggctcacccagagtcacacggtgagtcagcagcagagccagggcaccatgccaattttgtgacctggtactttcttcagtgccaggatactgcttccaggaggctgggggacaccttggtccctggaaagggcttctgccaagttccttatgaaccctctcctgcccct

SEQ ID NO: 164254 - DNA, 601 bp, Human
ctaaccacagcaggttgactctggaaggcattagaatatcacttcctgcttctcagattaatgccatcaaccacagacccagcacaggggtctttcatggcatttttacctctagcatcctacagtcccaggcgagcttggcaggtatcatcattcccatgagacacatggaaaggaggctcaggaggtgatggacttaacctaaagcctcctgggagttgctgtcagacagatggggcagaaaggcaaagaaagccaaaccctagatggcctgtcccaggctggactttctgagcacagrcccagctgatctgaacctgtgggtgcagtactcttcccattggtgccaaatataggtctgaaagacctgcccagcagggcacactcccaccacagaatgagggctcttgggttccagggtccacagccctgattttacacatagggaaattcagacccagagtggcggagaggctcacccagagtcacacggtgagtcagcagcagagccagggcaccatgccaattttgtgacctggtactttcttcagtgccaggatactgcttccaggaggctgggggacaccttggtccctggaaa

SEQ ID NO: 164255 - DNA, 601 bp, Human
ggatccttccaaccctgacagtccaagtcctgttagcaactctatgtcctttctcttcagctctctggaagctggaccctgagtccctctaaccacagcaggttgactctggaaggcattagaatatcacttcctgcttctcagattaatgccatcaaccacagacccagcacaggggtctttcatggcatttttacctctagcatcctacagtcccaggcgagcttggcaggtatcatcattcccatgagacacatggaaaggaggctcaggaggtgatggacttaacctaaagcctccygggagttgctgtcagacagatggggcagaaaggcaaagaaagccaaaccctagatggcctgtcccaggctggactttctgagcacaggcccagctgatctgaacctgtgggtgcagtactcttcccattggtgccaaatataggtctgaaagacctgcccagcagggcacactcccaccacagaatgagggctcttgggttccagggtccacagccctgattttacacatagggaaattcagacccagagtggcggagaggctcacccagagtcacacggtgagtcagcagcagagccag

SEQ ID NO: 164256 - DNA, 601 bp, Human
gccagtttgaactgagtatgggaggagttctaccaagaagttacagctaatccacctgggcttatgaggatcacctgtatccctattggcacccgcagacactagaccccctggtgccacactgtacctccatggccttcttcaactgcttggcatcgtaatgggccggtggcatcatgagccccagaatcagccttgccaggtctccagagatctcagacttcaggtcagtcattaagtcctgcaaagggcagagccacagtcatgccaacatcagcacttgcccacacatgactcaggmtgggagagatggaaagagaaaacaggggttccacatgagggatcatggaagcttgtgtctgtctttgctgatgttgtacttattatttagatgaagccaaagagggtagggaaaaaacaaccaggaggaagacccactctccttgacacaggagacaggaacgggaaggcagcagagctgaaggacactgtttccactcagggggaaatgcatcaacctaagccagatgccaccaatgtgcaataatccctgacactcagttggggccttgaagccagctctgtctgtgcagaggaattg

SEQ ID NO: 164257 - DNA, 601 bp, Human
taacaatgcccttcatacctgtgaccttgattgacctgtcctagtttgaagggcagaggtgaccatttccatttcccagatgaaggcacagaggattgggaagtgtaaggaatggcccagtcacactgtgagtgagtggcaggtctaggctggagtacagactccaactgctggtgctttcgttcgagacccaccccacttcctccagcggctccacgagacccttctgacaccagtgggcatgtgacttaagctgaatcaacttggagtaaatgccaagcctgttgttggagctcctagkaagaaggaactctttctgctggagccgctagctggcgggatggacatatgccaccatgaggagaaaggctgcctgagagtgaagccagaagggaggacagcagagccaagacaggggtgagccaagggtccacagaacatcatttgagtctctggactcagagctagtcctgtagttttcagttataggagccaacatctccttttgtgtttatgccagtttgaactgagtatgggaggagttctaccaagaagttacagctaatccacctgggcttatgaggatcacctgtatccctat

SEQ ID NO: 164258 - DNA, 601 bp, Human
gggaggagaggaggcaggcaagattgactgattgattgactgaatgagtcaatgactaattcactcattcaggtacttgttaagacacctattatgtgctagccactgtgcaaggtgctggggctacaactacaaaaaaaaaaaaaaaaaagtccgggcgtggtggctcacacctgtaatcccagcactttaggaagctgaagagggcagatcacttgaggtcaggagttcaagaccacgctggcaaacatggtgaaaccccttctctactagaaagacaaaaaaattagctggtcgtggyggcgtgcgcctgtaatcccagctactcaggaggctgaggcaggagaatcgcttgaacctgggaggtggaggttgcagtgaaccgagatcacaccactgcactccagcctgggcgaaagagcgagactccgtctcaaaaaaaaaaagagaaaggcaagaggcaagacatgttctctgtcctcaaagaggttactgcctagtgctctaatggtcctgccttctcagatcctaggagattcatcctgattgagatcttcaatcatttctttgttagaagcaggtgtgtggtgaggcaatcaag

SEQ ID NO: 164259 - DNA, 601 bp, Human
gaggtccatggggcccggacggctaaagctcaggccaagcattcctggattttctcctcacctccagacatggccctcaggcccaagaccttggcacaaccaaggctgactatgccagcctctcaagatccccagaacctcccatgtgaactgctttgccttccagccccccaaacagaaaaggtatataggcgtgtgtgtataacaccacatatacacatgaacatctgaatagaaatttctacttgtaagtattggaagagaacagaaggacacgcacatgcctcacagtgttaactarcagtttggtctctgtgtgagtgaaggatcacagatgattgctattttcttcttttttactctatttcttcaagtctccacagtgaacatgtattattttgttagaagaaaaaaagttttgtgcttaagataaaatgctaaattttttttcttttgagacagagtcttgctctgtcgcccaggctggagtgcagtggcatgattacggctcactgcaacctccgcctcccagactcaggtgattctcctacttcagcctcccaagtagctggggccacagaagcatgccaccatgcttggc

SEQ ID NO: 164260 - DNA, 601 bp, Human
tggaagttggggggcctggctgttctcccagcatctgggcccaggcctcccaaactcaccctccttataggcctcattgatggcccggatttcagcattggtccgagtggccaggatttcaataagagccttttcatctgtgccggctccctggaatgtcaaggcaaagatgatctcagccatagttctgacctcctgtgcagaggtccatggggcccggacggctaaagctcaggccaagcattcctggattttctcctcacctccagacatggccctcaggcccaagaccttggcacarccaaggctgactatgccagcctctcaagatccccagaacctcccatgtgaactgctttgccttccagccccccaaacagaaaaggtatataggcgtgtgtgtataacaccacatatacacatgaacatctgaatagaaatttctacttgtaagtattggaagagaacagaaggacacgcacatgcctcacagtgttaactagcagtttggtctctgtgtgagtgaaggatcacagatgattgctattttcttcttttttactctatttcttcaagtctccacagtgaacatgtattattt

SEQ ID NO: 164261 - DNA, 601 bp, Human
gggcagagctgtgggctggggttggaagttggggggcctggctgttctcccagcatctgggcccaggcctcccaaactcaccctccttataggcctcattgatggcccggatttcagcattggtccgagtggccaggatttcaataagagccttttcatctgtgccggctccctggaatgtcaaggcaaagatgatctcagccatagttctgacctcctgtgcagaggtccatggggcccggacggctaaagctcaggccaagcattcctggattttctcctcacctccagacatggcccycaggcccaagaccttggcacaaccaaggctgactatgccagcctctcaagatccccagaacctcccatgtgaactgctttgccttccagccccccaaacagaaaaggtatataggcgtgtgtgtataacaccacatatacacatgaacatctgaatagaaatttctacttgtaagtattggaagagaacagaaggacacgcacatgcctcacagtgttaactagcagtttggtctctgtgtgagtgaaggatcacagatgattgctattttcttcttttttactctatttcttcaagtct

SEQ ID NO: 164262 - DNA, 601 bp, Human
atcaaccaatcaaaccaaccacgcccctgccaggagccttcactcacagacagggcccggcgtagacacgcataagctggacctacatctcagggacacccggcagaggtgactggggtgggctgggggtcttacctgggcatcttcccgtgcctggtccaggttttctcctccctcctcacgatgcccctgcagcaggagcagcaagaaagttcagtccccaaacatcgacccatctccatctctgtaccaccacacaccctgctcattttcacctctctgaatgctcttcctcatcagytacacagggacgaaaatcctgcctctataaggtaggctgttgtggtcattaactgagaatgtgtgcaagacacttagcaccaatgcctgacacacagcaagctctcggtaactgtcaatgagggtctgccattttggttatgggaattcaagagatggtgacagaagctcccaggtaacaacacaggagagggtcacccatatggctttgtcctgtgagctgggggcccaacaagccaggacaagggccaccagggaggactgtctggagaaggtggtaccacgccaactttgacaaggg

SEQ ID NO: 164263 - DNA, 601 bp, Human
tctgtgccccacatccctggacacagcttttgggggcgggaaaatgaggcagtcagaagagatggagacatggacctgggtcaggctactgggtgctgggatcaaggtgcaggtcagtgggggacaatgcactggcctcagtagggactgcccagccatagaaccctcagggaaaatgaatttggggttgtccaacctccagaagaagccatttccagacctcaagctcactaggctaaggagcagggctgaggcagagcagccaagagactcctagagaacccttttccctgctattcaytcaacaaatatttattgagcactgatcatgtgttactttggatatatcagtgaacaaaatgaagattccagcccttgaggaacttactttctaggctcgtcccaggacactccctccaatctcggtcccattttacagataataaaccgaggcctttagcactcaggccctcttctcagcaagttcccagaccagctctctaggggtcaattctactggggccactgatttgctgtgtgactttcagaagtcatttgccctttctggacctccattttcccactgtaacatgagggcttt

SEQ ID NO: 164264 - DNA, 601 bp, Human
aaccaggcaccaggcagaagcattccctggaagatcaattcagggttggaggatggatttggggtgagagctgagatttttaaaaaactctcagcagcacacgaggctgttcacagtaatacttaataaacgtctgttgaatgagtgaatgaaatgtggcctcagcaagccaccctagtgtctggctgggttctcagcctaacccccatccatgtgcccacaatgtagctgaaatgccatacatttaaatgtaaccctgcagcttttgacaaccatattccaaagcaagggttggacaacwggacaacaacagctatttgatgtggaagctgcaggggaccttaactctactgggtcttggaagatattactgtaaatggaattaagcatagactctggcatcaggcaagcctgagttcaaataaaaccaccaccacttagaaattctttcattgaagaggttaaggagcttcattttcttctagtaaaaagggagaacataaaaacgtatagaataatcttggcatcgttctcaatatatagtatgcattctaaaaattataattacaattctgtaactgtcaggttccagctaaagatt

SEQ ID NO: 164265 - DNA, 601 bp, Human
gatatggaacagtatatagccattaaatgatatcgttgatttaaaaatgcaacaatattcacatagtattaatttttaactgtcagaaataaagaatccacttttatatatacatagagaagcaactagaataatgtatgccacaatactgacaatgcttattactattaggttatggagtcttttttggcttctccttattttctagtttctataaaagaatgtactgctagttataagaaaatgagcttgggtctagcatcctaaatctggagaagcagccgagttgggcagggatctygctcaagggtcccttagctatttccacccgggttctctctctccacttctctccttttgcgaagcagctgtcagcaaggcccaccactgccccctgctagcggcaattggaagcacagcctcattggcaaaccaggcaccaggcagaagcattccctggaagatcaattcagggttggaggatggatttggggtgagagctgagatttttaaaaaactctcagcagcacacgaggctgttcacagtaatacttaataaacgtctgttgaatgagtgaatgaaatgtggcctcagcaagcc

SEQ ID NO: 164266 - DNA, 601 bp, Human
ttgcgccaccgcactccagcctgggcaacagagcgagactccgtcttaaaaaaaaaaaaaaaaaaaaaaaaaaaaaagtctgagtattgattatctaaaaatgaccacaatccttcatttcatggtaggtctataataattatttataatttattgctctaattggacaacagagtgaaaggggaagcaattaacaatcactgtggggccacagttggaaattggacatatgttcaactggttaataacagtcccagacttctaagagcttgagggtgttctagacatccagagtgagagrccgccagggaggcagtgtaaaacaggcaaatacaaactgccaagtactcatgtgcgttatctaagggggagcttgactcggccctatcaaatgcccttaatttttatatacattttgctcccacatttccatttcatctctggaaattcattctaatgaataattcatgaatgtgataaaagagtttgctactaggaagaaggctggttaaataacatggtagattcagatatggaacagtatatagccattaaatgatatcgttgatttaaaaatgcaacaatattcacatagtattaa

SEQ ID NO: 164267 - DNA, 601 bp, Human
cttgtaatcccagctacttgggagtctgaggcaggagaattgcttgaacccaggaggcagacgttgcagtgagccaagattgcgccaccgcactccagcctgggcaacagagcgagactccgtcttaaaaaaaaaaaaaaaaaaaaaaaaaaaaaagtctgagtattgattatctaaaaatgaccacaatccttcatttcatggtaggtctataataattatttataatttattgctctaattggacaacagagtgaaaggggaagcaattaacaatcactgtggggccacagttggaaaytggacatatgttcaactggttaataacagtcccagacttctaagagcttgagggtgttctagacatccagagtgagagaccgccagggaggcagtgtaaaacaggcaaatacaaactgccaagtactcatgtgcgttatctaagggggagcttgactcggccctatcaaatgcccttaatttttatatacattttgctcccacatttccatttcatctctggaaattcattctaatgaataattcatgaatgtgataaaagagtttgctactaggaagaaggctggttaaataacatggt

SEQ ID NO: 164268 - DNA, 601 bp, Human
gggtcaatagtggggtaaatgaattctatttcaagaaagctgttatatttttaaaagcctgggccaggcatggtggctcacgcctgtaatcctagcactttgggaggctgaggcgggcggatcacttgaggtcaggagttcataaccagcctggccaacatgatgaaatcctgtctctactaaaaatacaaaaaaattagctgggcatggtgttgggagcttgtaatcccagctacttgggagtctgaggcaggagaattgcttgaacccaggaggcagacgttgcagtgagccaagattkcgccaccgcactccagcctgggcaacagagcgagactccgtcttaaaaaaaaaaaaaaaaaaaaaaaaaaaaaagtctgagtattgattatctaaaaatgaccacaatccttcatttcatggtaggtctataataattatttataatttattgctctaattggacaacagagtgaaaggggaagcaattaacaatcactgtggggccacagttggaaattggacatatgttcaactggttaataacagtcccagacttctaagagcttgagggtgttctagacatccagagtgagagacc

SEQ ID NO: 164269 - DNA, 601 bp, Human
cgtattaatatcactgtattgacatgaggtgtttggaagaggcacatctggagagacagaaagtagattagtggttgcttagggctggggggttagtaggatatgaggagtcacagctaatgtgtatggagtttcttttgggggtgaaaaaatgttctaaaattgattgtggtgatggttgcattaagtctgtgaagatactaaaaaccaccaaattgtacactttaaatgggtcaatagtggggtaaatgaattctatttcaagaaagctgttatatttttaaaagcctgggccaggcayggtggctcacgcctgtaatcctagcactttgggaggctgaggcgggcggatcacttgaggtcaggagttcataaccagcctggccaacatgatgaaatcctgtctctactaaaaatacaaaaaaattagctgggcatggtgttgggagcttgtaatcccagctacttgggagtctgaggcaggagaattgcttgaacccaggaggcagacgttgcagtgagccaagattgcgccaccgcactccagcctgggcaacagagcgagactccgtcttaaaaaaaaaaaaaaaaaaaaaaaaaa

SEQ ID NO: 164270 - DNA, 601 bp, Human
gtggaaataacccaaatgtccatcagctgatgaatggataatagactattatttggcaatgaaaagggagtaccaacatgctacaacacggatgacccgtgaaaacactgttaagtgtttaacatagtgtttaggttagtgttttcttaagtgaagaagccagtccaaaaggccacgtattaatatcactgtattgacatgaggtgtttggaagaggcacatctggagagacagaaagtagattagtggttgcttagggctggggggttagtaggatatgaggagtcacagctaatgtgtrtggagtttcttttgggggtgaaaaaatgttctaaaattgattgtggtgatggttgcattaagtctgtgaagatactaaaaaccaccaaattgtacactttaaatgggtcaatagtggggtaaatgaattctatttcaagaaagctgttatatttttaaaagcctgggccaggcatggtggctcacgcctgtaatcctagcactttgggaggctgaggcgggcggatcacttgaggtcaggagttcataaccagcctggccaacatgatgaaatcctgtctctactaaaaatacaaaaaaa

SEQ ID NO: 164271 - DNA, 601 bp, Human
ttagcctagctacttcatgcaaaaattaatctggacagttcctcaaatggttaaacttagagttctcatatgacccagcaattctatctaagagaaatgaaaacatatgtgcacacaaaaacttgtacacaaatgtttagagcagcattagtcataatagccaaaaggtggaaataacccaaatgtccatcagctgatgaatggataatagactattatttggcaatgaaaagggagtaccaacatgctacaacacggatgacccgtgaaaacactgttaagtgtttaacatagtgtttargttagtgttttcttaagtgaagaagccagtccaaaaggccacgtattaatatcactgtattgacatgaggtgtttggaagaggcacatctggagagacagaaagtagattagtggttgcttagggctggggggttagtaggatatgaggagtcacagctaatgtgtatggagtttcttttgggggtgaaaaaatgttctaaaattgattgtggtgatggttgcattaagtctgtgaagatactaaaaaccaccaaattgtacactttaaatgggtcaatagtggggtaaatgaattctat

SEQ ID NO: 164272 - DNA, 601 bp, Human
actaaattaatattcaccacaaaagcttgttcttattagcctagctacttcatgcaaaaattaatctggacagttcctcaaatggttaaacttagagttctcatatgacccagcaattctatctaagagaaatgaaaacatatgtgcacacaaaaacttgtacacaaatgtttagagcagcattagtcataatagccaaaaggtggaaataacccaaatgtccatcagctgatgaatggataatagactattatttggcaatgaaaagggagtaccaacatgctacaacacggatgacccktgaaaacactgttaagtgtttaacatagtgtttaggttagtgttttcttaagtgaagaagccagtccaaaaggccacgtattaatatcactgtattgacatgaggtgtttggaagaggcacatctggagagacagaaagtagattagtggttgcttagggctggggggttagtaggatatgaggagtcacagctaatgtgtatggagtttcttttgggggtgaaaaaatgttctaaaattgattgtggtgatggttgcattaagtctgtgaagatactaaaaaccaccaaattgtacact

SEQ ID NO: 164273 - DNA, 601 bp, Human
tgtaaaaaaaaagtggtgggacactaaattaatattcaccacaaaagcttgttcttattagcctagctacttcatgcaaaaattaatctggacagttcctcaaatggttaaacttagagttctcatatgacccagcaattctatctaagagaaatgaaaacatatgtgcacacaaaaacttgtacacaaatgtttagagcagcattagtcataatagccaaaaggtggaaataacccaaatgtccatcagctgatgaatggataatagactattatttggcaatgaaaagggagtaccaayatgctacaacacggatgacccgtgaaaacactgttaagtgtttaacatagtgtttaggttagtgttttcttaagtgaagaagccagtccaaaaggccacgtattaatatcactgtattgacatgaggtgtttggaagaggcacatctggagagacagaaagtagattagtggttgcttagggctggggggttagtaggatatgaggagtcacagctaatgtgtatggagtttcttttgggggtgaaaaaatgttctaaaattgattgtggtgatggttgcattaagtctgtgaagatact

SEQ ID NO: 164274 - DNA, 601 bp, Human
caaagcatctttaagataataatatctgtaatgtaaaaaaaaagtggtgggacactaaattaatattcaccacaaaagcttgttcttattagcctagctacttcatgcaaaaattaatctggacagttcctcaaatggttaaacttagagttctcatatgacccagcaattctatctaagagaaatgaaaacatatgtgcacacaaaaacttgtacacaaatgtttagagcagcattagtcataatagccaaaaggtggaaataacccaaatgtccatcagctgatgaatggataatagamtattatttggcaatgaaaagggagtaccaacatgctacaacacggatgacccgtgaaaacactgttaagtgtttaacatagtgtttaggttagtgttttcttaagtgaagaagccagtccaaaaggccacgtattaatatcactgtattgacatgaggtgtttggaagaggcacatctggagagacagaaagtagattagtggttgcttagggctggggggttagtaggatatgaggagtcacagctaatgtgtatggagtttcttttgggggtgaaaaaatgttctaaaattgattgtg

SEQ ID NO: 164275 - DNA, 601 bp, Human
gtgcctgtaatcccagctactcaggagggtgaggcaggagaatcacttgaatccgggaggtggaggttgtagtgagccaaattgcaacactgcactccagcctgggcaacaagaggaaaactccatctcaaaataaataaatatataaaatgattaatatggtaaagttgatatgtattttatcaaaaatttgtaaaaacttatgctaaataaaacggtatcatttttaaaaagagagagagagggacatgtttaaaaaatttaacagaaaagaatccaaagtcccaattgttctcacttwcgcgggtcagagtaccctagacatactcggtttttcaaagcatctttaagataataatatctgtaatgtaaaaaaaaagtggtgggacactaaattaatattcaccacaaaagcttgttcttattagcctagctacttcatgcaaaaattaatctggacagttcctcaaatggttaaacttagagttctcatatgacccagcaattctatctaagagaaatgaaaacatatgtgcacacaaaaacttgtacacaaatgtttagagcagcattagtcataatagccaaaaggtggaaataa

SEQ ID NO: 164276 - DNA, 601 bp, Human
tgtaatctcagcactttgggaggctgaggcaggttgatcacctgaggtcaggagtttgagaccagtctggccaacatggtgaaaccctgtctctactaaaaatacaaaaaattagccgggtgtggtggcaggtgcctgtaatcccagctactcaggagggtgaggcaggagaatcacttgaatccgggaggtggaggttgtagtgagccaaattgcaacactgcactccagcctgggcaacaagaggaaaactccatctcaaaataaataaatatataaaatgattaatatggtaaagttkatatgtattttatcaaaaatttgtaaaaacttatgctaaataaaacggtatcatttttaaaaagagagagagagggacatgtttaaaaaatttaacagaaaagaatccaaagtcccaattgttctcacttacgcgggtcagagtaccctagacatactcggtttttcaaagcatctttaagataataatatctgtaatgtaaaaaaaaagtggtgggacactaaattaatattcaccacaaaagcttgttcttattagcctagctacttcatgcaaaaattaatctggacagttcctcaa

SEQ ID NO: 164277 - DNA, 601 bp, Human
ttattcccagctacttggggggctgaggtgggaggattgcttgggcctagaaggtggaggttgcagtgagccaagattgtgccactgcactccaacctgggtctcaaccctatctcaaacatcacaaaacaaaaacctagttgaaccctgaggacatcatactaggtaaagaaagccagtcataaaagcataaatactgtataatttcacttacatgaagtccccagtcaaattcacagacatagaaagaatggtggttgccaggggctgggggaagggagaatggggagtgactgttgartgggtccagagttttggttttgcatgacgaaaacagttttggaggtggctggtggtgacagctgcccaacaatgtgaatgtacttaatgccactgaactgtatactttaaaatgattggccaggcatgatggctcacgcctgtaatctcagcactttgggaggctgaggcaggttgatcacctgaggtcaggagtttgagaccagtctggccaacatggtgaaaccctgtctctactaaaaatacaaaaaattagccgggtgtggtggcaggtgcctgtaatcccagctactcaggaggg

SEQ ID NO: 164278 - DNA, 601 bp, Human
caccccaaaacccagaggagattccaggcctgtttctttgtctgaaagtggaaataatccctgccacttccttacagaaccactgagatgtaaatgtgagcagtgcaaagttctctgcaccctttagcatattcagagttccaaggcaagagacatgtaattttagccttcatgttacagacaggaaagactggccagctgaggccttaaggggagctgacctgcctggaggcacacagcaaacagtgatgggaaagtcattttacaagggttacttttaatcactgcactatgcagagcrcaaaattctgtggttaggacactattttgttaggcaaatagctgtgacttggagagcctgggaacaaaatacccaggctcatgtacctaggctgcgtattgctttcgccgttcccccagaaactctgctgactttattctattggatagactgaactctttataaacttcacaatagcctatactctggaaaccttcctcttcttttcattgcataattggcaatgtccgttaaaagttaaaaggcatatgccatttgatcaagcaattatattgctaggaatttgccctacaggtatac

SEQ ID NO: 164279 - DNA, 601 bp, Human
gtgttcacttgaagggtaagagaaagacacagaaatggggaactctgcccttcgcaccccaaaacccagaggagattccaggcctgtttctttgtctgaaagtggaaataatccctgccacttccttacagaaccactgagatgtaaatgtgagcagtgcaaagttctctgcaccctttagcatattcagagttccaaggcaagagacatgtaattttagccttcatgttacagacaggaaagactggccagctgaggccttaaggggagctgacctgcctggaggcacacagcaaacagygatgggaaagtcattttacaagggttacttttaatcactgcactatgcagagcacaaaattctgtggttaggacactattttgttaggcaaatagctgtgacttggagagcctgggaacaaaatacccaggctcatgtacctaggctgcgtattgctttcgccgttcccccagaaactctgctgactttattctattggatagactgaactctttataaacttcacaatagcctatactctggaaaccttcctcttcttttcattgcataattggcaatgtccgttaaaagttaaaaggc

SEQ ID NO: 164280 - DNA, 601 bp, Human
tcacccagccatccaagggggccgagactggtcccctcttccttcctcaagcacaatggcttctatactcccctctccagttcacaaggaccctgtgaactgacaaagatggccttagcactgggtacttccatcctagcctcaggaccgtggggctggggctcctaggaggacccacatagactctgagcatagcaactgggagttccccttccatccctcaacctttctgcaagcccctctgggaagggtgtatggggtcatatgcagagaagatggcctggccagtgtttccccaagyggggtcaagggcaaacacacccgatcacactgcacattagtgtttccatgattgtcttctagctagctactagttctatttatactgatagtaaattccccttaactcattttgggtttaagagtgagtcgatttaaagatcagtattaatagctggtggttacacagcacaaatcgtgccagagatgattagctgaagtttgggaaacacttgcctggcctatcttttaccaagcagggcccggaaggggagagagagaagccgcacagcaagctcccaaatcactgctcgatactgcc

SEQ ID NO: 164281 - DNA, 601 bp, Human
gccaggactagaacccagggctccagagtcgccgtcacccatgacacgctactgctgggttaaggaggaggtgggtgggcaacgggctcctcttgccacagagagctgagaggctctcatcagattctgggatcttcctgctgagctgggaagggaggaggtcaggcctcacctctccggaggtgcggatagctccgggtacacaggatcgtcatgaaacgtgtctccaaggaagttttgtctccactgggtgtgtctgctatttcctgcagagccccagttggagcaaggatttgggagrggagacatgagaaagccttggttattattcactttcatgtctttgcctgggctgagggcagtcagaagctgggctcacccagccatccaagggggccgagactggtcccctcttccttcctcaagcacaatggcttctatactcccctctccagttcacaaggaccctgtgaactgacaaagatggccttagcactgggtacttccatcctagcctcaggaccgtggggctggggctcctaggaggacccacatagactctgagcatagcaactgggagttccccttccatccctcaacc

SEQ ID NO: 164282 - DNA, 601 bp, Human
aaatacaaactaacccttgtccagtgagtattacatgccaagaggcaccgttccaagtgctttacatataattaactaatttcagcctcacaaaatccaccctatgggctgggcactgttgttatctccactttacaaaggaggaaattgagacacagaggttttgtgacctgcccaaggacatatagtgagtaagtggcagagcagggattcaacctggattccatgcttttattcgtcgggctatcccgcctcctagatattgctcctgggtggtaaaggcccatcacgtgctaaacamcacccctaccaccacctctacttcacccaaatctaacacacctttcccccacattttagtgtctctgaaatcaagatgtgttttataattgaaggcaattatgtgaaaatcttccacggatacctcttggtaagattttttaaaagtgcattgatgcaatgtgttttatagtaaatgaaacaagataccactaatgatgaatattaatgagaataacttcagccctaacccatatccactcatccatatttatacacggtggaattaagatccaaaagggaaaaaccttttcaaagtcaa

SEQ ID NO: 164283 - DNA, 601 bp, Human
agaatgtaactaaacctgcgtgcaactaactttgcgcagggcttggtgggaaacaacaatacaaatacaaactaacccttgtccagtgagtattacatgccaagaggcaccgttccaagtgctttacatataattaactaatttcagcctcacaaaatccaccctatgggctgggcactgttgttatctccactttacaaaggaggaaattgagacacagaggttttgtgacctgcccaaggacatatagtgagtaagtggcagagcagggattcaacctggattccatgcttttattcgycgggctatcccgcctcctagatattgctcctgggtggtaaaggcccatcacgtgctaaacaacacccctaccaccacctctacttcacccaaatctaacacacctttcccccacattttagtgtctctgaaatcaagatgtgttttataattgaaggcaattatgtgaaaatcttccacggatacctcttggtaagattttttaaaagtgcattgatgcaatgtgttttatagtaaatgaaacaagataccactaatgatgaatattaatgagaataacttcagccctaacccatatcca

SEQ ID NO: 164284 - DNA, 601 bp, Human
gttttaccctacctaggcctgagtttcctcctctatcaaatgaggatgctaccacaatttcacaggactgccatgagggtcagctgtggtcagagagatgaagcccttggcacaggcttgacacatcgtgagtgctcaatgaatggctgtcacatttggagactgtagggtgagggtctcaggttccttcctaccctcccacctgcccaggctatctgcagttgagactccagtggctgagagggtggccagtgtggcttgggctctcccagaagggcaggactagactcagaggggagcrcttgtgacctttgatgactatttgtcctaggagaccctgtgtccccggatagattgtgagctctgagagggcagagactgtgtcctacccagccctgtgtgcctccagagcacatttctcaaccttggcatttggggctggataattctttgttgcgcaagcttatcctttgcactgaggttgtttaacagcatccctgttctctccccaccagatgctggtagcaacaatctccaagttgtgatgaccaaaaatgtgtctggatattgccaaatatcctccggggcgggggaaggcggg

SEQ ID NO: 164285 - DNA, 601 bp, Human
agtcctgaccaaaatccctctgtgcccaggactggccagactgacacgcaaaaaagatgtgtgtgggttgaatagtgtccccatgtccacctggaaactcagaacatgatgtaatttggaaataaggtatttgcacatgtaattagttaagatgaaggcatactgaattagattgaagcctaaaccaataaccaatatctttagaagagggagggcacagacatacacacagaaaagtggctaggtgaggacagaggcagagaccggagtgatgcattcacagccaggaaacaccaaggayttctggcaaccaccagaagctaggagaggcaggggagtgcttctcccccagagcctccaggaggacccaacccaggcgacaccttgattttgggcttttggcctccagaactatgagaataaatttctgttgtcacccaatttctggaatgtgttacaccagccctaggaaactaccaccgggcccaaggagcaggcacagggcatggaatgtgtgggcagccagagctgcctctgcccccagggagcgacaagcaccagcctaggagtcagagctaggttcgagtcccagctctgcctc

SEQ ID NO: 164286 - DNA, 601 bp, Human
aacagggcggatgttccacctctgtcttctgcaaacagtcctgaccaaaatccctctgtgcccaggactggccagactgacacgcaaaaaagatgtgtgtgggttgaatagtgtccccatgtccacctggaaactcagaacatgatgtaatttggaaataaggtatttgcacatgtaattagttaagatgaaggcatactgaattagattgaagcctaaaccaataaccaatatctttagaagagggagggcacagacatacacacagaaaagtggctaggtgaggacagaggcagagacyggagtgatgcattcacagccaggaaacaccaaggacttctggcaaccaccagaagctaggagaggcaggggagtgcttctcccccagagcctccaggaggacccaacccaggcgacaccttgattttgggcttttggcctccagaactatgagaataaatttctgttgtcacccaatttctggaatgtgttacaccagccctaggaaactaccaccgggcccaaggagcaggcacagggcatggaatgtgtgggcagccagagctgcctctgcccccagggagcgacaagcaccagccta

SEQ ID NO: 164287 - DNA, 601 bp, Human
ttcaagcgattctcttgcctcagcctcctgagtagctgggattacaggcatgagccaacacacccagctaatttttgtatttttagtagagacagggtttcaccatgttggccaggctggtcttgaactcctgacctcaagtgatccacctgccttggccttccaacgtgctgtgattacaggtgtgagccaccatgcctgcccatgatatgtaagttatacttccataacattgctttaaaaaaagcaaaaaatgggctcttgttttatttggaaatctttaattataaacctttgattyttttggaattgatttcggtataaacaatgcaatacagaccccctttcatttcaatatcctggctgttctaagcggtaacccactggaaaaaagtccatgggaataaagacttctaatcttatattagggatctgacactcacccgcttcctgctaacctctagcccctccccttacctcaatggcttggtggagagacttgtcatatttctcaatgaattccctccggatgttgagcaggtcaatctcactgcgggataccatgatcctggtcagagtcttctcatctgtgccagcaccc

SEQ ID NO: 164288 - DNA, 601 bp, Human
tgagatggagtcttgctctgttgcccaggctggagtgcagtggcgtgatctcagctcactgcaacctctacctcctgggttcaagcgattctcttgcctcagcctcctgagtagctgggattacaggcatgagccaacacacccagctaatttttgtatttttagtagagacagggtttcaccatgttggccaggctggtcttgaactcctgacctcaagtgatccacctgccttggccttccaacgtgctgtgattacaggtgtgagccaccatgcctgcccatgatatgtaagttatasttccataacattgctttaaaaaaagcaaaaaatgggctcttgttttatttggaaatctttaattataaacctttgattcttttggaattgatttcggtataaacaatgcaatacagaccccctttcatttcaatatcctggctgttctaagcggtaacccactggaaaaaagtccatgggaataaagacttctaatcttatattagggatctgacactcacccgcttcctgctaacctctagcccctccccttacctcaatggcttggtggagagacttgtcatatttctcaatgaattc

SEQ ID NO: 164289 - DNA, 601 bp, Human
ccatggtatggtatggatctcccttctgagggactcctatcattgttatgagacatggttttcgggattttgtttgtccttgtattttttgatgtatgattttaaaacataatatagtatcaaaatgtgccaacaatttacttacattcctactaagtctgtaagagactgcctctgagatgcccatagtctcgttagccaagtagaaccaagcatcagactttaagatcttggctgatctcaaagagcaaaaatataagctccatatgtcaaaaaagtcagacgcagccaggtgtggtgrctcacacctgtaatcccagcactttgggaggccaaggcaggtggatcacttgaggtcaggagctagcaaccagcctggccaacacagtgaaaccctgtctgtactaaaaatacaaaaattagccaggcatagtgatgcatgcctgcagtcccagctactcgggaggctgaggcaggagaattgcttaaacccaggaggtggacgttgcagtgagatgagatggcactgctgcactccagcctgggcgacagagcaagactccgtctcaaaaacaaacaaacaaacaaaaagtcagacaca

SEQ ID NO: 164290 - DNA, 601 bp, Human
ccttggcatatcgtgttaggtgatttcttatttgaacaaacaacattgagtgctaactgccaagccattgctgggaatgggtacaaacaccatcacgctcaccacacatcacagtggtctggtatacgttcagactggggaggccaaacttcctgacccatggtatggtatggatctcccttctgagggactcctatcattgttatgagacatggttttcgggattttgtttgtccttgtattttttgatgtatgattttaaaacataatatagtatcaaaatgtgccaacaatttacttwcattcctactaagtctgtaagagactgcctctgagatgcccatagtctcgttagccaagtagaaccaagcatcagactttaagatcttggctgatctcaaagagcaaaaatataagctccatatgtcaaaaaagtcagacgcagccaggtgtggtggctcacacctgtaatcccagcactttgggaggccaaggcaggtggatcacttgaggtcaggagctagcaaccagcctggccaacacagtgaaaccctgtctgtactaaaaatacaaaaattagccaggcatagtgatgcatgcc

SEQ ID NO: 164291 - DNA, 601 bp, Human
agctccactgaagataagagcccaacccaacccctccccccacccctgccccttccttagtctctggagctggaacaatcaggcttggccatggcggctggtgctgataaccatttcttggcagaagtgcccgccaaagctgtggccctagtcctcaccaccacagagagccagcaaggccttcaggaagtctccggaggtgtcaccctggcagaggcagagagcagagtgagtgaaaacagtccttccagtctcaatgccccctcctcccggctgcccatctgtctggacatctccctcrgcttctctccatgaccaacataggatcccatgccacatgtaggctactgggatctcccagacacataaatgtgaccacgtcccttttgtttatccccaggaagatatgcaagctcccggcctggcttcaaggccctttgggatctgacctgtgcagagctctgcagcttcacctgttcctttcccccaggagcatctcagtcctctctccacctgtcactcccctgtccaacatgcccctgtgcacccccaatcccatttgccagcagggccctctcctctgagaagcactctggccact

SEQ ID NO: 164292 - DNA, 601 bp, Human; identical to SEQ ID NO: 164220

SEQ ID NO: 164293 - DNA, 601 bp, Human; identical to SEQ ID NO: 164221

SEQ ID NO: 164294 - DNA, 601 bp, Human; identical to SEQ ID NO: 164222

SEQ ID NO: 164295 - DNA, 601 bp, Human; identical to SEQ ID NO: 164223

SEQ ID NO: 164296 - DNA, 601 bp, Human; identical to SEQ ID NO: 164224

SEQ ID NO: 164297 - DNA, 601 bp, Human; identical to SEQ ID NO: 164225

SEQ ID NO: 164298 - DNA, 601 bp, Human; identical to SEQ ID NO: 164226

SEQ ID NO: 164299 - DNA, 601 bp, Human; identical to SEQ ID NO: 164227

SEQ ID NO: 164300 - DNA, 601 bp, Human; identical to SEQ ID NO: 164228

SEQ ID NO: 164301 - DNA, 601 bp, Human; identical to SEQ ID NO: 164229

SEQ ID NO: 164302 - DNA, 601 bp, Human; identical to SEQ ID NO: 164230

SEQ ID NO: 164303 - DNA, 601 bp, Human; identical to SEQ ID NO: 164231

SEQ ID NO: 164304 - DNA, 601 bp, Human; identical to SEQ ID NO: 164232

SEQ ID NO: 164305 - DNA, 601 bp, Human; identical to SEQ ID NO: 164233

SEQ ID NO: 164306 - DNA, 601 bp, Human; identical to SEQ ID NO: 164234

SEQ ID NO: 164307 - DNA, 601 bp, Human; identical to SEQ ID NO: 164235

SEQ ID NO: 164308 - DNA, 601 bp, Human; identical to SEQ ID NO: 164236

SEQ ID NO: 164309 - DNA, 601 bp, Human; identical to SEQ ID NO: 164237

SEQ ID NO: 164310 - DNA, 601 bp, Human; identical to SEQ ID NO: 164238

SEQ ID NO: 164311 - DNA, 601 bp, Human; identical to SEQ ID NO: 164239

SEQ ID NO: 164312 - DNA, 601 bp, Human; identical to SEQ ID NO: 164240

SEQ ID NO: 164313 - DNA, 601 bp, Human; identical to SEQ ID NO: 164241

SEQ ID NO: 164314 - DNA, 601 bp, Human; identical to SEQ ID NO: 164242

SEQ ID NO: 164315 - DNA, 601 bp, Human; identical to SEQ ID NO: 164243

SEQ ID NO: 164316 - DNA, 601 bp, Human; identical to SEQ ID NO: 164244

SEQ ID NO: 164317 - DNA, 601 bp, Human; identical to SEQ ID NO: 164245

SEQ ID NO: 164318 - DNA, 601 bp, Human; identical to SEQ ID NO: 164246

SEQ ID NO: 164319 - DNA, 601 bp, Human; identical to SEQ ID NO: 164247

SEQ ID NO: 164320 - DNA, 601 bp, Human; identical to SEQ ID NO: 164248

SEQ ID NO: 164321 - DNA, 601 bp, Human; identical to SEQ ID NO: 164249

SEQ ID NO: 164322 - DNA, 601 bp, Human; identical to SEQ ID NO: 164250

SEQ ID NO: 164323 - DNA, 601 bp, Human; identical to SEQ ID NO: 164251

SEQ ID NO: 164324 - DNA, 601 bp, Human; identical to SEQ ID NO: 164252

SEQ ID NO: 164325 - DNA, 601 bp, Human; identical to SEQ ID NO: 164253

SEQ ID NO: 164326 - DNA, 601 bp, Human; identical to SEQ ID NO: 164254

SEQ ID NO: 164327 - DNA, 601 bp, Human; identical to SEQ ID NO: 164255

SEQ ID NO: 164328 - DNA, 601 bp, Human; identical to SEQ ID NO: 164256

SEQ ID NO: 164329 - DNA, 601 bp, Human; identical to SEQ ID NO: 164257

SEQ ID NO: 164330 - DNA, 601 bp, Human; identical to SEQ ID NO: 164258

SEQ ID NO: 164331 - DNA, 601 bp, Human; identical to SEQ ID NO: 164259

SEQ ID NO: 164332 - DNA, 601 bp, Human; identical to SEQ ID NO: 164260

SEQ ID NO: 164333 - DNA, 601 bp, Human; identical to SEQ ID NO: 164261

SEQ ID NO: 164334 - DNA, 601 bp, Human; identical to SEQ ID NO: 164262

SEQ ID NO: 164335 - DNA, 601 bp, Human; identical to SEQ ID NO: 164263

SEQ ID NO: 164336 - DNA, 601 bp, Human; identical to SEQ ID NO: 164264

SEQ ID NO: 164337 - DNA, 601 bp, Human; identical to SEQ ID NO: 164265

SEQ ID NO: 164338 - DNA, 601 bp, Human; identical to SEQ ID NO: 164266

SEQ ID NO: 164339 - DNA, 601 bp, Human; identical to SEQ ID NO: 164267

SEQ ID NO: 164340 - DNA, 601 bp, Human; identical to SEQ ID NO: 164268

SEQ ID NO: 164341 - DNA, 601 bp, Human; identical to SEQ ID NO: 164269

SEQ ID NO: 164342 - DNA, 601 bp, Human; identical to SEQ ID NO: 164270

SEQ ID NO: 164343 - DNA, 601 bp, Human; identical to SEQ ID NO: 164271

SEQ ID NO: 164344 - DNA, 601 bp, Human; identical to SEQ ID NO: 164272

SEQ ID NO: 164345 - DNA, 601 bp, Human; identical to SEQ ID NO: 164273

SEQ ID NO: 164346 - DNA, 601 bp, Human; identical to SEQ ID NO: 164274

SEQ ID NO: 164347 - DNA, 601 bp, Human; identical to SEQ ID NO: 164275

SEQ ID NO: 164348 - DNA, 601 bp, Human; identical to SEQ ID NO: 164276

SEQ ID NO: 164349 - DNA, 601 bp, Human; identical to SEQ ID NO: 164277

SEQ ID NO: 164350 - DNA, 601 bp, Human; identical to SEQ ID NO: 164278

SEQ ID NO: 164351 - DNA, 601 bp, Human; identical to SEQ ID NO: 164279

SEQ ID NO: 164352 - DNA, 601 bp, Human; identical to SEQ ID NO: 164280

SEQ ID NO: 164353 - DNA, 601 bp, Human; identical to SEQ ID NO: 164281

SEQ ID NO: 164354 - DNA, 601 bp, Human; identical to SEQ ID NO: 164282

SEQ ID NO: 164355 - DNA, 601 bp, Human; identical to SEQ ID NO: 164283

SEQ ID NO: 164356 - DNA, 601 bp, Human; identical to SEQ ID NO: 164284

SEQ ID NO: 164357 - DNA, 601 bp, Human; identical to SEQ ID NO: 164285

SEQ ID NO: 164358 - DNA, 601 bp, Human; identical to SEQ ID NO: 164286

SEQ ID NO: 164359 - DNA, 601 bp, Human; identical to SEQ ID NO: 164287

SEQ ID NO: 164360 - DNA, 601 bp, Human; identical to SEQ ID NO: 164288

SEQ ID NO: 164361 - DNA, 601 bp, Human; identical to SEQ ID NO: 164289

SEQ ID NO: 164362 - DNA, 601 bp, Human; identical to SEQ ID NO: 164290

SEQ ID NO: 164363 - DNA, 601 bp, Human; identical to SEQ ID NO: 164291

SEQ ID NO: 164364 - DNA, 601 bp, Human
gtgtgaggaggcgtttgctccctttccttctttctcctgctctctcttctcaggagagaggaccgcgagagggaccgggtcgcttttttgttcgtggagatccccgctttccgccaaaccccatccttccgatctccccaggctaaaactccggggccggtccccttgtcctttctctttgtcttgtttattatagctgcctttcttcccggctcttccaatttgcttgtcatttgcatacctttcacttctccttttttaaccccagcagaggaccgggaactgggaggaggagagaggkaggtgggggggcgctctgttactttcgtctcaaaacgctgtcgaagccgaattgtggaaatccggcttggaggggtgcggtgatgggtcccgggaaacgcgcgcggcgcccctcttccgagctcctggacccagggctgggtcaagttgagtagggtaaggcggcaccgggaggctcggggggtcgcgtggcggtgggattgggacaccagcacgaggaggaccggaggatcgcggtccgggtaagagtagggggttcttgggcagcagaaatgggaggcgatgaatctcccagccatcg

SEQ ID NO: 164365 - DNA, 601 bp, Human
gggtcgcttttttgttcgtggagatccccgctttccgccaaaccccatccttccgatctccccaggctaaaactccggggccggtccccttgtcctttctctttgtcttgtttattatagctgcctttcttcccggctcttccaatttgcttgtcatttgcatacctttcacttctccttttttaaccccagcagaggaccgggaactgggaggaggagagagggaggtgggggggcgctctgttactttcgtctcaaaacgctgtcgaagccgaattgtggaaatccggcttggaggggwgcggtgatgggtcccgggaaacgcgcgcggcgcccctcttccgagctcctggacccagggctgggtcaagttgagtagggtaaggcggcaccgggaggctcggggggtcgcgtggcggtgggattgggacaccagcacgaggaggaccggaggatcgcggtccgggtaagagtagggggttcttgggcagcagaaatgggaggcgatgaatctcccagccatcgctggcagactatggtgttgggcagcttcggtctggtctcgtctgggtggtacctaccgttttgccccagttaggag

SEQ ID NO: 164366 - DNA, 601 bp, Human
atacctttcacttctccttttttaaccccagcagaggaccgggaactgggaggaggagagagggaggtgggggggcgctctgttactttcgtctcaaaacgctgtcgaagccgaattgtggaaatccggcttggaggggtgcggtgatgggtcccgggaaacgcgcgcggcgcccctcttccgagctcctggacccagggctgggtcaagttgagtagggtaaggcggcaccgggaggctcggggggtcgcgtggcggtgggattgggacaccagcacgaggaggaccggaggatcgcggkccgggtaagagtagggggttcttgggcagcagaaatgggaggcgatgaatctcccagccatcgctggcagactatggtgttgggcagcttcggtctggtctcgtctgggtggtacctaccgttttgccccagttaggaggactggggagggaggacaggagaggtgagagtaattgttactgggaagactagtgaggagggcgggaagagggagggaagagctgctatcttgcctgagcagatcaggagggggacgcagtgggcggggggagacatcacccaaagtccagtttagcaagt

SEQ ID NO: 164367 - DNA, 601 bp, Human
tatcattttaggcatttgtgagagagaatcatattactggtgcttaagcagtttttgcttaatttttttttaatcttaatccatcttaaaccagtggagcagaaatatttaaaaatgtttcatttcaagcagagtgcataataaattgcaataattgtaatgtgccataaatcccagagcctatgcattttgcatttgattcaggattgaggtcaggaaatttggagaaatttaaagaaaatgattcatcagtccttttgttctgttggccagggtcccgggattcttgagctgtgcccakctgacgagcttttgaagatggcacaataaccgtccagtgatgcctgaccatgacagcacagccctcttaagccggcaaaccaagaggagaagagttgacattggagtgaaaaggacggtagggacagcatctgcattttttgctaaggcaagagcaacgttttttagtgccatgaatccccaaggttctgagcaggatgttgagtattcagtggtgcagcatgcagatggggaaaagtcaaatgtactccgcaagctgctgaagagggcgaactcgtatgaagatgccatgatgcctttt

SEQ ID NO: 164368 - DNA, 601 bp, Human
aaaacaaaccaaaaaaggtttcccaaaaggttgggtttacacaatatctagagtaatgtagattagtatcttcttaagaaggcaacctttcccattattcaaaggaataggcttttatcagcatgcgtgtgccattcctgattgcagaaaagcttaaaactaagccaacatctttgcagcttccacaagttgttcactgccttgaggagctcctatttaatatgtgctttctcagcagtgttttttttctgctgttcttcctgcattatcttcttatccctatctcttaaaaaaaataaaraagtagatttagagatgagaaaacagtctcattgtaaatactgattgaattctctcagatattttttaaagatggtaagtttaatagaataaggagaaaagtcagttttcagatccctaagatcccataagaagaattctcagtgtaaaccatctgcaaggcttctggtccgtttaaagacagcccgatgaaatcttaggaagagcgctttacaagtgggaggttgaggaggaagaaaaatggatgtgggtggggagttagtctctctttcatctttaagtgagacttttttttttaagg

SEQ ID NO: 164369 - DNA, 601 bp, Human
aagccaacatctttgcagcttccacaagttgttcactgccttgaggagctcctatttaatatgtgctttctcagcagtgttttttttctgctgttcttcctgcattatcttcttatccctatctcttaaaaaaaataaagaagtagatttagagatgagaaaacagtctcattgtaaatactgattgaattctctcagatattttttaaagatggtaagtttaatagaataaggagaaaagtcagttttcagatccctaagatcccataagaagaattctcagtgtaaaccatctgcaagkcttctggtccgtttaaagacagcccgatgaaatcttaggaagagcgctttacaagtgggaggttgaggaggaagaaaaatggatgtgggtggggagttagtctctctttcatctttaagtgagacttttttttttaaggaaatatacaggtactgatttattcagacagcatcggtctctctcccgttcacccaaggtctgttctttgggtctggtgcagctgcctctatgcatgattaacctctgttcagccatacacagaaatcttttgtcccaacatacacaaagcaaattattttg

SEQ ID NO: 164370 - DNA, 601 bp, Human
gaaaccagtgaggatctgttggtttgtagagagattgggcccacttttctcctgtctctacctctgtatggcagtgtgttcttcccttgatttaactgttagtgtgtaggcaaaattctcaagcttttactttgaagaaatatctgggaatcacagtgagtgatgtcttacttcaattttagggatacggggccatatatgatccggttgtacagttattcctcgaaaagatcaatagaaatgggcagaaatgtaatgaaatggtacaactgtgattgctattattatgttttaatttttygttcatggctttccaaactgttatatataatttaatttttcaggaaaaattatctcccactccaaaaggtaccatctgttttttgaacaaagtagctaagataagaactattaagaacaccagcttatcaggtcaacccattctacattcaccacattaaacatatatgttctgtaggatagaacacactacctcattatcccatctagtagaagggaaatagtgaatgtgtatgcaagttaaactgaatttcagtgcacctgctccaagggctcatgtcttggattttaaaaatatgtt

SEQ ID NO: 164371 - DNA, 601 bp, Human
ataaattagatgtattaaaagcttcaggaagttttggtagctcagtgcccatctaagaaacacagaaaaacactttgtattttgtatgacaccaaattttaaaagatttgtgacttccaattaaatgcatgacgttgtcttaatgtagccatctgaaagaaaagattagaacccagatctgagagtgtctgtcaaagtttggacttgcctaaaactcttatcacaaggcagtcgcagacagcttgcaactattatttcacttatccatttggacagatggtcctgaagtgtgctgggctcytttagtcttctgtatcagtctaatggaggttactggagggcctttcagccctctccttggcacaagaagtatgtcagtcataaattatcgtctttgtaatcattaaggatctcaaacaaaaacacaagttcagttaagctgctttggcttacagatataaaatcaaaatttctttctttagtgtttattttcagtttaacaaaaaataaaaaaataaaaaacctgcactacttaacttttctatttacagaccaaggtgatctttttaaaattgcatgggatattaaagggaatgttaat

SEQ ID NO: 164372 - DNA, 601 bp, Human
aggtaatgatgtttccagataaataggccttcttattttgggtaagtggccatttattgatctgctaacccacatgtattgatttgttagccccaactactgcgtcactctcaaaggagttaactataaatccaagacaggcaaattgtatttggttttggaccattgctttcacaaaagcaacagccccctccctgtcctctccatgccaaaactactcttcccaagttttagctattatttaaaaggaaaaacaattaaaaggatataataagataaaaagcaagtgagtcaagatgcyccattagattaacactaaaaggtaaaatgtgaaacttgcatagcagtgttcaaaataatgcattttatattttcatgtacattagtagaataatttgctttaaactgcagagtgtggagagaagaacaaacagaactgtaattgcaaggaagaaaaaaaaacctcttatgacaagagttgtgtagtacatgttgggtgcatttgtctccttagcaacaagtgaatgtatagatagcctaccgacctaaagcaaggaaaatattttgccatcctcaccctaaagtagccaagattctgcaa

SEQ ID NO: 164373 - DNA, 601 bp, Human
tgtgtggtggcaagtggggaagattattgatctgtagctttataaataccatgcaatacaaaccaacaagaaactgttcccattcctctagaatgcccctagcaattcagctttgcaaataaccactgactctgtgtagataacaatggaatacctgggtgaatattttattttcaaaagcactaatattcagattgttgattctatccataccttacccatactggaagagaaggctgttaaagtatatgtgagtctggttactaccaattatccactgtaatggaggggaaacagtagracatatcaggcaaagcagaaaatcactgaaggtcacttctcttttatttttggaaggaattatacatttttaactttcctaattatgttttttctttggttagtaataaatgaatttgtatttcttgagcttacactgatgagagtagaaagccatgcaaagaaagggaaaggtagtccaggcaatgtggtccagagactttccagaaaacaatggcagagcattctgggatttcttcaatattaaggataatcacagatgtgaatattgacaatgtatacacacacatatgtgcatgtg

SEQ ID NO: 164374 - DNA, 601 bp, Human
aaggctgaaagaaatagatatttctttatatatgaatatacaatccaaacttttattttggccaggattcaagaaatcactagagaaattggggaagagaacttagggtcttctcagaaatgaaacctgcatcatttatctggaacaagatatatgcatgtatctatggaccatgtaatgcttgttataatgacatgaggctctacttggtcatggccacattcatctaggagaaaattcctaactttagtaaaatgtactctttcaaataataaagttattttattcaatttttttttttgagacggaatttcactcttgtcacccaggctggagtgcaatggtgcaatctcagctcactgcaacctccacctcctgggttcaagagattctcctgcctcagcctcccaagaagctgggattacaggaatgtgccaccacgcctggctaatttttgtattttttttagtagagacggggtttcaccatgttggcgaagcttgtcttgaactcctgacctcaaatgatctgcctgccttggcgtcccaaagtgctgggattacaggcatgagccaccgcgctcagccctcatattttattt

SEQ ID NO: 164375 - DNA, 601 bp, Human
gttattttattcaatttttttttttgagacggaatttcactcttgtcacccaggctggagtgcaatggtgcaatctcagctcactgcaacctccacctcctgggttcaagagattctcctgcctcagcctcccaagaagctgggattacaggaatgtgccaccacgcctggctaatttttgtattttttttagtagagacggggtttcaccatgttggcgaagcttgtcttgaactcctgacctcaaatgatctgcctgccttggcgtcccaaagtgctgggattacaggcatgagccacygcgctcagccctcatattttatttagtgatcataagttcattttgcaagcaaaaacaaaaaacaaacaacaacaacaacaacaaaaaaaaccaggagaaaaaaatgtgagcagaaaatatcttgtttcctgaatatggtataacgtaatggtccatcaaagccacacttggaggatagagctagatggggtaaatcctctgacttgctctagaaggtgagtcatgccaaagtggtgcccactcctttgtatttctccttaggaatggacacagtgcttaactctccacaaatgacttcca

SEQ ID NO: 164376 - DNA, 601 bp, Human
actgcaacctccacctcctgggttcaagagattctcctgcctcagcctcccaagaagctgggattacaggaatgtgccaccacgcctggctaatttttgtattttttttagtagagacggggtttcaccatgttggcgaagcttgtcttgaactcctgacctcaaatgatctgcctgccttggcgtcccaaagtgctgggattacaggcatgagccaccgcgctcagccctcatattttatttagtgatcataagttcattttgcaagcaaaaacaaaaaacaaacaacaacaacaacaamaaaaaaaaccaggagaaaaaaatgtgagcagaaaatatcttgtttcctgaatatggtataacgtaatggtccatcaaagccacacttggaggatagagctagatggggtaaatcctctgacttgctctagaaggtgagtcatgccaaagtggtgcccactcctttgtatttctccttaggaatggacacagtgcttaactctccacaaatgacttccacttgggtaagaggtaaatgcttttcaattaccttggaacgaaagaggtagagggaaatcatacaattcagagatgttggcat

SEQ ID NO: 164377 - DNA, 601 bp, Human
tgtatttctccttaggaatggacacagtgcttaactctccacaaatgacttccacttgggtaagaggtaaatgcttttcaattaccttggaacgaaagaggtagagggaaatcatacaattcagagatgttggcatggcgagagttcttcttctacaggggtgatgtatatgaaggatgaaaccagggccgacctagtttaactcctagagcaagaatctaaacaaagttctatgttctcacagagagccaacttaattccctcataatgacatttagccaaacaaaaagctcagctcatyggggctacaaatcctttgagaaggacaagtggacaaatgtgagagagctgccagggatcgatgggccgcaccagctccctgttcactactgggtgctgattttaatgtacaaactaataactcttagaccactaagtacagcagattcagtgtcattttagctttgaagaacagacgctcacagcttttcaagccggcagtgttaaatgatgtatctcattccctccaccccttgagtcaactgctgcctagccagattaaggtgtcagattgatttgttttatacatcttttgaccatg

SEQ ID NO: 164378 - DNA, 601 bp, Human
cagggtgcccattttcgttttctcccaaggccctatttgcagatctgaatctcaacagtgcccttggagacatggcaattcccttactgggattatagagactaatttttcaaattcatacacaatttattgactgaattggcactatcattagacttgctgctcactttatttgttgccttggccagggtggccaaacaatgaggaaatttgtcagtgaagccctcatgccattgggttttctcacacattccatgcaggcctcaacacagactatcagcatttataatatgcattaacytctatataatgtacgtctcctctctttcagagcagaattggctatgtttttttttttattcttttatttttttatttttttgagacacagagtgttgcactgttgcctaagctggagtacagtggcatgatttcagctcaccacaacctccacctctcgggctccagcgattctcctgcctcagcctcccaagtagctgggattacaggtgtgcatcactatgcccagccagaattggcagttttagatgatataactaccttccctactaagcctacttggtagtgtttgcaaaagcaa

SEQ ID NO: 164379 - DNA, 601 bp, Human
agtgaagccctcatgccattgggttttctcacacattccatgcaggcctcaacacagactatcagcatttataatatgcattaacttctatataatgtacgtctcctctctttcagagcagaattggctatgtttttttttttattcttttatttttttatttttttgagacacagagtgttgcactgttgcctaagctggagtacagtggcatgatttcagctcaccacaacctccacctctcgggctccagcgattctcctgcctcagcctcccaagtagctgggattacaggtgtgcrtcactatgcccagccagaattggcagttttagatgatataactaccttccctactaagcctacttggtagtgtttgcaaaagcaacaccacccttttctttaaatattccccaaatgatagtaatatagatcatgaaagtcttttcccttgagattgttttgtatgtgtgagagtttgtggttgggaggtattgagtcctcatacaagccatttggatatgtattcttcatatttcttatggctattgcacctaagttctgttttcttaaggctacattaacattttaaattagaatatg

SEQ ID NO: 164380 - DNA, 601 bp, Human
agccctcatgccattgggttttctcacacattccatgcaggcctcaacacagactatcagcatttataatatgcattaacttctatataatgtacgtctcctctctttcagagcagaattggctatgtttttttttttattcttttatttttttatttttttgagacacagagtgttgcactgttgcctaagctggagtacagtggcatgatttcagctcaccacaacctccacctctcgggctccagcgattctcctgcctcagcctcccaagtagctgggattacaggtgtgcatcacyatgcccagccagaattggcagttttagatgatataactaccttccctactaagcctacttggtagtgtttgcaaaagcaacaccacccttttctttaaatattccccaaatgatagtaatatagatcatgaaagtcttttcccttgagattgttttgtatgtgtgagagtttgtggttgggaggtattgagtcctcatacaagccatttggatatgtattcttcatatttcttatggctattgcacctaagttctgttttcttaaggctacattaacattttaaattagaatatggtgct

SEQ ID NO: 164381 - DNA, 601 bp, Human
cgaaagcaacttcacagccagtgctcctggatcctgctagtttttccaaacacaagcatcctaataaaattcaaacaccatttagctgtttgggaactctaaatataacatcttgccctttgaccacggtgctcagtgttcaatacacaaaacctaatctctaaagatgattttaaaactgaccttcccagagaagtacacgtatccattcagctacgaacagtgcagaaaacaggattttgactcataattatgaaatggccaaaataaaacttagggaacacaaagcaacttttctcarccggttgactcagccaacaaactcacccaagcgaacctcctcagagcacctctcaaaacgatgctttgcagacatttattaatcacagtgaatgcttcccaggaattagggctcctctttaaaatctcaaacttgtaaaccaccttatatttggatgatattttatgcttcccaaagtgcattcatgttttcttttccatttgatcctcccctggaatgagagggcactggaatagaatctcaggattcactgtgtatagcatcctgcaccattccttctcttctggagggcctgttagt

SEQ ID NO: 164382 - DNA, 601 bp, Human
aagtccccagcttgtgccactgctgtcaggagatgagtctctccttgatcgatatttacttaacaaacagcagggatgggagagtttgtttagaggaatcatgtgcactctagggtgaatgaatgctcgggaaagtacttcaactatttgtctccttccctaagatttttgtgtacgtgtgtgtgcacacacgtgtgcagatgcccattctctttttaacttctccaaagacacttcgaagtcatctagaaaaatacctcgctatgtatgattggtacatcattataccgttaaggagctmatgatgcagatgcagtttttctaacccagcaaagtttggttcttcttttgtgctcttatatagagcacaaaagagactcttaggataaactaaatgcacaagcatctacctttgacccctttcagatgagtggaagggaagaaaatacggatggaaacaataaaagcagtttgacaaggcagctcttcactatgtatttttgatggcattacctatatatttttaaaggcccacagggacaaaaagtaactttctccaatttttcagagctgcttcagcattagatatatttaactctac

SEQ ID NO: 164383 - DNA, 601 bp, Human; identical to SEQ ID NO: 33821

SEQ ID NO: 164384 - DNA, 601 bp, Human
tcaactgcagggaagggtgatggatttgtttctttaaaagcttcctcagacagatcatagtctgcagctccaataattagtagagcacaatggtggtggcagagggcgtcggactgctgggatgctgggaatatttccacaatggagggttagacgagagctcaaagtttcacttttttttttttttttttttttgcatttgagctaagattttaacaatcctgtgaaaataggtaatatagtcacgtatttgttgaatacattatttcaaagaaccacaaacacacagaaaaaatatttwaaaagtccatggtgggggaaatgatccagaaacaacagctcttctacttccagccctaaccgtctgggatgctagatggttgtgggcaaaccgtggaaaaagataagcttctgtttttcaagattttattttgttagagagtgcagaaaatctaagtgatgtctctgtttttgctttctagcaattaatatatgacagcagtctttgtgatttattttaactttctgcaagacctttggctcacagaactgcagggtatggtgagaaaccaactacggattgctgcaaaccacaccttct

SEQ ID NO: 164385 - DNA, 601 bp, Human
ttcattgttgggatccacacctgggaggttctctaggacactctgaaggaactcagggtcttgcatcacgtcgtaatcatcctcctccttggctggctcagatgtgtccatggctgagctggcatcaatgtctgctgattctgccaggccaaactctgctccctgcagggacatctgcatggcacaaacaatcttctcttcctcagtcatactgcttaggtcaggaagcccagtgtggccaaactcttgctggctgatggtcatcttcagcagggcatcgtctgagtcttcagtcccagtygtagcaatcccggcctcagcagcagaagctgcagctgcctgccgggcctcctcctcctgccgctgccgctgctcttccataaatacacgaaggaccaaggccagctcaggatcagcactgggatctactccaaattcaaagtcactggcaccaagacccatcatggcaccaccttcaccagccaaaatcggaaaactgatgagagcatcagccaaactgggcccaggaggcactgtcaccagatgagaaccggttccatctttgccattcaacgtgtttacaaaggctgtcagcttttct

SEQ ID NO: 164386 - DNA, 601 bp, Human
aagctcatcagcatttcaaggggtcagatttaggcatcaggatttcttttcttttcttttcttttctttctttctttctttctttctttctttctttctttctttctttctttctttctttcttttttttttgaagcaaagaaggaaaaaatcttgccaagctttatttaggctgtaatgattacagataacacacatctaaccctatattccgtgcttcccatgcagtcccctgagcaggctcagctaccctttccctccagtctcacttcttgtcttcctccttcttgtccttcttgcygtccttggtggcctgggaggccagggagcccacagcatttcgaatggcttcattgttgggatccacacctgggaggttctctaggacactctgaaggaactcagggtcttgcatcacgtcgtaatcatcctcctccttggctggctcagatgtgtccatggctgagctggcatcaatgtctgctgattctgccaggccaaactctgctccctgcagggacatctgcatggcacaaacaatcttctcttcctcagtcatactgcttaggtcaggaagcccagtgtggccaaactcttgctg

SEQ ID NO: 164387 - DNA, 601 bp, Human
tttttgttttttttaggaacatccatactgttttctcaaatcacaatgctaatttacatacccaaggttcactttattccacatctttgtcaacacttgttatctttttatctttttgataataataatatcttatctatgagttgtgatgagttatctcattgtggttttaatttgcatttctctgatgattaaatttgttgagtatttaaaaaatatatcttggccatttgtatgtctttttttgaaaaatgtctactcaaatcctttgcccatttaattaattaattaattaattaaaagagacagggttttgctctgttgtaggatggagtgtagtgatgggatcatggtccctgcagccttgagctcctgggctcaagccatccttctaccttagacccccaagtagctggggctacaggtgtatgccaccatgcctggataattttttaatgctttgtagagatgtggtctcattatgttgtccaggctggtcttgaactcttgggctcaagcaatccacccacctttgtctctcaaagtgctggaattacagacatgagccattgcacttgacccctttgctcgttttaaatag

SEQ ID NO: 164388 - DNA, 601 bp, Human
catagaaacttctgtattactggaggccagttattaaaggttatatgttataggaacattcctcagcattcctcctgtaccagcagaggctgattattaaagtatgctattgtaaagcaaatacttcctgtggagtatgtttttcttttttgtcattgtcagaaatagtggaataaaataatgcattttgccagaagagaaacatttcaagtggtaaggtagaatcaaaatgataaaggcctgctgctttctttgcttcacagtcatttgctatatttttttgcctgaaggaaaatggtartggaagtgttttgtgattaaagattttgagaagtcagtcactgtatatgctatgtattttgcttagattagccatgatcattaaacgtcttaaaaaagcaaatcatgcctgatgtcaaagaaatatctatgagttcatcataaacataaacgaatgaaagaaagaattaattagtcagggccatctgggtggtaacagaatatttatggcctctgtacaaagctgctgtctgtgacctatgagtgtatagcatggaaaacatttttcctctgtgagatgccacacatcctgatactatct

SEQ ID NO: 164389 - DNA, 601 bp, Human
aatttatttttagattgatacataacttttatgcatatttatggggtacgtgtaatattttgttacatgcacagaatgtgtaatgatcaagttaggtgtttaggatatgcatcactttgagcatttatcatttctatattttgagaacagacctgtgttctagctatcttgaaatacgcaatactttgacattaacacactgctatgttctctaatgacatccctggaaacctcctaggggcagccagatctttcatgatagtggttgtcagtcctcatatggagggtggaggtttgaagsagagagccaagggaggttttgtgcacctatgcttgttgtgtttgtacacaatgactatgcatacgctgtgagtataaaaggctcatttaatcctattgtgtcccaggcttggtttgttttcaaatcattacagcatgaatttagaaggttttgtctcatttttttcaaattattaaagagcaatgtttttcccaaagtgtaattgtgggttatctattctagaacatttcaccaggaatacttgtggcacagacatagtgggaatgacttctttacatcttttgggcatggaacaactga

SEQ ID NO: 164390 - DNA, 601 bp, Human
tcaattttaatttccctgttaattaagaagtaattaaaattatcagctggtgttatttaatgttactatttactgtaatgttttatatattttaagaaaatatatgctatagcatagtctttcaatttaaacaaatgccaagttataaaatgtttatttaaataaattttaagtattattaataactctttatcctaccttccctagttgtccattagctctgtattcagctttctttatattttccttcatctttacttgtgtattaatcatgttttttattttctatatttttatgaawtcttcaacatcttggggattttgtggtcctagaagggactgctgctcccaaagtcagacagttcctagagatagcaaatgtcttgtccacagcatgtctctgatttacaaagcacactctccagagccagagtcccatccaccttctttaccaaactctcacacatgaatccaatacagttgtccctccttatcagtaaggcattggttctaggactcctcttggataccaaaatccacatatgctcaagtcccttagatatggcataatatttgccatatattggagaatattgacaat

SEQ ID NO: 164391 - DNA, 601 bp, Human
caattttaatttccctgttaattaagaagtaattaaaattatcagctggtgttatttaatgttactatttactgtaatgttttatatattttaagaaaatatatgctatagcatagtctttcaatttaaacaaatgccaagttataaaatgtttatttaaataaattttaagtattattaataactctttatcctaccttccctagttgtccattagctctgtattcagctttctttatattttccttcatctttacttgtgtattaatcatgttttttattttctatatttttatgaaakcttcaacatcttggggattttgtggtcctagaagggactgctgctcccaaagtcagacagttcctagagatagcaaatgtcttgtccacagcatgtctctgatttacaaagcacactctccagagccagagtcccatccaccttctttaccaaactctcacacatgaatccaatacagttgtccctccttatcagtaaggcattggttctaggactcctcttggataccaaaatccacatatgctcaagtcccttagatatggcataatatttgccatatattggagaatattgacaata

SEQ ID NO: 164392 - DNA, 601 bp, Human
taatatttcccaatattagagaatattgacaagaaaaaaggtccgtacatgttctgtacagatgcttgtttttgctctgaatattttttatttggggttggttgaatccatgatacaccatggatacagagtgctgactatattctccttgtcttaaattattatagggccagttatgggacaactatggccacccctatatcccagagcccacagaaattgttcaaactatctattcccaggcttactcagtctaccctccctatctcactcatttcttcctgtgaaaaccccaatgaargctcagccccatggtttctttttgctcttgctgcctcctgaccaaccctggtacttccccatgtggctccccgcactccatggtgtggagtgcccctcctttaggaaccgtgagtaatgaactatcttttcaagggaagtctgttttggggcaacctgatcggttgacctcaccatatctaaatggatacaaaatcctcggtgaattttaaaacaactggatttgggagtaaaagtttatttatcctctccccatccaagttggactcacctataaagttcttgtcataatgagtctggt

SEQ ID NO: 164393 - DNA, 601 bp, Human
ttaggagatatatctaatgctaaatgacgagttaatgggtgcagcacaccaacatggcacacgtatacatatgtaacaaacctgcacgttgtgcacatgtaccctaaaatttaaagtatataaaaaaaagtgtaatcccccatattggaggtggggccttgtgagaggtgattggatcatgggggtggatttttcatgaatagtttagtaccatcccttttggtactgtcctcatgatagcaagtgagttttcatgaaatctaaagtgtgtagcacctcccacctcccttttttgctttgrcttttgccatgtgagtgaaagctcctgttttgccttctgccgtgattgcatcacgcttcctgtacagcctgcagaactaggagccaattaaacctcttttcttataaattacctagtctcaggtatttctttatagcaatgcaagaacagcctaatatacttccccacatgaagtgaaaggaaagaccagaaaccagattttcactacatcatgttcatatgcatgcacaaacacacttgcatgcatgcatgcacacacacacagaaatctctaactaataatccaaaattatcccctgc

SEQ ID NO: 164394 - DNA, 601 bp, Human
acaattttatttaaaaattgccctttcctcttattgcccttacatttcagtatgagatttgaagggaacacacatccaaactgtatcagggagataataaaaatcagggtaatttgtaatccaagctgaaaatcagctttcctctatagtaatttattgatttgtaatatgatggaattacctaaatgatgatcaaattaaaaagtttataataacataaggtatttttttgatggctagatagaacaataaccgaggattctataagaggtcaggctttgttcaaataaattgaagataktgcctggtgataatagacaccatttcttagagcaggaaattccttttttttctttgaatattgaaataaggaaataaaaggactccatctgtcaatttaactttttctgtctgctctatttgtagtttaggtttgaaatgaaagtttcttattacttttattttaggcaaaccaatctatcttcttatttgtgttaatttgtgttagattttttcttgtataacatagatgacttttgcctgtttacatttgttccatcaacctgaattttcccataccctttctgtctttagtctcccc

SEQ ID NO: 164395 - DNA, 601 bp, Human
ccgaggattctataagaggtcaggctttgttcaaataaattgaagatagtgcctggtgataatagacaccatttcttagagcaggaaattccttttttttctttgaatattgaaataaggaaataaaaggactccatctgtcaatttaactttttctgtctgctctatttgtagtttaggtttgaaatgaaagtttcttattacttttattttaggcaaaccaatctatcttcttatttgtgttaatttgtgttagattttttcttgtataacatagatgacttttgcctgtttacatttrttccatcaacctgaattttcccataccctttctgtctttagtctccccctctgctggtactacacacagttactttaactactcattatatagaagatgttttctggttcctattttctcccttcctctatcaatcaattgtctacaagcttttcagacagatgttattttgcactgatgacctgaattattaggtggttttaaatgtggcctctttaattttttttgttttctcttcaaaataacaggcatcttgggtcagaattgtgtaaagaaaggcagtgcggtaaatgcagtatt

SEQ ID NO: 164396 - DNA, 601 bp, Human
tgtgatcccactttcatcctgggctgtgctccctgcaatgtgatctgctctgttattttccatgatcgatttgattataaagatcagaggtttcttaacttgatggaaaaattcaatgaaaacctcaggattctgagctctccatggatccaggtgagatcaagagcttctcttcctgagatattatttttgttattttatcagacagtccaatttttttaattttttaaaattatactttaagttctgggatatgtgtgcagaatgggcaggtttgtcacatgggtatacatgtgccatrgtggtttgctgcacccattaacccgtcatctatattaggtatttctcctaatgctatccctccctttacccccaatcacccaacaggccctggtgtgtgatgttcccctccctgtgcccatgtgttctcattgttcacctcccacttaagagtgaaaacatgcagtgtttggttttctgttcctgtgttagtttgctgagaatgatggtttccagcttcatccatgtcccggccaaggacatgaactctctcagcatttgcttgtctgtaaaggattttatttccccttcacttatgaag

SEQ ID NO: 164397 - DNA, 601 bp, Human
aatagtggcccccactctcttctggcttgtctggtgtctgcacagagatctgctgttagtctaatgggcttccctttgtgggcaacctaacctttctctctggctgccctcaatattttttccgtcatttcaaccttggtgcatatgatgattgtgtgtcttggggttgctattctcgaggagtatctttgtgatgttcctgtatttcctgaatttgaatgttggcctgtcttgctaggttggggaagttctcctggatagtatcctgaagcgtgtttttcaacttggttccattctcccygtcactttcagatacaccaattaaacatatgtttggtcttttcacttagtcccatatttcctggaggctttgttcgctccttttcattcttttttctctaatcttgtattctcactttatttcattaagttgatcttcaatgactgttatcctttcttctgcttgatcaatttggctattgatagttgtgtatgcttcatgaagttcttgtgctttgtttttcaactccatcaggtcatttatgttcttcttgaaactggttattctagttagcaattcctctttttatcaaggttctta

SEQ ID NO: 164398 - DNA, 601 bp, Human
gccattttttttattcagttctcccttgtttgctataaacctttgactgatttccagagttctgttagagttgattctgacttttttgtttgaatttttgggtgtttttatggagagatgggcccatggaactgtctattgtgccaattttgcgggcattattctgtgaagtgagtggttgaacactacagcttgcccatatcttagcattgtggcattaacatctgggaaagatagatgatttctttattttacagatgagaaaagaaatgcctgaatatagagctggaattcaagcccrttagctggtggtttttcccaccaaacccccaaatccagtttctggcagtactttggtgactgcccaaaagcacacactcaatggaaatccaagtcccttgttgaaaagctggcattactcacaggcttttcctctaattcacacctagagacctcttcatcacattatttggcaaaaggggaggaggttttggagaacagatgctaccaggaagttctgaataggataggggtgtttgctgcttcagcaaggtaattaaggttaagatgacaaaatgattggattttggggtgtatgaac

SEQ ID NO: 164399 - DNA, 601 bp, Human
caaacccccaaatccagtttctggcagtactttggtgactgcccaaaagcacacactcaatggaaatccaagtcccttgttgaaaagctggcattactcacaggcttttcctctaattcacacctagagacctcttcatcacattatttggcaaaaggggaggaggttttggagaacagatgctaccaggaagttctgaataggataggggtgtttgctgcttcagcaaggtaattaaggttaagatgacaaaatgattggattttggggtgtatgaaccattaaaaaattacagttttgsctgtgctgagctagcatgtcctgaactctgtctaaaggataattgtgtgattatctcaactactcacggaagtatcttaactactctggtgtatgggtacttatccataaaatgctgagttacattttatggtatctttgtacccctcccagttataaaagagtgattctatttctgaggcttcctgctaggagtagaaatagcagggaatggctttgtgatctatttcatgttgttcaaatttccttaccctctgttcttatctgtaaaatgggaattaaagcaattcatggcattcta

SEQ ID NO: 164400 - DNA, 601 bp, Human
tcatcacattatttggcaaaaggggaggaggttttggagaacagatgctaccaggaagttctgaataggataggggtgtttgctgcttcagcaaggtaattaaggttaagatgacaaaatgattggattttggggtgtatgaaccattaaaaaattacagttttgcctgtgctgagctagcatgtcctgaactctgtctaaaggataattgtgtgattatctcaactactcacggaagtatcttaactactctggtgtatgggtacttatccataaaatgctgagttacattttatggtawctttgtacccctcccagttataaaagagtgattctatttctgaggcttcctgctaggagtagaaatagcagggaatggctttgtgatctatttcatgttgttcaaatttccttaccctctgttcttatctgtaaaatgggaattaaagcaattcatggcattctatatttcaaggctatggagaagaattaatgtacaaaaatgagataattgacatgaagctattttaatattctgaaaataatatatgagtatagaaaattatcatctttgatcccttgttcagaattttctaactta

SEQ ID NO: 164401 - DNA, 601 bp, Human
ggtgtttgctgcttcagcaaggtaattaaggttaagatgacaaaatgattggattttggggtgtatgaaccattaaaaaattacagttttgcctgtgctgagctagcatgtcctgaactctgtctaaaggataattgtgtgattatctcaactactcacggaagtatcttaactactctggtgtatgggtacttatccataaaatgctgagttacattttatggtatctttgtacccctcccagttataaaagagtgattctatttctgaggcttcctgctaggagtagaaatagcagggwatggctttgtgatctatttcatgttgttcaaatttccttaccctctgttcttatctgtaaaatgggaattaaagcaattcatggcattctatatttcaaggctatggagaagaattaatgtacaaaaatgagataattgacatgaagctattttaatattctgaaaataatatatgagtatagaaaattatcatctttgatcccttgttcagaattttctaacttaaatctttctatcagtatagaggactactttgtacgtataatcaaatgctcctcttacagagggagataattttt

SEQ ID NO: 164402 - DNA, 601 bp, Human
tccataaaatgctgagttacattttatggtatctttgtacccctcccagttataaaagagtgattctatttctgaggcttcctgctaggagtagaaatagcagggaatggctttgtgatctatttcatgttgttcaaatttccttaccctctgttcttatctgtaaaatgggaattaaagcaattcatggcattctatatttcaaggctatggagaagaattaatgtacaaaaatgagataattgacatgaagctattttaatattctgaaaataatatatgagtatagaaaattatcatmtttgatcccttgttcagaattttctaacttaaatctttctatcagtatagaggactactttgtacgtataatcaaatgctcctcttacagagggagataatttttaaaaattcactccagttttaaaccagcagttgacttatggcatatgtcttcaatacatgtgtttaatttaattaatttttaaaaatctttaaggtctgcaataatttccctgctctcatcgattatctcccaggaagtcataataaaatagctgaaaattttgcttacattaaaagttatgtattggagagaata

SEQ ID NO: 164403 - DNA, 601 bp, Human
ttttaaaaatctttaaggtctgcaataatttccctgctctcatcgattatctcccaggaagtcataataaaatagctgaaaattttgcttacattaaaagttatgtattggagagaataaaagaacatcaagaatccctggacatgaacagtgctcgggactttattgattgtttcctgatcaaaatggaacaggtaaaatgttatttgtttgcctgcatcttgtggttcattgattagttctataacgattgcttaaatagtgaggcaagaaacacttcatgagcactttatgtacttaycatgtgtatagatctggatgaagcaccatggagaatttataattgaattgttaaacaattataatatgtgagcaccattgttaggtactaagaatttatctgagaaaagacagaatgcatgccttagatgaaagggaaatacaaataagatagaaaatgcaaaatatagcatcataaattgaaggtggacatggtcatatcacacagcatatgggagagtgaggtgaaagggtttaacctaagtgggcctcctgcatgtcctgatgtttggtgtaaatgttaaaatatttacaatgaata

SEQ ID NO: 164404 - DNA, 601 bp, Human
attattttattcaaccgctttacagcactaggtggaaatgcagaatcagtcagtaggtgaaaatgggacagagtcaaagatgctgatgaaggtgacttccatgaaattgcccatggaatgttagcaggactgctcgaataatgtgttctagatggagtgaagtgaagaagatgagatactttgaggaaactggagaagggaagaaacaaattatttgtactctccaccttctctactgctaggtcaattgttctgaggtctaattaatttaagaatctcattaaaatatggacactgccasaaaaatgacactatatgagttctccatttttgtacacatttaggggggtttccttaatgctatgaattgtctccattaattccaggttaaggagaattgtaaggtctatggtgtttcagtgaccagtggctatgtcctcattactatatttaaaaagtgcattgttcctttgacctcactataatatttagaatctagcttattttatttttcacagcatttttattgagtttaattcacatattgtaccctcatacattttaaatacaattcaacagttttagtatttttcacagagct

SEQ ID NO: 164405 - DNA, 601 bp, Human
gctctagtcaacactaatatactgtctgtctctataggtttgctattgtagacatttcatgtaaatgaaattacacagtatgtggtctttgtttgtctgacttctgtcacttagcacaatgttttcaaggttcattgacatagcatgtatcagtacctcattcctttatgtggtcaaataatatttgggtgtggctatatcatattttatatttccattcattagttgttggttttgattgtttctgttttggctgttatgaataatgctggtatggacatttgtgtacaagtttttgtgyatagataagtttttatttctcttgggtatatacttggctgcagaattgctggattatacagcaactgtatgcttaatctttggagaaaccgtggctggatcaaagacctaaatgtaagagctaaaaatataaaactctcagaagaaaacctaggcatgaaatttgctgcaccatttcgtattctcactacaatgttttgaggattccactttctccacaaccttgctaatgtttcttatctttttgattccagccatcccagtggggttgaggtggttccatgtggtttggtttgcattt

SEQ ID NO: 164406 - DNA, 601 bp, Human
tcttttgaaatacaagtttttagtttttgtgaaatccaatttatttatttatttgcatggtttcttgcaatttttttgtcacgtttaagaaatgatttcttagtccaatatcacaaagattcaccccaagttttcttcaaatggttttataattttaactattacatttaggtctaagatccactctgagtcaatttttgattatagtgtgaggtatgggtacaacttcattctttgcatgtgcattcagttgtcctagtaccatttgttgaaaagactattcattccccattgagtgatygtggtacatttgttgaaattcagttgactacaaacacgaggatttatttttagactctaaattctatttcattgatctatatagctttctttatgccagtatgacagtactttttttttttgagacagggtctcgctctggttgcctaggctatagtgcaatggtgtgatcttggcctctacctcccgggctcaggtgattctcccacctcagcctcctgaatagctgggattacaggcatgtgccactatggccagataatttattgtatttttagcagagacagcctttcgctatttt

SEQ ID NO: 164407 - DNA, 601 bp, Human
aatttatttatttatttgcatggtttcttgcaatttttttgtcacgtttaagaaatgatttcttagtccaatatcacaaagattcaccccaagttttcttcaaatggttttataattttaactattacatttaggtctaagatccactctgagtcaatttttgattatagtgtgaggtatgggtacaacttcattctttgcatgtgcattcagttgtcctagtaccatttgttgaaaagactattcattccccattgagtgatcgtggtacatttgttgaaattcagttgactacaaacaygaggatttatttttagactctaaattctatttcattgatctatatagctttctttatgccagtatgacagtactttttttttttgagacagggtctcgctctggttgcctaggctatagtgcaatggtgtgatcttggcctctacctcccgggctcaggtgattctcccacctcagcctcctgaatagctgggattacaggcatgtgccactatggccagataatttattgtatttttagcagagacagcctttcgctattttgcacaggctggcctccaactgctggcctcaagcagtc

SEQ ID NO: 164408 - DNA, 601 bp, Human
aatctttttttgtatgttaattactccctatagtcaataatttagactgtcccattgttatggtcaattttgtgttacatatttccctcatcttaaaccagccttagttgccttgtgaagtgctttgttcttccactctccattttattattaatggcataaactgcaattactttttcaccaactgaatataagaactcagttcattcagtcccttgtcctaagcatctccattgcccttactctctccttcatcctgtataggtggttaatgtccaaactctctgtcttcatgtctgtmgtgtctcttcaatttctatattcttattcattcctgtgcttgtttactagatcaagttgactattacctcacatctggaatataataatggctggccccatcttgtcttgtcaatctgttctctttctccataatcttggatatgttaccatgttatcttttgcacatttccgagttcataatgagtctgcaggcaatattgagtgtgactaaattcttttttttttctcagacagagtcttactctgtcacccaggctggaatgcattggcatgattgtggctcactttagctcgacct

SEQ ID NO: 164409 - DNA, 601 bp, Human
ggctggaatgcattggcatgattgtggctcactttagctcgaccttctggactcaagtgatcctcccacctcagcctccccagtagttgggactgcaggtgcacatcaccatgcccagataattaaaaatttgtttttatagagatagggtctcactgtgtttgcccaggctggagtggacctcctgaactcaagtattcctcctgcctcagcttccgacagtgctgggatttaaggcatgagccactgtgcccagtctaaattacctataattccttatacaatgtaaatgccatgtaartggttgttatactgtattttttagggaataatgacaagaaaaagaagtctgtacatgtccaatatgaacacttttttttttctgaattttattcttttttgttttagaggcagaatcttgccccattgcccaggctgttgtgaagtggtatgaccatagctcactgcagccttgaactcctgggctcaagcaattcttccacctcagcctcctaagtatatgggacaacaggtgcatgccaccatgcccaactaattttttttttttttttttttgtagagatagggtctttccaggttg

SEQ ID NO: 164410 - DNA, 601 bp, Human
cttatacaatgtaaatgccatgtaagtggttgttatactgtattttttagggaataatgacaagaaaaagaagtctgtacatgtccaatatgaacacttttttttttctgaattttattcttttttgttttagaggcagaatcttgccccattgcccaggctgttgtgaagtggtatgaccatagctcactgcagccttgaactcctgggctcaagcaattcttccacctcagcctcctaagtatatgggacaacaggtgcatgccaccatgcccaactaattttttttttttttttttttgtagagatagggtctttccaggttgcctaggctagtcttgaacttctgggctcaagcgatcctcccatcttggcctcccaaagtgctgggattacaggcatgagccacctcacctggcctctttttccaatttttttttttttttatttaaggttggttgaatcaatggatgtggaatccatggataggaaggtggattgtactctattattagctatattcaactggctgtgcaatttattattttttaaaaaagagatcagatttactcctccattctaacaggctttataccctttg

SEQ ID NO: 164411 - DNA, 601 bp, Human
taatagccattctaacagatgtgaggtgatagctcattgtgtttttaatttgtaactttttaatgattagtgttgttaagcatctttttatgtatctcttaatcatttgtatgtcttctttttagaaatattcattcaggctatttgcccatttcttaattggattatttgttttctttctatagagttgtttaagttccacatatatgtgcatgcatgtctgtgtgtatatagtttttaattttaattttaattttaaaagaagtatagaaatttaatatgtttttcttccaatgttatkttttctcatatttttttctttttttaattatactttaagttctagggtacatgtgcacaatgtgcaggtttgttacatatgtatacatgtgccatgtaggtgtgctgcacccattaactcatcatttacattaggtatatctcttaatgctatccctccccgctccccccaccccacaatagtcccccgtgtgtgatgttccccttcctgtgtccatgtgttctcattgttcaaatcccacctatgagtgagaacatgcggtgtttggttttttgtctttgtgatagtttgctgagaatg

SEQ ID NO: 164412 - DNA, 601 bp, Human
taatcagtgcatttagtccatttatatttaaggttaatattgttatgtgtgaatttcatcctgtcattatgatgttagctggttattttgctcattagtttatgcagtttcttcctagcatcaatggtctttacaatttagcatgtttttgcagtggctggtagcagtttttgctttccatgtttagtgcttccttctggtgctcttgtagggcaggcatggtggtgacaaaatctctcagggtttgcttgtctgtaaaggattttatttctccttcacttatgaagtttagtttggctgkatatgaaattctgggttgaaaattcttttctttaagaatgttgaatatcggcccccactctcttctggcttgtattgcccagatcaatgtcctgtagtttttcctcaatcttgtcttctagtagtttacagtatctggtgttatgtttaagtctttaatccatgttgagttgcttgagtatatggtgtgagatcagtgttcaattttattctttagcatttggatatccagttttctcaccatttatttaagagactgtcccctttccattgcatattcttggtacctttgtctaaaatc

SEQ ID NO: 164413 - DNA, 601 bp, Human
atatcggcccccactctcttctggcttgtattgcccagatcaatgtcctgtagtttttcctcaatcttgtcttctagtagtttacagtatctggtgttatgtttaagtctttaatccatgttgagttgcttgagtatatggtgtgagatcagtgttcaattttattctttagcatttggatatccagttttctcaccatttatttaagagactgtcccctttccattgcatattcttggtacctttgtctaaaatcaattgtagttgcatgggttcttttccagctctctgttatattctrttggttgatgtgtccatttttatgccagtaccatgctgttttaattactattaatttgtagtatagcttgaaatcaggtaatgtgatgcctccagctttcttctttctgctaattattgccttggctatttgggtatttttgtggttctatatgaattttttggggatgacttttcctatttctaagagagataacattggaattttgatagggatttcaatgaaaccataaatttctttagatagtatggacattttaacaatatcaactcttccaatccatgcatatggtatctcttt

SEQ ID NO: 164414 - DNA, 601 bp, Human
ttctgttggttgatgtgtccatttttatgccagtaccatgctgttttaattactattaatttgtagtatagcttgaaatcaggtaatgtgatgcctccagctttcttctttctgctaattattgccttggctatttgggtatttttgtggttctatatgaattttttggggatgacttttcctatttctaagagagataacattggaattttgatagggatttcaatgaaaccataaatttctttagatagtatggacattttaacaatatcaactcttccaatccatgcatatggtatcycttttttatttgtgtcttcttcatttttttaattaatattttatattttttggtgactttcacttttttggttaaatgtactcctaaatactttatttctttgatgctattgtaaatgggtttatttttaaaatttctttttcatatcatttgttgttaatgtgttgaaacactattaatttttgtgtgttgattttgtatcctgcaactttactgaatttaattatcagttctaagagttttttggtgatgtgtttaaggttttctgtatgtaagatcatgccatcagcaaacagagac

SEQ ID NO: 164415 - DNA, 601 bp, Human
attatcagttctaagagttttttggtgatgtgtttaaggttttctgtatgtaagatcatgccatcagcaaacagagacaattttacttcttttcttctttggatgtctttcatttatttttcttgtctcattgctctggctagtacttctcatactatgttgaattgaagtactgagagtgggcatccatatctttttcctgatcttatgggaaaatccttcaactttccactattgaatatgaggttagccatgcacttgtcatatatggacttgtgttgaggctagttattagctccagtatcaggagcagcaatttgcaggacatgctaacaagtctcatccaggcagaaacttggacttttgagtttcatccctttctctgccatgatcccagaggattaaacctctggaagtgcttgtgcactaatataatactggtactttttccagtggtctagagagagactcctgtatacttagtcctctctgctcccagaattggtaagttaagtagatagctgtggggaaccttagagttagggtgttaatgtgtggtctaaatcctcctttccacagggagaagctggatgttggggat

SEQ ID NO: 164416 - DNA, 601 bp, Human
ctattgaatatgaggttagccatgcacttgtcatatatggacttgtgttgaggctagttattagctccactatcaggagcagcaatttgcaggacatgctaacaagtctcatccaggcagaaacttggacttttgagtttcatccctttctctgccatgatcccagaggattaaacctctggaagtgcttgtgcactaatataatactggtactttttccagtggtctagagagagactcctgtatacttagtcctctctgctcccagaattggtaagttaagtagatagctgtggggaamcttagagttagggtgttaatgtgtggtctaaatcctcctttccacagggagaagctggatgttggggattcattctcaattgtatggtgtagtgcctgggtgaggttggtgctgtagctttttcttcccagtctatgtggatattttctttgttgctcagtacatagaagtctctcaacttgtttctgactttctctcacagggaattgatctgtgaatagatatttatttggtgtatccttgggtggaagaagagactggagcctcctattctgcaatgtccctattgtgacactgaga

SEQ ID NO: 164417 - DNA, 601 bp, Human
gacaggatctctctttgtcatccaagctggagtgcagtggcatgaacatgcttcactgcagccttgacctcctgggctcatgtgtttctctgtgtcagcctcccatgtagctgggaccacagatatgtgcaattcacctggttaattttttgatttttatttttttttttgagaggagtttcactctgtcacccaggatagagtgcagtggtgtgatctcggctcactgcaacctccgtctcctgggttcaagtgattcttatgcctcagccttccgagtagctgagattacaggcgcatkccatcacgcccggctaatttttgtgtttttagtagagatgagatttcaccatgttgcccaggctggtctcgaactcctgacctcaggtgactgcctgtcttggcctcccaaagtgctgggattacaggcatgtgccaccatgcctggccaagtttttgattttttttttagagacagggggtctcacttgttgcccaggctggtgtcaaactccagaactcaagtgatcctcctgccttggcatcccaaagtgttgggattacaggcatgagccaccacagatggacttgttatattctt

SEQ ID NO: 164418 - DNA, 601 bp, Human
cagtaattctaaattggcatatgaaaattagaattgaaatggacacacaagtccaagaatatacaaaaaagagacataattacagctgtcccacttgtggtcaatgtttatgaaataataatggtgtgaacatgagtattaatataataaaaatgtgatataaatacattggggaaactagagtgggggaagtgtgaatgtgtgtgcatgtttctgtttgtgggtgtgtgtctatttgttatggggtgatgatggagatataagtcctcatctttcttaccatgaggttttagaaatttttaaagataaattaaaaaataaaaagagagtcagtatttagaaatatgaatataaacttcagaagaaacttctagaatgtttcaacatagtcacctttgtggagtgtgaggatgagagagaatatcatttcaagtttcaaataaacatatgcacacaatacacaaatccatccatacatatagatctgttagtagaattaaagttttaaaacattatatgttattctgatacaacattaatttgatttttttctttcttcaagaacagtaatttcttgagtttataatgtactaaatattta

SEQ ID NO: 164419 - DNA, 601 bp, Human
ctccccaccaacctgccccatgcagtgacctgtgatgttaaattcaaaaactacctcatccccaaggtaagcttgtttctcctacactacatctccatgctcttcaagtccccaaattcatagtatagtcccaatcctctaacaacacatgatgagagaagtgtaaaattcatacgtggggcagctttctggactctgctgtttccattccagtttgggcctatgaaggtttataacaggtctcagtatctagcagtgtatgtcttccaaatttgttctgcttctttagtattttttttttgtggctattctcaggtgtttacatttccaagtaagtgttgaaagtatcattttgtcaatttcccaaaacactgtgctgggatttttatcatgatgacattaaatctttagatcaatttagaaataattgatgtcctgacaggttgaatctttcaattcatggatatgattatgctctttatttatttgggctttcttctattgtgtcagtaatgttttgtcttcagttcagtggctttctcatgtattacgttttttttctgaaatgatatttctatgtaattgtaagttgtgtatttaa

SEQ ID NO: 164420 - DNA, 601 bp, Human
tgtttctcctacactacatctccatgctcttcaagtccccaaattcatagtatagtcccaatcctctaacaacacatgatgagagaagtgtaaaattcatacgtggggcagctttctggactctgctgtttccattccagtttgggcctatgaaggtttataacaggtctcagtatctagcagtgtatgtcttccaaatttgttctgcttctttagtattttttttttgtggctattctcaggtgtttacatttccaagtaagtgttgaaagtatcattttgtcaatttcccaaaacactrtgctgggatttttatcatgatgacattaaatctttagatcaatttagaaataattgatgtcctgacaggttgaatctttcaattcatggatatgattatgctctttatttatttgggctttcttctattgtgtcagtaatgttttgtcttcagttcagtggctttctcatgtattacgttttttttctgaaatgatatttctatgtaattgtaagttgtgtatttaatatataatataaaatatatataatatgaaataaatatatataatattaaaaatatattttcaaaacagagtct

SEQ ID NO: 164421 - DNA, 601 bp, Human
agcagtgtatgtcttccaaatttgttctgcttctttagtattttttttttgtggctattctcaggtgtttacatttccaagtaagtgttgaaagtatcattttgtcaatttcccaaaacactgtgctgggatttttatcatgatgacattaaatctttagatcaatttagaaataattgatgtcctgacaggttgaatctttcaattcatggatatgattatgctctttatttatttgggctttcttctattgtgtcagtaatgttttgtcttcagttcagtggctttctcatgtattacrttttttttctgaaatgatatttctatgtaattgtaagttgtgtatttaatatataatataaaatatatataatatgaaataaatatatataatattaaaaatatattttcaaaacagagtcttgctatgttgcacagattgatcttctgggctcaagcaatcctccacctcttcctcctgagtagctgggattagagatgtgtgccactgcacctggcttttaaataatatactttaaaaaaaatgccttttccatttctttgtttctggtacatggaaatataattgactttattattt

SEQ ID NO: 164422 - DNA, 601 bp, Human
tccttgtttcatatatgatgttcaggatgggtggagatttaacatctcaccagtgagaatgatgttttatgtatattttcataagtaaaaaatcagattagagaaggttgccttctacttttgatgactttttttggtcttgaatgtgtatacaatttgatcaaatggagtctctgcatcaatcgatatggccatatattttgtcctgtctatagatataatatatatattagttaaaatacacacaaatgtgcacacagagacatacacagctgggttttatttgctatgattttcaggrtgtttgaacttatatttacaagagacattggtttgcaatttttcttcctcaaaattttcttgtcagatttctgatattgaggaaatgttggcttcgtaaaataaggaagataatgttctgtattgtggttgtttttataatcttttctcccttctctattctttttgtgctcacttagttctgtctttggagtgactcataaattttggttaagtgccagttatgatgtatgaaaaaatgcagaatgtcagatgaggttcatcttcttccagaaagggttcatccctcccatgctaggca

SEQ ID NO: 164423 - DNA, 601 bp, Human
tttatttgctatgattttcagggtgtttgaacttatatttacaagagacattggtttgcaatttttcttcctcaaaattttcttgtcagatttctgatattgaggaaatgttggcttcgtaaaataaggaagataatgttctgtattgtggttgtttttataatcttttctcccttctctattctttttgtgctcacttagttctgtctttggagtgactcataaattttggttaagtgccagttatgatgtatgaaaaaatgcagaatgtcagatgaggttcatcttcttccagaaagggttcatccctcccatgctaggcagacagaattatgcaacaccttctaccttcattcagaattagatatcaacacagtcaaaaaaaattttttttcaattttttttttattatactttaagttctgggatacatgtgcagaatgtgcagttttgttacataggtatacacgtgccatggtggttcgctgcacccatcaacctgtcacctacattaggtatttctcctaatgttatccctcccctagccccaacatcccccacaggccctggtgtgtgatgttaccctccctgtgtccttatt

SEQ ID NO: 164424 - DNA, 601 bp, Human
aatgttggcttcgtaaaataaggaagataatgttctgtattgtggttgtttttataatcttttctcccttctctattctttttgtgctcacttagttctgtctttggagtgactcataaattttggttaagtgccagttatgatgtatgaaaaaatgcagaatgtcagatgaggttcatcttcttccagaaagggttcatccctcccatgctaggcagacagaattatgcaacaccttctaccttcattcagaattagatatcaacacagtcaaaaaaaattttttttcaattttttttttattatactttaagttctgggatacatgtgcagaatgtgcagttttgttacataggtatacacgtgccatggtggttcgctgcacccatcaacctgtcacctacattaggtatttctcctaatgttatccctcccctagccccaacatcccccacaggccctggtgtgtgatgttaccctccctgtgtccttattgttcaactcccacttataagtgagaacatgcggtgtttggttttctgatcttgtgatagtttgctgagaatgatggtttccagcttcatcaatgtccctgcaaagg

SEQ ID NO: 164425 - DNA, 601 bp, Human
tttcaattttttttttattatactttaagttctgggatacatgtgcagaatgtgcagttttgttacataggtatacacgtgccatggtggttcgctgcacccatcaacctgtcacctacattaggtatttctcctaatgttatccctcccctagccccaacatcccccacaggccctggtgtgtgatgttaccctccctgtgtccttattgttcaactcccacttataagtgagaacatgcggtgtttggttttctgatcttgtgatagtttgctgagaatgatggtttccagcttcatcmatgtccctgcaaaggacatgaagtcatcattttttatggttgcatagtattccatggtgtatatgtgtcatattttcttaatctagtctatcattgatggacatttgggttggttccaagtctttgctattgtgaatagtgccacaataaacatacgaaacacagtcaaaaattgactgtagccatcaaaaattgactgtaacctctctgagttcccccatgcctgcaagcctgagtaatttttgtctcagcatcttttccagtgccttctaacacatggtttctgtgtttattgagact

SEQ ID NO: 164426 - DNA, 601 bp, Human
cagaatgtgcagttttgttacataggtatacacgtgccatggtggttcgctgcacccatcaacctgtcacctacattaggtatttctcctaatgttatccctcccctagccccaacatcccccacaggccctggtgtgtgatgttaccctccctgtgtccttattgttcaactcccacttataagtgagaacatgcggtgtttggttttctgatcttgtgatagtttgctgagaatgatggtttccagcttcatcaatgtccctgcaaaggacatgaagtcatcattttttatggttgcayagtattccatggtgtatatgtgtcatattttcttaatctagtctatcattgatggacatttgggttggttccaagtctttgctattgtgaatagtgccacaataaacatacgaaacacagtcaaaaattgactgtagccatcaaaaattgactgtaacctctctgagttcccccatgcctgcaagcctgagtaatttttgtctcagcatcttttccagtgccttctaacacatggtttctgtgtttattgagactttttagttgctattctgcaagctgctccattccacttgaagcgag

SEQ ID NO: 164427 - DNA, 601 bp, Human
tcaacctgtcacctacattaggtatttctcctaatgttatccctcccctagccccaacatcccccacaggccctggtgtgtgatgttaccctccctgtgtccttattgttcaactcccacttataagtgagaacatgcggtgtttggttttctgatcttgtgatagtttgctgagaatgatggtttccagcttcatcaatgtccctgcaaaggacatgaagtcatcattttttatggttgcatagtattccatggtgtatatgtgtcatattttcttaatctagtctatcattgatggacwtttgggttggttccaagtctttgctattgtgaatagtgccacaataaacatacgaaacacagtcaaaaattgactgtagccatcaaaaattgactgtaacctctctgagttcccccatgcctgcaagcctgagtaatttttgtctcagcatcttttccagtgccttctaacacatggtttctgtgtttattgagactttttagttgctattctgcaagctgctccattccacttgaagcgagtacatattgccattataaagaaataaaataatgaaaatttaactttgagaggaaaaag

SEQ ID NO: 164428 - DNA, 601 bp, Human
aacatttacttgcgtggagtgaatgtatttattttccttatttatcatactttgtataaatattaatgttttgctaaagaaaaggccaggtgtggagattcccatttgtaatcccagctctttgggaggccaaagtggaaggatcatttgcacccaggagctggaggccagcctgagcaacatagtgaaactctatctctacaaaaaataaaaaaattagctgggtgtagtggcatgtgcctgtagtcccagctacttgggaggctgaagtgggaggattgctggtgtccaagaggttgasgctgctgtgagctatggtcgtaccactgtactccagcctgggtgacagagcaaggccctgtctcaaaaaaaacaaaaaaaaaagaggaaagaaaagaaatatcatgtattcaattatatggtatctccccactctccacattattgggagtgttagaaaatctgtagcaactattatgtagcataatatctttctagaatgaatatatgtgtgtgtaggtatatagtatacatataatatatggaaatgtgcatacatctacattttaatctatacatttatctgcatttatctatcatc

SEQ ID NO: 164429 - DNA, 601 bp, Human
gtgtagtggcatgtgcctgtagtcccagctacttgggaggctgaagtgggaggattgctggtgtccaagaggttgacgctgctgtgagctatggtcgtaccactgtactccagcctgggtgacagagcaaggccctgtctcaaaaaaaacaaaaaaaaaagaggaaagaaaagaaatatcatgtattcaattatatggtatctccccactctccacattattgggagtgttagaaaatctgtagcaactattatgtagcataatatctttctagaatgaatatatgtgtgtgtaggtatayagtatacatataatatatggaaatgtgcatacatctacattttaatctatacatttatctgcatttatctatcatctatctacctatgtaatctaatctgtcacatttaacacctaagtacttcagtatataattcccaaaaacaaggactttctcctacataataataataacattcacactcaaggaattattatcaatacattaatattatctaatatcttataactacattttcccagttatactaaaatatctcttatagcttttttttgatggacttcctgtagtccagtcaag

SEQ ID NO: 164430 - DNA, 601 bp, Human
ttaatagccacagggatctctttcccagttccaaagaggaattaatgaagaccaggtatgtttagaggcttctatttaaaaactgtcttctggaagtcctagccagagcaatcaggcaagaggaagaaagaaaacgtattcaaataggaaaagaataaatcgaaatatctctcttcactgatgatatgattctacacctagaaaactctgaagactcttccaaaagggcctctggaagggataaatgaccagtaaagtttcaggatacaaaataaatgcacaaaaatcaatagcatttttrtatatcaataatgttcaagctgagagccaaatcaagaacgcaatcccatttacaatagccacaaaatattaaatccctaggaatacatctaaccaaggaagtgaaagatctctttaaggaaaactgcaaaacactactgaaagaaatcatagatgacaaaaacaaatggaaaagcattccattctcatggattggaagaatcaatactgttaaaatggccatactgggccaggtgcggtggctcatgcccataatcccagcactttgggaggccaaggccagcggatcacaaggtcatga

SEQ ID NO: 164431 - DNA, 601 bp, Human
aaatcatagatgacaaaaacaaatggaaaagcattccattctcatggattggaagaatcaatactgttaaaatggccatactgggccaggtgcggtggctcatgcccataatcccagcactttgggaggccaaggccagcggatcacaaggtcatgagatcaagaacatcctggctaacatggtgaaaccccatctctactaaaaatacaaaaagttagccaggcaaggtggcaagtgcctgtagtcccagctacttgggaggctgaggcaggagaatggcgtgaacccggaaggtggagyttgcagtgagcagagatcacactattgtactccagcctgggtgacagagtgagactctgtctcaaaaaaaaaataaaataaaaaaataaaggccatactgcccaaagcaatctactgattcaatgctattcctatccgactaccagtgtctcttctaaaatttatatggaaacaaaaaagcctgaatagccaaaacaaacctaagcaaaaagaacaaagctggagtcgtcacgctaccagacttcaaactatgctataaggctacagtaaccaaaatagcgtagtactggtacaaaaaca

SEQ ID NO: 164432 - DNA, 601 bp, Human
ggaaaagactccctattcaataaatgatgctgggatggcaggctagccatatgcagaatgaaactggaccccatcctttcaccatatataaatatgcactcaagatggattaaagttttaaatgtaagacatcaaactataagaattgcaaaagaaatacctaggaaacaccatcctgggcattggccttgggaaagaattcatgactaagtcctcaaaagcaatcacaatgaaaaaaaattgatatgttacttaaaattgataatttagttacaaattaaactaaagagcttctgcatawcaaaagtaactattaacaaagtaaacagacaacctacagaatgggaggaaatatttgcaaactatgcatctgacaaaggtctaatatcctataaggtaattaaacaattgaacaaacagaaaacaaataatgccattaaaaagtaaaatacatgaacagacactgctcaaaagacatacaagtggccaataaacatatgaaaaaatgtttcacatcactaaacatcagagaaatgcaaatcaaaaccaaaatgggataccatctcacatcagtcagaatggctatgattaagaagtcaaa

SEQ ID NO: 164433 - DNA, 601 bp, Human
cgaccataataacatccctgacttctgtgctgcacaatgacaaagaattccccaacccagagatgtttgaccctggccactttctggataagagtggcaactttaagaaaagtgactacttcatgcctttctcagcaggtaatagatattcatttccatctgtccttcagggcacatgatacctttttgggatcagttgactcttacatgatgccacctctgaggtttggctgaattgctttgcagatcattagcaccattccctatgcccatgcgatttccctgctgatgaacatccccrttattgggccaggttagtggggctttggggagttgatccagtttttcaaactgaaaaagctagaatgtaggttaatttaattctgcctctagatacatcactgagctacccaagagctcttcttaatgggtgaaacttatttagacatttctcatctgccatgagaaaagtatctaattccacaactttgaatatcttccctgtggtgtccctagctccctagactgagctctggagatacaagtatctgagagcagagaatgggctcttaagaggctcactcctgatttagagaagtag

SEQ ID NO: 164434 - DNA, 601 bp, Human
tagggatcacagaaatcataaagaggaaatgacatggggcatagcttctgaaggaagcataggagtagagctttttaggcagatgtgacagcaagagataaagcttgaaactttgtggtgtgttggaaattgatgaagaatggatatgcctagagctgagagtggaggagatgaagaatggaaggagtgatatagaacatcagactgggaacagaatgtgaagagtcaggtcaagccatttggcctttatcccataggacagatgggtgttgtttaaagttgtaaaatgagagactgacakgtttagacatgtacttttgaaagtacactaggaaaaaaaatctttggctaaacattgtgccagaagtacaaaggggaacacactatatgagccttctcttttcagcccatcttccctgtgaatgcatttctagaaaaagactgatggaaacttgtagtgtcaaaagagcagttataacgtgggaacacttagtgaagtgcatggcatagagctgatactccataaatatttgttgagtgaagggtgcctagtaaaataagatattaagtagataggaagtgtattcatttttgtttttct

SEQ ID NO: 164435 - DNA, 601 bp, Human
gactgacatgtttagacatgtacttttgaaagtacactaggaaaaaaaatctttggctaaacattgtgccagaagtacaaaggggaacacactatatgagccttctcttttcagcccatcttccctgtgaatgcatttctagaaaaagactgatggaaacttgtagtgtcaaaagagcagttataacgtgggaacacttagtgaagtgcatggcatagagctgatactccataaatatttgttgagtgaagggtgcctagtaaaataagatattaagtagataggaagtgtattcattttcgtttttctgtgtatccagccatccttccagtcattctgccttcgatccatccatctatttaatcatttatcaaatagttactgcatactctttgtgactgttcatgacctaatgttcaaggaacaaatcccctatgtctcttattttcaggaaaacggatgtgtatgggagagggcctggcccgcatggagctgtttttattcctgaccaccattttgcagaactttaacctgaaatctcaggttgacccaaaggatattgacatcacccccattgccaatgcatttggtcgtgtgccac

SEQ ID NO: 164436 - DNA, 601 bp, Human
tcatttatcaaatagttactgcatactctttgtgactgttcatgacctaatgttcaaggaacaaatcccctatgtctcttattttcaggaaaacggatgtgtatgggagagggcctggcccgcatggagctgtttttattcctgaccaccattttgcagaactttaacctgaaatctcaggttgacccaaaggatattgacatcacccccattgccaatgcatttggtcgtgtgccacccttgtaccagctctgcttcattcctgtctgaagaagggcagatagtttggctgctcctgtgytgtcacctgcaattctcccttatcagggccattggcctctcccttctctctgtgagggatattttctctgacttgtcaatccacatcttcccattccctcaagatccaatgaacatccaacctccattaaagagagtttcttgggtcacttcctaaatatatctgctattctccatactctgtatcacttgtattgaccaccacatatgctaatacctatctactgctgagttgtcagtatgttatcactagaaaacaaagaaaaatgattaataaatgacaattcagagccatttattc

SEQ ID NO: 164437 - DNA, 601 bp, Human
cgactgcgggaagcggctccgagagatggagacgcacgcccccgccacccccaccctgttgctcaccggtgctgcagccccacgagtcccagagtgatcacatgcggtacatccagctgcgtgggccactctcctgaggcgatgcacccgaacacgccacattcctctcggatccccaactcctccagctccatgtcgccgccgaaagcacgtggaaggacctgccgctgcggccaaggtgtaagcaccaaccagctgccagctcggcccgtcgagctcagaagctcgcgctcgcgacagrctcttccttcccgagggtggccccagctactgcggcggcgcgcgctgtccctaggtggcgtggccagctcagccctgctcctccccctccgagtccaccaacgagcgagggcggaggggcggtcccgcggctgaggggcggggtcacggatgctgtagggtggagctagccttcccctaagagctgcctggaaagctgtatttgctgcacgtggaaatctccgttattttccagcacccaacagtagcgtaatgggagtaacggacttaacctcatttctctttcagagcatttagcctt

SEQ ID NO: 164438 - DNA, 601 bp, Human
gtgtaataatttatatcaacttccagttaagtcaggtagtaagaaaaggaaagatcaccgaagcaaagtaattttttttaactcgaaaggatctcccaatttttcaaaatcaagtgtatggatcttggcatagagacactactcccctgtcccccttttgaagaagggagttaatttttgtcatgttattaccaacgttttcattcattaggcaagacgtctaccaatgaatcttttccagatgcactgttccctatggttggcttatttccatttaatttatgtgagatctactaccagyagtcattctcaacatcaactagtcatctttccctgggtctgaagtctagcatcctcaagttcccatagcgataactactttcaaacccataatctgctcaatagctctgcccttgcaaacaaaagcttgtggtggttggaggccccgcgcgaaaacctttaggtgttgaaggacctggactggccgccacgccacactagcctattacaggagcagccacaggctccgggagactagaacccgcctgcagtcggggaggagccctgacccagctagaccaagcaaaccggcggtttacaa

SEQ ID NO: 164439 - DNA, 601 bp, Human
attctgttaaccccaggactaaatgtttcagattagattatacccaagacaaaaaactggaccaaatacaaaacaaaagtgatagaaatctcaccttctagattccatcttcttaaagataaggttggccaggcatggtggctcacgcctgtaatctcagcactttgggagaccgaagagggtggatcacttgaggccaggagttcaagaccagcctggtcaacatggtgaaaccccgtctctgctaaaaatacaaaaattacctgagtgtggtggcgggcgcctgtaatcccagctactygggagacaggtacgagaatcacttgaacttgggaaacggaggttgcaatgagcccagatcataccactccactccagcctaggtgacagagtgagaccctgtctcaaaaaaaaaaaaaaaaaagggaggccaaggcgggcagatcacgaggtcaggagatcgagaccatcctggctaacacagtgaaaccccgtttctactaaaaatacaaaaaattagccgggcgtggtggggggcgcctgtagtcccagctactcgggaggctgaggcaggagaatggcgtgaacccgggaggcggag

SEQ ID NO: 164440 - DNA, 601 bp, Human
agattagtttgggattcatactatatgtacttttctttcattcaacattgtttatgagattcacccatgactttactcacaacagtagtctgttattttttattactgtagaatagtccattgtaaaaatatacatcccagccaggtgcagtggctcaggtctataattccagcactgccttggaggccaaggcaggaggatcacttgaactcaggagttcaagaccagtctgggcaacatagtgaaaccccccatctcaatatttacttaataaataaacgtatatcccattactttttmaaatctatttcactgttggacatttcagctgtttccagattggggcttttttgaaaaattgcatgtctctcaatggacatatgtatgcatttctgttgaatacatacccagaagtggaaggcagggtcatagggcatgcatatatccaagcactgttctaagcactttacatatattaacatatttagtcccaatcacaatcctataaggtaggtgctattattaaacccaatgtacagatgaggaaactgaggcatagagaagtctacgctcctgaaccaataaggtctctgcgagggc

SEQ ID NO: 164441 - DNA, 601 bp, Human
agaaataacaagttcttccacacagtggaaacaacttgttgctttttcctgataacagagatatttattcctgtccttgataaattagactaaatatattgtttatgaactgtattagagcagagaatgctgagaaataatttatttcatagctcactgagtgaaagttcctgcaggagctagagtttatattttaaaagaagaagaaagaaaaaagagtgagagtaacactgaaagtaaatgaaaacttgcccggagttaggtaactgtttggttatcatggtcctttaaattgtacttyacagtgattgttgcaattattgttatcagatgtaaaaagaaaaaaatccacagttcttcaaaggtagtcaataatcaatataacattttaataagtctgaaagtcaaactcagaagccaacctaataatgggagctgtaattccaaaatgacccatcacagacatcagaaaagataatataatgcaatatagcatgtagaagaaagaaaatgcacataagactaataagaaaacctgagctccagtctctctttgaccctaattcctaaacacagagcaaatcactgcatctctctggat

SEQ ID NO: 164442 - DNA, 601 bp, Human
ttgctttaagtgaatgataatcaaatacaagatttatctatgtttgaataattataaatcatgttgatttgtaggtaatcctttagaagatgctaaaagtcatttacagattataacagtgagtaacacagaggccggaaaatactggtgtgacagtgaggtcagagcattgatatggtctgatgaaaaaattaagcgaatgcttgaaggggccacaagaaacaagaaaatatttgaggaaattgccagaagattaattaatgcagtttgggatagacagagaccggaaacaatgtcataygaaatataaaaatgtaaaatatgaatatagcattttacaaagaaaaaatggcaaccctccaagaaaaatgagattttatgaagaagttgactgcatcctaagaaaaccaactctcagaactgccaaatggagacatggtaactttggaattgacattaacaaaaaaaattctagacattcctctttgcattttcatttagcaagagaaaaactctttaaaaatgaaatccttacactattgtatgctcaaatgacccttaaaaatcattaaaaataggtacctaatttaagccaagagtt

SEQ ID NO: 164443 - DNA, 601 bp, Human
cattctggtacaatttttttcccattttggtaaaatatacataaaatatttaccattatacccataagtacgttcacgttgttgtgcaaacatcaccactctccatctccagagctttttcatcattccaaactgaaacttctgtagccattaaacaataactcctccatcccaactcgccttagcctgtggtgaccactattctcctttccatctttgtgaatttgactattctaggtacctcatataagtggaatcatacaatattcgtccatttgtgcctggcttatttcacttatartatctttagggctcctccatgttgtagcatttatcagaatttccttcattttaatattccattgtatggatacaccattttgtttattcatccatcgatggttatctgggttgtttctgcctttcggctattatcaataactctgctatgaatgtggatgtataaatatctgcttgagtccctgctttcaattcttttgggtatatacccagaagcgaaattgttgatcatatggtaatttgtgtttaatttttttaggacctgcagtactgtttttccacagcatgtatatgtttttat

SEQ ID NO: 164444 - DNA, 601 bp, Human
tggcttagaggaagatttggaagctccgtacaatgcagttcatgtttccttagttcctttataacttcccacagacatcactgcattaacctctacacttgacttgtctttacttttctattctcaaacctcagcaacttttctgagatgtgatttacatacaatcaaattcacccaactaaagcgtataactgtggtttttagtatatccacagttatataataatcaccagtatcccattttagaacattttgatcaccccacaaagaaatcccgtatctgccaggcacggtggctaaygcctgtaatcccaacactgtgggaggccaaggcaggcagaacacgaggtcaagagatcaagaccatcctggccaacatggtgaaaccccatctctactaaaaatacaaaaattagctgggcgtggtggccgcgcacctgtggtctcagctactcgggaggctgaggcaggagaatcacttgaacccaggaggcggaggttgcagtgagccgtggtcacaccactgcactccagcctgggcgactgagcaagactctgtctcaaaaaaaaaaaagaaagaaaccccatatccatcagtagt

SEQ ID NO: 164445 - DNA, 601 bp, Human
acctccatgaaggagagtggggctggaggttgagttccatcttgcagccaatgacttaatcaatcacatcataaaaactctggcttagaggaagatttggaagctccgtacaatgcagttcatgtttccttagttcctttataacttcccacagacatcactgcattaacctctacacttgacttgtctttacttttctattctcaaacctcagcaacttttctgagatgtgatttacatacaatcaaattcacccaactaaagcgtataactgtggtttttagtatatccacagttatayaataatcaccagtatcccattttagaacattttgatcaccccacaaagaaatcccgtatctgccaggcacggtggctaatgcctgtaatcccaacactgtgggaggccaaggcaggcagaacacgaggtcaagagatcaagaccatcctggccaacatggtgaaaccccatctctactaaaaatacaaaaattagctgggcgtggtggccgcgcacctgtggtctcagctactcgggaggctgaggcaggagaatcacttgaacccaggaggcggaggttgcagtgagccgtggtcacac

SEQ ID NO: 164446 - DNA, 601 bp, Human
tttttttttttgtttggcatgtttgcatgccaaatatgaaatatttggaatatatttagaaaatgtgaaacaggacaaatgcatagtcatcctagagattatattattttaaactgtcacatgaaaattcaaagcaaagatataaacccacaaggatctcagcagctaaatacgtaagaaaaaaacttaaacaggcaaggattttaggtacacctgcaatatatacctactgattcacaaattgccactccgctcttaggaagaatgtaatagaacgtagtattgaggtataaaaatatgrattatttatcttcagggaaaaaaattcacatgaaatagtctttctttaaaacaacaacaaagtgatgggtatttacatgtaaaaacagaggtcacttcatttttattttttgtatttcactgatgaatttttgaaattggagttgctattattaataatagctccatattgttaactttgatatctggccaaaaaaccagtcccccaaaagtattctctttcctatcttaaatgtatgctataagccataagcttttctttacttcaaatgaaaatccagctacagctgtagaccccttg

SEQ ID NO: 164447 - DNA, 601 bp, Human
gaatgagaatccttggaacctgggaggcagaggttgcagtaagccaaaatcgtaccactgaaccacagcctgagcaacagagtgagactctgcctcaaaaacaaataaataatctaaataaataaaacacgatcctgaagtaaatttaaaaagccaatatatatccccttatgttcatacagtcattgctggagatgtagctgaagatgattcagtcagtaataagtcagaagacataggagatacagataaaaaacaaggtcttgacacacataaaataatattctggttttttttttttgtacgtgtgtgtgtgtgtgtgtgtgtgtgtgtacaaagtatatacataaaatgctattataagacactgctatggcctgaactgtgttcctcccaccaatattcatatattgaagccttaacccccaatgtgatgtatttggagacagggcctttgaatgataactagctttagatgaggtcatgagagtggtgccctcataatgggttttagattttatatctatatattaatagacgctaccatacctaagaaattatgttataacattatatgaagtactgttggatcataactcaa

SEQ ID NO: 164448 - DNA, 601 bp, Human
atggtcttaaagacctctactaaccacagtgtctccggattttattatctggcttaaatgatgagtcccaattgtaagacagtctgcgtctagggaagagaggggaaccacagacagttaagactggaaatgttggtgagaaatctcaaaatatttcgctggtggacaagaaagaaactggtatgctagagaactatacatctcccccagttagatgactacagataaagcagcccaacagcagtggcatgatatcttcatacagtcattgctggagatgcagctaaagatgattccattagttatgtcagaagacttagttagagactcagatacatacccaatatctatagtgacaaaaagatgcttaagggtagggaatctaactaatcatatttaatattagggtccctttaaaaaggaaaatactgcattagagtttaaaacacaattctgggccaggcgttgtggctcatgcctctaatcccagcactttgggaagccaaggtgggtggatcacttgaggcaggagtttgagaccagcctggccaacatggtgaaaccccatctctactaaaaaatacacaaaaaattagctagg

SEQ ID NO: 164449 - DNA, 601 bp, Human
tgtctttaaagtatatttaaaccaaaggattgagatacagtacatacacactaagacatgatagcatgaaataaactgaatgagttctagaccaggattcaggaaatcaaagttgtaaggctctgtggaagcttgaagtaaccaagtgtcttctctagaccaggggtccccaacacctggacccttactggtccgtggcctgttacgaactgggttgcacagcaggaggtgagtggtgggcgagccaagcttcatctgtatttacagacactccccatcatgcacattatgacctgagctscgcgactcctgtcagatcaacggcaacattagattctcacattagattagaacactggagcacgaagactgttgtgaactgtgcaggcaagggatctaggttgtgtgctccttatgagaatctaatgcctgatgatctgtcattgtctcccatcactcccagatgggaccatgtagttgcaggaaaacaagctccgggctcccactgattctagattatggtgagttgtttaattatttcattatatattacaacgtaataataacagaaataaagtgcacaataaatgtaatgcacttg

SEQ ID NO: 164450 - DNA, 601 bp, Human
ggcagaagttaaagtaaattttcatactaattgtggtaaaattgagtaaaatagaaaaagggcattgaagaacttagaaaaatataaaatacatgagactttcttagaagtagtacatttctctgagacccatcataaatgtctttaaagtatatttaaaccaaaggattgagatacagtacatacacactaagacatgatagcatgaaataaactgaatgagttctagaccaggattcaggaaatcaaagttgtaaggctctgtggaagcttgaagtaaccaagtgtcttctctagaccaggggtccccaacacctggacccttactggtccgtggcctgttacgaactgggttgcacagcaggaggtgagtggtgggcgagccaagcttcatctgtatttacagacactccccatcatgcacattatgacctgagctccgcgactcctgtcagatcaacggcaacattagattctcacattagattagaacactggagcacgaagactgttgtgaactgtgcaggcaagggatctaggttgtgtgctccttatgagaatctaatgcctgatgatctgtcattgtctcccatcactccca

SEQ ID NO: 164451 - DNA, 601 bp, Human
tattctgggacccaataaaacagaaaaatcacgagaccaggaatcccaagatggagaacatgtcacagaatgtgccaacgtaaaaatgggagaggaccagacaggtaggaaggtgaagaaaaataatcttaacatcatgttacatcacacaggttcaaggatcccttttccaaaatgcctgggatcagaagtgtttcagatttagatactttttcagattttagagtatttgcatatacatagtgaggtatcttagaaaggggagccaagtccaaacatgaaattcatatgtgtttcatayatatagcttaaagctaattttatgcaatattcttaataattttgtgcatgaaacaaagttttgactatacccatcacatgaggtcaagtgtataattttccacatgtagcatcatgttggtgctcaaaaagtttcaaattttgtagcatttcagatttcatattagggatgctcaacctgtattgagaatgttcagtaccataagaggaatattatatatgtaagttaaataggtttcattacatgctatttgacaagctagctgaatttattatgaaacagatttagtatacatttgat

SEQ ID NO: 164452 - DNA, 601 bp, Human
agatttaggttctgtattttgtttccccactgtttaagagaaaagctaagctatgatttgttactccatctcctatggaggaaactgctttctttaataatgttgcatccaattatttaccttgtctgatgtatataatgcatatatcttttacctctctacctaatgcaggtatctctacgtcagtattggaaccctctaataatacaacttttatcccaactgtagcaaatgaaggaggaaagcactggactgtgccagaagtcagggctctaatagacatctggtctgataaaagcakacaacgacaactagagggaacagtgagaaataagaggatatttcaacaaattgcagccaagcttcagaaatttggaatagacagagactggaaacagtgcagaacaaaatacaaaaacctaaaacatgaatacaagatcgtaagaacagctcaagatctaggcatgactaagagtatgaaattttttactgagttggatgctattctgggacccaataaaacagaaaaatcacgagaccaggaatcccaagatggagaacatgtcacagaatgtgccaacgtaaaaatgggagaggacca

SEQ ID NO: 164453 - DNA, 601 bp, Human
tcgtaagataaagaaaaaagaaaggagttaaattgtttgtacctatcctatttcaaaacaaattatctacaatgagccattttcttaagtaattactgttttctatagtaaatgctacacatttatatattgaacttccactatacactgacatacaccctacatactaaaggagtggtatggaagagaaaaaaaaggtatacaggaaagatgatcaaaatatgactaaaaaaacacaactttattaaagccagtaaccggcataataatggacagatttaggttctgtattttgtttccycactgtttaagagaaaagctaagctatgatttgttactccatctcctatggaggaaactgctttctttaataatgttgcatccaattatttaccttgtctgatgtatataatgcatatatcttttacctctctacctaatgcaggtatctctacgtcagtattggaaccctctaataatacaacttttatcccaactgtagcaaatgaaggaggaaagcactggactgtgccagaagtcagggctctaatagacatctggtctgataaaagcatacaacgacaactagagggaacagtga

SEQ ID NO: 164454 - DNA, 601 bp, Human
gcttgtaagtttataattcagaaaatgaacctacttcttttatgaaaatgaaatctgagaaaaacacaagattggttgtcaaaataaccaatataaagtcaagtactgtcagtaatgtaaatgaagtataaaactgttctagagacctaatacacaccatggcatattaaaggatttataactaagtggagacatactgcctaggaacaaggcattatgaaatttctgacacatttccctaccattaaaagaaaatacttcatttaaaatggctttagtctttctgtaattttcgcaaggygtaagcactgattgttctgtgtgactcttccaagccctcagctcatgagtagcctcagttctcaaccctgactacacattagattcacagtctggggatgagggatgaggcaggtaccagagtggtggtttttaaatgcttcccagtagactgatatatagccaaaggaaatcgtaagataaagaaaaaagaaaggagttaaattgtttgtacctatcctatttcaaaacaaattatctacaatgagccattttcttaagtaattactgttttctatagtaaatgctacacatttatata

SEQ ID NO: 164455 - DNA, 601 bp, Human
tctggaggttcacttgaacctgggaggttcaggctgcaatgagcagtggtctctccactacactctagcttggtgaaagaaaattactttcttttttaaaaaacttattttattttattttatcttattttgagacagggtctcactcttttgcccaagctggagtgcagtggtgtattctcagcccattgcaacctccacctccccgactcaagcaatcctcccacctcagcctcccaaatacctgagaccacaggcacatgccaccaagcctggctaatttttgcatttttttgtagayacaggttttgccctgttgggaggctggtctccaactcctgagctcaggcaatccacctgccttggcaccccaaagtactgggattacaggcctgagccaccatgcccagccaaaaattcctttctttaataatattacatccaatttgaaaccctgtctcaaaaaaaacacaaagaccaaagttaatgtgcttgtaagtttataattcagaaaatgaacctacttcttttatgaaaatgaaatctgagaaaaacacaagattggttgtcaaaataaccaatataaagtcaagtactgtca

SEQ ID NO: 164456 - DNA, 601 bp, Human
ttgcttctatttttcttttcttttctagtctcactctgttgcccaggctggagtgcagtgtcatgatcccagctcactgtaacctctgcctccggggttcaagcaattctcctgcctcagcctcctgactagctgggattacaggagcgcaccatcacgcccagctaattttgtatatttagtagagacagggtttcaccatgttagccaggctgatctagaactctcgacctctggtgatccacccgcctcggcctcccaaattgctgggattacaggcgtgagccactgcacccggccrcttctaatttcttattgaagctagaagcaaaaaccttacttctaacttacataatagaaaaacttatttgtaacccaaataagaaaaaaaattctgaaaaagcattacaaagcaaagacattaaatatttgtaacctaaataagaaaaaaaattctgaaaagcatttcaaagcaaagacattaaatacaccataaaatatctcaaacaaatgctataaagtttttttaatgacttaaaactcatgaacctgacaaaagttattaattgtaatatcatttgtatgataggggccaaaacct

SEQ ID NO: 164457 - DNA, 601 bp, Human
ttgtctcaagggaagtttttccttcaggctgaaatgatatagttaagaatcatttagatccaggcttctttaatcacaaagcctgcttatttggcagtttctcaagttactccctcaggcagcttgaaccagttaaactacatcctttcagctcttcggagcttattgacaaccagccatctggtttcctaggaaacaaaaccttggctggaaatagtgaatcatttccaggtcactttcaacatggagagtggagcaggaaagcactggactgaggaggaggttaaagctttgctaagtstctgggcagaaaaaaatatacgaaaacaactttatggaacactaagaaataaaggaatatttatttacattgctaaaaggctgcaatcattaggagtatacagagactggaaacagtgctgggctaagtacaaaaatctcaaatatgaatatagaacagttaaatatgcccataactctggagacagctctaaaactatgaagttcttccatgatttggatgtaatcctgcagtatgaacctgccacacaatttacagaggaagatgcaaatggcaggtacctggaaacgctcagcccaa

SEQ ID NO: 164458 - DNA, 601 bp, Human
aaatagcacttttgctattagaaaaaaaaattttgtttctgaaaaccctctgctgaccaggcaccctttcccatgtctgtgtctcatttcctgcattagtgttgattaagtggtgatacagagaaaaaagccaaaatctagactgaaggtagggcaagacatagtaaagactaagagcatccataccactgtgcagtataaactctcataaaggttccaactgctttgccatttttaatagttctgaacaagtgctataaatagtagatgtttattgaccaatttttgttccaaagaatayatatcaggatagaaacaaaaagtaaacctcttccatatgtgcctgtagactttagtagctgttaatacattgatttatttggtaaaaaggaacctttttcaaaattatatattgcaattgttgcagtgttttattaacgagaaaaatgacaacattaaatatgttgccaagtaaaactctaaaaaaacttggcatgatcacagctcacagcagcctcaagaaatgattttattaaatgcattaaatactgaaaatagatatgcataatactatataccatatgggactaaataaattgac

SEQ ID NO: 164459 - DNA, 601 bp, Human
atgcccattttacagataaacacactaaagcaatagaaaggaagttactttcccattgtcacacagacagcaggtggtagccaggattccaatgcagacaatccaactgcagaatttatgcttctaacctctactctttataacccctaaatagggtttcaacaggatgagtatgtagatgtaaattaaaatctccaaatataatagaggcaaaatgcatagttggtaaccattttttatgcctttctgcattttccaaatgttctccaataaatagcacttttgctattagaaaaaaaaattttgtttctgaaaaccctctgctgaccaggcaccctttcccatgtctgtgtctcatttcctgcattagtgttgattaagtggtgatacagagaaaaaagccaaaatctagactgaaggtagggcaagacatagtaaagactaagagcatccataccactgtgcagtataaactctcataaaggttccaactgctttgccatttttaatagttctgaacaagtgctataaatagtagatgtttattgaccaatttttgttccaaagaatatatatcaggatagaaacaaaaagtaaacct

SEQ ID NO: 164460 - DNA, 601 bp, Human
atcctggccaacatggtgaaaccctgtctctactaaaaatacaaaaattagctggccatagtagcacacgcttgtagtcccagctactcaggaggctgaggcaggagaattgcttgaacccgggaggcggagttgcagtgaaccaagatcgcaccactgcactccagcctgggcgacagagcggagactccgtctcaaaaaaaaaaaaaaagaagacatcagaaacaataacctcctgccttctcaagtgatgagctttgttaaagattaacttctaggtggaggcgggtggaccacgagstcaggagatcgagaccatcctggctaacacggtgaaaccccgtctctactaaaaatacaaaaaatgagccgggcgtggtggcgggcgcctgtcgtcccagctactccggaggctgaggcaggagaacggcgtgaacccaggaggcggagcttgcagtgagctgagatcgcgccactgcactccggcctgggcgacagagcgagactccgtttcaaaaaaaaaaaaaaaaagttagcttttgttttgttgtcctgctttgctagaccaaatgaaagaaaacccattaacatcctctgtaaa

SEQ ID NO: 164461 - DNA, 601 bp, Human
aatggcgcaatatcggctcaccacaacctccgcctcccaggttcaaacgattctcttacctcagcctcccaagtagctgggattacaggcatgcgccaccacgcctggctaattttgtatttttagtagagacagggtttctccatgttggtcaggctggtcttgaactcccgacctcaggtgatcctcctgccttggcctgccaaagtcctgggattacaggcatgaaccaccgcacttggtctgtcatcaacatttcttaaagttcaaatttaccttgtgtgatttgaatgttggcacsgaactcccatcactagtcacaataccagcactctcctgacccctgtgaatataaaaagatattagctgttaaatctgccaattgattagcttcttgaagaactttatcaagcatactttctcaacaagcatccatgaacttagtgtgacaacacattaaatgctacttgtactagcactacttctattgatgatgctgatgctgatgattagcaatcacagcagatgacaatgtaacaattagatatctcatctaatattaactaacatgccaggcagtctgtcctagcattttacgttg

SEQ ID NO: 164462 - DNA, 601 bp, Human
aaaaaagtataactggggaagaaatacatcctaatttgacaaatgttaggatataaagttgaaagtggctgatccaaagaatattacttttgattgcaaattatttattcaaatccccctccccatattaatgatcatctgtctttgttatctttgtcatcccatttcttttttctttcttttttttttttgagatggagtttcactcttgttgcccaggctggagtacaatggcgcaatatcggctcaccacaacctccgcctcccaggttcaaacgattctcttacctcagcctcccargtagctgggattacaggcatgcgccaccacgcctggctaattttgtatttttagtagagacagggtttctccatgttggtcaggctggtcttgaactcccgacctcaggtgatcctcctgccttggcctgccaaagtcctgggattacaggcatgaaccaccgcacttggtctgtcatcaacatttcttaaagttcaaatttaccttgtgtgatttgaatgttggcaccgaactcccatcactagtcacaataccagcactctcctgacccctgtgaatataaaaagatattagctgtta

SEQ ID NO: 164463 - DNA, 601 bp, Human
ttaagaaatttttactccatatttatactttcatgattgtctgaatttttaaatgaactatgtattttttcatttggggacagaaaagcacaataaggtcattataatgcctatgaacagggctggacaaagctctaggaaatgtctaaagacagaactaaaaaatggaatgacagtgagtggtacaaaagcctgggttctagatatttttgacccagcagttcattattattaagcttctgtaactgttcatcatatgtgaattgcccagctctagaatgcttataggatggggtgtgcrtgtaaccatctattactaaatatcaccaggttctgaagttaccaagtcaaggttattgggagctaataaactgaagaaactcaacattaattaatgaatgcctgaatggataaaaggaagctactaggaatgaatataaagacaggcagttaaaaaaaaaaaaaaagaaagatgaaatgatgaatgaaagcataggcacaaatttgacatcattagcacagaaagctccaaacaacatgctgtgaaccaagagtttaagtaaacagtctccgtcccttttcccatattctagtttcctgt

SEQ ID NO: 164464 - DNA, 601 bp, Human
ttattactgatagaagaaagtaatcaactgtattgaacaatgaaatgtagcagatgtaataaatatcgcttgagtgtactctatgataattacaaagttctgagcaggactgaccaagacaagggcagccccatggacatgcacagattgagtctgaatgggcactacagaacattttcagtagggagctaaaggtaaagataaagtttagcatctaggtaagtcattatgtcaggaaacagtgagttagtggttatctctaagtggtgaatttttaagaaatttttactccatatttatrctttcatgattgtctgaatttttaaatgaactatgtattttttcatttggggacagaaaagcacaataaggtcattataatgcctatgaacagggctggacaaagctctaggaaatgtctaaagacagaactaaaaaatggaatgacagtgagtggtacaaaagcctgggttctagatatttttgacccagcagttcattattattaagcttctgtaactgttcatcatatgtgaattgcccagctctagaatgcttataggatggggtgtgcgtgtaaccatctattactaaatatcac

SEQ ID NO: 164465 - DNA, 601 bp, Human
atttttacttagcatgatataacagtgttattctaaaaaactagtgctagaattctacagattgagtataaaaagaaatgcaatatatacaaaaatatgaatgtgaaaatacacaaactggggaactcaactgtgtggttttaaaaaaaaaatcgaccttcatatagatctagaaaatcataatccttactcctaacaaaaaacaaaatccaagagtcaaaaggaagtgaaaaatagtgatcttatgacttgtgggctcagtcctatatccacaacatataactatatgccttcaaagagycaggtaagcctttgaggcaagaattgccatgtttcaaggagatagctaaaacatttatatgaatgttcaaagaaaagaaatctacttaccttcgaacatactgtctggtcttgcaaaataaacatattcaaagatacaaaaagccactgggtttccttcagaccttgatataatatcaagagtttggacattgtgtctggatatttccacaatttctccaggcaagacttcacggtaatatcttgggaaacaatgttaaagaaagaagacttttaataaactagtccttaaggctgatga

SEQ ID NO: 164466 - DNA, 601 bp, Human
aaatatatacatttgtcaatttaaaaaataaaaattaaaaaaaattttttttcaagacataaagtgaggccgggtatggtggctcacacctgtaatcaagcactttgggaggctgaggcaggcagatggcctgagctcaggagtttgagatcagcatgggcaacatggtgaaaccctgcctctactaaaaatacgaaaaatcagccgggcatggtggtgtgtgcctatggtcccagctatttgggaggctgaagtgggaggatctcttgagcccaggaggtggaggttgcagtaagctgaratcgaaccactgcattccaaccaggtgacacagtgagtcccagtatcaaggaaaaaagaaaaaaaggcataaagtgatattaaaatataacttggccgggcacgatggctcacgtctgtaatcctaacactttgagaggccgaggcaggtggatcacctgagtccaggagctcaagaccaacctgggcaacatggtgaaaccccgtctctgctaaaaatacaaaaattagcctggctgcaatggcacatgcctatagttgcagctattcagaaggctgaggtgggaggattgcttgagcc

SEQ ID NO: 164467 - DNA, 601 bp, Human
acaagctgtacaatgaccactcttttcaaaacattccagaccatttccattttcttggatcataatatcgtgctttttctctttctgttttttaaactttatcccttcttgtacagatgaaaccagtccttctactgacagatacacaacactgtttgctcctaaagaaagagggaaaaataaaaatgtaataagaattcctttagaaaggaagaaacgcgtcaacagagaatagttacaaacagaataatttaagctaggataaatttctcctttagcctttctttaaaaaaaaaaaaaaggaaaaaaaatcaataaaactcagttcctttatttttaaaaattttaattggaatctaggggataacataatttaaaacagcagaggaggcttcaagtctagaatggaattagagggctttgggagtaattttcttaattgaaaaaatggaatttaaagtcaggaagatctaggctcaaagttaagctcaagttcactcagttttcctaagtctattttttcatctatataagatggtggaaacattgcctaaatgtagagtttttatgataatatagataatataggcagcatagtttc

SEQ ID NO: 164468 - DNA, 601 bp, Human
acagccagaactgtagaggctagacacctatgaggtataatgtattctattcaaactttgtgtgaaatggtatatttaactcacctgtcttgttggcatcacctctccttaaccctaacttcttgcaaaccctttaaagcatggacttgggaaatgtcagtgaccacctgccttctctgaccaggttaaaaaggctagccaatgcttgtgtaaaaaaaagaacaccacatattgttgtattatatgcaattggaaatgttcagttatcgcactttggtatccttttcagaaaaaaaaaaaatctcaaaacttataaacataagcatggcattttacattgtaccaactgagtaacagtaaatagatgaggtgtgaccactataacttcttgaccaactttctatcttgaaactacacacatccaaccctaccagctaccattctaattctacaggatattttccagtgagacaagctgtacaatgaccactcttttcaaaacattccagaccatttccattttcttggatcataatatcgtgctttttctctttctgttttttaaactttatcccttcttgtacagatgaaaccagtcctt

SEQ ID NO: 164469 - DNA, 601 bp, Human
gtacacaaaacataaatgaattttgtgtttagacttgggtcccatccccaagatatctcattatacatatgcaaatattccaaaatctaaaaacatccaaaatcttctggtcccaagcattttggataagagatgctctcaacctgtaattccctatgcctttcactcctgctgttccttctgcccaggattcctactcatttcactcaacaactttgtggattatccttgaatcccttttagtcaccattacaatgattctcataaatgttaaataaatacctgctgaaaattattttcragaagtcctctcccacaaatgtaggaatgtgaaagaataaagaatatccctactgctgtagtagggatatctgaatagctactatgaaaaattccaagtggtacactgttggattatcagcaaaagtacagaaaaacagagaaagaggtatgcaacaacattcacactatggtgtcaaaagttgcatatttcatgcagtgtaatacctggtcaaaaagttgtttgccagttgtattgggctgaatggcaaattccagctcagcatccattgtagttactcttacgttgatctgtaataaa

SEQ ID NO: 164470 - DNA, 601 bp, Human
ggaccactgttgcataagtggcccgtcactgatcgaaatgtcattatgcggcacatgacactgtatttatctacataaatagaaagagatatacacaaaaccatcaaatactgttctacgcactttacatagattttcatttaactctcacaataaacctctgaagaagtaatgttaccatcatcctaattgtacaaacgagaaaaataagacaaagagattaatttgtccaaagtcaaacagctgcaactacaactattgcaggcagtgtgactccagtgcccacacttctaaaccactrtacatcactgccctataataaatggtttcattttcctgtatccaagtgaaagtaattctacttaataaaaaacaagttttatttctcagtatacaataccaaagaggataacttgctgattagtttttggctgccacaaacatctcacttactataaataacatttcaatttgctatgaagtacaataaatgctaactctattcacatttttttcaaataagatagactgtatattcacaaacaggaggcacagaagaatcaacagaagtggatattataccagaacaaaagtggtttgg

SEQ ID NO: 164471 - DNA, 601 bp, Human
agctgggattacaagtgtgcaccaccacactcagctaatgtttgcatttttagtagagacagttttgcaatattggacaggaaaaggtacagtaaaaatatggtattacactcttgaactcctgacctcaagtaatcctcccgccttggcctcccaaagtgctgggattacaggtgtgggccaccaagtctagcctaaaaatatattttaatacttctttcaccgtaacagatgttcttgcacactctttgggggtatgaacactctttacactaatcccacaagaagcagctaaaggagraggctagtcaagaaaaaagtcagcaagaagcaaaccaaaggacttcaagcactcagagtccccaaacacagagcagctggcctcgatttaacatcataatcagacatggggctttactacacatgtactcatgtagctatgtgctctcattttagaggacccagtttacccctggcttgacctgaacctgccagcttatcccacacacactacatacaaaagtaaagtctgcatttttcgatccttgcatttgagttcaaggaaagttcatcactgcatttgagttcaaggaaagcagtc

SEQ ID NO: 164472 - DNA, 601 bp, Human
ctcagctgtgaaattccctaaaaggccctgtctccccagtggttctctacttcttcagaaggtgctcctagaatgttttttttttaattaatatattttagtgaggctgtcctttaagctcccataaacttctgatcacatacttttagaagtgaatctgcttgggcacgtaactataacataggtatatttatttacaagttacatactatcatgctaatacactataaagcatatatttttaaaaatgtttaaaaatacatattatatatacatatatatatatttttttaattaattwatttatttttttgcccaaactgaagtgcagaccgcaacctctacctcctgggtttcagcagttctcccacctcagcctcctgagtagctgggattacaagtgtgcaccaccacactcagctaatgtttgcatttttagtagagacagttttgcaatattggacaggaaaaggtacagtaaaaatatggtattacactcttgaactcctgacctcaagtaatcctcccgccttggcctcccaaagtgctgggattacaggtgtgggccaccaagtctagcctaaaaatatattttaatact

SEQ ID NO: 164473 - DNA, 601 bp, Human
aaaaaagcaaaaagtgggccaggcacggtggctcacgcctgtaatctcggcactttgggaggctgaggcaggtggatcacaaggtcaagagttcaaaaccagcctggccaacatggtgacactctgtctctactaaaaatacaaaaattagccgggcatggtggcaagggcctgtaatcccagctactcaggaggttgaggcggagaactgcttgaacccgggaggcggaggttgcactgcattgagctatcgcaccactgtactccagcctgggtgacagagtaagactctgtttcgggraaaaaaaaaaaaaaaagcaaaaagtgagaaatttctagaagatgtggaatataaagtctcatactgataatgcaaaagctgatcaatgtcaaacaatgaaaaattcaatgtggacaaaaggagattccaaataatctaactttggtaaaagacagattgccccagcagtgccatagaaaacattcaagcttggagcggcaggagtagtaatgtacaggtcaaaagcagcagagagaagtataacaaagcagctgggctcagcttctgcctccacactctgtgagattcacaatggtaagt

SEQ ID NO: 164474 - DNA, 601 bp, Human
cttaaaacattccaggcttttggtttcaagacagcaaactgaacccttccatttactttcccactcttgaaaattttcactgaaatgacagaaaaaaagaaaaaacactggctgggcacagtggctcacatctgtgatcccaacactttaggaggccaaggcaggaggagctcaggagtttcagaacagcctgggcaatgtagggagaccttgtctcttaaaaaaaaaaaaaaattagctaagtagtcaagcaaatctgtagttctagctaatcaggaggctgaagtggtaggatcacttragtccaggaggtcaaggctgcagtgagctgtgattatgccactgcactccagcctcagtgacagagcaagaccctgtctgaaaaaaaagaaaaaaaaaattaaaaataagaaaaaagcatttagaaaatgttaccatcaaaaaagcaaaaagtgggccaggcacggtggctcacgcctgtaatctcggcactttgggaggctgaggcaggtggatcacaaggtcaagagttcaaaaccagcctggccaacatggtgacactctgtctctactaaaaatacaaaaattagccgggcatggt

SEQ ID NO: 164475 - DNA, 601 bp, Human
agcactttgggaggccaaggcagctagatcacttgaggctaagagttcaagaccagcctggtcaacatggtgaaaccccatctctgctaaaaatacaaaaattagccaggtgtggtggtgcacacccataatcccagttactcaggaggctgagacagtagaattgcttgagcccaggaggcagaggctgcagtgagccgagttcgcgccactgcactccagcctgggtgccagagcgagactccgtctcaaaacacacacacacacacacacacacacacacacacacacacacacacacacaaataatcttaaaacattccaggcttttggtttcaagacagcaaactgaacccttccatttactttcccactcttgaaaattttcactgaaatgacagaaaaaaagaaaaaacactggctgggcacagtggctcacatctgtgatcccaacactttaggaggccaaggcaggaggagctcaggagtttcagaacagcctgggcaatgtagggagaccttgtctcttaaaaaaaaaaaaaaattagctaagtagtcaagcaaatctgtagttctagctaatcaggaggctgaagtggta

SEQ ID NO: 164476 - DNA, 601 bp, Human
gggtcttctgtatttttatgacttattgaacaatttattctttaaggacaagctcaactaacgtgccttctgtgaataaagctctcctaccatctagataaaattaatcacttgttccctgatattcccataggactttatctatcctgctattagaaaatttactctatcataattgtgttattagcagtgtgtctatttaccctccttgactgcataatacttatggacagagattattgatttatgtgtcttaaaatccatagcatctcacagaatgatcagcctgtggtagatactmaaaagtaagactaagtaggctgtgcgcagtggctcacgtctgtaatcccagcactttgggaggccgaggcgggcggatcacaaagtcaggagatcaagaccatcctgactaacacggtgaaacttcatcactactaaaaatacaaaaaaaaaaaaaaattagctgggcgtggtggcatgcgcctgtagtcccagccacttgggaggcagaagcaggagaatggcgtgaacccgggaagcggagcttgcagtgagccgagatcgtgccactgcactccagcctgggcgacagagcaagact

SEQ ID NO: 164477 - DNA, 601 bp, Human
aataatacactaatacactacaaatgctatgtattgttatcctgtatttttaaaattttgtaccttttcattgctgtgttatttttttcacatattttcaatctgtggttggttgactctgtgaatgcagaacccaaagacaaaagctgaggtccaacaagatctgtcctaggtctttttctcatttttatgtacttggtaggttgatctctttcattctcatggtttaattaccatctattcactgattactcccaaaactgtatctatagtccaagactgtttctaaaaggtctgcacscacatatgcaaataaataccagatatctctcttggttatattgcacatatttcaaactcaataggttcaaaactgaattcatcttccccctcaaatgtattttttcttccactcattttgataaaaggtattaccaaatacccagccgcccaagtcagaaacctggtatgtaaaagtttatgtatatttagctcttttcaaagggaagcaatactatctggtggagctaattatctataccacaagagctaaacttttctacagtaagaacagattgctcatctgggtttttcaatacaa

SEQ ID NO: 164478 - DNA, 601 bp, Human
aggtgtgagccaccacacccggctggaaactgctcttctaaggtcactaccaagctccttattccaacagatactttagttctcctcatatttgacctcttggtaccatttggcagtgctgaccattctcttcatcaaagtattcttttaccttggcttccatgatataatactcttctggtattattcttgttttctgagatggagtctcgctctgtcgcccaggctggagtgcagtggcgccatcttggctcactgcaacctccgcctcccgggttccagtgattctcaggtctcagaytcccgagtagctgggattacaagcatgtgccaccatgcccagccatcttctagtatagaattattcttgaatctgtggccagtgtctcagtacagttgtccctccatatccataaaggattgcttccaggactccccttggataccaaaaactgtggatgctcaagtccctgatataaaatggtgcaatatttgcatataacctatgcacatcctcttgtatactttcaatcatctctaggctaataatactaatacactatattattactactatgtagtataataatacactaataca

SEQ ID NO: 164479 - DNA, 601 bp, Human
cctctccagtagctaggattacaggcatgcaccaccacgcccggctaattttgtatttttagtagagacggggtttctccatgttggtcagcctggtcttgaactcccagcctcaggtgatccgcccacctcggcctcccaaagtgctgggattacaggtgtgagccaccacacccggctggaaactgctcttctaaggtcactaccaagctccttattccaacagatactttagttctcctcatatttgacctcttggtaccatttggcagtgctgaccattctcttcatcaaagtattmttttaccttggcttccatgatataatactcttctggtattattcttgttttctgagatggagtctcgctctgtcgcccaggctggagtgcagtggcgccatcttggctcactgcaacctccgcctcccgggttccagtgattctcaggtctcagattcccgagtagctgggattacaagcatgtgccaccatgcccagccatcttctagtatagaattattcttgaatctgtggccagtgtctcagtacagttgtccctccatatccataaaggattgcttccaggactccccttggata

SEQ ID NO: 164480 - DNA, 601 bp, Human
tatttttttttctttttcagagacaactttcttttatggactgtccattatacactaacctcaatttccatacctgacatccactgcccccagtctaccataatctggctcaaacacccaatactctatggtaactgttcttctttttttttttttctttagacagagtttcgctcttgttgcctaggctggagtgcaatggcatgatctcggctcactgcaaactccacctcccgggttcaagcgattctcctgcctgagcctctccagtagctaggattacaggcatgcaccaccacgmccggctaattttgtatttttagtagagacggggtttctccatgttggtcagcctggtcttgaactcccagcctcaggtgatccgcccacctcggcctcccaaagtgctgggattacaggtgtgagccaccacacccggctggaaactgctcttctaaggtcactaccaagctccttattccaacagatactttagttctcctcatatttgacctcttggtaccatttggcagtgctgaccattctcttcatcaaagtattcttttaccttggcttccatgatataatactcttctggtat

SEQ ID NO: 164481 - DNA, 601 bp, Human
attaatacacatgatgaaattgcatagaactaaattacatacacacagaaatgagtgcaggtaaaactgatgtaatctgaataaggtggctagattgtaccaatgtcaatatcttgtttgtaatattgtactgtagttacacaagatgttaccatcagggaatgctgggagaaggataccagggatctcttttttttacaactgcataataatcagtaattatctcaaagttaagtgtctaggatccttaaattccttgaaataatacttgctccataaagtgattacaaagatagcttayaggaacccaaacagttcaaaggaataaaacattagataaaaaaatggctcattgttaatagataaagaccagactgaaaaccagaattcttgggccctaattcttcctttatgtatttacttttttgctactaattttgttgttttaggtaggtaatactttcaattaaaaagtagagtgaaaagtcatactccagtccaataccccccaaataacttgtttttgtatccttccagtgttcttaattcaaatgtgagcaaatacattcttttttttttttttttttttttgagatggagt

SEQ ID NO: 164482 - DNA, 601 bp, Human
ttgcaaaatacctggaattaaaaattagtactttacataagtcaaacaatcttttggaaataatgtaataataaatgttacgacatgaaaatactttgaaggaaaaaagaaaacatagaaaatagctacccaaataccttaacattcctctatgttcttcatgccagttctgtattctttcttcccactgttcttttgttagtttgtgttgttccaatacactaagaggaccaaaaaaaaaaaaaaattataatgactttaagattcaaaagcatacactttaaaagtaaagaatcctttsagtaacttgactgtggtagttgtcagacaattaatacacatgatgaaattgcatagaactaaattacatacacacagaaatgagtgcaggtaaaactgatgtaatctgaataaggtggctagattgtaccaatgtcaatatcttgtttgtaatattgtactgtagttacacaagatgttaccatcagggaatgctgggagaaggataccagggatctcttttttttacaactgcataataatcagtaattatctcaaagttaagtgtctaggatccttaaattccttgaaataatacttg

SEQ ID NO: 164483 - DNA, 601 bp, Human
tgctttgtaataaaaacatgagaagatattagggtaaaaatagtaaaatgctcttgtttggaatcacatatgctttgaaattagtattttattagatatctgtagtaataaaaattaaaattctggagccaacctagaataaagaataatgccttaggaaaaggcattaattactggcatagacttgcatgcttatgtggtatggtaaataaattaaagtctaagacaattgagttattaatcctgaaaagtaagagtctgatgtattttatattgcatgtgtatgtgtataatataccgyctctatatagtatttacccatgtatttgtatagtacatatacatgtatatgtaaatatacatatattatacatataataaaatattgatgaattatatatgtataataaaaaactatttggtcaatttcaagatataattacagtgttcaatatgtgtaatacagggatattctattgtattaatgtccaaacatatttaaaacaattcctatatataaatgttcaaaaaaatcctctaagatgtgatagacatatttattaaatccattctctcattgctcctgatttcttatgtatgt

SEQ ID NO: 164484 - DNA, 601 bp, Human
aaccttctaacttgctttgtaataaaaacatgagaagatattagggtaaaaatagtaaaatgctcttgtttggaatcacatatgctttgaaattagtattttattagatatctgtagtaataaaaattaaaattctggagccaacctagaataaagaataatgccttaggaaaaggcattaattactggcatagacttgcatgcttatgtggtatggtaaataaattaaagtctaagacaattgagttattaatcctgaaaagtaagagtctgatgtattttatattgcatgtgtatgtgwataatataccgtctctatatagtatttacccatgtatttgtatagtacatatacatgtatatgtaaatatacatatattatacatataataaaatattgatgaattatatatgtataataaaaaactatttggtcaatttcaagatataattacagtgttcaatatgtgtaatacagggatattctattgtattaatgtccaaacatatttaaaacaattcctatatataaatgttcaaaaaaatcctctaagatgtgatagacatatttattaaatccattctctcattgctcctgatt

SEQ ID NO: 164485 - DNA, 601 bp, Human
caaaaattagtcttgaagtcatttttgcttttcaaaaatttctcttctaaatgatataaccttctaacttgctttgtaataaaaacatgagaagatattagggtaaaaatagtaaaatgctcttgtttggaatcacatatgctttgaaattagtattttattagatatctgtagtaataaaaattaaaattctggagccaacctagaataaagaataatgccttaggaaaaggcattaattactggcatagacttgcatgcttatgtggtatggtaaataaattaaagtctaagacaatttagttattaatcctgaaaagtaagagtctgatgtattttatattgcatgtgtatgtgtataatataccgtctctatatagtatttacccatgtatttgtatagtacatatacatgtatatgtaaatatacatatattatacatataataaaatattgatgaattatatatgtataataaaaaactatttggtcaatttcaagatataattacagtgttcaatatgtgtaatacagggatattctattgtattaatgtccaaacatatttaaaacaattcctatatataaatgttcaaaaaa

SEQ ID NO: 164486 - DNA, 601 bp, Human
tttgaaaatgtctggatattcacgaatatactaaaaatacttaattttcagtatattttgaaagaatcttatggtatatgaattatatctcaaaaattttaaacactcacatacataaatatttggataaatgatagagatggaattcaaactcttgagactatacacagcagttgactccgttttaccaccctacacacaaagatatagggaatcatattggaataagtgattttgtttctgccttttcatgtattttactgtttcagactacctatcaaatgcatcactattgtcctaytgtcctaataactaagactgagaaatgattttgacacctatactggccagaagacatcttttagccaggcttctgacaacacagcatgaatttttacctatttatattccttttagttctcaagcagagtaggtactgcagcacagcagagtcttttctacataaaacattctttactcaataagcatattagaggaccctctaatggcccctgatataagtcaaagtaacatgcttaaaacggagactgcaggaatgcaacatagtattttagagaacactatgctacgtttatatgct

SEQ ID NO: 164487 - DNA, 601 bp, Human
agagaatggtcctcagaagcaatttaataaatgaacactgttattcttcaagtgatatcatgggaaactagcagatattaaacagttaatacacaaaatattaaagaaattacttacaggtgcctttttgtcgattggctttataacaaattttttgtcattaaatgaaatatttctgatttcactccagggaaaaccaattttaggtgttaaccttaaaaaatgaaagcatctccttaattaaaggcaggaaacaatgaataaaattcctgtttaggacctaaactgactgaatgaccartcttaagagttccagattttcaaaatgtattaacttattcataactacagttgaccttatcttttaaggggaaaactgataaatcatataaaacaaacaactgtccaaagatttcataaatgtgtcatgaaccttaaaagcagtgtattttcctaaaattatctaaaaaaactacctggtgacccaagtgtagaactgagcctcctggggtttgaactagctgttcagtttttattgtttggattcaagctacaactacagtttaaatatgtgtaagaagtgggaagaaaaaaaaaggcc

SEQ ID NO: 164488 - DNA, 601 bp, Human
aagagaaagggttttactacactgcatgttgcctgttgccctgattgtcttcaaactcctgtactcaagcaatcctcctgcctcagcctcccaagtagctgagactacaggcacatgccaccatcctcagctcaccaactcagtatctttaatgatgggattagtaattactgacaagcttcaaacccatataaaaaatgttttgttatgtggttaacttctctaaggaagataatttgagttaatatgacaaaataggtaaaaatcaataaaatctcttacacagaacagttgttgaatragaaaaaaaatcattcaatataaaacctaaaactatagtagcaaaatggtatctagcagatggcttccttctagatacaaagtaccttatatccaatatttaaaatacatatgtttagggctcttcaaattttttttaaggacttactctatttcttagactatcacgttgttccataaagatttattcaataaaggttaactttagtttggtctctaaattttttcaagtaaagcacaaagttgaaattaatctaaaaccagatttggaaattaatgtcactggacccagtaatctgat

SEQ ID NO: 164489 - DNA, 601 bp, Human
gtatgagatacaggaactgtatataaaataattcctcatttatctcatgctagaaaacctttaagagacagtgaaatctttaagacgatttaaaaaaattaagtggaaactaaaagaagtcttccctttgacagagggaaatgcaaggctatgtgtataagaatgtactgtatagaaagtaaagcccaataaagagtatttttaaaaagcatttaagattagaaccacaatgtaatgctacagcacatgagcacaataaaaaaggacatagcccatcaaagtaacaatccaactcattacctttttttatttttatttttaagagaaagggttttactacactgcatgttgcctgttgccctgattgtcttcaaactcctgtactcaagcaatcctcctgcctcagcctcccaagtagctgagactacaggcacatgccaccatcctcagctcaccaactcagtatctttaatgatgggattagtaattactgacaagcttcaaacccatataaaaaatgttttgttatgtggttaacttctctaaggaagataatttgagttaatatgacaaaataggtaaaaatcaataaaatctctta

SEQ ID NO: 164490 - DNA, 601 bp, Human
ccataaagcattgcatacttttctttaaatgccataatgtattgcatatgtgttttttgtttataaagcccatatatacatttacaattatttaagaatacatatgaaaaatatttgcatgtttaaaacaaaaaactaaaaaaagaaaaatatctgcatgtttaagagaaacatcagcactgtataaatgaatgtgccttagtgaaacatgtttatgatgtgattccactaagtattaatttgccaattaaatatacaattgtcctatataacaaataaggtttaagagtactaaaaaaamtaccactatctgacaacagagcaataataatttttaatccattttcaaaaaagaaacttttacctttctgagctttaattgtctgctcttcaatttgttttagacgttccattagctcttccttttcacgttctattctttccttttccttttctgctatttctcttttcttcttttcattctctaattgtgcccttaaaaggaattgcaattgctgttacaaattaatacacaaaaatattattcatgtgatggaatactactctgccataaaaagtaacaaaataatgtcttttgcag

SEQ ID NO: 164491 - DNA, 601 bp, Human
gcctaagaagtaagttcttccaaacacattaccaaaaacaaacaaaaaacgttataacacgtctatgtgttgtgtattttctagtagaataaagtaaaatatttttaggaattgagttccaaaaaagttcatatagtcagaatagcttaaattactttaattacttaaatgccttacttatacagccataaagcattgcatacttttctttaaatgccataatgtattgcatatgtgttttttgtttataaagcccatatatacatttacaattatttaagaatacatatgaaaaatattkgcatgtttaaaacaaaaaactaaaaaaagaaaaatatctgcatgtttaagagaaacatcagcactgtataaatgaatgtgccttagtgaaacatgtttatgatgtgattccactaagtattaatttgccaattaaatatacaattgtcctatataacaaataaggtttaagagtactaaaaaaaataccactatctgacaacagagcaataataatttttaatccattttcaaaaaagaaacttttacctttctgagctttaattgtctgctcttcaatttgttttagacgttccattag

SEQ ID NO: 164492 - DNA, 601 bp, Human
tggaattcactttgatatttgctgggacagtaactgaatgcaggtctggtgctatatatatagatatttcattttttttgagacagggtctcactctgttgctcaggctggagtgatcctcccacctctcagcctcctgagtagctgatacaacaggcatatgccaccacacctagctcacttttatttttcggagagataagatctcactatgttgcccagactagccttaaactcctgaattttagcaatcctcctgcctcaacctcctaaagtgctgggattacaggcatgagccacmgcacccagcctaggttattgctatttattctcctagaagtattatttctaatcctcttggaattgaaatgatcaatcagcttgcgcatttatagcaatctttgtggctttcccctctagctactctcccttacaattattctactcattgctcaagagtacgtctccaccacagcaggctggtgtaagaaatcaaaatatatcttaaataagactgagtatccctaatccaaaaaacgtgaaatctgaaatgctacaaaatccaaaactttttaagcaccaacatggcattcaaagaaaa

SEQ ID NO: 164493 - DNA, 601 bp, Human
taagcaaaatgtggtatacaaatagaatatcattcagccttaaaggaaggcaattctgacatatgctacaacgtggatgaaccttgagggcattatgttaagtgaaataagccagtcacaaaaagacaaatactgtatgataccacttatacaggtagaatactcaaaatcacaaagacaaaaagtagaatgatggttgccaggggttgtggggaggggggaaatggggattgtttaatgggtgcagagttttagttttacaagatgaaaataattatgtagctggatagtggtgatggcygcacaacattcccaatatattttgcatcagtgaactacattacttaaaacggcaaaaaactggccgggcacggtggctcatgcctgtaatcccagcactttgggaagcctaggcgggcggatcacatgaggtcaggagtttgagatcaggctggccaacatggtgaaacctcgtttctaataaaaataccaaaattagccagacatggtggcagccacctgtaattaggcaggagaatcgcttgaacccgggaggcagaggttgcagtgacccgagattgcacaatcgcactccagccta

SEQ ID NO: 164494 - DNA, 601 bp, Human
tatccagcaatagtatccagcaatatccagcaatatccaaaacaaaggaaatcaatatattggagatagttgtactcctacgtttattgcagcactattcacaatggccaaaacatgaagtcaacctaagtgcttaaagaaaatgtggtatacatacactatggaatattattcagccataaaaataaatgaaatcctgtcatttgcagcaatatggatggaactggaagccatcacgttaagtgaaataaaccaagcacagaaagacaactattgcatgttttcactcatatgtcagagytaaatctcataaagataaataaactggtggttatcaaaggccaggaagtgggtggggggagttgaagggaggagaaaaagaatagaaatgtatttattactactgaactgtatacttaaaaacggtaaaaataggccgggcgcggtggctcacgcctgtaatcccagcactttgggaggccgaggcgggcggatcacgaggtcaggagatcgagaccatcctggctaacacggtgaaaccccgtctctactaaaaatacaaaaaaaattagccgggcgtggtagcgggcgcctgtagtcc

SEQ ID NO: 164495 - DNA, 601 bp, Human
gcaatatccagcaatagtatccagcaatatccagcaatatccaaaacaaaggaaatcaatatattggagatagttgtactcctacgtttattgcagcactattcacaatggccaaaacatgaagtcaacctaagtgcttaaagaaaatgtggtatacatacactatggaatattattcagccataaaaataaatgaaatcctgtcatttgcagcaatatggatggaactggaagccatcacgttaagtgaaataaaccaagcacagaaagacaactattgcatgttttcactcatatgtcagagctaaatctcataaagataaataaactggtggttatcaaaggccaggaagtgggtggggggagttgaagggaggagaaaaagaatagaaatgtatttattactactgaactgtatacttaaaaacggtaaaaataggccgggcgcggtggctcacgcctgtaatcccagcactttgggaggccgaggcgggcggatcacgaggtcaggagatcgagaccatcctggctaacacggtgaaaccccgtctctactaaaaatacaaaaaaaattagccgggcgtggtagcgggcgcctgta

SEQ ID NO: 164496 - DNA, 601 bp, Human
agaaaaggaacactcatacactgttggtgggaatgcaaattagtaaggccgctatgtagaacaatatagagtcctcaaaaaactaaaactacggaattaccatagtatccagcaatatccaaaacatagtatccagcaatatccagcaatagtatccagcaatatccagcaatatccaaaacaaaggaaatcaatatattggagatagttgtactcctacgtttattgcagcactattcacaatggccaaaacatgaagtcaacctaagtgcttaaagaaaatgtggtatacatacactayggaatattattcagccataaaaataaatgaaatcctgtcatttgcagcaatatggatggaactggaagccatcacgttaagtgaaataaaccaagcacagaaagacaactattgcatgttttcactcatatgtcagagctaaatctcataaagataaataaactggtggttatcaaaggccaggaagtgggtggggggagttgaagggaggagaaaaagaatagaaatgtatttattactactgaactgtatacttaaaaacggtaaaaataggccgggcgcggtggctcacgcctgtaa

SEQ ID NO: 164497 - DNA, 601 bp, Human
ggttgcctgggtgatagaggaagactctgtttttaaaaaaaaaaaaaaaaaaggcagtaacagatgctggcggggatgtagagaaaaggaacactcatacactgttggtgggaatgcaaattagtaaggccgctatgtagaacaatatagagtcctcaaaaaactaaaactacggaattaccatagtatccagcaatatccaaaacatagtatccagcaatatccagcaatagtatccagcaatatccagcaatatccaaaacaaaggaaatcaatatattggagatagttgtactcctaygtttattgcagcactattcacaatggccaaaacatgaagtcaacctaagtgcttaaagaaaatgtggtatacatacactatggaatattattcagccataaaaataaatgaaatcctgtcatttgcagcaatatggatggaactggaagccatcacgttaagtgaaataaaccaagcacagaaagacaactattgcatgttttcactcatatgtcagagctaaatctcataaagataaataaactggtggttatcaaaggccaggaagtgggtggggggagttgaagggaggagaaaaag

SEQ ID NO: 164498 - DNA, 601 bp, Human
ccagtcaaaatggcttgtatcaaaaagacaggcaaggctgggcaaggtggctcacgcctgtaaatcccaggactttgggatttacaaaaattagctgggcatggtggcacatgtaatcccagttacttgggtggcagaggctaagaatcacttgaacccgggaggtggaggttgcctgggtgatagaggaagactctgtttttaaaaaaaaaaaaaaaaaaggcagtaacagatgctggcggggatgtagagaaaaggaacactcatacactgttggtgggaatgcaaattagtaaggccrctatgtagaacaatatagagtcctcaaaaaactaaaactacggaattaccatagtatccagcaatatccaaaacatagtatccagcaatatccagcaatagtatccagcaatatccagcaatatccaaaacaaaggaaatcaatatattggagatagttgtactcctacgtttattgcagcactattcacaatggccaaaacatgaagtcaacctaagtgcttaaagaaaatgtggtatacatacactatggaatattattcagccataaaaataaatgaaatcctgtcatttgcagcaa

SEQ ID NO: 164499 - DNA, 601 bp, Human
aaaagacgtacaaatggccaaaagctatatgaaaaaaatgttcatcactataatcacagaaatataaatcaaaaccacaatgagatatcatctcaccccagtcaaaatggcttgtatcaaaaagacaggcaaggctgggcaaggtggctcacgcctgtaaatcccaggactttgggatttacaaaaattagctgggcatggtggcacatgtaatcccagttacttgggtggcagaggctaagaatcacttgaacccgggaggtggaggttgcctgggtgatagaggaagactctgtttttwaaaaaaaaaaaaaaaaaggcagtaacagatgctggcggggatgtagagaaaaggaacactcatacactgttggtgggaatgcaaattagtaaggccgctatgtagaacaatatagagtcctcaaaaaactaaaactacggaattaccatagtatccagcaatatccaaaacatagtatccagcaatatccagcaatagtatccagcaatatccagcaatatccaaaacaaaggaaatcaatatattggagatagttgtactcctacgtttattgcagcactattcacaatggccaaaaca

SEQ ID NO: 164500 - DNA, 601 bp, Human
tctgttgcccaggctgaagtgcagaagctcactgcagcctcgaactcatgggctcgagcaatcctcccgcctcagcctcccaagtagctaggactacaggcgctatacctcgtttccaacttggcaaaagcctaataatttttaaagagaaatgaaaatcttctgcaattcaagttatgtaaaaaggctacaagcacgtaactattttatttttaaaaaataatctctccatctgaagttttgacctcagtaaacaaattgccatgtttcagaaatctataatacatttcaaaacttccaytaaggttttacttatctaaactaataagtaaatccaagaaattaagattgaaaacagtatttactgaccccaaaataggaattttgatgtgattatatgaattattgaaaaatgtgagttattggtatatattcattcctaaagcatgaagataagcaatattgggagataaataacatgaattttaatccttaggtgcatagatcactaaatcaactcttttcttattccaatgagttgaacaggaaaggaaaataaatttttaagagagtttaacagtactaactttaaatattattt

SEQ ID NO: 164501 - DNA, 601 bp, Human
cagggtctcgctctgttgcccaggctgaagtgcagaagctcactgcagcctcgaactcatgggctcgagcaatcctcccgcctcagcctcccaagtagctaggactacaggcgctatacctcgtttccaacttggcaaaagcctaataatttttaaagagaaatgaaaatcttctgcaattcaagttatgtaaaaaggctacaagcacgtaactattttatttttaaaaaataatctctccatctgaagttttgacctcagtaaacaaattgccatgtttcagaaatctataatacatttyaaaacttccactaaggttttacttatctaaactaataagtaaatccaagaaattaagattgaaaacagtatttactgaccccaaaataggaattttgatgtgattatatgaattattgaaaaatgtgagttattggtatatattcattcctaaagcatgaagataagcaatattgggagataaataacatgaattttaatccttaggtgcatagatcactaaatcaactcttttcttattccaatgagttgaacaggaaaggaaaataaatttttaagagagtttaacagtactaacttt

SEQ ID NO: 164502 - DNA, 601 bp, Human
atagcttatttacaataagtcctttaggtaatgagctaaggagacaaaattaaaaaattactattattctacagactagttaatcctgctttcagtagcaggaacttaaaatgtgtaacttaaaagcttttttaaaaaatttccatcaataaactatttgttaaagtccacaaaagataaaatatttatctaatgctatatactttaaatggcactttgtcaaatcatctcatttaataccccaataatcctaacaggtagtatcattaacaggtagtatcattcctccttttttttttttcagacagagtctcgttctgtcacccaggctggagcccagtggcacaatctcagctcaccgcaacctccgcctgccaggttcaagcaatactcctgcttcagcctcccgagtagctgggattacaggcgtgcaccactgtgcctggctaattttgtatttttagtagagacagggtttcgccatgttggtcagggtggtcttgaactcctgacctcaggtgatccacctgcctcggcctcccaaaatgctgggattacaggcgtgagccactgtgcccggccatcattcctcttttcaaag

SEQ ID NO: 164503 - DNA, 601 bp, Human
gttcaagaccaacctgggttacacagcaagacctccattctcaacaaaaataaaaatgatggtgcatgcctgtagtctcggctactgcagaggctgaggtgggaggatcccttgagcccaggagttcaaagctgcaatgaattatgattgtgccactgcactccagcctgggacacagagtaagaccatgtctctaaaaaaataaaaataattcaacttcatatccaatcactggttcccatgcctttttgtgaccacaaaatgtctcttatatcttcccattcctctttattctcatttycacatcctcagtttgggtctttatctcttaagtatccactatcccaatcctttcttcacactgatcactacatggtttttataaaatcatatctgatcatgttacaatcctgttttgaaatcttctaagccccaagtcaatcgatactcccactgccttgctgtagcagagcatttatttaaagcctttcacaattccctattatcaaacttgagggccacatctcctaacatttctgaacaacactaagcctcggctgcttattggttatcctcaaatctattatatacattcatactt

SEQ ID NO: 164504 - DNA, 601 bp, Human
ggtggtggaggtggagggggggcagacatcacagtttttaactcttctttggtcttttccaagtcttcctgggctgcaaaagcctgaacattaaaaatacgtttatgagcaacttacttcaaaaattaataatcaaaacaatcaagttatactccctttttaatagaaactgtatttcaaggtaatgaaaataggccctatttatgaaacctctattttcataaaagaatgtcaacaggtaaaagagaaaatcaaaaacattattatgcaaaccctattagaattactctgtgagcttcagagtgacagattaaaagaaaaacaagcatacatgcaaaaaaagaactattaattctggcaaggattatcaattgtttgctaaaactgttgtgcaaatagttgatgagaaatagatattcatataatgcctaagaatctcacacccaatagattttatttgagccacaaggggaaaatgtaaccgaataacggaggaatgagactgtcgttactcaaatccaatgatcactaaaaaatactaatggtgagttaactagatattaagtgtcttctgatatgatacaacctgaaatatctaaca

SEQ ID NO: 164505 - DNA, 601 bp, Human
tggtctgtttctgatttcataggtaaattgtagaaggttcctgtcctgtccaggccctcaccaaaaagtttccagaaggaaaagtcaaatacgatgaatttggtctgattattccacattgttaaacatattttcttatgtgaacgcttagtctggcaattgccttgacctttctggtttaattaccatatcagattgatttatttcttccttgttctggatgttctcagtgcttacctgaccttaacactgagttccctccaaaaatcagtgctcacatctctcctaacagaggactagratgacctactcttccctgaccttttctctgtctcataaaaatgtaatagtctcgtcatttctggtcctgctccagcgctttctgtataactttcatggactataaatctggtatcttggatgttggttgctttgttactttcataagctagggtgggagccaaccggggctgcaaacagatctagaattgaagaaagatgtcattactgggctcatccactaagtgttgtcacttgactgagccccatctcctcatctataaggtacacctgtacctgtttcaatgagactgatttgtgg

SEQ ID NO: 164506 - DNA, 601 bp, Human
ctgaccttttctctgtctcataaaaatgtaatagtctcgtcatttctggtcctgctccagcgctttctgtataactttcatggactataaatctggtatcttggatgttggttgctttgttactttcataagctagggtgggagccaaccggggctgcaaacagatctagaattgaagaaagatgtcattactgggctcatccactaagtgttgtcacttgactgagccccatctcctcatctataaggtacacctgtacctgtttcaatgagactgatttgtggcaaagcacccagcaaytgtaaccactagatgaatgcaatggggtgttatcaggcaaacgggaataagaacaagtattatgaaacagctagaatggaaagtatgcaaagaggaatttgaagaaaaaatttaaatctatgctagctttatttggtgtagcaacacgtaaaagcaatccctgtccccagagcttcctgtcttctaaaataagacttttggggcatgaaatacacgaactggggatacagatttgaatgatggtgatgatggagtgagcagctgggttctctttgttttgttttgtttttttaaactgtc

SEQ ID NO: 164507 - DNA, 601 bp, Human
ctgagatctgggtgggagctgtccaatttctgtggctgtagcctcagcatccccaggaagcagttctgagatgaaagtggagaatggcatcaatttcttcatgcccaggttgcctttgtaggggcctgtctcctgtgcagccctgcctttctgccctcagggtagtgcatggaccctgtgttatgggggaggctctcactgcggggctctttggccacagagcactgccccaccagcctccattgcttctttccttggaggggacatggcataggggcttcctgccctgcctgcctctctstgctgcagaaaggaagtcagcatccctgtcttgctcttcatttccactggagaatgcgaggatccctcctgtgcatctccacactcttagatcacttgttccataaagttctggtccgcagggctgccacctactgcactgtgtgccctgtgcttgcccgtgctgcacttcccacatcctaggcaaagtgcccagttgtgcagcattcgatcagagattagccttgctccccagaggacatgggcacggccataaacaaatcctggcaccaggtgctcagtggatggcgagcaactgtga

SEQ ID NO: 164508 - DNA, 601 bp, Human
ggtagtgcatggaccctgtgttatgggggaggctctcactgcggggctctttggccacagagcactgccccaccagcctccattgcttctttccttggaggggacatggcataggggcttcctgccctgcctgcctctctctgctgcagaaaggaagtcagcatccctgtcttgctcttcatttccactggagaatgcgaggatccctcctgtgcatctccacactcttagatcacttgttccataaagttctggtccgcagggctgccacctactgcactgtgtgccctgtgcttgcccrtgctgcacttcccacatcctaggcaaagtgcccagttgtgcagcattcgatcagagattagccttgctccccagaggacatgggcacggccataaacaaatcctggcaccaggtgctcagtggatggcgagcaactgtgagttgtacccagagtggggcaggggcagggaaaatgtccctgtggagaagttgactggcatcagacctgggtgatggcagaagcaggaactggcaaagagcgaagtgtgacaagcgcttcagaatcagggtgttctgacctccccacctcacacacctgcc

SEQ ID NO: 164509 - DNA, 601 bp, Human
ctgtgttatgggggaggctctcactgcggggctctttggccacagagcactgccccaccagcctccattgcttctttccttggaggggacatggcataggggcttcctgccctgcctgcctctctctgctgcagaaaggaagtcagcatccctgtcttgctcttcatttccactggagaatgcgaggatccctcctgtgcatctccacactcttagatcacttgttccataaagttctggtccgcagggctgccacctactgcactgtgtgccctgtgcttgcccgtgctgcacttcccamatcctaggcaaagtgcccagttgtgcagcattcgatcagagattagccttgctccccagaggacatgggcacggccataaacaaatcctggcaccaggtgctcagtggatggcgagcaactgtgagttgtacccagagtggggcaggggcagggaaaatgtccctgtggagaagttgactggcatcagacctgggtgatggcagaagcaggaactggcaaagagcgaagtgtgacaagcgcttcagaatcagggtgttctgacctccccacctcacacacctgccctgccgaggcgggtg

SEQ ID NO: 164510 - DNA, 601 bp, Human
aagatctaacagggcaatgacccagggaaggcccagggctgggagagctcttttggatgtgatgttgggaaaagcctcttggaggtgatgttgaggctgagtcccgaatggaggcagccctggtgtggaaaggagcgtggtatgttcaagggcggtccgcaccaggcctgctcggaaagctgccacactgaccatgggcaaggagctgatccaacagactgctcggttttctaaaacggcaggaagcgtgtggcacgtgagaaaagagtccttagaggcagatggacctggatttgatccyggctctgccacctggagcccaggactttgcttcctgagctcctgcatcttcacctcagaagttggggcttgaggcctaagggagtaacatgagcaacactcctggctccctgcctggcgcatgcccattacccctgggctcagggaggtgaggctgcccgagagccctctggaaatggctgagcagcaaccaaggtcaaggcagggctcgtcatctgtctgctcccttggagttggaacctcgactgcagggttcgggtgttggggaggcagcaggagtggagatgagtctatttgcaag

SEQ ID NO: 164511 - DNA, 601 bp, Human
acactgaccatgggcaaggagctgatccaacagactgctcggttttctaaaacggcaggaagcgtgtggcacgtgagaaaagagtccttagaggcagatggacctggatttgatcctggctctgccacctggagcccaggactttgcttcctgagctcctgcatcttcacctcagaagttggggcttgaggcctaagggagtaacatgagcaacactcctggctccctgcctggcgcatgcccattacccctgggctcagggaggtgaggctgcccgagagccctctggaaatggctgagsagcaaccaaggtcaaggcagggctcgtcatctgtctgctcccttggagttggaacctcgactgcagggttcgggtgttggggaggcagcaggagtggagatgagtctatttgcaagccattgagtcttgcctttcaatgagacaagaggaatccattagttatcagccactgcagctgcttctcaggaaactgccttaccagggacttcctgttcatttctcaaaggccgtggtgtgatgtgaggaggaccaatgaaggggctttttcaggcccagccctgggccctgactttggcagct

SEQ ID NO: 164512 - DNA, 601 bp, Human
gaaggaacaagcaaacacctgtgtatcctcaaccaagattcactagtcttaacattttgccacatttgcgtttttcctctttatatgtgtgcagttgccttttgaaaataagctgcgtcattgtgtgatcacatccctaaggtcttcaacatttccggagaaaaaaggaagagatgctctaacatcatcacagtacctttgtcacatttaagaaaattaatagtaattccttgatatgatcaaatatctggtccatattcattttttctcattcaactcccgaaaaacctggtataacttmttttttccttcaagtgagagcctgtcacattaaagaattgcaggatgttgttttgtttgtttgtttgtttgttttttgagtcaaagtctcactctgtcgcccaggctggagtgcagtggtgcaatcttggctcactgcaacctccacctcctggtttcaaaggattctcatgcctcagcctcctgagcagctgggattacaggcgtgcgccgctacacctggctaatttttgtattttcagtagaggtgggatttcaccatgttgcccaggccgatctcaaactcctaacttcaggtgat

SEQ ID NO: 164513 - DNA, 601 bp, Human
agagcagacagagttcaggtcttagcctcatcactgccctctgctctccaggatgccttccgcgccttccaccctgacctggaattcgtgggcaagttcttgaaacccctgctgattggtgaactggccccggaggagcccagccaggaccacggcaagaacgtaagtctggcttgcaacctgggtgggggtggagacgaggctgggggtggctgggagtctgagagaggctccccttgccccatgaccagtaactggggctgaggcaggggtgcttttgtcctggaggagccactgtggwtcacctgtgttcagggagggcctcagagcctccctgggagccggggtttgacaacaactagtggcgtctcctctctcctggccagtttcattttccttctcctccatccctttccaggaaggtgccagatgacaatctaggggaaagacaggacagaaacaccgaaaaatgtcatttgatgacaagagtggctttggggtgtgtggtccggggcacctctttgagaaagaatgaccattccctggtcatctgttcattgtctgcaggtcagacgcccccctgggtgctgggcttccagga

SEQ ID NO: 164514 - DNA, 601 bp, Human
attggtgaactggccccggaggagcccagccaggaccacggcaagaacgtaagtctggcttgcaacctgggtgggggtggagacgaggctgggggtggctgggagtctgagagaggctccccttgccccatgaccagtaactggggctgaggcaggggtgcttttgtcctggaggagccactgtggttcacctgtgttcagggagggcctcagagcctccctgggagccggggtttgacaacaactagtggcgtctcctctctcctggccagtttcattttccttctcctccatccctttycaggaaggtgccagatgacaatctaggggaaagacaggacagaaacaccgaaaaatgtcatttgatgacaagagtggctttggggtgtgtggtccggggcacctctttgagaaagaatgaccattccctggtcatctgttcattgtctgcaggtcagacgcccccctgggtgctgggcttccaggacagccatgtgtgaaaatagcaacccctgaggtctcatgggctgttgttttgttcaacaatgaagtctccatgtaaatggcggagccgtttatagaagaaagttgggacaggagg

SEQ ID NO: 164515 - DNA, 601 bp, Human
ccttgccctccatggcacatgagatcacctgccctgtacccatgccagcccatgcttgtcccctcctgcctccttcgcaagtgggtccatctcccactctcacctccagcacctcctggcctgcggcttccccagctctgctcgtcctgccctgtagctcccttgtccatggccttgctccttggctctctccactgctctccctttctgctgcagatcctgcaccatttagcatccaagctcccaccaggcaccaccagaaccacccttcatagcaccttggtcatgccctgtgggtacygctcctctccttgtatccactctcctccccgtccggccctgcccctgcctcttgtcccaagttccttcttcctcgcaatgccattgtgttcccagggccctccttgactccgctttgcctccctggctccatgtgcccgggactcacagccccctcctgcctgcctcagctcgccctcctgcgctagtttgtgtcgcccccaactcaacccctcaagacccaacagtgtgcgcagagcaagtggtgctctgtttggtggtggaaaatgcaagttttatttttcttttcttttctttcttt

SEQ ID NO: 164516 - DNA, 601 bp, Human
cgtcctgccctgtagctcccttgtccatggccttgctccttggctctctccactgctctccctttctgctgcagatcctgcaccatttagcatccaagctcccaccaggcaccaccagaaccacccttcatagcaccttggtcatgccctgtgggtaccgctcctctccttgtatccactctcctccccgtccggccctgcccctgcctcttgtcccaagttccttcttcctcgcaatgccattgtgttcccagggccctccttgactccgctttgcctccctggctccatgtgcccgggrctcacagccccctcctgcctgcctcagctcgccctcctgcgctagtttgtgtcgcccccaactcaacccctcaagacccaacagtgtgcgcagagcaagtggtgctctgtttggtggtggaaaatgcaagttttatttttcttttcttttctttctttctttttttttttgagatggagttttgctcttgttacccaggctggagtgcagtgacaccatctcggctcactgcaacctccgcctccaggttcaagcagttctcctgcctcagcctcccatgtagctgggattacaggtgcc

SEQ ID NO: 164517 - DNA, 601 bp, Human
ggctctctccactgctctccctttctgctgcagatcctgcaccatttagcatccaagctcccaccaggcaccaccagaaccacccttcatagcaccttggtcatgccctgtgggtaccgctcctctccttgtatccactctcctccccgtccggccctgcccctgcctcttgtcccaagttccttcttcctcgcaatgccattgtgttcccagggccctccttgactccgctttgcctccctggctccatgtgcccgggactcacagccccctcctgcctgcctcagctcgccctcctgcrctagtttgtgtcgcccccaactcaacccctcaagacccaacagtgtgcgcagagcaagtggtgctctgtttggtggtggaaaatgcaagttttatttttcttttcttttctttctttctttttttttttgagatggagttttgctcttgttacccaggctggagtgcagtgacaccatctcggctcactgcaacctccgcctccaggttcaagcagttctcctgcctcagcctcccatgtagctgggattacaggtgcccatcatcatgcctggctaatttttgtatttttagtagagat

SEQ ID NO: 164518 - DNA, 601 bp, Human
tcactgcaacctccgcctccaggttcaagcagttctcctgcctcagcctcccatgtagctgggattacaggtgcccatcatcatgcctggctaatttttgtatttttagtagagatggagtttcactatgttggccaggctggtctcgaactcctgacctcaggtgatctgcctgcctcggccacccaaagtgctgggattaaagttttcttttttaaaaaagtgtggtcaaccattttggtcatttgacgtgtacagttcagtggcatcaaataagcacatttacattgttatgtaaccrtcaccaccatccagttctcatcttccccaaattgaaattccacatccattaagcactcactcctcattctcccacctctcagcccctggcaggcaccattctactttctgtctctgaatttggcctctccaaggacctcctgtatatggaatcatacaatatttgtcctttggtgactggcctgtttcccttagcatgatgtcttcaaagttcactcacattgtagcatgtgtcagaatttcctcccttttcaaggctgagtaatattccattgcatggatagaccacgtgttgctgatc

SEQ ID NO: 164519 - DNA, 601 bp, Human
aggcgttatctcctcagttttgaaaatgagtctttgccaacttgctctctgaaatagactatccccatcccagcctgacccaacagtacctgcttcctgagaaaagctgggtcctaaagaatccatccctccacaccctggcaagggacgagctacatgtggggtgtagcttatcccctcttccacccagaccgcaacggggcccttggcttgccggctgcagatctcactggtggccaaccacccctgagctggtcaccagtttcgcagcgagcagcttgcctggccctgagcctgaagyggcctgagaacctggtctctgtccagaatctcaggggcaaagggagagggtgcacatagtggagtgctttgtttcattttatactcttctctgttggatcaaaccctcctcagtatggcaaagtaacatttaactcctgacccatgttagcccccacacacttaacaaagatgggctgtgtcctgcttccagattctgggcaggggccgggcaggggggattgttcctgtccaattgccctcagtctttgaggggccccagagcacggctgttgcgtcaggcgggagacggggccaggac

SEQ ID NO: 164520 - DNA, 601 bp, Human
gcactgctaatgggatttaatgggagttcttcacatcctgacctgtttgccttcagcccgtgtcatgcccagtggacatttcttccaaagtgtgatcttttacaaagacgattctgaggttaaaactctttcgtagttcagcactgtacttaggatgaaatgcaaacttcagccaggcacagtggctcacgcctataacctcagcgctttgggaggtcaaggcaggaggattgcttgaagccaagagtttgagaccagcctgggccacatagcaagaccctgtctctactaaaaataaaaraattagccggggatggtggtgcatgcttgtagtcccagctactggggaggctgaggccggaggatggcttgagcctgggatttgaaggctgcggtgagctgtgatggtgccactacattccagcatgggtgacagagtgagacactgtctctaaataaataaatgcaagctgaaaggcccagtgccatctgggcgctgcatctggaaatggacatcaccagactttctgcagcctcatctcaggccaccagggctgggattagggtgaaacaagtaaggcactcgcttagggtataaaat

SEQ ID NO: 164521 - DNA, 601 bp, Human
gtggtggcacacgcctgcagtcccagctgctcgggaggctgagacaggagaatcacttgaacccgggaggtagaggttgcagtgagccgagactgcatcactgccctccagcctgggcgacagaggaagactccgtctcaaaaaaaaaaaagaaaaaagaaaaaagaaagaaaatgaaatgaggcaaaaagtaggctttgaaaatgttatcgatgagtttgtttccattaaagccagaagtgcactttttttttttttttttttttttttttttgcctcaggctctgatatggcgccaccsagcactgctggtcacagttataccgaggagctttcctctggcttctggagcactctacactcccccttcctctcccagggcctcccgtaggctcttgcctctgtcaggaaagcacccctcactctgcctggccaacttctccagctgcgtggacacttagctttcctggccccagctcagtttgggtttggtgtgatgaggccagaccctccctcgcagctccgtgaggacaagggctttgtctcttggttcacctcccaggcagagcacggcagctggcttagggtaggcaacatctgc

SEQ ID NO: 164522 - DNA, 601 bp, Human
ttttgcctcaggctctgatatggcgccacccagcactgctggtcacagttataccgaggagctttcctctggcttctggagcactctacactcccccttcctctcccagggcctcccgtaggctcttgcctctgtcaggaaagcacccctcactctgcctggccaacttctccagctgcgtggacacttagctttcctggccccagctcagtttgggtttggtgtgatgaggccagaccctccctcgcagctccgtgaggacaagggctttgtctcttggttcacctcccaggcagagcayggcagctggcttagggtaggcaacatctgcaccacattctgggaacacggagctggccattgttcctgggcaaggcgggcttcccggtgcccggaaggaggggctcttgaaggacaagcagggcttcacctggcaaagaagaatggaagagaggcccggtgcggtgggttatgcctgtaatcccagcactttgggaggcggaggtgggcggatcacctgggttcaggagtttgagaccagcctggccaacatggtgaaaccccatctctactgaaaatataaaaattagccgggcatggt

SEQ ID NO: 164523 - DNA, 601 bp, Human
tgagtgaagtagtattcccgacagccttggcgcctaaggcttggaacaaggcgaggagacagcctggctccccagttctggtttgtacaccctcttcttatttcatttccacccgtgagactatctgagcaggaacgtggatttttctgtaacatggccaattcgcaggaaatcagccacagttctgtactttggaagcctctctaagctgccagggattccattttctgccaaagtacaggctattgttattcttctaggaaacagtttgccagctttaattagaggtgtctagaaaacrgaactgatgaacttgaggccctctgataagtggggacaaaggcttcattttctcggcgaggctttgtaatgtagagccgttggctgtcctgacagatgttctctgtgtctccaacaaagaaagtctagtcccaccagctgcactggcaagaaggcgtctttcttgtgcgtggtggccagagaagcctctcctttcccgacatcttctcacccccgacacttctggaacgctggctttggggcaggagataggggtgggaggctgtgaggatctggttgttcagttaccagcggcgtttgg

SEQ ID NO: 164524 - DNA, 601 bp, Human
ttttctgccaaagtacaggctattgttattcttctaggaaacagtttgccagctttaattagaggtgtctagaaaacagaactgatgaacttgaggccctctgataagtggggacaaaggcttcattttctcggcgaggctttgtaatgtagagccgttggctgtcctgacagatgttctctgtgtctccaacaaagaaagtctagtcccaccagctgcactggcaagaaggcgtctttcttgtgcgtggtggccagagaagcctctcctttcccgacatcttctcacccccgacacttcyggaacgctggctttggggcaggagataggggtgggaggctgtgaggatctggttgttcagttaccagcggcgtttggaagtccccagccagtgccgcggtgttctgtggaaatccccgctctcacactcatggggaaaggattggtgcttcctgggttcctggtgttttgacctgtgctctggctctcgcaggacccggccgccctggaaggaaccctggtctcttgactgaagtgacagtgggtctgatgggacttgtcacatgccagtcccacacaccacagcagggccaggtggggc

SEQ ID NO: 164525 - DNA, 601 bp, Human
cacccccatgaggtggcattgcttcttcatatgaggcagtgagtgctcctgagcccgggcttggcctgggctgggctgtctgtcctctcccaggccaccgtctggatgacttgggggccacactcacactcattcatccttggcacttaactcattggaagctcgtagtggggtgcctttccccttctctttctctctctttttgtttttgtttttgtttttgagacaaggtcatgctctgtcaccttggctagagcgtagtggcgcaatctcggttcactgcagcctcaacctcctgggmtcaagccatcgttctgcctcagcctcccgagtagctgggactacaggcacccgccaccatgcccggctaattcttgtatttttagtagagatggggtttcaccatgttggccaggctggtctcgaactcctgacctcaagtgatccgcctacctcagcttcccaaagtgctgggattacaggcatgagccactgtgcccggccaaggtctgtacttctttatatgtctcatggatgtttcttttaaaacgcaatccttatatgttttatattttgtcattatgattggaggttctccagt

SEQ ID NO: 164526 - DNA, 601 bp, Human
cctgggctgggctgtctgtcctctcccaggccaccgtctggatgacttgggggccacactcacactcattcatccttggcacttaactcattggaagctcgtagtggggtgcctttccccttctctttctctctctttttgtttttgtttttgtttttgagacaaggtcatgctctgtcaccttggctagagcgtagtggcgcaatctcggttcactgcagcctcaacctcctgggctcaagccatcgttctgcctcagcctcccgagtagctgggactacaggcacccgccaccatgccyggctaattcttgtatttttagtagagatggggtttcaccatgttggccaggctggtctcgaactcctgacctcaagtgatccgcctacctcagcttcccaaagtgctgggattacaggcatgagccactgtgcccggccaaggtctgtacttctttatatgtctcatggatgtttcttttaaaacgcaatccttatatgttttatattttgtcattatgattggaggttctccagtactcgggaaagcagtggatattggggtagttatcttaattttcttttttttctaaatttttgtt

SEQ ID NO: 164527 - DNA, 601 bp, Human
ctagagcgtagtggcgcaatctcggttcactgcagcctcaacctcctgggctcaagccatcgttctgcctcagcctcccgagtagctgggactacaggcacccgccaccatgcccggctaattcttgtatttttagtagagatggggtttcaccatgttggccaggctggtctcgaactcctgacctcaagtgatccgcctacctcagcttcccaaagtgctgggattacaggcatgagccactgtgcccggccaaggtctgtacttctttatatgtctcatggatgtttcttttaaaacrcaatccttatatgttttatattttgtcattatgattggaggttctccagtactcgggaaagcagtggatattggggtagttatcttaattttcttttttttctaaatttttgtttgcatggccttccaatgaatgggatagttatcttttgtcccgctagtgtccacttacgtctcttcgtaattctagttgtgtttcggttgattcttttgagtttcctgggtagatgatcatatcctagaaaataatgaaaacgtagtctctcggcccagcgtggtggctcacatctgtaatcccagc

SEQ ID NO: 164528 - DNA, 601 bp, Human
tgacgggaaatttcagagctgagtttaatagcggtgatattggcagcagccttgttttgttcttcttttgccatatccccgttttctgagggggctggtgagaccattatcccggtagcagtgtaaaggggcctcagaagccgtgcggtgcctgagatcctcctcctcctcccatccgggaaaccacctctgctgctctgactgtctgaagctaacctcctgggcttcctgcttgaggcagaccttcatgaacaggcttaagccacccatcccgccttgggacacacatgccgccctctcrgggaccttggactgggaccttgccattctgctcctgctggggaggtcgtgccgcctgtttctctctgtgtgtgagtttgcaggttcccagaggcagagactgggctttgcgacagctcccctcccccaaccctcgatggacaaggagggcccttgtcattcctcagacattttgttccaaagctgaaaggtcccctccacatggcccggcatcccccaggccctcatccaagcctggccttgaggtgcatggagaggccgaggacaggagagtcagccccgccgccagggctggctgcac

SEQ ID NO: 164529 - DNA, 601 bp, Human
tctctgtgtgtgagtttgcaggttcccagaggcagagactgggctttgcgacagctcccctcccccaaccctcgatggacaaggagggcccttgtcattcctcagacattttgttccaaagctgaaaggtcccctccacatggcccggcatcccccaggccctcatccaagcctggccttgaggtgcatggagaggccgaggacaggagagtcagccccgccgccagggctggctgcactccctcccttgcccctggcctgcgtctctgcctgtcaaccgcagcctgggaaggcactgttsctgatcagggggaggtccatgtgtgccacccacacccttggccgcagcccagccaggtgaaagtcatgtgtcttccttgcctcttgggctttctctgtgtgtgtgacggggactcctctggaggaggagatgtgtggggtcctccactccccacacttggggctctgagcccccagttgggaagaagcctgactcttgttgagtgagtctgtggaccgggcactgtgatgggcagtgtgcgtgcacaacgtcacttaatccttgcttaacccgtgaggcgggagctgtcatcgacccatt

SEQ ID NO: 164530 - DNA, 601 bp, Human
caccactgtccgaacccaaaccatctggctgcaaaccacagcttcggagtcctgggggcccttgtgaaatatgtttgttgggtagccccagctttctgatcaattaaacagccaggcactcacccccctagcttgctacattctaaaatacctctccctcccttccctggtcccatgacttaaacggcaaagctctggcaaagaactgagcgtgggaaagatgagagcagagagttagccacagggcagggcttcgtatcccaaacccacagttgtactttctggtttgggaggggagtaytggccatcccccagcagagccgctgcagctgaggccatcgagatgggcacagatgtgtagtggtatgtcaccatacgcatgtacatacacgtgcgtgactgtgatgagcattttgctcaccgtcccacagaggcccactctgaggcctgctgctgcctggcaagcaggaccccctggctcccgagggtcattctggggcattgaagggacgcacactaaagccagcagtgcttaccagcagaggcagcccctgtaacctgtgttgtccacccacaggccaccatcacccatgagaacagg

SEQ ID NO: 164531 - DNA, 601 bp, Human
ggttaggctccagctggggaggagtgattcactcttgtaaattacagggaggctccagggaggcagatgctcccagcctgatgactggcagcaattctggggcccttacctaggttctccctgccactgcgggctccgggagctctccatggtgacctaggaactcccctgggtgcttatgctccgccgagagttgctctgttgcacattcattcaacaaacatttgtttagtgcctgtcacatgggctcagagtcagctttttgggttctgatcccagtcagggccacttcctgtggccytgggccatggcttaacgctgagcctcagcctcagaagtgccggccttgtagaggatcgatgccatcgggccagtgctcggctagggctgaggaagcgttggccgctgctggctgtagcatggggagcccagagggctggaggggccccaggcttggtgggcccagggtgcagattgacaggaaagggacagtggtgtgccctgagcagatagaagggatggtggctgcaggatgggttggggaacatgggaggctgggagctgaggctactgggtgctcatgatctctcctctctcctca

SEQ ID NO: 164532 - DNA, 601 bp, Human
gcctgtcacatgggctcagagtcagctttttgggttctgatcccagtcagggccacttcctgtggccttgggccatggcttaacgctgagcctcagcctcagaagtgccggccttgtagaggatcgatgccatcgggccagtgctcggctagggctgaggaagcgttggccgctgctggctgtagcatggggagcccagagggctggaggggccccaggcttggtgggcccagggtgcagattgacaggaaagggacagtggtgtgccctgagcagatagaagggatggtggctgcaggaygggttggggaacatgggaggctgggagctgaggctactgggtgctcatgatctctcctctctcctcagtacggcaagaagaagctgaaatacctgccctacaatcaccagcacgaatacttcttcctgagtgagtgctcggcgccccgaaatcactctgggaccctcccctccccccagagtggcgtgtctctccctcctacctgacatctttttcagatccagaaagtgacactaaacttgttagaagcgggggccacagcagccttgctgtgcagacccctcagcctgcgttacaggc

SEQ ID NO: 164533 - DNA, 601 bp, Human
gctgcaggatgggttggggaacatgggaggctgggagctgaggctactgggtgctcatgatctctcctctctcctcagtacggcaagaagaagctgaaatacctgccctacaatcaccagcacgaatacttcttcctgagtgagtgctcggcgccccgaaatcactctgggaccctcccctccccccagagtggcgtgtctctccctcctacctgacatctttttcagatccagaaagtgacactaaacttgttagaagcgggggccacagcagccttgctgtgcagacccctcagcctgygttacaggcctgatggggacacagaggctcagagagtcccaggggtgacacacgtcctcaagggctcccagccttctctgcaggccccggggtccctggctgcttctgcccacgtctgcagggctggcccctgcactcagtgctgggcctgggttcccctgaccttccggcacaggcagcgtggaatggatgcctctaagcgcctgtctctctcctgcagttgggccgccgctgctcatccccatgtatttccagtaccagatcatcatgaccatgatcgtccataagaactgggtggtg

SEQ ID NO: 164534 - DNA, 601 bp, Human
tccccccagagtggcgtgtctctccctcctacctgacatctttttcagatccagaaagtgacactaaacttgttagaagcgggggccacagcagccttgctgtgcagacccctcagcctgcgttacaggcctgatggggacacagaggctcagagagtcccaggggtgacacacgtcctcaagggctcccagccttctctgcaggccccggggtccctggctgcttctgcccacgtctgcagggctggcccctgcactcagtgctgggcctgggttcccctgaccttccggcacaggcagsgtggaatggatgcctctaagcgcctgtctctctcctgcagttgggccgccgctgctcatccccatgtatttccagtaccagatcatcatgaccatgatcgtccataagaactgggtggtgagttggggacacagctggcttggcatggggaggagggtgactgggacagggggacccgggggtcctacgctgcctcctcgtgtgccccagtggagcctgtggggccccaggcatctcctccctggggtagctgcctctcaggaaaggactccctctggggccaccaggacctagtcctaa

SEQ ID NO: 164535 - DNA, 601 bp, Human
ccacgtctgcagggctggcccctgcactcagtgctgggcctgggttcccctgaccttccggcacaggcagcgtggaatggatgcctctaagcgcctgtctctctcctgcagttgggccgccgctgctcatccccatgtatttccagtaccagatcatcatgaccatgatcgtccataagaactgggtggtgagttggggacacagctggcttggcatggggaggagggtgactgggacagggggacccgggggtcctacgctgcctcctcgtgtgccccagtggagcctgtggggccccakgcatctcctccctggggtagctgcctctcaggaaaggactccctctggggccaccaggacctagtcctaaagatctctactctccctcagacatagggagtccactggggcagcccctgcttttgcagagcccccgagaaagttctcaaaggcagcaggatgagaggcaagtgtggccatctcccttccccgctccctgtgggccctgagtcccatgaactgggttgccccacaccctggtttgaagttggagcagctgggcgttggctgagatgacaggtgtggtcgtttgcgaagacc

SEQ ID NO: 164536 - DNA, 601 bp, Human
aagcaccacgaactgagtggcataagcagcagcgatgtgttttctcccggttctggagaccggaagtccaaaactgaggtgttagcagggtggattccttagggctctggaaggctctgttctgggcctctcatcggctggttgatggctttcgtcctccctctcggtacatcatctctctgcatatttgtatctgtatctgtgtccaaatatccctctttaaaaaaattattttgtttatttgtttatttattgagacagagtcacataggctggagtgcagtggtgtgatctcgactcactgcaacctctacctcctgggtgcaagcaattcttgtgactcagcctcccaagtacctgggattacaggcaccggccaccatgcccagctaatttttgtatttttagtagagatggggtttttccatgttggcgaggctggtctcgaactcctggcctcaagtgatctgcccgcctcagcctcacaaagtgctgagattacaggcatgagccaccacgcctggcctattttttaattttctttttttcttcaccaaaagtggattcttgaaaatttttccttttttttaaaatagggaca

SEQ ID NO: 164537 - DNA, 601 bp, Human
ggctggtctcgaactcctggcctcaagtgatctgcccgcctcagcctcacaaagtgctgagattacaggcatgagccaccacgcctggcctattttttaattttctttttttcttcaccaaaagtggattcttgaaaatttttccttttttttaaaatagggacattggtcatattgcattagggcccattgtaattacgtcatcttttttttttgagatggtgtttcgctctgtcgcccaggctggagtgcagtggtgcgatctcggctcactgcaacctccgcctcctgggttcaagcrattctcctgcctcaacctcctgagtagctgggagtacaggcgccggccaccatgcctggctaatttttgtatttttagtagtgatggggtttcaccatgttggccaggctggtctcgaactcttgactcgtgatccacccgccttggcctcccaaagtgctgggattacaggcgtgagccactgcacccggcagataaattgtttatctgaaaattatcaaagactaaattgtcactttctgaaatgcttgcttaaaatccagtctttctcagcagtctatttgtccctcatgctccaac

SEQ ID NO: 164538 - DNA, 601 bp, Human
ctcacaaagtgctgagattacaggcatgagccaccacgcctggcctattttttaattttctttttttcttcaccaaaagtggattcttgaaaatttttccttttttttaaaatagggacattggtcatattgcattagggcccattgtaattacgtcatcttttttttttgagatggtgtttcgctctgtcgcccaggctggagtgcagtggtgcgatctcggctcactgcaacctccgcctcctgggttcaagcgattctcctgcctcaacctcctgagtagctgggagtacaggcgccrgccaccatgcctggctaatttttgtatttttagtagtgatggggtttcaccatgttggccaggctggtctcgaactcttgactcgtgatccacccgccttggcctcccaaagtgctgggattacaggcgtgagccactgcacccggcagataaattgtttatctgaaaattatcaaagactaaattgtcactttctgaaatgcttgcttaaaatccagtctttctcagcagtctatttgtccctcatgctccaaccaatagccatggggaagtttttcctctcttaaccaaatgtggact

SEQ ID NO: 164539 - DNA, 601 bp, Human
tttcttcaccaaaagtggattcttgaaaatttttccttttttttaaaatagggacattggtcatattgcattagggcccattgtaattacgtcatcttttttttttgagatggtgtttcgctctgtcgcccaggctggagtgcagtggtgcgatctcggctcactgcaacctccgcctcctgggttcaagcgattctcctgcctcaacctcctgagtagctgggagtacaggcgccggccaccatgcctggctaatttttgtatttttagtagtgatggggtttcaccatgttggccaggstggtctcgaactcttgactcgtgatccacccgccttggcctcccaaagtgctgggattacaggcgtgagccactgcacccggcagataaattgtttatctgaaaattatcaaagactaaattgtcactttctgaaatgcttgcttaaaatccagtctttctcagcagtctatttgtccctcatgctccaaccaatagccatggggaagtttttcctctcttaaccaaatgtggacttgtttattgattactgttttttgtttgtttgtttgtttttgaggtggagtttcgctcttgttgc

SEQ ID NO: 164540 - DNA, 601 bp, Human
gggctttcagagccaggagcgcacctatgacctggggcactggttctcaggggagctgttctgccctttggcagtatccggagacacttttaattgtcacaacttcaggagaggagggtgctactggcatctggtgggcgtctagccaggatggtgcttagcaccctgccatgccctggagaaccgcccatgacaacaagcagcctgtcccaggtgccaatagtgtggaggttgggggaccctggcttagaggaaagaggtgacaaaccctaagatctttgaaggaggcttcccggggagrtttacatgctctggcaaggttccctgttcccggggccacgtcctggatcctgagatgctcccacgcttcaccctcctggaattttgctgtatctgacaccactggccactccctcttgcagttcttcctgttggcttccaggtccccacctctgctggcttcttcccaaccccctcgctccgcctctttggctgcttctgatctcttgggctctctgcccctgaaaccagcgatctctgtgtatgtgttgctctctacactcaaaagaagtccaggccaggcatggtggctcacgcctgt

SEQ ID NO: 164541 - DNA, 601 bp, Human
aggggagctgttctgccctttggcagtatccggagacacttttaattgtcacaacttcaggagaggagggtgctactggcatctggtgggcgtctagccaggatggtgcttagcaccctgccatgccctggagaaccgcccatgacaacaagcagcctgtcccaggtgccaatagtgtggaggttgggggaccctggcttagaggaaagaggtgacaaaccctaagatctttgaaggaggcttcccggggagatttacatgctctggcaaggttccctgttcccggggccacgtcctggaycctgagatgctcccacgcttcaccctcctggaattttgctgtatctgacaccactggccactccctcttgcagttcttcctgttggcttccaggtccccacctctgctggcttcttcccaaccccctcgctccgcctctttggctgcttctgatctcttgggctctctgcccctgaaaccagcgatctctgtgtatgtgttgctctctacactcaaaagaagtccaggccaggcatggtggctcacgcctgtgatctcagcactttgggaggctgaggtgggagggatcacctgaagcca

SEQ ID NO: 164542 - DNA, 601 bp, Human
gagaccatcctggcgaacacggtgaaaccccatctccactaaaaatacaaaaaattatccgggcgtggtggcgggcacctgtagacccagctacttgggaggctgaggcaggagaatggtatgaacccaggaggtggagcttgcagtgagccaagatcacaccactgcactctagcctgggcgacagagcgagactccctctcaaaaaaaaaaaaaaaaaaaaaaaaaacagaaattagctactcgggaggctgaggtagaagtatggcttgagcctgggacagagtcatgatcacaccaytgcactccagcctgggcaataaagcaagatcccatctccaaaaaaaaaaaatccgtaaccccatcctcattttgtttccatatatgtgtagatacactgcacactattgcaccacacacacagaatagaaggaatgtgatggaaagtgggagcagaactggctacatctgcctccctcctcaccttgaaggccaccttattggaacgtgaggtcctgccctcggccaatgttggccccaaggccatctccagcctctcctgagcgctcccttcctcctttcctgttcagctgctggcacc

SEQ ID NO: 164543 - DNA, 601 bp, Human
tagacccagctacttgggaggctgaggcaggagaatggtatgaacccaggaggtggagcttgcagtgagccaagatcacaccactgcactctagcctgggcgacagagcgagactccctctcaaaaaaaaaaaaaaaaaaaaaaaaaacagaaattagctactcgggaggctgaggtagaagtatggcttgagcctgggacagagtcatgatcacaccactgcactccagcctgggcaataaagcaagatcccatctccaaaaaaaaaaaatccgtaaccccatcctcattttgtttccayatatgtgtagatacactgcacactattgcaccacacacacagaatagaaggaatgtgatggaaagtgggagcagaactggctacatctgcctccctcctcaccttgaaggccaccttattggaacgtgaggtcctgccctcggccaatgttggccccaaggccatctccagcctctcctgagcgctcccttcctcctttcctgttcagctgctggcacccgacccctgatcacctaggaccagcctagattccccacagccaagcaggcacaaatgcagccaccgttgcctctgacagtt

SEQ ID NO: 164544 - DNA, 601 bp, Human
ccaccgttgcctctgacagttctggaatctgtcacctccttgtcagtgccgtgggttctggtttaggcctctgtcatttcatgtctgagccgctggaataacttcctagtctccccctctccagtgggtggggatctattttaagacacaaatgtgaccttgttcttcagtcgtttgaagtgagacagggcagtcccttggcctcaccttccacctcggacacctgtgctgagcctgtggcatgtcaccatacctaaactcatggcaggatgagcgccctggcagtgggaacaggccatgyagaggccccggggagggagtaagctaggtcagggggctgagtaaagacaggttcttaaccccatgaggctccgtgggtgactgggtgggatgggggctttagcaggggagagttgggacctgcttggagcgaaggccactctggttgccatggccacgaggacaagcaggagactgtgggaagctgatgctgtggtccagttgagacaagacttgggtggcagagagacagtggacagggtggagccgtgaagtcaccctcccagtacatgagagaagacgtccaagcccagtccctgac

SEQ ID NO: 164545 - DNA, 601 bp, Human
cgctggaataacttcctagtctccccctctccagtgggtggggatctattttaagacacaaatgtgaccttgttcttcagtcgtttgaagtgagacagggcagtcccttggcctcaccttccacctcggacacctgtgctgagcctgtggcatgtcaccatacctaaactcatggcaggatgagcgccctggcagtgggaacaggccatgcagaggccccggggagggagtaagctaggtcagggggctgagtaaagacaggttcttaaccccatgaggctccgtgggtgactgggtgggrtgggggctttagcaggggagagttgggacctgcttggagcgaaggccactctggttgccatggccacgaggacaagcaggagactgtgggaagctgatgctgtggtccagttgagacaagacttgggtggcagagagacagtggacagggtggagccgtgaagtcaccctcccagtacatgagagaagacgtccaagcccagtccctgacaccagtccagccagaggcagggaggagagcagagtggagggacacaggatgacagtggggcgtggggaggccagcctctgctgtgagagc

SEQ ID NO: 164546 - DNA, 601 bp, Human
cgtttgaagtgagacagggcagtcccttggcctcaccttccacctcggacacctgtgctgagcctgtggcatgtcaccatacctaaactcatggcaggatgagcgccctggcagtgggaacaggccatgcagaggccccggggagggagtaagctaggtcagggggctgagtaaagacaggttcttaaccccatgaggctccgtgggtgactgggtgggatgggggctttagcaggggagagttgggacctgcttggagcgaaggccactctggttgccatggccacgaggacaagcaggrgactgtgggaagctgatgctgtggtccagttgagacaagacttgggtggcagagagacagtggacagggtggagccgtgaagtcaccctcccagtacatgagagaagacgtccaagcccagtccctgacaccagtccagccagaggcagggaggagagcagagtggagggacacaggatgacagtggggcgtggggaggccagcctctgctgtgagagctctgagatagggacgatggtacctctgaccttccctacccctccaagccctctgtcctgctggaaggagatgccaggagga

SEQ ID NO: 164547 - DNA, 601 bp, Human
ccctcccagtacatgagagaagacgtccaagcccagtccctgacaccagtccagccagaggcagggaggagagcagagtggagggacacaggatgacagtggggcgtggggaggccagcctctgctgtgagagctctgagatagggacgatggtacctctgaccttccctacccctccaagccctctgtcctgctggaaggagatgccaggaggagacccaggtgctgaggaggagggacaggactgggggacggttggggacctggccccgggttgggggcgcaccttcagaatcgcccytgccccacgagagggctgctgacccccacccctaccccatggctgcccctcagcaggagggtccgtttctctcccgaaaaacagggcacagtcacttcctgatgctaaaacactcagcatttccctagaaacaaaggcagccatgcaaaccccgagcaagcaggtggcgtgtagttgcccattgcatttcagtgggctgcggtccagcttctagaggcctgagtgtgaggtgtgtgcacatctggggcacgcacttggtgccagggcagaggagagggcaggttgcacctaacttcatct

SEQ ID NO: 164548 - DNA, 601 bp, Human
aatcttaactatgactataaattctcttcagtgcattcaaattatccatcaacatcattgtatatatgaaatgcatcatcattctatgatcttaagttcataattagctggagaaggaagcctgggccaaaaatggcaacatttctaagattattaatctaacaggtattacctatgcctaaagtaactttctttttcacataaccctatatattctctgaaacaaaattcataagcctggctggacattcccattcctcacctttcccttcagcctatactatccttgtttcatctcagrtgctataaaaatggttgttgagatacagatagaaaagtcaccacttggaaaccatgaccctaccagatttacaggagcactagcagaagctaagatactagagttaattctttctccatttttagactgagcctgtttattgtagtgaaatattttatccgacaatatgaaacttttttaaaagttgaggtgtcatattaaattcaaatgaaaactaaactcaaaagaaaagaataaaatttgtttaatgtatatatacattgcatgtgtattgccctctgaaatcttaaaggcacaaag

SEQ ID NO: 164549 - DNA, 601 bp, Human
ctaaaaattcccaaatgtactggccactgtgtgtatttttccagtgataaatgaaaataaagcaacttattctcaaattaataagccatcttattttgaacacaacagtcacattcaatggaagaaaactacttaatcgaagcccaaacaagtttaggtttgtttttggtggggaacagtctcaacatacaaataatttctttaagcaacttttaacagtaatcttaactatgactataaattctcttcagtgcattcaaattatccatcaacatcattgtatatatgaaatgcatcatcrttctatgatcttaagttcataattagctggagaaggaagcctgggccaaaaatggcaacatttctaagattattaatctaacaggtattacctatgcctaaagtaactttctttttcacataaccctatatattctctgaaacaaaattcataagcctggctggacattcccattcctcacctttcccttcagcctatactatccttgtttcatctcaggtgctataaaaatggttgttgagatacagatagaaaagtcaccacttggaaaccatgaccctaccagatttacaggagcac

SEQ ID NO: 164550 - DNA, 601 bp, Human
tctttctgtgtactctgaatgtatttatcctggatgtgttacttgctcccaaaggaaggaaaaggaagtgaaaccactagggatataatgaattgattcttctctgtgaaagtctcttcagtacttctaaattacagtgtcagtcattcctctgagagacagggccttgctgaaaataaatggctcattttataaataagtacataatgtttccccaccttcttgtttctcatagaaagcccaggcccataaggcattcctgtcgagaatactggcctctgggtacattcctcctgtagascagtggtctgttgaggttgttggttatctcttgttcatttaattagccttaagtaaaattacttcttatctagttctgtttttaagctgtttccaatttagtggaagaggtcatcaacaaaagtataaattcatttcttagctgaaacaattaaattttttaaaatgggtggtataaaagtgactaaagactaaagctaatatctgaagagtcctttggtatacattatattttactgaatggaagagaaactttcatttttgtaggtaaatggaatttgttaactgatataagaattat

SEQ ID NO: 164551 - DNA, 601 bp, Human
caaatttgcctggtatttcgtcagaattttaactggtgagagatcatgatcttaaaaatgcaatctgaaaaataaaatgtgcatggggcaaaaagaaatgaaaaagaaaactagtattttctaaggaagggagtcattttctgaatataacttttgttcatctttacaaagatgaagtgcattgctatcttaagattcaaaggacttcttcaactgttcagaaaataccaatattccacacctaagatgctaaaaggcaggattgtttagtagaccgtttactcataaagtatctttctgygtactctgaatgtatttatcctggatgtgttacttgctcccaaaggaaggaaaaggaagtgaaaccactagggatataatgaattgattcttctctgtgaaagtctcttcagtacttctaaattacagtgtcagtcattcctctgagagacagggccttgctgaaaataaatggctcattttataaataagtacataatgtttccccaccttcttgtttctcatagaaagcccaggcccataaggcattcctgtcgagaatactggcctctgggtacattcctcctgtagagcagtggtc

SEQ ID NO: 164552 - DNA, 601 bp, Human
cagtggagtctcaaaatagtcagcaacatttgatacttaaattctggctatctctgagacacatagctaaaaactcttaataacagctatctccttccatgtctctatcagtgggagaagttattatgtggagcaaaggcaatataactataagcatcagaccatttcagagagcttggctggttttctcttgtaaagtttgttcttgtctagtatccttaagtcatccgaaatcattaaaacttcttgtaacatggcagaaaactttaaaagaaggctgggcatggtagctcatgcctgyaatcccagtactttgggaggccgaggcgggtggatcacctgaggtcaggagttcgagaccaacctggccaacatggtgaaaccctgtctctactaaaaatacaaaaattagccgggcatggtgacacatgcttgtagtcccagctactcgagaggctgaggcaggggaatcgcttgaacctggggagtggtggttgcagtgagccaagatcacgccattgtactccagcctgggtgacagagcaagactccatctcaaggaaaaaaaaacaaaaactagaaaagttatgattaaacttct

SEQ ID NO: 164553 - DNA, 601 bp, Human
aacaacattgctgggtaagaagagacataaggaaacaaaaacagagctggggaacggtttgggtttggaggtattcagacatctgaaatataggcacttgggatagaaagtcaggacacccccgaagccccatgttctgcactgtgctggacaccaacagcggcaacaggatgtcaggcattcgtatctccaagccagctgaataatgcaggctaatgacccctctcctctaggctactggaaagacacgaaaggaaatcacctctctaaatcagggtcatcagtcctagaaatttaatargctgtgagcacatctttatgttgtaagaccagaacaatagcttacaagagcaccaaacgatggtagcataatctaatggggtataataaaaaaaactacataaattaatgaaatacttaataaaatatggctatgattatgctaattaaacataaactgagaagatatttaaacaaatgactctgattcatgtcacttttataaagccaaagcagattttcactgttttcttttttttcatagttttccagaagctatgatcagcatcaacactgaaatgtctctgaaaccaattttact

SEQ ID NO: 164554 - DNA, 601 bp, Human
tatacctgttgtatattatatatatttttttctgaatgtatggtccttaatttaaaaatgattattttgttttatcgttattgctgacttgaaaatggagcacataaaaagtttaattttctaatatgtacattattttaaaatattttagctagaataaaaaacatgatcatgaatatacattgatggcattctcaggataattattagcacatagtgtatataatgtcatagttataaatgctctgtaagtttgcatcttgatcagtatattttagatcaaaaattttatttagatcayctttttaatatatttatctcgctagtaaaatctgtgacttttttcattggcctgtagaaggagagtgttcagaaatttcatgaaaaaattttgttggcatattctagttacagtaactttaagtaggggatagggttgtcaggtttagttaaaaaaatacagaatatccagttaaaattgaactttagaaaaacaagaattttttttggtataaatatgtcccatgaaatattggggtaatacttaaagttattgaatgattgaattttttttttgtattttatcaagcagtcctataag

SEQ ID NO: 164555 - DNA, 601 bp, Human
catgtgaattagagaggcttgcacatctgctacagggctcaagaaacaatggacttttaagaaatatggtagaactgccataaagcatgaaagatacagctgacatcaaataccataaagttctaaagttgtcccattctgcagggtgatatttacttttcttagcagttcccagaaaattggagcaagtgtggaggacgggggcagttagattcatcatgaaaaaagattttgttttttggatccctttgcaaacaacagaacaaggacatggagaacgctggcaagcatgatggacaasaaagaaagaagtgaagatgaaagggaatgaataggtaggaggaatgaagaaaatctgagataaagattccagttcactgccctggacccgtagttgagaacaacaaattttctagtttgggtgattggtactataattatttttaaattatatgtaagtgaccagtttccttgggatggtctttgtttatgccttttttgttatcatgattagtaagccatcccctttgactcttaaaagtgttctggtttgactaacacattttattgtcttgatatatataaagagagatgacacgaa

SEQ ID NO: 164556 - DNA, 601 bp, Human
tgagagggtggcttctattttccatgtgaattagagaggcttgcacatctgctacagggctcaagaaacaatggacttttaagaaatatggtagaactgccataaagcatgaaagatacagctgacatcaaataccataaagttctaaagttgtcccattctgcagggtgatatttacttttcttagcagttcccagaaaattggagcaagtgtggaggacgggggcagttagattcatcatgaaaaaagattttgttttttggatccctttgcaaacaacagaacaaggacatggagaaygctggcaagcatgatggacaagaaagaaagaagtgaagatgaaagggaatgaataggtaggaggaatgaagaaaatctgagataaagattccagttcactgccctggacccgtagttgagaacaacaaattttctagtttgggtgattggtactataattatttttaaattatatgtaagtgaccagtttccttgggatggtctttgtttatgccttttttgttatcatgattagtaagccatcccctttgactcttaaaagtgttctggtttgactaacacattttattgtcttgatat

SEQ ID NO: 164557 - DNA, 601 bp, Human
gccatggcactccagcctgggcgacagagagagattccgtctcaaaaaagaaaaaaaaagaaaaataaccagagtgggagaggttgataatacaagagagaatagatctaataaatagagatttatccaagaaaactggaggaaatgagatccagagctcgggggcaacatccacactgggctcttcgaggtaaaggagatttaaaaaaatattattctacaaaaaggaaaaaagagataatgcattgggggtacagaccagaggctagttttaggcaagacagtgagagggtggcttctrttttccatgtgaattagagaggcttgcacatctgctacagggctcaagaaacaatggacttttaagaaatatggtagaactgccataaagcatgaaagatacagctgacatcaaataccataaagttctaaagttgtcccattctgcagggtgatatttacttttcttagcagttcccagaaaattggagcaagtgtggaggacgggggcagttagattcatcatgaaaaaagattttgttttttggatccctttgcaaacaacagaacaaggacatggagaacgctggcaagcatgatg

SEQ ID NO: 164558 - DNA, 601 bp, Human
tgctatttactaaactagataaaattggggtggttcaaattcagaagaaagaaaaagacttcattatggacttgtggaatttgacaggtttgtgagatgtgctagtgcaggtggtttagacactcactggatagatctaaagatgtgggagtcgccagcacatagctgagtgcagtgtgatgcatggacgtagatggaagtgcacagggagaatatgtagggtggggacaagcatcttgggcagaagccattgaaatacaaacagccaagaggccggtagacttctctttagaagcctgaratggagactgagatagattaaccatagaagcctgaaatctaggaaagaatgacgccacaaagcccaaggtagagattgttgtgaagggaacatggtcaccagtattaaaatgccacaaaaaaagcactgaaaaaaagtaattgttgaccttgctgaggagcatttcaatggagtagctgtgggagaaagctcattacagtaagttgaggagaggatgggggtgaggggatagacagtgaacataggtagttcaggaaaaaaaaaagtggctctcatgaaaaggagaaagattgacagaag

SEQ ID NO: 164559 - DNA, 601 bp, Human
gaatcctgtcagctagtatattgggtaattttatttaattaatttatttattttacaaaatttccatttttattttagattcagggagtgcatgtgctggtttgttgcaagggtatgctgcatgatgctgaggtttgggcttctattgatcccatcacccagagagtgaacatactgtattgggtaagtttagatgaggctgctttccagctaagagctcaagccaggtcactaagaaccttgcaaatcacttaaaataatttggacctaattgtcacagcaatgaaaagacattgaagcrctttaagtggggagatattttcatatttacactttagaacagtgactctagcttcagtgtgagggaataaattagaaagtaacaagatgggagacatagagactgatgggtgaggtttgcaggaattcagtaagagaggatgataaggaaggtcaggatttatgctaatggagagagatatttatgagacagaatccataggatgactcctatgttcctgtttttgaaaacggagtggagagaaaatggtgctatttactaaactagataaaattggggtggttcaaattcagaagaaag

SEQ ID NO: 164560 - DNA, 601 bp, Human
taatatttacatctcctattggtctatttctattttctgttttactatcttggctttttcggtcattgaatcctgtcagctagtatattgggtaattttatttaattaatttatttattttacaaaatttccatttttattttagattcagggagtgcatgtgctggtttgttgcaagggtatgctgcatgatgctgaggtttgggcttctattgatcccatcacccagagagtgaacatactgtattgggtaagtttagatgaggctgctttccagctaagagctcaagccaggtcactwagaaccttgcaaatcacttaaaataatttggacctaattgtcacagcaatgaaaagacattgaagcactttaagtggggagatattttcatatttacactttagaacagtgactctagcttcagtgtgagggaataaattagaaagtaacaagatgggagacatagagactgatgggtgaggtttgcaggaattcagtaagagaggatgataaggaaggtcaggatttatgctaatggagagagatatttatgagacagaatccataggatgactcctatgttcctgtttttgaaaacgg

SEQ ID NO: 164561 - DNA, 601 bp, Human
attgcctattttcatattgggcaaatgttctttttacacagtaaataaaaggcaaaatgctctcctaaaaataatctaatttcttaagcatattaatcacataaagcctatgtctgaaaagcctaatatttacatctcctattggtctatttctattttctgttttactatcttggctttttcggtcattgaatcctgtcagctagtatattgggtaattttatttaattaatttatttattttacaaaatttccatttttattttagattcagggagtgcatgtgctggtttgttgcaagggtatgctgcatgatgctgaggtttgggcttctattgatcccatcacccagagagtgaacatactgtattgggtaagtttagatgaggctgctttccagctaagagctcaagccaggtcactaagaaccttgcaaatcacttaaaataatttggacctaattgtcacagcaatgaaaagacattgaagcactttaagtggggagatattttcatatttacactttagaacagtgactctagcttcagtgtgagggaataaattagaaagtaacaagatgggagacatagagactgatggg

SEQ ID NO: 164562 - DNA, 601 bp, Human
cagacctcccaaagtgctgggattacaggcgtgagccaccgtgctcagcccagtttatctttctagccatgtatttctctaaactcacagagatatctggaattcaactaactaaatgtgtaagtagtgtgcttgtatttttctgtattgcctattttcatattgggcaaatgttctttttacacagtaaataaaaggcaaaatgctctcctaaaaataatctaatttcttaagcatattaatcacataaagcctatgtctgaaaagcctaatatttacatctcctattggtctatttctrttttctgttttactatcttggctttttcggtcattgaatcctgtcagctagtatattgggtaattttatttaattaatttatttattttacaaaatttccatttttattttagattcagggagtgcatgtgctggtttgttgcaagggtatgctgcatgatgctgaggtttgggcttctattgatcccatcacccagagagtgaacatactgtattgggtaagtttagatgaggctgctttccagctaagagctcaagccaggtcactaagaaccttgcaaatcacttaaaataatttgg

SEQ ID NO: 164563 - DNA, 601 bp, Human
ccagacctcccaaagtgctgggattacaggcgtgagccaccgtgctcagcccagtttatctttctagccatgtatttctctaaactcacagagatatctggaattcaactaactaaatgtgtaagtagtgtgcttgtatttttctgtattgcctattttcatattgggcaaatgttctttttacacagtaaataaaaggcaaaatgctctcctaaaaataatctaatttcttaagcatattaatcacataaagcctatgtctgaaaagcctaatatttacatctcctattggtctatttcyattttctgttttactatcttggctttttcggtcattgaatcctgtcagctagtatattgggtaattttatttaattaatttatttattttacaaaatttccatttttattttagattcagggagtgcatgtgctggtttgttgcaagggtatgctgcatgatgctgaggtttgggcttctattgatcccatcacccagagagtgaacatactgtattgggtaagtttagatgaggctgctttccagctaagagctcaagccaggtcactaagaaccttgcaaatcacttaaaataatttg

SEQ ID NO: 164564 - DNA, 601 bp, Human
atcgaggcaataccatcctggaaacaggaacaggcaaagatatcatgacaaagacaccaaaagcaatcacgacaagagcaaaatttgacaaatgggatccaattaaacttaagagcttctgcacagcaaaataaactgtgaacagagtaaacaacctgcagaatgggagaaaatgtttgcaaactatacatctgtaagaacttaagcaaatttacaggagaaaaaggagaataacaaccaatcccatttaaaagtgggcaaaggacgtcaacagaattttccgaagaaggcatacatgcarccaacaagcatatgttataaaagctcaatatcactggtcattacagaaatgcaaatcaaaactacaatgagacaccatctcacacagtcagaatggctataattaagaagtcagaaaataacagatgctggtgtggttgtggaggaaagcgaacacttatacattgttggagggaatgtaagttagttcaaacattgcggaaagcagtatggtgactcctcagagagctaaagcagaactaccattccacccagcaatcccagtactggggatatactcagaggaatataaatcattcta

SEQ ID NO: 164565 - DNA, 601 bp, Human
aagactccctatacaataagtggtgctgggattattggctagcgatatgcagaagattgaagctggatctcttccttaagccatatacaaaaatcaactcaagattaattaaaaacttaaatgtaaaactaaaaactgtaaaaaccctggaagataatcgaggcaataccatcctggaaacaggaacaggcaaagatatcatgacaaagacaccaaaagcaatcacgacaagagcaaaatttgacaaatgggatccaattaaacttaagagcttctgcacagcaaaataaactgtgaacakagtaaacaacctgcagaatgggagaaaatgtttgcaaactatacatctgtaagaacttaagcaaatttacaggagaaaaaggagaataacaaccaatcccatttaaaagtgggcaaaggacgtcaacagaattttccgaagaaggcatacatgcagccaacaagcatatgttataaaagctcaatatcactggtcattacagaaatgcaaatcaaaactacaatgagacaccatctcacacagtcagaatggctataattaagaagtcagaaaataacagatgctggtgtggttgtggag

SEQ ID NO: 164566 - DNA, 601 bp, Human
gggaaaagactccctatacaataagtggtgctgggattattggctagcgatatgcagaagattgaagctggatctcttccttaagccatatacaaaaatcaactcaagattaattaaaaacttaaatgtaaaactaaaaactgtaaaaaccctggaagataatcgaggcaataccatcctggaaacaggaacaggcaaagatatcatgacaaagacaccaaaagcaatcacgacaagagcaaaatttgacaaatgggatccaattaaacttaagagcttctgcacagcaaaataaactgtraacagagtaaacaacctgcagaatgggagaaaatgtttgcaaactatacatctgtaagaacttaagcaaatttacaggagaaaaaggagaataacaaccaatcccatttaaaagtgggcaaaggacgtcaacagaattttccgaagaaggcatacatgcagccaacaagcatatgttataaaagctcaatatcactggtcattacagaaatgcaaatcaaaactacaatgagacaccatctcacacagtcagaatggctataattaagaagtcagaaaataacagatgctggtgtggttg

SEQ ID NO: 164567 - DNA, 601 bp, Human
cccaaacaagaccactcacctatgaccgtctgatctttgacaaaactgataaaaacaagcaatggggaaaagactccctatacaataagtggtgctgggattattggctagcgatatgcagaagattgaagctggatctcttccttaagccatatacaaaaatcaactcaagattaattaaaaacttaaatgtaaaactaaaaactgtaaaaaccctggaagataatcgaggcaataccatcctggaaacaggaacaggcaaagatatcatgacaaagacaccaaaagcaatcacgacaaragcaaaatttgacaaatgggatccaattaaacttaagagcttctgcacagcaaaataaactgtgaacagagtaaacaacctgcagaatgggagaaaatgtttgcaaactatacatctgtaagaacttaagcaaatttacaggagaaaaaggagaataacaaccaatcccatttaaaagtgggcaaaggacgtcaacagaattttccgaagaaggcatacatgcagccaacaagcatatgttataaaagctcaatatcactggtcattacagaaatgcaaatcaaaactacaatgagacac

SEQ ID NO: 164568 - DNA, 601 bp, Human
gactgctaactagggtaataaagaagaaaagagagaatatccaaataaacatgattagaaatgacaaagaggatgttaccactgaccccacagaaatattaataaaaacaaccatcagaaactactatgaacacctctatgcacacaaactagaaaacctagaaaagatggataaatttctggaaacatgcaccctcctagaactaaacctggaataaactgattccctgaaaaagaccaaaaataagctctaaaattgaatcagtaataaatagcctaccaatcgaaaaaaaaaaaaaamaaaagcccagggccaaatgaattcacagtgaaattccaccagttgtacaagaaagagcttgtaccattccaaaaaatcaagaaggagggactcctccccaactcattctatgaggccagcatcatcctgataccaaaatatgacagacacaacaacaacatcaaaaaacttcaagccaatatccttggtgaacattgatgcaaaaatccctaacaaaatacttgaaaactgaatctagcagcacatgaagagctaatccatcatgttcaagtaggctttatacccacgatttaaggctgg

SEQ ID NO: 164569 - DNA, 601 bp, Human
ttaataagatcgaaagactgctaactagggtaataaagaagaaaagagagaatatccaaataaacatgattagaaatgacaaagaggatgttaccactgaccccacagaaatattaataaaaacaaccatcagaaactactatgaacacctctatgcacacaaactagaaaacctagaaaagatggataaatttctggaaacatgcaccctcctagaactaaacctggaataaactgattccctgaaaaagaccaaaaataagctctaaaattgaatcagtaataaatagcctaccaatcraaaaaaaaaaaaaacaaaagcccagggccaaatgaattcacagtgaaattccaccagttgtacaagaaagagcttgtaccattccaaaaaatcaagaaggagggactcctccccaactcattctatgaggccagcatcatcctgataccaaaatatgacagacacaacaacaacatcaaaaaacttcaagccaatatccttggtgaacattgatgcaaaaatccctaacaaaatacttgaaaactgaatctagcagcacatgaagagctaatccatcatgttcaagtaggctttataccc

SEQ ID NO: 164570 - DNA, 601 bp, Human
aattaataagatcgaaagactgctaactagggtaataaagaagaaaagagagaatatccaaataaacatgattagaaatgacaaagaggatgttaccactgaccccacagaaatattaataaaaacaaccatcagaaactactatgaacacctctatgcacacaaactagaaaacctagaaaagatggataaatttctggaaacatgcaccctcctagaactaaacctggaataaactgattccctgaaaaagaccaaaaataagctctaaaattgaatcagtaataaatagcctaccaaycgaaaaaaaaaaaaaacaaaagcccagggccaaatgaattcacagtgaaattccaccagttgtacaagaaagagcttgtaccattccaaaaaatcaagaaggagggactcctccccaactcattctatgaggccagcatcatcctgataccaaaatatgacagacacaacaacaacatcaaaaaacttcaagccaatatccttggtgaacattgatgcaaaaatccctaacaaaatacttgaaaactgaatctagcagcacatgaagagctaatccatcatgttcaagtaggctttatac

SEQ ID NO: 164571 - DNA, 601 bp, Human
ttgcttggccaggcgcagtggctcacatctgtaatcccagcactttgggaggctgaggcagctggattacctgaggtcaggagtttaagaccagcctggccagcatggcaaaaccctgtctctgttaaaaatacaaaaattagctgggcatggtggcatgcacctgtaatcccagctactcaggaggctgaggcaggagaaccacttgaacctgggaggcggagatttcagtgagccgagatcgcaccattacactccagcctgggtgacaagagtgaaacgtcacaaaaaaaaaaaaaawaaaaaaagaaagaaagaaaattgctcaaaaccacggaattacatggaaattaaacaacgtgctcatgaatgacttttgggtaaataatgcataaggcagaaatcattaagttctttgaaactaataacaacaaagacataacataccagaatttctgggacacagctaaggcagtgttaagagggaaagtcatagcactaatttctcacatcaaaaagttggaaagatttcaaattaatgactaacatcacaactgaaagaattagggaagcaagaataaatcaaccccaaagctagcag

SEQ ID NO: 164572 - DNA, 601 bp, Human
agccaataattagacataaaacaatgctcagcaaatgcaaaagaagcaaaatcataccaaacacactctcagacgatattgcaataaataaagaagtcaagactaagaaaattgcttggccaggcgcagtggctcacatctgtaatcccagcactttgggaggctgaggcagctggattacctgaggtcaggagtttaagaccagcctggccagcatggcaaaaccctgtctctgttaaaaatacaaaaattagctgggcatggtggcatgcacctgtaatcccagctactcaggaggctraggcaggagaaccacttgaacctgggaggcggagatttcagtgagccgagatcgcaccattacactccagcctgggtgacaagagtgaaacgtcacaaaaaaaaaaaaaaaaaaaaaagaaagaaagaaaattgctcaaaaccacggaattacatggaaattaaacaacgtgctcatgaatgacttttgggtaaataatgcataaggcagaaatcattaagttctttgaaactaataacaacaaagacataacataccagaatttctgggacacagctaaggcagtgttaagagggaaag

SEQ ID NO: 164573 - DNA, 601 bp, Human
atggcaaggaaagactgctactagttaatacaaaagcacacttaaatatacaggcaagtgacactataaagcaaccacacaaacaagtcaggataataaccagctaacaacatgacaggatcaaatccacatatatcaatacaaaccttgaatgtaaatgggataaatttctcacttaaaaggcacagagtgacaaactagattaaaaagcaagactcaatggtatgctgccttcaagagagatacctcacacataacaacacccataagctcaaaataaagggatggaagaaaatctacwaagcaaatggaaaccagaaaaaagcaggagctgcaatcctaattttggaacaacagactttaaactaacaaagatcagaaactaacgaagaagggcattaaataataataaggtgttcaattcaccaagaagatctgactatcctaaatttatatgcacccaacataggagcacccagattcataaagcaaattcttagagacctgcaaagagacataagactccaacatagtaatagtgggacagttcaacattccactgacagtattagacagatcatcaaggcagaaaattaacaaa

SEQ ID NO: 164574 - DNA, 601 bp, Human
gagattatgtaaaaaaactaaatctacaaatcactggcattcctgaaagggatggggagaaagccaacaacttggaaagcagatttcaggatatcatcctagaatctagcaggagttctctgtatttcctgaacttgtctgttggcctctctggcaagttttgggaaaggcccagagaggccatagttgacttcaggaaatacagagaacccctgcaagtttctacacaaaaagaacatcctaaagacacatgatcatcagattttcgaagattaaaatgaaaaaaaaagaatgttaaagrcaactagagagaaagggcaggtcacctagaaaagggaagcccatcaaactaacagcagacctgtcagcagaaaccttacaagccaaaagagactggggggcctatatgcaacagtctcaaaaaaaaaaaaaaaatcttcaaccaagaattttatgtccagctgaactaagcttcctaagtgaagaagaaataagatctttttcagatatgcaaatgtttagggagttcgttaccaccagacctgtcttacaagagatcttgaaaggagcactaagtatggcaaggaaagactgctactag

SEQ ID NO: 164575 - DNA, 601 bp, Human
ctaccacacttgactaatttttgcatttttagtagagatggggttttgccatgttggccaggctggtcttgaactcttgacctcaagagatatgcctgcttcagcctttcaaagtgctgggattgcaggtgtgaaccaccatatctggcctccagcaattttcttatgccatgcctgggtgtgggtgttttactttttggtgtttatcctgttggggcattgcagtgcttcctgaatctgtgacttgttggacagccacagacattattgctaaaatattttttctgccccatttgcgttwactccatctgagatgcctatttctatatctcacatgtcttttactaccactgccccctgctcctggaagtttcatttttctctccaattttagcctggttacttttgtcagacctattttcgagtttactaatcatctcctcaatgtttctaaactttcctaaactcatgtactgagttttaattttagtcattacattgtttttagttctaggatttccatttgaatgtttttttgtagtttccagttcttttttaaaattctctactttaatatctaatttctgtgcttgcttgagta

SEQ ID NO: 164576 - DNA, 601 bp, Human
catcttcagggagctaggcacactgataatccctctaggcttgaagggtttggtctctcagagaaataaggccatgaagataagggttactcagaacatagtcaagccaacccactgatttttggcatttcttaaagtggaaagaaaaggaaattttccaactagctgattttcttactcgttagtctgtctagtgtcttttgtttctggaagctttcaatatgccctctttttttttcccccaacagttttcctttttttttgagacagtctcgccctgttgcccaggctggagtgcagyggagcaatttcaactcactgaagactccgcctcaacctcccaaatagctgggactacaggcatgcactaccacacttgactaatttttgcatttttagtagagatggggttttgccatgttggccaggctggtcttgaactcttgacctcaagagatatgcctgcttcagcctttcaaagtgctgggattgcaggtgtgaaccaccatatctggcctccagcaattttcttatgccatgcctgggtgtgggtgttttactttttggtgtttatcctgttggggcattgcagtgcttcctg

SEQ ID NO: 164577 - DNA, 601 bp, Human
aaactgaaacaattgttttatttaaaaactacaccttcacacctgtaatctcagcactgtgggaggccaaggtggttggatcatgaggtcaagagatggagaccatcctggccaacatggtgaaaacccgtctctactaaaaatacaaaaattagctgggcatggtggctcatgcctgtagtcccagttacttgggaggctgaggcaggagaatcactttaacccaggaggcggaggttacagtgagctgagattgcgccactgcactgtagcctgggtgacagagtgagactccatctcaaaaaaaaaaaaaaaaaaaagacaaccaccaccaccaccacaacaaaaattacatgtatctactctgatactgcatacaaataaagacttttctttttaaaagagaaaagaatggatttccaattattgccaatgtgtcatgcctgaaggacccttttcccacccatcagtttgaggtgacagttactggcttatagcaatatccatcatgattcaaaatttagaatattattatgcagaagtcacatactgttcacctctcatcctcaccatggacactgtcatctggtgcaggcaagga

SEQ ID NO: 164578 - DNA, 601 bp, Human
aaagaatttttgtttatgatgtgaggtagagtccaacttcattctatgtctgtgtctgtctacttctcccagcatctcagttttccactgagaagtctgctgccagacatactggagctccattgtatgttatttttttctttttcttttcctgctttgtaaggagtatactttcctcactgaattttcttggtactcttgtcaaaaatctgctatcgatttttaaaaactctttgcatattaaagatactgcttctttttctgtgacatatgttaaaaaatttccctgtattttgatttwtggtttttatgtctagaattaatgagaatttatgaaactaaatctatcagtgttttctttaatgaattcttctgccattattattataagaaatccacctatagttcccctagtagtagttcatgaaaataatataaatagctgccaattgttcattactttctatggtgctttacatatattatcttggcagtatcttggctacaaacactatgaggcaaatattgtcaaaaattctattttataatggataatgaaactcagggcttaagtaatttgcacaaggtgcagaactgatac

SEQ ID NO: 164579 - DNA, 601 bp, Human
ctaatgaggcctcatttattaatatcactttggttgcgtggcttttggtatcacatctaggaaaccactgcttaatcaaaggtcattaatatttacacctatgttgtcttcaaaagttttatagttttagttcttatatttagtcttcaaatctattttgaaagaatttttgtttatgatgtgaggtagagtccaacttcattctatgtctgtgtctgtctacttctcccagcatctcagttttccactgagaagtctgctgccagacatactggagctccattgtatgttatttttttctttttcttttcctgctttgtaaggagtatactttcctcactgaattttcttggtactcttgtcaaaaatctgctatcgatttttaaaaactctttgcatattaaagatactgcttctttttctgtgacatatgttaaaaaatttccctgtattttgatttttggtttttatgtctagaattaatgagaatttatgaaactaaatctatcagtgttttctttaatgaattcttctgccattattattataagaaatccacctatagttcccctagtagtagttcatgaaaataatataaata

SEQ ID NO: 164580 - DNA, 601 bp, Human
aaaaaaattttgtccatgctcatcagtcacttacatttctccttttgtgaattgccatattttaactgttgcctattagttgttactgagttttgaaacattaaaaaactaatgtaatttgtatatcataaaatgcactctttaagcatacagtgcagtggtttttagtacattcctcaagttgtgcaaccattaccactacctgtttccagaacatttccatcacccgtaaaagaaactgtgtacctatgagctgttattccctattccctcccccaccaggattcctggcaaacactartctactttctgtctctatggatgccattctaaatgattctaaatgattcaatgaattcaatgacttcaatgaatttaatgattcaatgaatattcaatgaatattctagatgattcaatgagtctattctagatgattcaacaaatcatctagaataggcaaattcatagagacagatgtattgactgatgtaaattgaatcatataatttgtggtccttttatgcctggcttctttcacttagcgtaatgttttcaatgttcattctgtagcaagtatcagtacttcattctttttatg

SEQ ID NO: 164581 - DNA, 601 bp, Human
aaaacatttcaagaaaagtagattacaaatcaattacccttcacaaacataaacgtaaaaattttaacaaaattttagcaaatctaatccaaaaagatataaaatggattaatacaaaatggggtttatcccagaaatttaaggttttctttatattagaaaatcaatgtaattcattatacatatatttttgaaatggagtctcactcttgtcacccaggctggggtgcagtggcgcaatctcggctcactgcaacttctgcctcctgggttcaaacaattctcctgcctcagcctcccragtagctgggattacaggcacatgccaccacgcccagctaatttttgtatttttagtagagatggggtttcgccatgttggccaggctggtctcgaactcctgacctcaggagatctacctgcctcggcctcccaaagtgctgggattacaggtgtgagccaccacacccagccataattcattacattaagagatagaaagacagacacaacaatcaatcgattgctcaacagataaaacagatagatcactaaatagatttatatatatatacatatttagtgtatctattttcctgt

SEQ ID NO: 164582 - DNA, 601 bp, Human
aaaaggttttatgaacaattctttgagaaatatgttggaatctagaataagtaagattggggtaatttatatgtggagatatgttaattctattttcacagatttcattgtaacatgctatggtttattaaatgggttttatatatttaaagagtcacatatttttcttttcagataaggcctttccatttttatctgctaatttatgaatttgcgcacccctgattttctcttccttagggaaaaaaatatctgacataatttcaatattgttaaagacattgaaaactatttatatggygattatatattcaggcatattattatgatcaattaccaaatctagtcctttaatactatcctgagtattttattaaaataagtcgcatatttttattagttttatatgaatgcatgtgttattttagagaaactagaaaaatgaagaaaagcaaaactatgaaaataaaaccacctaggacttctgtttctgatcaagatgaagtaagatgagcagtatttactcttctgtctcaaacaactaaaaagataatggacaaaatacagaaaaaaccagacactcaagatattggacatcagg

SEQ ID NO: 164583 - DNA, 601 bp, Human
gagattgttgaaagtgtaagatgttatttgaagtggcacagaattagctgtttggtcacgggagaaacatctgtaaatgggaactaaaaggttttatgaacaattctttgagaaatatgttggaatctagaataagtaagattggggtaatttatatgtggagatatgttaattctattttcacagatttcattgtaacatgctatggtttattaaatgggttttatatatttaaagagtcacatatttttcttttcagataaggcctttccatttttatctgctaatttatgaatttgcrcacccctgattttctcttccttagggaaaaaaatatctgacataatttcaatattgttaaagacattgaaaactatttatatggcgattatatattcaggcatattattatgatcaattaccaaatctagtcctttaatactatcctgagtattttattaaaataagtcgcatatttttattagttttatatgaatgcatgtgttattttagagaaactagaaaaatgaagaaaagcaaaactatgaaaataaaaccacctaggacttctgtttctgatcaagatgaagtaagatgagca

SEQ ID NO: 164584 - DNA, 601 bp, Human
acagtgattttactatagaaggttgtgtgtgtgtgcatgcacctataaaagtaaacaaatcagatagtttacacacacatgccccaaattaatggctaattctaaacccaaatatataaacttaaaattttttcattggatttatatagaatttttccttctgaagggtcagagataggaaattgtatatgaacaaacaaaatatctcattgctattcattctttcttagcttcaaagctaaagagctaatgttattttacatttacagtattattagtgcactgctttcttcaaagagcyattttctggaagaccacccagaagtttcaactaattgaggaggcaatcttcagtttacttaaataggaaggctacgtgggacacattcctggcatcagtactcctctgtcatatctgtttgtgctggatataatgcaaaggacaatgttaaattctgaaaataccctagactgtttccccccatcaaacaaccaaagcaaaaaatagttaatttctgatacctttttcagaaagattgttttataatctgggctttgaaaattccaggaaaaatgagccacccaaggcgatcataaaagc

SEQ ID NO: 164585 - DNA, 601 bp, Human
tttagacttgacagtgaaatcaaatgtgcagaataggctaaataatggccaattttctcagaaagggagagatttttttatttactacatacccccagttatttaaaatttattatacagtgattttactatagaaggttgtgtgtgtgtgcatgcacctataaaagtaaacaaatcagatagtttacacacacatgccccaaattaatggctaattctaaacccaaatatataaacttaaaattttttcattggatttatatagaatttttccttctgaagggtcagagataggaaattktatatgaacaaacaaaatatctcattgctattcattctttcttagcttcaaagctaaagagctaatgttattttacatttacagtattattagtgcactgctttcttcaaagagctattttctggaagaccacccagaagtttcaactaattgaggaggcaatcttcagtttacttaaataggaaggctacgtgggacacattcctggcatcagtactcctctgtcatatctgtttgtgctggatataatgcaaaggacaatgttaaattctgaaaataccctagactgtttccccccat

SEQ ID NO: 164586 - DNA, 601 bp, Human
ggggcaggctgcagtggaatgataatatcaagggcacatatggggtgattttagacttgacagtgaaatcaaatgtgcagaataggctaaataatggccaattttctcagaaagggagagatttttttatttactacatacccccagttatttaaaatttattatacagtgattttactatagaaggttgtgtgtgtgtgcatgcacctataaaagtaaacaaatcagatagtttacacacacatgccccaaattaatggctaattctaaacccaaatatataaacttaaaattttttcaytggatttatatagaatttttccttctgaagggtcagagataggaaattgtatatgaacaaacaaaatatctcattgctattcattctttcttagcttcaaagctaaagagctaatgttattttacatttacagtattattagtgcactgctttcttcaaagagctattttctggaagaccacccagaagtttcaactaattgaggaggcaatcttcagtttacttaaataggaaggctacgtgggacacattcctggcatcagtactcctctgtcatatctgtttgtgctggatataatg

SEQ ID NO: 164587 - DNA, 601 bp, Human
aactacaacttttttttcactccccagacaagaagaatacaagggaaaaaggagtctctggaagggaattagagtgcccacaaaaccaacttcaataacttcactattttgcctggggcaggctgcagtggaatgataatatcaagggcacatatggggtgattttagacttgacagtgaaatcaaatgtgcagaataggctaaataatggccaattttctcagaaagggagagatttttttatttactacatacccccagttatttaaaatttattatacagtgattttactatagaagkttgtgtgtgtgtgcatgcacctataaaagtaaacaaatcagatagtttacacacacatgccccaaattaatggctaattctaaacccaaatatataaacttaaaattttttcattggatttatatagaatttttccttctgaagggtcagagataggaaattgtatatgaacaaacaaaatatctcattgctattcattctttcttagcttcaaagctaaagagctaatgttattttacatttacagtattattagtgcactgctttcttcaaagagctattttctggaagaccacccag

SEQ ID NO: 164588 - DNA, 601 bp, Human
aggtcacttaaatttcagggagttcaagagcaggataaggtttatttcctctacatctggaagggtgtgttgtttctccattcctgaatttcaaggaaagaatttttattctgtaaaaatgccattgctaaaaataaacaacaataacagaagttaataggtggaactggctgtttggaagtgaaggtgacaggtattttggaatataaaacaaaaggaaatgcactcaaaaattacgaaatatgtaaaacaaaactgatataaggaagagcaagtggtatttataaagcaaacctctccycaaaatccacaggaaatcaggaaaagaaaatgattcatttaatttcagtgctggtgtagtcaaaatcaatttttaaaaactgcaaaaaatggcaaattttctctcagtatatagtgaatggcctaaggaaacatctgccgttcctctcatggaggagaatacagtagtcttcagttacgaacctcttgaccacaatttgcattttctagtgatagtttaggaaggtcttttcaaaataagcctctcagcaagagcataaatttctgttcaggcatatgcataaacaatataaatagctac

SEQ ID NO: 164589 - DNA, 601 bp, Human
cacaaacacacacacatatctcatccccttcactgtatagcccccagcacctgccgcccacctgccgttttggaggcagcaagtgaatttagaaaagttctctaaatctgcactgctgggccaatgggtgggagtagacagtacagcaggtggggtgcaaagtgacagaaaacaaaagaaggtcacttaaatttcagggagttcaagagcaggataaggtttatttcctctacatctggaagggtgtgttgtttctccattcctgaatttcaaggaaagaatttttattctgtaaaaatgycattgctaaaaataaacaacaataacagaagttaataggtggaactggctgtttggaagtgaaggtgacaggtattttggaatataaaacaaaaggaaatgcactcaaaaattacgaaatatgtaaaacaaaactgatataaggaagagcaagtggtatttataaagcaaacctctcctcaaaatccacaggaaatcaggaaaagaaaatgattcatttaatttcagtgctggtgtagtcaaaatcaatttttaaaaactgcaaaaaatggcaaattttctctcagtatatagtgaatgg

SEQ ID NO: 164590 - DNA, 601 bp, Human
aaaaggtagaagagggaacaagaccagcctgtcaaatagaatcagttctagtgaggctttctgaattctgcttgtcctttcttgccaggcttatggaaacttcctttggtttggctgagagacaaagttagtgaaatccacatatgttcattcttatcttagttggcaatagtgatagcaacaataaagtaagaaggatcaatgtcgctaaacttcagatagtatgttttagtgatgaattaattcagagacagccatgccaccttttcattctgctaatgctgactaaaattgtaatacwtcaaattcaacacaaacacacacacatatctcatccccttcactgtatagcccccagcacctgccgcccacctgccgttttggaggcagcaagtgaatttagaaaagttctctaaatctgcactgctgggccaatgggtgggagtagacagtacagcaggtggggtgcaaagtgacagaaaacaaaagaaggtcacttaaatttcagggagttcaagagcaggataaggtttatttcctctacatctggaagggtgtgttgtttctccattcctgaatttcaaggaaagaatttttattc

SEQ ID NO: 164591 - DNA, 601 bp, Human
acaaaagtgtaaacttcctgaggacaaggaccatattttattagtctttatactcctggatttattggtccttctaatcttgagttttcgtgagtgttcaatgaatgaataaggagattggcgtttctgtagttctaaacatagctgtatatgagagtgaactagaggtaactggagttgtctgaagtagttactaagggaactcagttactccattattggagttgattggtgtgaccttttctctcttgtcggtgcctcaatctgaacttgtcaagggcaaatcttccaaatatgtgcygcttatttgaagagaataacgtactctgatagaaaaggaccatttttggccaagagcatatgactatctatactttcttgcaagtatttccacacaagttctcgaagtccatttgtaggagaacataaagcatatgtgcttttgattttcaccgtcatttcctgctaaatttctctaccctggcacactggagattatttgaaattgtactatcaccaatgacggagccaaaacaacaattagagatataaaatgtagccaaaaaaaaaaaaaaaaaaaaaggaaatgtcaagacttgag

SEQ ID NO: 164592 - DNA, 601 bp, Human
tcattgtctgcatgtgtaactactagaatgcaagctccaggagggtagaaactatgtttactactatgtcctctgacacactgtagaagctcagggatgctatgtatgcctctgtggctttgcactgcacactgcaggataaatggaagcctccagaattgcacagtatacaacctgcacaaccgtatgctgcagacttctagatattgttcagtacacaacctgtaaaactatatgctgcaaacttctagatattagacatcacacacacacacacaactcattgaataaatcatcacatttcatacaactgtaaaaaaatcatttgattctcaaactattaatgaagcatctaaaacattttgaccccgtgctaatgttacaaaagtgtaaacttcctgaggacaaggaccatattttattagtctttatactcctggatttattggtccttctaatcttgagttttcgtgagtgttcaatgaatgaataaggagattggcgtttctgtagttctaaacatagctgtatatgagagtgaactagaggtaactggagttgtctgaagtagttactaagggaactcagttactccattatt

SEQ ID NO: 164593 - DNA, 601 bp, Human
aaatataaagatttcaaaatacaatgggttagcctttagctattggattctcactcattctttagtaagggcagattaacatagctattgttataaattcagtgatcagtgtaatcatttctacatttaatattaatacattttcataattggttatatcaaaagattgtcaagccacatactttaaaatggtactggaaaaatggcatgggatttgatagcagaatccagctcattgtctgcatgtgtaactactagaatgcaagctccaggagggtagaaactatgtttactactatgycctctgacacactgtagaagctcagggatgctatgtatgcctctgtggctttgcactgcacactgcaggataaatggaagcctccagaattgcacagtatacaacctgcacaaccgtatgctgcagacttctagatattgttcagtacacaacctgtaaaactatatgctgcaaacttctagatattagacatcacacacacacacacaactcattgaataaatcatcacatttcatacaactgtaaaaaaatcatttgattctcaaactattaatgaagcatctaaaacattttgaccc

SEQ ID NO: 164594 - DNA, 601 bp, Human
aagcaggtaccctcaagataggctgggaagcaatataaaagaacagggtggcaagtgcatataggcatactcaggatactattggaaaaagaagaggggcactccagcatgcagtcggaatggtgcccactaaaactgtgcagagtggcaggcttggcaggcacctaacccagcctggctggcaggatatagaaacggtttcagaaaggtgatcgttcagctgggctgaaagacaaacaggagatagagaagaggggaaaggatattgctgcttaatcatatgaactgtgagggagcttgrcctgcttgtgtgactacatggagctcgtgtagttggagagtggggtgatcatagtagagtggctggaggtgagattggacagggagtcaggggcaagacaaaaaggccttgaacataaaattaatgagaacttttcctagtgcaatcaggcattccaaccagtgccacatcactgcaggttacttactttatctttacatacctcataagaagatataactgtgtacaaagtacacagtacaaagagggatcttctcaatctgacatgcatactctgtttactagggaagatgcatgtag

SEQ ID NO: 164595 - DNA, 601 bp, Human
ttcattaacgttggatctaaaaatacaaccgcaaaacatctacatgacagctttggtgccatcacaaatatgtaaaaagttttctacatattgcaaaaacactaagctcaccactgcatcccatgtgtcattctaaagtagttaatgaacaacaagaatcaggcaactcacacatattttaaaaagtcaccagactctgagaaggcataggaagatttttaaatatgtgtcaattctgattttgtactacatacaatgaaaagttttatgatcatcgatttactgtggtacctagttataytaagtcataataaaaataaaaataatatattaatggtttttagcagcagaaacttctgttctctccaatgcacttcatgcagtcaatcctcatctccgttggctgagtcttttcaggtatcttccaagatccttacgaaagtttactatttgtccccatcctacgtcaaaacatgacctcatcagaattcagttcattggtatataagtaacaaagtgtgttccagccaaaagggctgtgtctacacagctcaaaaaagggaaaatacaatatcttccaattaatttagcaaatattgac

SEQ ID NO: 164596 - DNA, 601 bp, Human
atacatcatttgaaatatatagaataactctcctcttcatattataatgtacaaacaaaattaagaatttttaggaaattcagaattggtcaggcgtggtggaggaaatttagaatttagaatttttaggactgcttttaaatgtaggttatataaaaatgagtttagactcttgtgctcatatgcacacaactaaatgaatacaaacctcctagttacaggttttataatttgaaacaagagtttttaaaataagatttctagcactagggtttatatgggtaggaaattgatcattacrtcagtttcaactaaatgcatttgaaattgtttttaattgagccagcaaaacaatattttaagattccatttcattaaaattttaaatctctttaaaagttcaaaatttcaacagctgtcagttaaacatttcattaacgttggatctaaaaatacaaccgcaaaacatctacatgacagctttggtgccatcacaaatatgtaaaaagttttctacatattgcaaaaacactaagctcaccactgcatcccatgtgtcattctaaagtagttaatgaacaacaagaatcaggcaactcac

SEQ ID NO: 164597 - DNA, 601 bp, Human
ggaccacagccacctgccaccaaaccaggataattttttgactttttgtagagaggaggtctccctatttgcccacgctatacatcatttgaaatatatagaataactctcctcttcatattataatgtacaaacaaaattaagaatttttaggaaattcagaattggtcaggcgtggtggaggaaatttagaatttagaatttttaggactgcttttaaatgtaggttatataaaaatgagtttagactcttgtgctcatatgcacacaactaaatgaatacaaacctcctagttacagrttttataatttgaaacaagagtttttaaaataagatttctagcactagggtttatatgggtaggaaattgatcattacgtcagtttcaactaaatgcatttgaaattgtttttaattgagccagcaaaacaatattttaagattccatttcattaaaattttaaatctctttaaaagttcaaaatttcaacagctgtcagttaaacatttcattaacgttggatctaaaaatacaaccgcaaaacatctacatgacagctttggtgccatcacaaatatgtaaaaagttttctacatatt

SEQ ID NO: 164598 - DNA, 601 bp, Human
taaaattacttttttacatcattttattttaattaattaattaatgaattttttttttgagacaaggtctgtctgtcacaaaggctggagtgcagtggtgagatcacgtctcactgcaccctcaacctcctgggctcaagtgattcttccacctcggctcgccaagtagctgggaccacagccacctgccaccaaaccaggataattttttgactttttgtagagaggaggtctccctatttgcccacgctatacatcatttgaaatatatagaataactctcctcttcatattataatgyacaaacaaaattaagaatttttaggaaattcagaattggtcaggcgtggtggaggaaatttagaatttagaatttttaggactgcttttaaatgtaggttatataaaaatgagtttagactcttgtgctcatatgcacacaactaaatgaatacaaacctcctagttacaggttttataatttgaaacaagagtttttaaaataagatttctagcactagggtttatatgggtaggaaattgatcattacgtcagtttcaactaaatgcatttgaaattgtttttaattgagccagcaaa

SEQ ID NO: 164599 - DNA, 601 bp, Human
ttaaaattacttttttacatcattttattttaattaattaattaatgaattttttttttgagacaaggtctgtctgtcacaaaggctggagtgcagtggtgagatcacgtctcactgcaccctcaacctcctgggctcaagtgattcttccacctcggctcgccaagtagctgggaccacagccacctgccaccaaaccaggataattttttgactttttgtagagaggaggtctccctatttgcccacgctatacatcatttgaaatatatagaataactctcctcttcatattataatktacaaacaaaattaagaatttttaggaaattcagaattggtcaggcgtggtggaggaaatttagaatttagaatttttaggactgcttttaaatgtaggttatataaaaatgagtttagactcttgtgctcatatgcacacaactaaatgaatacaaacctcctagttacaggttttataatttgaaacaagagtttttaaaataagatttctagcactagggtttatatgggtaggaaattgatcattacgtcagtttcaactaaatgcatttgaaattgtttttaattgagccagcaa

SEQ ID NO: 164600 - DNA, 601 bp, Human
atcaagcacaaataaaaaatggacacaaacaaataaaacaactctcatttaaaattacttttttacatcattttattttaattaattaattaatgaattttttttttgagacaaggtctgtctgtcacaaaggctggagtgcagtggtgagatcacgtctcactgcaccctcaacctcctgggctcaagtgattcttccacctcggctcgccaagtagctgggaccacagccacctgccaccaaaccaggataattttttgactttttgtagagaggaggtctccctatttgcccacgctmtacatcatttgaaatatatagaataactctcctcttcatattataatgtacaaacaaaattaagaatttttaggaaattcagaattggtcaggcgtggtggaggaaatttagaatttagaatttttaggactgcttttaaatgtaggttatataaaaatgagtttagactcttgtgctcatatgcacacaactaaatgaatacaaacctcctagttacaggttttataatttgaaacaagagtttttaaaataagatttctagcactagggtttatatgggtaggaaattgatcattacg

SEQ ID NO: 164601 - DNA, 601 bp, Human
cttatcaagcacaaataaaaaatggacacaaacaaataaaacaactctcatttaaaattacttttttacatcattttattttaattaattaattaatgaattttttttttgagacaaggtctgtctgtcacaaaggctggagtgcagtggtgagatcacgtctcactgcaccctcaacctcctgggctcaagtgattcttccacctcggctcgccaagtagctgggaccacagccacctgccaccaaaccaggataattttttgactttttgtagagaggaggtctccctatttgcccacrctatacatcatttgaaatatatagaataactctcctcttcatattataatgtacaaacaaaattaagaatttttaggaaattcagaattggtcaggcgtggtggaggaaatttagaatttagaatttttaggactgcttttaaatgtaggttatataaaaatgagtttagactcttgtgctcatatgcacacaactaaatgaatacaaacctcctagttacaggttttataatttgaaacaagagtttttaaaataagatttctagcactagggtttatatgggtaggaaattgatcatt

SEQ ID NO: 164602 - DNA, 601 bp, Human
ggaacctaaacggaggcattttaaagccatcagaaggccccttgtaaccaattatgtataattttgtctgaaacattctaaaggaatgttctgggaattatcaacagcttagattgctatctcattgtttcttatcaagcacaaataaaaaatggacacaaacaaataaaacaactctcatttaaaattacttttttacatcattttattttaattaattaattaatgaattttttttttgagacaaggtctgtctgtcacaaaggctggagtgcagtggtgagatcacgtctcactgcamcctcaacctcctgggctcaagtgattcttccacctcggctcgccaagtagctgggaccacagccacctgccaccaaaccaggataattttttgactttttgtagagaggaggtctccctatttgcccacgctatacatcatttgaaatatatagaataactctcctcttcatattataatgtacaaacaaaattaagaatttttaggaaattcagaattggtcaggcgtggtggaggaaatttagaatttagaatttttaggactgcttttaaatgtaggttatataaaaatgagtttag

SEQ ID NO: 164603 - DNA, 601 bp, Human
aacagtaacatgtaaattggagctatcctggatagatggggaaatatggcaatgggtacaatggaggaaaggtagaatttagtttcatttctttatctaccactttttagctgtgtgacccatgaagaagtgattcaactgctttagggtcaagtattttttatctgtcaattaaaagagttgacgtcaaatgtccaagctccatgttagttgttattattatgatttaatgttttcttactggagatatcagatcgtctcttctacttatgttgcattttaggactgtcctcatcagcarataaattcatggatttttaaagggataatatcaataatgcttgtttaagtagcaattcaatttacttactgtttttggctgttgctctttgctagctctctctctcagacaatattgacagggtttgagacaaactcagcaacctttcacctaatcgaagtgcatttgctcaggctgctcactggccccttagaacctgctttaggtaatgcttgagatgggggttagacttctccaaaaccagctttttaagtggattctgcaatagttttgtttatttgttgattttctaaaacacat

SEQ ID NO: 164604 - DNA, 601 bp, Human
ctgtagatgtttctacaatttacttgtggcttcttttctaattaaagatctcagaaatctcaatcatgaatttgtaccatgcgtataaaacatgggaggctgaacttaggatcctcatgtctcagaacctgcattcttaaatttacgaaaaatttatattcctttttctcctcgatgttttgaaatcagtctatttctatcctgtttttcccctaacttttctattctctttctaacctttctctgttttactttcttgcttttgtttatccattcatcacctccaaatctttctgacccrctcttacataatttattcttttctcttttccctatatttcatatttattacattatatgatatttgacgtggtcataggattacttatcatcgaaccaggcacagagtaagcaggataactacttacaactatactaggaaaacagtaacatgtaaattggagctatcctggatagatggggaaatatggcaatgggtacaatggaggaaaggtagaatttagtttcatttctttatctaccactttttagctgtgtgacccatgaagaagtgattcaactgctttagggtcaagtattt

SEQ ID NO: 164605 - DNA, 601 bp, Human
tttttggagtatcacttagctgtagatgtttctacaatttacttgtggcttcttttctaattaaagatctcagaaatctcaatcatgaatttgtaccatgcgtataaaacatgggaggctgaacttaggatcctcatgtctcagaacctgcattcttaaatttacgaaaaatttatattcctttttctcctcgatgttttgaaatcagtctatttctatcctgtttttcccctaacttttctattctctttctaacctttctctgttttactttcttgcttttgtttatccattcatcacstccaaatctttctgacccgctcttacataatttattcttttctcttttccctatatttcatatttattacattatatgatatttgacgtggtcataggattacttatcatcgaaccaggcacagagtaagcaggataactacttacaactatactaggaaaacagtaacatgtaaattggagctatcctggatagatggggaaatatggcaatgggtacaatggaggaaaggtagaatttagtttcatttctttatctaccactttttagctgtgtgacccatgaagaagtgattcaact

SEQ ID NO: 164606 - DNA, 601 bp, Human
ctctgggtccactgctcttctctgaagccaatacgactgcccttatgggctcaattatcgatgggtggaaagtgggtagaaatgcattagaaaacaggaagaagatatgaggggattgtaagagaggtgaaataaagaggaagaaaaggccactcaaaaataagaggaagggcagtaaaaaagtagcaaatgaataataaatggtgaatatttggcatactgcttctaagtttaaagaaataaaatgtcaccacaaaatggatactgaactatagttctcagatccaagaatttcttaacrtggcttctctaagaacaatatttgttatggagtttaatatcaagtttttcttgcaaagatttggcagggtgtggagaaaaagatccagtggcagaaacagaaatgagcaagtcagccatagacttcccagttttttatgggagcaatatataccaacatatttgagtgatataaggacatatatttcagtttaatatttattaggcttgccaatgcctgcagttactgctaaaggaatctctaagaataccttagccacttacatacaaactgcttagatttagagcaaatcatttaaaa

SEQ ID NO: 164607 - DNA, 601 bp, Human
tggactttggatgatttcagcaggactggcagtgcaggtccctcaaagcatcactctgggtccactgctcttctctgaagccaatacgactgcccttatgggctcaattatcgatgggtggaaagtgggtagaaatgcattagaaaacaggaagaagatatgaggggattgtaagagaggtgaaataaagaggaagaaaaggccactcaaaaataagaggaagggcagtaaaaaagtagcaaatgaataataaatggtgaatatttggcatactgcttctaagtttaaagaaataaaatgycaccacaaaatggatactgaactatagttctcagatccaagaatttcttaacatggcttctctaagaacaatatttgttatggagtttaatatcaagtttttcttgcaaagatttggcagggtgtggagaaaaagatccagtggcagaaacagaaatgagcaagtcagccatagacttcccagttttttatgggagcaatatataccaacatatttgagtgatataaggacatatatttcagtttaatatttattaggcttgccaatgcctgcagttactgctaaaggaatctctaagaa

SEQ ID NO: 164608 - DNA, 601 bp, Human
agattctcatccacaaatggttaacaatttaaacaatatattttgtcattataaaagatgatttgccgtggtttattttctgtaaggttacgatagttgtcattttactgacggtctaggaaatatctaacactggctgtggactttggatgatttcagcaggactggcagtgcaggtccctcaaagcatcactctgggtccactgctcttctctgaagccaatacgactgcccttatgggctcaattatcgatgggtggaaagtgggtagaaatgcattagaaaacaggaagaagatatraggggattgtaagagaggtgaaataaagaggaagaaaaggccactcaaaaataagaggaagggcagtaaaaaagtagcaaatgaataataaatggtgaatatttggcatactgcttctaagtttaaagaaataaaatgtcaccacaaaatggatactgaactatagttctcagatccaagaatttcttaacatggcttctctaagaacaatatttgttatggagtttaatatcaagtttttcttgcaaagatttggcagggtgtggagaaaaagatccagtggcagaaacagaaatgagc

SEQ ID NO: 164609 - DNA, 601 bp, Human
cagaaagattctcatccacaaatggttaacaatttaaacaatatattttgtcattataaaagatgatttgccgtggtttattttctgtaaggttacgatagttgtcattttactgacggtctaggaaatatctaacactggctgtggactttggatgatttcagcaggactggcagtgcaggtccctcaaagcatcactctgggtccactgctcttctctgaagccaatacgactgcccttatgggctcaattatcgatgggtggaaagtgggtagaaatgcattagaaaacaggaagaasatatgaggggattgtaagagaggtgaaataaagaggaagaaaaggccactcaaaaataagaggaagggcagtaaaaaagtagcaaatgaataataaatggtgaatatttggcatactgcttctaagtttaaagaaataaaatgtcaccacaaaatggatactgaactatagttctcagatccaagaatttcttaacatggcttctctaagaacaatatttgttatggagtttaatatcaagtttttcttgcaaagatttggcagggtgtggagaaaaagatccagtggcagaaacagaaa

SEQ ID NO: 164610 - DNA, 601 bp, Human
cagcagcagcacttggaaactgttagagaatggaaattcttgggcccctgatacactgaatcagaaactctgggggatggggcccagccatcagtatttagcagtctccttccccctcagtgatcctgatgcatgctcaaatttgagacccactgggctaagtttttaagattactgggcgttcttcttctgggtgtgggtttgagcttctgagacttcccaattcttggaaataacaccatgcttacgttcatttttcctctctacttttcctcattttcctttttatctatagtttggttgtgtgtgtgtgtgtgtgtgtgtgtgtgttttaattaaaaatgttactttaaaacactggaaatgaatgcatataacatattagttattttctaaaaataataggcagatgggtattttccttttattttacaaactctttatattgttgctacatttataagaattaaggcgaaaaatatataatcagaaagattctcatccacaaatggttaacaatttaaacaatatattttgtcattataaaagatgatttgccgtggtttattttctgtaaggttacgatagttgtcattttact

SEQ ID NO: 164611 - DNA, 601 bp, Human
gcagcagcagcacttggaaactgttagagaatggaaattcttgggcccctgatacactgaatcagaaactctgggggatggggcccagccatcagtatttagcagtctccttccccctcagtgatcctgatgcatgctcaaatttgagacccactgggctaagtttttaagattactgggcgttcttcttctgggtgtgggtttgagcttctgagacttcccaattcttggaaataacaccatgcttacgttcatttttcctctctacttttcctcattttcctttttatctatagtttgtgtgtgtgtgtgtgtgtgtgtgtgtgtgtgttttaattaaaaatgttactttaaaacactggaaatgaatgcatataacatattagttattttctaaaaataataggcagatgggtattttccttttattttacaaactctttatattgttgctacatttataagaattaaggcgaaaaatatataatcagaaagattctcatccacaaatggttaacaatttaaacaatatattttgtcattataaaagatgatttgccgtggtttattttctgtaaggttacgatagttgtcattttac

SEQ ID NO: 164612 - DNA, 601 bp, Human
tgaaagttcaagctaccaagtcagctaaaaagcttttctgatgccatggactggatgtccagccaagaccttttcattgtggtgagctttcagtctggacatgggcagcctattgttcccttagcctgggcctgatcctttggcaacctgacaaactgagaaaaatcatagaccagaaggaagaaaagtgagctctattccaggtctcacaaccagtacaacaggtctcaatttcttcacctacaaaatagaaataatgacaatgtctccctggtttgaaagtattcttgaacaagtatasaaatcacaaacactaaggtattgttattaaattgggaaggactgcctcaaacttgattgatcgttatggataaatgtaagaaaaatagtgaatcaaggacatctccatctcagagacagataaatcctcccataaaactgctatttggaatgagttcaggagtcacttcccagcagcagcagcacttggaaactgttagagaatggaaattcttgggcccctgatacactgaatcagaaactctgggggatggggcccagccatcagtatttagcagtctccttccccctcagtgatcct

SEQ ID NO: 164613 - DNA, 601 bp, Human
acaaggtgctggtagtctgggcagtgttaccccagagacgcattcccaactaccattaccattgtcgtgggtcccctgacgagtgctgtcggctctctcttagccagtcttgcaactcctttaatgcttcatgcaagctggaattttccttgtcatattgcatagttctgtgaaagttcaagctaccaagtcagctaaaaagcttttctgatgccatggactggatgtccagccaagaccttttcattgtggtgagctttcagtctggacatgggcagcctattgttcccttagcctgggyctgatcctttggcaacctgacaaactgagaaaaatcatagaccagaaggaagaaaagtgagctctattccaggtctcacaaccagtacaacaggtctcaatttcttcacctacaaaatagaaataatgacaatgtctccctggtttgaaagtattcttgaacaagtatacaaatcacaaacactaaggtattgttattaaattgggaaggactgcctcaaacttgattgatcgttatggataaatgtaagaaaaatagtgaatcaaggacatctccatctcagagacagataaatcctcc

SEQ ID NO: 164614 - DNA, 601 bp, Human
taggtaatggggagatcaaaccaagtgaaaggcatgtgtgctacttcatgtgccttgagagctaacactacatatttcctgaactgccatttctcagaacaactcaattgaggtaagtatgttgttagacacattttacagctctagaagtggagtcttagggtggtgaggtacccagcatgtacaacaaggtgctggtagtctgggcagtgttaccccagagacgcattcccaactaccattaccattgtcgtgggtcccctgacgagtgctgtcggctctctcttagccagtcttgcamctcctttaatgcttcatgcaagctggaattttccttgtcatattgcatagttctgtgaaagttcaagctaccaagtcagctaaaaagcttttctgatgccatggactggatgtccagccaagaccttttcattgtggtgagctttcagtctggacatgggcagcctattgttcccttagcctgggcctgatcctttggcaacctgacaaactgagaaaaatcatagaccagaaggaagaaaagtgagctctattccaggtctcacaaccagtacaacaggtctcaatttcttcacctaca
